United States Patent 10,407,724 (METHODS AND COMPOSITIONS FOR SCREENING AND TREATING DEVELOPMENTAL DISORDERS) - sequence listing, part 60

SEQ ID NO: 1641 - DNA, 163190 bp, Homo sapiens
tttctttttaaatatacacatatattttattttaaaaagcacaagaacattatacaagttttaaatttacatttttgcaataaaagttatcaatatatgcattatttgtataacttcatcatggatggaatttgaatcagtggtataaacatgttgcagtcactaaatatagatcatcatcacagtgaaccaaaatgcatagttgttatgaaatgacaaatgaccactaaaaggtgaactcacagcccatacaccaatataataaattaattatacagatatatttttcttcaccatatcattaaaattctcactagccccttaccaaacattagaaaaacacagttctggagccatcctgttgaaccagtgccttcacatactacactaaagaaaataaagtgactcagttgcttgtttgtaagtaaacttcataagcataattgtttgcaatgattaaggtaaatcactaggacatttgaacataatgagaaatccctggggcttggggcagcactgagacatacgctcatctacagtgcaaaaatctgaatcaatctcaatcagtggaacgcaatatgaaatgggttctttggcagtaaaggtctggctggccattgccagacagtccctctgtcctcttgagagcctaactccagaatttattaagttaatataaaaaggactaaaaataaagtcagtttatctttgctaaattggggcccatctattagggtagaagtcagtatcttctgtttcctattctagcccagatttcccagtcaaacaatccactcaatacaattatataagaaacaaacacacatgttcaaatactttcatcattctggcaaatctgacaaactgaatactgaatttcctgatccttacctgttattgttacaaattgttcactagacatgtatctatttatccagataccttctgaattgtaattattcaagtagaaaatcatgattgtgattctgacgcctgctcatgccaatcccttactgcaaaatccacttttctttacataaaagtaccaaaaaaatctagccccaaatgtgcatcactaatcacttagcaaatatattttacttgcttgcctttgctgagcaaaaagaaggtaggaaaacatttacacacatatgtgagacactaatagccaagggcaaaataagatacagtctttgaatgcatctttcaaggttctaacattaccccagaaacaacgtaagttaaaatggaaggtttccatttatcttctgctgttttatatcacaatctcttgatacaaaaaacaaaagccaggaaccaagaagtctatgcacaaattcaggagagctctattatttataaacaagatggctcaaccacagcatgttataacaggacacagactattgatcacatggcttttttggtggtttgtactagtcataaaaccagagtttatgaaaaggttgcacacagacaacatcaaggatttgtcttttacaaagatatagaagactgcggaattggtttaaatctgattgttctaatttacagttgtcatgatccactcattgcgagaattttctcatcttcattctacagtttttacatcagaattacaagaggtttctgagagtcaaacaggatggtgccacaatctccttgcagaatgagatttgcctttggaaaatgtcaagtattatttcaaaactcaacaaagctactggtagtcagaggtgagaactgcaagctctttgtaccgtcaggaatgaataacaaatacattaccctaacttttcttgaggcctacagtgagaaaaaagcttttccatattggcagaaatcatcctctgtccacatagagattgagtttaatttgtggtgatagcagcaggtggcacattaggggtatttccttaaaagagaaataataaaaaatttatttttggaatctttcccaagtatattgcatggtttctgcaattcttctttaactgcaaggaagactatcacagattattagaattttgtcagtgatccaatgtcagttgaactaaacttggggggaaaacaccaaatacaaaattgcagaagagttaaccaacatataaaatgtctacaactgtttgacgtgacttcatctaccaagtggatgaaataaaatgaaatgagacaaattatgaaggggaataaattcctggaaatactagcacataaaacagattgatctatgtccttttttcctgtgaagcatatgtttgctaattgaaagcaatactccattaagaaatattttattgatgtaagtgaacctggacatggagcaaaagaccctccaatactttcccagccctcagaaagttttccataattttgaatcagcctttactactgtcgtcatttgtgattgtcttgaggcagagttggagctcacagtaactgccagttgaatccaaataacatctgattagtctcttggctcctagcaatctcttctataatgcagtgttgttgccagaccaaatggagcttccgataccgctcacgagataaatgaagggggttgcccctcctttagggaaaaaagaaaaaacaacatgtaagtttgaatctagtaactgccacatctttattgtctaaattagtatgcactcttgagatgttcctggagccgggaggactcaccagcacagggcttaaaaagggatattttcccttcaccattgatcactaagaacttgacaggctacttagctaataaagcagaaatgtactccttgaccattcataaaataggtcaggtatattatggcattatgggacctcacttaaatggtcactgaggtttataacttgaagcagcactattcttttttggtggttagcttgaatagctttttggcttcatattgttatctagcttcaatttatgatctttgcacagtagaggttaggcctgacgtataacactaggccctaaaattatattttgctactcagagatatttggttgtaactgtccttacgatacaaaaaactggctggttattagcaaataatttaataaaataattatacttcaattctagagttgcacagtttttaacactgtataacagctaatccaaaatgacttaagtctggctgttgccagtaacggagaactgtgagatcctaattccttgagacattcaagtctctcagctggttggggattttttttgtttttgtttttgttttttggagatggagtttcgctctttttgcccaggctggagtgccgtggtacgatcacggctcagggcaacctctgccttccagtttcaagcaattctcctgcctcagcctccagagtagctgggattacaggtgcccgccacgatacctggctaattgtttttgtatttttagtagagacggggtttcacaatgttggccaggctagtctcgaactcctgacctcgtgatccgcccgcctcggcctcccaaagtgctgggattacaggcgtgaaccaccgcggccgcctggttggggatttttaaactgccaaattaatgttaaaactctgctttgtacccttgtggaacaactaagattctcagtcattaactactttcaccactctgcttttctccctaaacctaaagacaggtcaaatgtcatcccaataaaaagaaagctctgtgtgatccaaggtcccaagccccatctaataagtgtattctttctgagcaatatttcaaaggaacaaaatttcagtgaaccaaaaagagtttattgtaaggaggtctaatctttatctatatgtacttttgagatcactgtcagtctcctcattttcataagtcatcagtaggaccccagttcctaccaccagggaaggatacagaaaagttcaggattctaaatattttgttaatgctcagaaggaaagaaggctgatatagctggctaataaaaagtctcagttgggtgcagtggctcatgcctgtaatcccagcactttgggagtccaaggtgggcagatcaactgaggtcaggagttcgagaccagtctggccaacacagtaaaaccccgtcactactaaaaatacaaaaaaaattagccgggtgtggtggtgcatgtctgtagtcccagctacttgggaggctgaggcaggagaatcgcttgaaccctggaggtagacgttgcagtgagccgagatccagcctgggtgacagagtgagagactgtctcaaaaaacaaagaaaaaaaaagtttcaagtattgcaatggaaacaatatctctaaaacaaacttcatcactggacactacaaacttatactatcagtgtcaatccttttaagtagttctgaagaaaggttgattacaaacaatagaacactgaaacattaagatggctggtgtctttaaaaattttggggaaacactaccttcaaattttggagaagttgttgaaaattatgtgctacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcaccagcattcttatacaccaataacagacaaacagagagccaaatcatgagtgaacttccattcacaattgcttcaaagagaataaaatacttaggaatccaacttacaagggacgtttaggacctcttcaaggagaactacaaaccactgctcaatgaaataaaagaggatacaaacaaatggaagaacattccacgctcatgggtaggaagaatcagtatcgtgaaaatggccatactgcccaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacgctacctgacttcaaaccatactacaaggctacagtaaccaaaacagcatggtactggtaccaaaacagagatatagatcaatggaacagaacagagccctcagaaataatgctgcatatctacatctgatctttgacaaacctgagaaaaacaagcaatggggaaaggattccctatttaataaatggtgctgggaaaactggctagccatatgtagaaagctgaaactggaccccttccttacaccttatacaaaaattaattcaagatggattaaagacttaaacgttagacctaaaaccataaaaaccctagaagaaaacctaggcattaccattcaggacataggcatgggcaaggacttcatgtctaaaaccccaaaagtaatggcaacaaaagccaaaattgacaaataggatctaattaaactaaagagcttctgcacatcaaaagaaactaccatcagagtgaacaggcaacctacaaaatgggagaaaattttcgcaacctactcatctgacaaagagctaatatccagaatccacaatgaactcaaacaaatttacaagaaacaaacaaacaaccccatcaaaaagtgggcaaaggacatgaacagacacttctcaaaagaagacatttatgcagccaaaaaacacatgaaaaaatactcaccatcactggccatcagagaaatgcaaatcaaaaccacaatgagataccacctcacactagttagaatggcaatcattaaaaagtcaggaaacaggtgctggagaggatgtggagaaataggaacacttttacactgttggtgggactgtaaactagttcaaccattgtggaagtcagtgtggcgattcctcaaggatctagaactagaaataccatttgacccagccatcccattactgggtatataaccaaaggactataaatcatgctgctataaagacacatgcacacgtatgtttattgcgggactattcacaatagcaaagacttggaaccaacccaaatgtccaacaacgatagactggattaagaaaatgtggcacatatacaccatggaatactatgcagccataaaaaaggatgagttcatgtcctttgtagggacatggatgaaattggaaatcatcattctcagtaaactattgcaaggacaaaaaaccaaacaccatatgttctcactcataggtgggaattgaacaatgagaacacatggacatagcaaggggaacatcacactctggggactgttgtggggtggggggaggggggagggatagcatttggagatatacctaatgctaaatgatgagttaatgggtgcagcacaccaacatggcacatgtatacatatgtaactaacctgcacattgtgcacatgtatcctaaaacttaaagtataataataataaaataaaataaaaaaaaaattatgtgctaaagaatgacatcatattttttaaatttgaagccatttaaaagatagctctcagccgggcatggtggctcatgcctgtaatcccagcactttgggaggctgaggtgggtagatcacttgaggtcaggaattccagaccagcctggccaagatggtgaaaccctgtctctactaaaaatacaaaaattagctgggcatagtggcacatgcctgtagtcccagctactcgggaggctgaggtgggagattcacttgaacccaggaggcagaggttgcagtgagctgagatagcgccactgcactgtagcctgggtgaaacagggagactctgtctcccaaaataaataaataaataaataataaaaataaaaagtagctctcaattacttttttttttttttagacagaatctccctctgttgcccaggctggagtgcagtgggcgatcttggctcactgcaacctcctgggttcaagtgattctcctacctcagcctcccaagtagctgcgattacaggcatgcaccaccatgcccagctaatttttgtatttttagtagcgacgggttttcaccatgttggccaggctggtctcaaactcctggccgcaaatgatctgcctgcttcggcctcccaaagtgctaggaatacaggtataagccacggtgtctggcctcaattaccttttgtgattaaagaactattaccgtttacatacaataatgtgactgaaatagaaaacaatcaacataaaagagaacttactgaaaccttcctattatataaaaaaaatcttacttcaggccagggtctgtttctccatattcatccaagtaaggagctggataggcacagcctctggctttaccttcaaccaggaccactcggcattctctgattctgaaagagaaaatcaataggaaatatggttaagtgtatgtgtgcaaatgataggcactgcatcaatgttaacctagagaaaagacgtggccaatatctgttagatattcagtaaaaagacaatataaacagacaaatagactaaattatgttttgtctaaataaaagagaacacttattgctatttctgttgaagctatagaaaaggagcagtggatttggtgaaatgagatcatttatactgacggaatctgttgaagggaggaaactgtcctacttcagccacagacaccttggaaaatggtggctggggttgtttctattctaattcctgacacaacctggagaggggagggaacctcacagaagaacagaatcacatctcctagtctgataacctcaagccagacagaatatcaactagggaagtatgccagcttttctggttagagctggcctgaaacactgcagattaaaagagccactaccaccctgaaggcacctgggacttttatgtctcttgggaaatagacataaaaaaggcttgcgtacacatatatgggggataagtactttacagataaattataaaataaacagctgggataaggtagtgggtttacttgctgtgggttccctaaaaataggtgtttgggtttggcttccatacattctttccccttggttcaaaagatgcctatgaacaatgattacatatttcacagttagaaagacatttggctttatgtaacagaaactgtgttacatgaggagagtggaaagaaaaaggatatatatccactttgaattttatttctctgcaggcaacttaaactcttttttcataaatataagtgactatttttcttttttttcccagatagagtcttgctctgtcaaccaggctggagtgcagtggtgtaatctcggcctactgcaacctccacctcccaggttcaagcgaattctcctgcctcaaccttctgagtagcttggattacaggcatgcgccaccacgcccagctaatgtttgtcttcttagcagagatggggtttcaccacgttggccaggctggtcttgaactcctgaccttgtgatctacctgcctcgggcctcccaaagtgttgggattaaaggcgagagccaccgcgcccggccataagtgactatttttctatcctcaatcttttgctgaaagaccaggagaaatggtgggttgatagatgaaataaagatatcacaggacaatctaaagtaaaaatttacatgtacttttttttttgatagaggatctcactctgttgcccaggctagaatgcaatggcacgatcatggccttgaactcccaggctcaagcagcccatccacctcagcctctcaagtagctgggactgcagccatgtgctaccatgcctggctaattttttatagagatgggggtctcgccttgctgcccaggctgatcttgaactcctgacctcaagtgatcctcttgcctcagcctcccaaagtgctgggattataggcataagtcactgtgcctggcctacatgtaccttttatttgtttatttttatttattttaaagagctcatcttccaggaagagtactttttaaatacaagttttaggacttgaagttctttcattacacctgagtattatataataccagagcaattaatacaaactctatcctatttaagattttccataaataatggaaatgtgaacagaaacttattcttttttcacagtatcttctcaaatgcaatttcatgtcaataacaggttaatactctaacttctgattgattatttgctatcaacacactgtcccaccatagtgacccccagattggatccagattccttaagttcatcatgaagcttccagaacactcactactcactttaggaaaatgcagactccggctccacagtgaagtgcgtgaaaaatgcaagctccaacctcttccccgttcacaatttcctggcagcaaatgttctgagaacatagtatagccccacagaaaaggcagaggacaggatgctttcgctcatcatctgcagaccgtgggcacctcaaaagagaagaaaacatttagagaatgatggaaaaacaaaacaaaacaaataagtaccatatatcctgttagcaatcaagcatgttttcatcactgacccctttccagcaaggaagctcttaaaacacaaggaaacatttaattagccaattcctctttaatatgccccctaaaagggcttcatggaaaatcttccaattaatccatagtaagaaaatctatattacataaatggtgtcctgataattctcataaagtatggtggttgaatatgccttgtgattgagattcactgatagactccagtcttcatctgacatgcccaatttacagttacctgcctcctctgtattgtgttagtcaagcttgtgtcttcgatgttgaaggaatatgaccttgtaagtatgcaattgtttaaaagaaaaaaaattaaaatttacagtaagggtccaaacacattccccccatttcttttcttttctttttttttttgagacagtcttgctctgtcacccaggctggagtgcaatggcatgatctcggctcactgcaacctcggcctccccggtccaagcaattctcctgcctcagcctcccgagtagctgggactgaaatgagagattgtagcctttgagttggcccagccttccatctgggaatcacagtaagtcttaggaaggaaaaagtgatagtgctgacttgcttgagtcaactagtgttttatgatgagaccattttacatagtatgctggaggcgtgctataatgccccaccaagggggataatggttatcttttaaaaaggagtttcccatgctcctcccatctatgctgtacactgaacacaatgggaaatatcaaattccttaatttgggaagtagaagataaatgcaaccgaaggagagatccaactaggcccacactggggtcggaataaagaagatcagaaagaatctccaatagggtactgacagccttttttctgatccccagtttctcagacaggataaaaaacaaaacaaaaaacacctgtctccataggagcagagggactctgcgcataggatgagaggactattttcacttccgggaggttgctccagaacataattatagccctttttggataaagccaacatcttctttcatctttaacacaggatggctgagtctgagtcattagacatcctacagaggaaaagctgggagggagcctaaagtatatgactgagcagccaccctccaacactagggatggttctgtcttatggaaattggtggtgacaataaaactggaagacatcataggattgattttcattcttatgtgaaatcataagtggtaatatcatccagaaggatcctcattgtgattaataaagaccaacactctccacagatcctccgaggagccaacaacttgatattctttttttttttttttttttgagacagggtctggctctgtcacccaggctgaagtccagtgtcacagtcacggctcactgctgcctcaacctcctcggctcaagtgatcttctctcctcagcatcccgagtagctgagactacaggcacatgccaccaagcctagctaattattttgtattttttgtagagacagggtctccccatgttgcctaggctggtcttgaactcctgagttcaagagattcacccacctcagcctcccaaagtgctggggttacagacatgagccactgtactcagccaacctggtattcttaatgcctggaagataatatctattcaccaggcttttgtggtagcaatgtagccccaagattaggaaaattactgaatttagagatggatgcaatctttgaaactaattagctaattgtttgagggctgaaaggtaaagtgacccaaccattcctttagatgattgactagaaagggagctagaacaggaaggtcaattttatactgtaacagtggctagggtgtgagctactgaagaccctattgggccagttaacttccccaacttcatggcttaaaacaatggttataactagataagagaatttcctgagtcattccgcagggcagtgattctcagagcgagtcaaagaggggctctttaagacctcaaatgatcttttattttttgagacagtcttactctgttgcccaggctgaagtgcagtggtgtgacctcagctcactgcaacctgtgcctgcacgttgaagtgactctcgtgcctcagcctcctgagtagctggaactacaggatgcgccaacatacctggctaattttttttgtatttttagtagagatagcattttgccatgttggccaggctggtctcaaactcttggcctttagtaatctgcccgccttggcttcccaaaatgttgggattacaggcataatccaccgcacctggcctcaaaataaccttaaaccggccaggtgcggtggctcacgtctgtaatcccagcactttgagaggctgaagtgggtggatcacgaggtcaggagttcaagatcagcctggccaagatagtgaaaccctgcctctactaaaaatacaaaaattagccaggagtggtggcgggtgcctgtaatcccagctactcggaaggctgaggcagagaattgcttgaacccaggaggcagaggctgcagtgaactgatatcgtgccactgcactccagcttgggcaacagagcgagactctgtctcaaaaacaaaacaaaacaaaacaaaaacaaatttaaactgcactccttttttttggttccttcaaatgacagcaagttatttcacatatgactgaggactactacatgaaagcagttaattatgactactaactgctatccttaaaacaaaatgtaagagttatgtgtatttactgagatcttgaattaatttaagtattttactaaaacgtctggctgctgcataatgcttagtaatattacaaaactcttaaaggagctttggaattcttgcaatttggaaaaaggatgattacttactagtaaatcaataaagtcttgaataggctttgtttttcaggctactgagattcttgtcttttaattacaagttactacttgttacatgtcatcattatcaatgtggtttgctatgggaggtgatatgatgcctcctgagtatccagaatacatagttacatcaacagaagttttggcttagtattttcaagacataatgcattatgattcaaatatgaagtattcaccccccaatggtgaaagcagatgtgaatataattcctccattcagtgacatctcactggtggtggtcatgattcatgctactcaaataacttacaacatattatagcaaggtaagcataataagatacaaaattatgtttaagctacaggacattattttatcatgtagacacatgtttaggcttatgctcttacagaagtaactaataggtaagtcacacacaatgttaaaaatgagtacctgtatattgttaacctattttgttttcaccagtctttgttatcatccagttctttttccacttgaaattatcagtgaaaggggtgaaagagataaaaaagtttgggaaccactgctttagagtggtttgattgaggtggggggatggtgccaaaaaagcctaagcgggtgtactccactcttcaagcttgaacctgagtcacgatgctattacctgttctgctgtttaatgggcttccatgtaagattttgtttaataacggttcttgtggcttaaaaaacaacaacaaaaaaagattaaggagtgatatcatagaaaatggtagctccagaaatcagtcactctaatgaaacaactgttgagccagcaagaactgcctgaggcaactttttttttcttttgagacatagtctcattcactctgtcacccaggctggagtgcagtggcacgatctcggctcactgcaacttctgcctcctgggttcaagtgattctcacgcctcagcctcccaagtagctgggattacaggtgcgcaccaccacacctggctaatttttgtatttttagcagaggcagaggcggagtttcaccatgttggccaggctggccttgaactcctgacctcaaattatccacccaccatggcctcccaaagtgctgggattacaggcatgagccactgtgcccagcctgaagcaactattttggaactctggagcctggtgaaatgcttgcagcatccaggggaatgcttaataaaggaagaagctggcattttgtgtagtggctagcatcctctattccccaatgtcatggcaggtagccatggggatgatggcttgtttttctggtgtggcttgcttgtgtcagggtaggcaatagagacgtcttccaaaaattgaggctgtatgtttagatctctctggtggttcactgaggggccagcaaggatgtgagaaaaaaggcgccctcacacattgctggttgggacataaaatggtgcaaccactgtggaaaacagtttgcagctcctcaaaaagttaaacacaaaattaccatatgactcagcaattccactcctgggcatacatccaaaagaaatgaaaactttatgtccacaaagaaacttgtagatgagtattttttttagtagcattatctgtaatagtcaaaagggggaaacaacctaaatgcccatctatggatgaaggaataaacaaactcttatatatacatacaatggaatattatttagtcaaaaaaggaaaaaagtaatgacatatgctacgactcggataaatattaaagacatgctaagtgaaagaagccaaacacaaaaggtcatatattgtatcattcctttcatataatatatccagaataggcaaatccatagagacagaaagtagattacagattaccatagggtacgggatgaggggaataagaagtgattagtgagtacaaggtgacgaaaaagtttgcaaactaaagaggtggtgattgtacaacattttgaatacattaaatgccactgaactgtacactttatcatggttcattgcatgttatgtggatttcccctcaacttaaaaaaaattgacaaccactgttatgaaggatactcagaggtcaccgctaaaaaaggaaatttgtggccaggtgcagtggctcatgcctgtaatcccaacattttgggaggccaatgggtaggaggatcacttgagcccaggagttcgagaccagcctgggcaacataacgaaaccttgtctctatgaaaaattaaaaaaattagcagggcatggtggcgcctgcctgtagtttcactacttgggagattgagatgggaagagcccaggagtttgaggctgcagtgagctatagtcaaatcactgcactccagcctgggcaacagagcaagatcctgtctaaaaaacaaacaaacaaaaacaaaaaaacccaaaccaaaacaaacaaaaaaacaaaaacaaggaagtgtgttagttatggcatataccaattgcgagttcagaaaatgatttaaaattacacacatatatatacacactctccttacctgaaatgagaagcttgattcaggaggcagctatagtcatcaggaagctctatcaaactatttctttttctagggtacctacaatgtaatttaaaaggcaattttattttagagtaaataaccccagatcaaaaactgcccaaagtgatagaagaatgtcttaaaaataacaaaaggatctacacttgcaatccaaagtaattcccactgttgacttgatcaaatccaaacttctcagcctataattccaaatctttcatcagctggattcctttccaaacttaacttcctctagtttctaggactaaactgttatagctagatttctgtactgtatagggaagtaacataaagtagtagttaagaacacagcctttgaaattagagctggttacaaatcctaaattctctgacacttcacaagtctttgaacctaagcctgtatttccctgtctgtaaactagggataaaatataccatactccaatcatggggccaccatcaaatcaggttctggggaagggagggagagaaacattacattaaatgaacttatcaattaaaaggctaatattgatttaagaaatgtcaaattaaatatgaatattagcattaaggaaacatatagagcggttgaggactaaatgagatactgaagtaaaacacaatatacttagtacttaatacatgcttgcaaatgttactcattctcaccaaactagatacaataaaagccttgcttgcatgtattggggaagatcatctgaataatgtgaaattctctcctcaaaccccagtcaatcaaccaatcaaccaatttattgatttatttattggaggcagagtctcactctatccctcaggctggagtgcaatggtgcgatctcggctcactgcaacgtccgcgtcctgggttcaagcgattctcatgcctcaggctcctgagtagctgggattacaggcgcctgccaccatgcccagctattttttgtatttttactagagacggggtttcgtcatgttggtcaggctggtctcgaactcctgacctcaggtgatccgcccaccttggcctcccaaagtgctgggattacaggtgtgagccacggcgcctggccccaatcaatttaaattctgtaattcttttcatcttcaattcagttgtctatatttagtacaaccataacatttatttggcaaacctagacactttttggtttgtttttttagagacagtattcactctgttgcccaggctggccttgaactcctaggctcaagcaatactcctgtctcaggctcctgagtagctgggactacaggtgcatgccactgtgcctggcttaaattttataattatttctatactcagctaaaaatgatctctaagactaaccttgcctcattaacaatcttttcctctttaaatttctatagcactaatggtatattccatacatcattatactttatgttataatgtcttaagttttatgttcataactagattgtagatgactcatgaccaaaagctatgttacctcttttaaattttccagagtatttcagtaccatgctgggtaaatagcagatgtataaaaggtgtacagtgaattgaaataaaggaaaaattgtgtgagattaacagtccaaaaatatgtattcatatcttaaacttttcttttttctctactcgaagatcttttcttagtgatgtgactcctactgcatctgagcacagaggctggatctattatcactaaatctctaaagatgtgttacaagtgaaagcagcatatgcacatgtacagtggaggtgaaaggagttccagggtgagagaagatgagaaaaggcggcaaatgtgcactgtcttgaagtttgctttatccacaggaaaatggtactagtgttggtatttaaagctgggagtcaattcctccacttgtttatagatgtgattcaagtgagtaaaattagacaccgtatacaataccagtcaggccctcggaggggatacaaagacaataagcatgcagttcttattcgtcagttattctgggtgcaaacaagtggacatttatgagagagactatattaggggaggcttcatggaggaggtggcatttaaattagtacttaagaagtagattttgttagagacaacttaagggagataagagggctgaagaaaagtttttggggtagtttctaaggacacaggaaggaaaaaggatatagttctatgtatatcttgctttattctaacaaaaaaaatcaaaaacaaaagtggcttatagaaatattgtaaaccactaccttttgaagttaatacaccagcagctccatgatgcctcctccaactttgccttttgacaggtatgtgctagcttaaaaaagattctcttaagaggaactgctggcttctaataatctaagaggaaaaggacagccactccaagaaaaaaacatttgtaggaagaatctgatttctggcaaagacctaacagaaatcaggaacactgtactgagtgagaatgaagaaagcagactagaaactatgctcaacaaatcaactactttaggaaacacaacttgtggatgagggagaaaggattaagtagtaaaaccaacctgaccacggtgtttttttgcttcaaacagtttagtaaggcaggatctgcacaccacctgtatgtggagccaagagaaaagacaaatggattatcacagcttcaatgcatgatttgtcaacaagccattctcttttttttttgagatggattctcactctttcgcccaggctggagtacagtggcagcaatctcggctcactgcagcttctgcctcctaggttcaagcaattctcctgcctcagcctcccaagtagctggcactcgccaccacacctggttagcttttgtatttttagcagagacgaggtttcccatgttggccaggctggtctcaaacccctgacctcaagtgatccgcccgcctcagcctcccaaagtgctgggattacagacgtgagccactgtgcccagccttgccattctcttcaattctttctgtcccttctttctatttctatgttcccccttttttttttttttttgttttgagacagttttgctcttgtcgcccaggctggagtgcaatggtgatctccactcactgcaacctccatctcccgtgttccagtgattctcctgcctcagcatcttcagtagctgggactacaagcacacaccaccatgcccggttaattttttattttttagtagagacagggtttcaccatgttggctgggctagtctcaaactcctgacctcaggtgatcagcctgcctcggcttcccaaagtgctgagattacatgcaaatgagccactgtgctggcctatgttcctctttttttttttttttttttagatggagtctcactctgtcacccaggctggagtgcaatggcgcgatcttggctcactgcaacttctgcctcccaggttcaagtgattctgatgcctcagctcccgagcagctgggattacaggcatgcgccaccacgcctggctaatttttgtatttctttttttttagtagagatggggtttcacaccatgttggccaggctggtcttgaactcttgacctcaggtgatttgcccacctcggcctcccaaagtgctgggattacaggtgtgagccactgtgcctggctctgtgttcctctttctatacttatctttttttttgtttttgagatggagtctacctctgttgcccagagtggagtccaatggtgtggtcttggctcactgcaaccttcgcctccagagttcaagcaattctcctgcctcagcctcttgagtagctgggactacagatgtgcgccaacatgcccagctaattttttttttttttttgtatttttagtagaaatggggtttcactatcttggccaggctggtctcaaactcctgacctcgtgatccaaagtgctgggattacaggtgtgagccaccgcacccaaccttatatttaacttatttatatttatcattttgccccttttcttctccctttctttcctctctttctttgttgtgtctaattatttttcttctcttattcatttattttttacagagtatatcatccaaggtcttactagaaaaacagaaaccattctaagtatttaaacaagagagaatttaacaggagttagtaataaaagtgatggaagggctgagaagccaaccatgagacaaaaaggcaaggcaaactaaagatcaccactcccctaggctggaggaacaaaaggaaacagcggtatcatggagcccagaggctagggacaccagcagatactggaatcacagcaggcttgtctggtgggaactggagccagacaagagctgccgtcaccatcagagatgccccacaagacagacagagctagcctgaactggggcctctcttttttttttcttttggagatggagtcttgctccatcacccaggctggagtgcagtggtgagatctcagctcactgcaacctccgcctcctgggttccagcgagtctcctgcctcagcttccccagtagctgggattacaggtacctgccaccacgcctggctaatttttgtatttttagtagagatggggtttcaccatgttagccaggctggtctcgaactcctgacctcaggtgatccacctgccttggactcccaaagtgctgggattacatgcatgagccaccacgcctggccaacactggggcttccctttttcctggccaccaaaatcttgccagtgcttcccctcccactggctgaacccatgcagaagtcagctgacaaggtagactgggaaattcccagggtcactttcctgcaacatagggcagaggatgagagaagactttcagacaaggagggtctggaaagatacagagggcaaggactttctgtttcaaagtgtgaatttttaatacttgactgaactagaacagcaattaagacttttctactccaagaatataaaagtaaaattagttaacctactgtgattgtactcaacacaaagcatgatactgattttcttaaacaattcattttgatcacgctagagatcagaatatttcgagagaaatgaggaagcaaagaaaagaacccaacacagagaacccactgcacaagaagggtggtaggagacagaagccaacgttcacacaaatactgacctgggtatttaaaaaaaagacaattaaagaaaaaggtagaaagcaaggagaataaaggaaatgatgggcaaggaaagcaatacagtgagagctgattataaaaatgatagaaaatggtgcaggcaaagatagggtaagaagactggaggttagcagcattgacagtgcacaagagggccagtaaccaatagggtaaaaagtttttctgaaagaaggacacatttctctcttggaaatttaactgaagtattttttttgatctaccaaatgaccttccttcttttctcagtcactctcctgatacatgcgctaccatgtgagatatgctcctattttggatacagttccaatttgggttcttttgatactaactgtgactttatgcctgctagcaaaatccccaccccccacccccaatttaaaacagatgagacaccagctgtggggaaagtaaataaaatgaatgatagttatagtggagcaagcagaaattccaactgcctatggctgttgatcttatccccacttcttaagtgtgtaacttaggaatctcctatacttttgccacccctttaatcagtgctgattgaactaaaagcttagcaagtaattgtaattttaaaatttcaaattgtataataacccaacaacaatattttatccccatagtacctctggagcaagggccttacagtatcccaatattcctggaagagcaggaacaaatttgtaggtaaagatagatagctacagagtgcactgtactctccttctgcagaatctgcaagagaataaaaatacatttaataagcacattattcttacctggtcaatctgtgcattagagtttcttcactgtttatgcttatttctacactctccttgtagagggtatattgcttattctataaaaccatgggtggcagtccgggcacggtggctcatgcctgtaatcccagcactttgggaggccgaggcgggcggatcacctgaggtcgggagttcaagaccagcctgaccaacatggagaaaccccatctctactaaaaatacaaaattagccaggcgtggtggcacatgcctgtaatcccagctactagggaggctgaggcaggagaattgcttgaacccgggaggtggaggttgcagtgagctgagatcgcgctattgcactccagcctgggcaacaagagcgaaactccgtctcaaaaaaaaacaaaaaacaaacaaacaaacaaaacccatgggtggcaaataagtcacagtgatttttttaaaacataaattgtatcgagtcactctcctgatcggatggctctaatgtgtaaccacacttagtataaaatacaaggtccctatcgtggcccaaaggtcctgtgtgagctgcccctggttgcctcttagacctcatctcctgtcatctcctgttaccctcccccttaggcttcagccatactcatctctttgcaattctgtgactacgtcaaacgaagccttgacatttataacttcttctatttaggaatattcttccttcaactgtctgttcaactcaaccccctctatgtagctgtttgctcaatgtctcctcacagagaagcattctatgaaaactatctcagagagttccccactctggccccaataccctctattcctgaactgcttcattctgccttgcaacatttatcagcatttgacattacattatatgtatttctctatttgtttataattggattcctcccaataaaaaggactttatttcactcacaactgtactgtagcacctatgagataaatacatgacttttttgtatgtgagcaaacaacagatctgtgctggcaattacttggaaagtggactcctattttatacaagaccatgaaaaacctagatcagataaaccctactgaactgagttcaagataaagaagctgatagccagtaacggtaacctggtcagcttattctcaaaggacaaaaggaagaatctcagcaattttgatgactcttccaaaatcatataaatattctgatttttacccatacaaagccacaggaaggcttccctactttggtctagatttagaggcaagtaaatgagaaggtgatcctattgcttaaatatgcatggcctaggttggttctagtaggcctttcctagcagcactttcattctttaatgtagtcatatgtactttttttttttttttttgagacagagccttgctctgtcacccaggctggagtgcagtggcgcaatctcggctcactgcaacctctgcctcctgggttcaagtgattctcccacctcagcctcctgagtagctgggattacaggcaatatgccaccatgcccagctaatttttttgtatttttagtagagacggggtttcaccatgttggccttgctggtctcgaactcctgacctcaagtgatccacccgcctcggcctcccaaaatgttgggattataggcgtgagccaccacacccggcctacatgtccaaaatttaaataacagagtatacagtaaagtcttcctcctatctagccaaacaattctcttctctaaagacaaccaatgtttctaatttcttgtatagcatatcagttatattctgcatgcaggtattttataagctcaagcacataacctatacatagataggagcgaagagtaggtcttgcagattataaagctaatatactttttggcctcacctttaacctacaccagggctcatgtttgaagggaacacacatgaaagaaatggggagaggagaagtggttttatctgctttaaccttgtattcatgagcttgaaggtaagaacaaagaaaatctcccattttccactccatgatttcatttttctacttactggtatgcagttcctcaggcggagttaccccaagtaaatagtggaaaaacaatgcagcacagcgaagataaggggtgatgccattcttcagtgagacccacaaataccagccaggaatatcacacccaatggagctaggagacaataattccagaagagaacagaatacatatcagactaaagccctagatttaaacatatcccccttttcaaatacaaagttaaacatttaggtaatttattatccatgcaatttttaaacatttaaaacaaaatataatcccagcactctgggaggccaaggcaggtggatcacctgaggtcaggagttcaagaccagcctggccaacatggcaaaaccccagtctctactgaattagccgggcatggtggtgggcacctgtgatcccagctactcgggaggctgaggtgggagaactgcttgaacccaggaggtggaggctgcagtgagctgaaactgtgccactgtactttagcctgggcaacagagcgagacgctgactcaaaaaaaaaaaaaaaaatttgagtagcaaatagtttcagtgtttaaatctcctaataatttcctcaagaaaatcacaaatcttacatattttaccatgtggatttttaaggcaaggaactactcttctttttcctaggtggtgataaaaaacaaaagcaaaacaaaaacaaagaggcaaccaaaaaatctactttaaaggaacttgactcttaaataaagtatactctttattttcaaatttttattattattattttttgagatagagtcttgctctgtcacccaggctggagtgcagtgctgcgatctgggctcactgcaacctctgcttcccaggttcaagtgattatcctgcctcagcctcccgagtatctgggactaaaggcacacgccaccatgcctaattttttgtatttttagtggagacaggggtctcaccatgttggccaggatggtttcgaactcctgacctcgggtgatccgcccgcctcagcctcccaaagtgctgggattataggtctgagtgaccatgctcaactagttttttttttttttttttttttaaatagagacaaggtctcactatcttgctcaggctgatcttgaactcctgggctcaagcaatcctcctacctcagtttcccaaagtgctgggattataggtatgagccaccgtgactggcctaaaataaagtatattcttcaacataaaagttaaaggttactaaagcttccttttttttttttttgtttagattaaaaccttgtaaagaaatgtggagaaaaaaaatttatcaataactaaccaaagcaacttgttagctaaaacaaaattaataatttcctggtttctatattaagattgactaatgatgtgtgtggcagttaaattattctgtatgatactgtaaagcgaatcttatgtaaactatgaacttgagttaatcataatgtattaatattggttagtcaattgtaacaaatggtacctccctaatgcaaggtattaataatacgggaactggtagggggagggagcaaatggcgactctttatactttctgctcaatttttctgtaaacctaaaatgtctctaaaaaacaaaatctattaacttaaaaaaaaagaaagactggtaaaggtgactgatgaggggaacttggcagcagatgtagttcagcagagcatgcctatcgtactcctactataacctctacacaagggttaaatatatataagattttaaatatatattatgaatatatataaaaattatatatgtagtatgtactgttatacaatatatgtacatattgtatgttatgtatatattacatgcatgttaaaatacaaatgccaatgtattttccatattactcaataagggccttaacctgtaactacatgcatgcactgagtgcatcaattgtatggatcactgtaaaaggacaacctattttctattttctacatttattttaattctaaatactcctttttttaaaatccaatcatcttttgtctatgcttccagaacagtttacaaaagtaaagatgtgttgaacttgtttcagtctcagaaacaagtgggtagctgttattccaacctactatcttttacttcaaagtaaaatcatcaaaataaattttcttcactgtaaacctatcctgtagcaaacaaagtcatgctaaaagcccttaacagatttttttttttttttttaaatagagagacagggtcttgtaatgttgcccagggtggtctcaaactcctgggctcaagcaatcctcctgccttggcctctaaaagtgttcggattacaggcatgaaccattgcacctagcttcataactgattattattattattattatgcacgtgcagaacgtgcaggtttgttatataggtatacatgtgtcatggtggaggtttgctgcacccagcaacccgtcatctacattaggtatttttcctaatgctatccctccccttttcccccagcccctgacaggccctggtgtgtgatgttcccctccctgtgcccatatgttctcattgttcaactcctacttgtgagaacatgcggcatttggctttctgttcctgtgttagtttgctgagaatgatggtttccagcttcatccatatccctgcaaaagacatgaactcattcttttttatggctgtatgatattccatggtgtgtatgtgccacatttgctttatccagtttaacactgataggcatttgggttggttccaagtctttgctactgtgaatggtgctgcaataaacatatgtgtgcatgtgtctttatagtagaatgatttataatcctttgggtatatatctagtaatgggattgctgggtcaaagggtatttctagttctagatccttgaggaatcgccacactgtcttccacaattgttgaactaatttacactcccaccaacagtgtaaaagtgttcctatttctccacatcctctccagcacctgttgtttcctgactttttaatgattgccattctaactggcatgaaatggtatcccattgtgcttttgagttgcatttctctaatgaccagtgatgatgagcttttttacatgtttgttggccgcataaatgtcttcttttgaaaagtgtctgttcatatccttcgcccactttctgatagagttgtttgcttttttcttgtaaatttgtttaagttctttgtagattctggatattagccctttgtcagatggatagattgcaaaaattttttcctgttctgtaggttgcctgttcactctgatgatagtttcttttgctgtgcagaggctcttttgtttaattatatcccatttgtcaattttggcttttgttgcaattgcttttggtgttttagtcatgaagtctttgcccatgcctatgtcctgaatggcccaaaaactccttaagctgacaggcaacttcagcaaagtctcaggatacaaaatcaatgtgcaaaaatcacaagcatccctatacaccaataatagacaaacagggagccaaatcatgagcaaactctcattcacaattgctacaaagagaatacctaggaatacaacttaaaagggatgtgaaggacttcttcaaggagaactacaaaccactgctcaaggaaataagagagtacacaaacaaatggaaaaacattccatgttcacagacaggaagaatcaatgtcgtgaaaatggtcgtactgctcaaagtaatttatagattcaatgctatccccatcaagctaccactgactttcttcacagaattagaaaaaactactttaaatttcacatggaaccaaaaaagagcccgtatagccaagacaatcctaagcaaaaagaacaaagctggaggtatcacgctacctgacttcagactatactacaaggccacaataaccaaaacagcatggtactggtaccaaaacagatatatagaccaatggaacagaacagaggcctcagaaataacaccacacatctacaaccatgtgatctttgacaaacctgacaaaaacaagcaatggggaaaggactccctatttaataaatggtgttgggaaaactgtctagccatatgcagaaaactgaaactacaccccttccttacaccttacataaaaattaactcaagatggattaaagatttaaatgtaagacctaaaccataaaaaccctacaagaaaacctaggcaataactgattatttttaactggaatttaaatgattcaaatgttacgttgccaaacaactgaacaagaaatggaattattacaatagactgaactaatggattgttactcacccacttgtatattgagaaatttctgcaaagaaagaagatgcggaatgagcctcttcactgtcttcttgaacctgagcaaggggtaggcctgaaaaagaaattctgcaagatgaattatgtatttgctattcagtttacaaattagactttaatttcattgttccaagacaataaacaacgtagattcattcaactgaggttctttcctttttttttttttgagacagagtttcgctcttgttgcccaggctggagagcaatggtgcgatcttggcttgctgcaacctccacctcccggattcaagcaattctcctgcctcagcttcccaactagctgggattacaggcgtatgccaccatgcccagctaattttgtatttttagtgtgtttcaccatgttagtcaggctggtcttgaaatcctgacctcaagtgatccacctgccttggccttccaaagtgctggaattacagacataagccaccatgcccagccccacctgtttttaatctaagtagttgatgctgaattttaaagttgttaggtaaactttatctatatattagctggagaaacaaatagggcagaatcactaaacatggatgtttaatatttacttgctaaacatgtaaatacttacttcatcataatatgaccatggaaataaattgttatcaacctgctttgggttcctaggaatctaagccagcagatagaaattcaacctctagaaagggaagtaggtgtctgtcctgccttcatgctcaagcaaagggtcccataaagagaactttgtgaggttattttcctccatcaacctatctttaaggaggaccatcctaaacccttccagcaactgccaactctctcacttacattaaggctctggataagctacataagttctctgaacttcagaaatattgtattaaacttgatatacaaatgtctaccttgtagtttgctgtgaggtatagttatagcacatttgagtagtgctctgttgttttaaaaatgcttttgtttatgtattaattcatctggaaggtcaagattcaagttgccctcagtaattttatcatatcttgaatgaatactgctagtccttttcattttccaaataacatctctttattcctatacttttaaaaaatgcatcatgaattcatactgattttttcaattcaaatgtaagagagttcaataattctaagggattctttataaatttgaggtaaattttacatgcaattaagtgcacaaatatcaagtgctctatctgatgatgagtttgacaaatgcatacacccacaaaataagatttttattttttaattaatacactttattttttaagagaagttttagattcacagcaaaattgagcagaaagtacagaggattccctctgtctctatgcacacacaacatcccccacctatcaacatttggcaccagtgttgtacgcttgttataatcaatgagcctacattgccacaccattatcacccaaagtccacagtttacattagggttcattcttggtgtttacattctatgagtttggacaaatgtgtaataatgacatgcatgcaccattgtagtatttttcataacagtttcactgccttaaaaatcctctatgctgtgcctattcagccctcccccaacacccttacccctggcaatcactaatcctttcactgaccctatagttttgtcttctctagcgtgtcatatagttggatttgtatagtatacaaccttttcaaattgacttattttagctagtaataggcatttaggttttgtccatcttttcatcactcggtaactcatttcttctttttattttttttatttttttgagatggagtcttgctctgtcacacagactggagtgtagtggtgcagtcctggctcactgcaacccccgcctcctgggttccagcgattctcctgcctcagcctcctgagtagctgggattacaggtgtgcaccaccatgcctggctaatttttgtatttatttagtggagatgggatttcaccatgctggccaggctagtcttgaactcctgacctcaggtgatccacccgtcttgtcctcccaaagtgctgagattacaggtgtgagtcaccgtgcccggccgataactcatttctttttagcactgaataatatttccactctctggatatactgtaatttatttatccacccacctattgaaggatgtcttggttgcttccaagttttggcaattatgaataaagctgctataaacatccttgtgcacagttttgtgtgaagttcagtttttaattcatttgggtaaatacaagaagcatgactgctggatcatatggtaagagtatatttagttttgtgataaactgtcaaactgtcttccaaagtgactgtaccttttgcatccccatcaacaacaaatgagagttcctgttgctccacatacttgccagcatttggtggtgtcagtgttttagattttggcaattctaataggtgtatagtggtatctcattgttttaacttgcaattccctaatggcatatagatgttgaacattatgatcacttaccatctgtatatcttctgtggtgaggtgtcttttcaagtgctttgcccactttattttttagagacgggatcttgctatgttgcccagggtagtctcaaactcctgggctcaagcaatcttcctgccttagcctcctatagtgttgggattacaggcatgagctattgcacctggctcattgccccgtttttttgagaccaagtcttgttccgttgccaggatggagtgcagtggcatgctatcagttcactgcaatctatgcctcctgggttcaactgattcttatctctcagcttctcaagtagctgggactacgggtgtgcacaccatgccaggctaatttttgtacatttagtacagacaggttttcctcatgttggtcagggtggtctcaaactcccggctgaagtgatctgcccaccttggcctcccaaagggctgggattacaggcataaaccacagcacccggcctcatcgctcatttttaaattgggttgttttcttattgttgagtgttaagagttctttgtatactttggataacagtcctttatcagaagtactttttgcaatactttttcccagaatgtggcttgtctctcattctcttgacagtgtctttcagtgcataagtttttaattttattataatgaagtccagcctatcaattatttctctcacagattatgcctttggttttgtatctaaaaagtcatctccatacctaaggtcatctaggttttctatgttaacttgtaggagtttttttttttttttttttttgagatggagtctcgcactctctcccagtctgtagtgcagtggagcaatctcggctcactgcaagctccacctcccgggttcacgccattctcctgcctcagcctcccaagtagctgggactacaggcacccgccaccacgcccagctaattttttgtatttttagtagagaccgtgtttcaccgtgttagccaggatggtcttgatctcctgacctcgtgatctacacgcctcagcctcccaaagtgcagggattacaggcgtgagccaccgtgcccagccatcttgtaggagttttatagttttgcattttacatttaggtctatgatctgctttgaattaatttttgtgaagggtgtaaagtctgtgtctatattcattttattggacatgggtgtctacttgttccaacaccatttgttgaaaagactacctttgatcctttgctcaaatgtcaaagatcagttgactacaaatatgtggatctatatctgggctctctttcatatttcattgatctatttgtctaatcttttgccaaccacactgtctttattactgtagctttatagtaagtcctaaggttgggtagtgtcaaccctccaaatttcttctcctccaatactgagctggctattctaggacttttgtctttccatatatacttcatgtatttatttatgtacttgtttgtttacttattacttactttctggttgattgacagggtctcactctgttacccggcctggactgcagtggtgcaatcccaactcactgcagccttgacttcctgggctacagcaatccttacacatcagcctcccaaacggctgggactataggcatgtgccaccatgcccagcaaattttcctatttttttttagagacagagtctcactatgctgcccaggctcaaattcctcccaaaggactgggattacaggcatgagccactgggcttggctcacataaactttagaatcagtttgttgatatccacaataataacctgcatggatttttatcgggaggctggagtgcaatggcatgatctcagctcactgcaacctctgcctcctgggttcaagcaattctcctgcctcagcctcctgagtagctgggattacagacacctgccaccacgctggctaattattgtatttttagtagagacggggtttcacaatgttggtcaggctggtctcgaactcctgacctcaggtgatccacctgcctcagcctcccaaagtgctgggattacaggtgtgagccaccacccggcctctattgtctcttttataaaacacataagcaaaaatgtatataaacacatatatgcataaaataccttacagaaaaatgctacactatagccactattctgtaccttacttttttaacttattgcatcatggagatcaattcatatcagatcttgttcattcctttttaaaactgcatagaatttcattatatggtacatcataggttattcaaagaatctcccatcgatggacagctaaattgtttctgttttttttgatatcccaagtaatatcacaataaataatgtcgtgcttgtatcatttcatatttttgctggtaaagctttgggataaattcctagaaatggagttggtgtaccacagggtaaatgcacatgtaattttgccatattttattctgacatcactttaattatgtttgttctctacattatatgaatcttcagaagcccttattggtcactgatacccaggaccagattttgctttgggttttttttttcttctttttttaagagatgagatcttgttctgttgcccaggctggagtgccatggcgtaaaggcactctgcatggtgcaatcacagcactctgcagcctcaaactcctgggctcaagtgatcctcccacctcagcctctcaagtagctgggactacaggcacgcagcagcatgcccagctaattaaaaaaaaatttttttgtagagatagggtctcaccatcttgtgcaggctgttcttgaacttctgagcttaagggatcctcctgccttggcctcccaaagtactgggattacaagcatgaaccactgcacccagcccccagactttgcttcctattaaaaaccagactccaaaagaaaaactgtatcatcattccataatgttgtattactaatgtatcttcaaatgaacattaattcaaaagacatttaatgagtgtttactgggtttaacaagtgttaccagatacttgcagttttagagggaagatgttgatatttcattgtttcctatcatcaagaaacttacactgaggacaaaggagcagagagagaggagaaacagggaaaggagcagaacaacagtaagatataaccagaaataactataaaacaagatactaatgataaatgctacaaggggaagaaagtactatcattctagctgaaggaattaagaatggttttagggacctccttatcaaaaggttgaaaaaactcatgtagggacagacctcgaggatggggaatttgaaaaagagggaaaagcaggtccaagtggtctccctgcatatctgtagagcagttgataattaggtagtttcacctaattatctttttcacagcttattctacctttccttgtttaaacagtatccattaaaaaacagataatcattcaacaaaaaacataacacagaacctagaaatacattatataatcacaagaataattaattttgccagtaaagcatggcaaaatgttattcacagtcaacacccagatgaaaaccttacctgtgtctactgtaagtagtatctgaagcatgtgtgccatggtgatcaaatggaagagataaaggtggttataggaagaactaactgaagaaggctgcagatcaacagggtcatcccaatacaaggatgggaatgctaacacagcacccacctatgagagaaaaatggacatcaatatggctaatgataaaagactaacataaattaatgtcataactaaatgtgaagggcagcagatgctacacagtgtttgtgtgtgtgttttttaataaaaaccatatttttcttatttattcaatagaatatcttagaatataatgtaccataaatggaggacgatgatcaccaccaaataggttatccctttgctgtgtctacttattgtaggtctaggtagtggttctgaactctggctcaaagattcaacattacaggagttcttaaaacaatactgacacagaggccctaccctagtccaaccaaatgagaatctcttggggtagggcctagttaatagcattcttttcaaagttccccaggagattccaaaagacagtcagggttgatgaccactgggtagaggcctagataatgagggggatgaggatgttggctacccctgcatccataaactccatgctcccaatctcaatactgctttctctacggaacttggtttgaaggaatgagatcatcacaggaatggaaaatctctacaaaaaactaagggcagttgccatccatccataggtgttttgaggaagcctagatacacccatggtctggtcctcatcaccaaataattaatgattttaagagagctcacacagtcattgactgcatatcatatatacaacttaagaaaaaggccagaagaggagcataatatgaattagaaaaggcttgtctgtacagacacccactaatgtaatcaaccaggacaagacctattacaaattgaagtgctttttttttttttttttaatgattttgacagtctccatcaaatctgtacctatttgtaaacaatggacaggagagaccaaactttatagattaaacacaaagaatttataatcttgaacaaagggcatgaatttaaatgaggaaaatacaagaaattatcaacatgagtgacttaaacaaaattactgaacacttaccaaaacatgaaacagatctatagacagaaggcatggtgtatcttctgattttatgttaggaagaacaactaaaacaaacaaaaagttaatgtaattcagtcagtaagatagcagtgtaggtaaataaaatgcaagctaaaaacacctaaaccaaacatataacagggttataaaatacagaaactaatacatcacacctttgagatatgaaaaccataatgagagacaaactgaactgagaaaaggctgctagaaagccttggatacagtttaagggttaaaaggtaaaatctaggtggaaatggcacgtgaactaggacaactgaaatatagagattgttaaagaaacatttgttgaatgaatgagaagagttacttttatacaatgttccctttatcacttgttttctgacttccatttctaaacgttctgtgatacataatatgtgaacaaaattggggttgtgagtgggaagaacatgcaaaacagagtaggtaaaatgaggatggagaagatcatcctgaacaaaattagataatggtttatatagattgttcatctggaggaaatgcaaacagctcaaaagctacttaatctttctaatctggtccgtgcctaaggaaaagctgtaattccaaaagtgagagcaagagtggcaaagaagtgaaattaataagtcaggacaagaggaatggttttgtttatataaaaatgaaggaattattgtaggtctaggtattggttctgaactctggctcagaagattcaacatcacataaataaagctgttatttttaaaaatgagggagaagactcttttcagactaggtaaatttcttttcttttcttttctttttttttttttttagacagaatcttgctctctcatccaggcaggagtgcagtggcatgatgtcggctcaccgcaacctccgcctcccaggttcaagtgattcttgtgtctcagcctcctgagtagctgggattgcaggcacgcgccaccacgcccggcttttttttttttttttttttcgagatggagtctcgctttattgccaggctggagtgcagtggtacaatcttggctcactgtaatctctgcctcccgggttcaagcgattctcttgcctcagcctcccgagtagctgggaccacaggcacgtgccaccatgcccagctaatttttgtatttttagtagagatggtgtttcaccatgttggccaggatggtctcgatctcttgacctcgtgatccacctgccttggcctcccaaaatgctgggattacaggcatgagccactgtgcccaaccaattttttctttttttcttttttttttttttagtagagatggggtttcacaatgttgaccaggctcgaacttctgacctcaggtgatgtgtctgcctcggcctcccaaagtgctgggattacaagcatgagtcaccacgcctggccatgtaactagatcaatttcttaacctcaaattccaagattctaaacaaaaagcataaaggttaagatcaggggctttgaagtcagactaaaatggcttccagtattggctgtgactactggtcatgggcaagtgacaggcgacttaacttctctaagtttacatgcagtatatgcaagtttgttgggaggttcattaacaaattaatttattatttatgtattttattttgagatggagtctcactctgtcccccaggctggagtacagtggtgcaatctcggctcactacaacctccgcctcctcggttcaagcaatcctcctgcctcagcctcccaagtagctgaaattacaggcacctgccacaatgcccagctaatttttttattttttatttttagtagagatggggttttgccacgttggccaggctggtcttgaactcctcgcctcaagaggtccacctcccctggcttctcaaagtgctgggattacaggtgtgagccactgctccaggtcaacatatgaatttaaagcacttatccaagcttggcatatgtaaccactctataaatgttattaatattggctacataaaacaaactaaagtgatcatagggctctgacattaactagctatgtgacttcaacaagtcatttgctgtttctaggtcccatttcctcaaattatcttttagtaatatttctgatatttcagttagcatgtctatgatactacctatcttatttttttctcaatgttacagcttactcaaaatatttaaataattcctgatccctcgtcctaatttccatcatcttttcagccaaaagaatactctttgtgtcatcaaatttttcttacaggcagtttaaaatgatttttctttccctgattgctaaaaatatttaaaattctgttgaaatcaaaagtcaattttggtatgcatattttcattttaactatgggttaagccaaccctttatgcacaattaaacacctcggcaaagtttacatgatatagtgggaaaatcatgggctttatggtcaggcctgggtttaaatattagttctacttcttattggttttattaccatgggcaagtcatgcaacttccctgtgcctcagttttctcgtaaatcgggagaataatttccttgaaggatggtgactagaaattagattttatttaaaaattctaggacaaggcatagcacatggcagtgagcattgtatgtcctatctatctatccatccatccatccatccatccatccatccatttagagacaaagtctctctctgttgcccaggctggagtgcagtagtacaatcatggcttactgcagccacgacctcctgggtgcaagtgatactcccaactcagcctcccgagtagccagtactacagttgtgcaccaccacacccggctaagttttttgtggagacggggtttcaccatgttgcccaggctggtctcgaactcctgagctcaaatgatctgctcaccttggcttcctaaagttctgggattacaggtgtaagccattacacccggcctgtcctattgctactgcagaaatcaacatattaaaacaatactcatcactttacatagaaaatagctcctattctggacttccttatttctctcaatttttctgctattcattttagttcaaaatcttgcccctgacccagcccaccccaacgtcttccctaattcctgctatcacattcagatgcatatgttacctctaatttttccctccttcaatccaacctattcaatatcaaattaagctcagaatactattgtccacaacgtttcaaaaaattccgattacctaaagaataaagttcaaacttatgcctggggcatttaagccactgtaattttattaaaaaaaaccttcatgcttttctaactatagatgccactactcctatcaaacctatctacttgaacacatcacgcactttcctacctcctcaatctttgttcaaatgtgccctgtgtcttttggaatgcagcttctgttcctctcaatttatctattatgtgtactcccttcaaggctcagttcaaatcctaccctgttagaggagataacagcagagtcccaaagcgatttctttcttgcctcaattttttttttcttttttgagatggaatctcgctctgtcgcccatgttggagtgcagtgtggcaatctcagctcactgcaagctctgcctcctgggttcacgccattctcctgcctcagcctcccgagtagctgggactacaggcgcccgccaccacgcctggctaattttttgtattttttagtagagacagggttttaccatgttagccaggatggtctcgacctcctgacctcgtgatccgccgcacccagccacttgtctcaatatttgaagcatgtattagtgaagcacatatctggcatttggctattttatgtttgtttttatagaagttctgcttaattcaatcataagcattaaaatggcaaggaacatatctgatagccctaacatcttacaaataaaaatgcacctctaataaatgttcatatgaaaaactttcatatataggcataaagctacactacataaattcctccagtattgctaattagagattatacaccatcattttagtctctaccatctgtgataatgttagtctccttctttggtgctttttttgagacaaggtctcactatactgcctacactggtgtcaaactcctgggcttaagggatcctccccctcaggctcctgagaagctgggattataagtgtgtgtcactatgctgggcaataagctgttttaaacattgtaaatcccataatgtttaacaagtgcaaaagcagtgaaaccatttggaagaattagtaaatatctaaattatgactgaaatgaaaaagataccaaaaaattaaaaaacaaaaacaaaatagtgatatgcaaataggataaactgttcaacagaaagaggtcctaaaaacaaagacaggcgcatgtgacatatggaaggttctggccctgtgcaactgaccaagaagggaaaaaagtaagtgaaagaagggaaaacttttaagtgtgtgactagtggaacagcatcaacattagatttctattagcatgaagccaattcaggagacacctggaagttaatttgaaaatataaaagctaagcatggcagaagttctaacaaaacttggatggtagctttggaaggagttgtggaatctccacatcaacaggatgagcggaaagctgctcaggaagagctccctaagaagcttgtggggattgacaaggaaaaacactattggcttcaatagattttcaaggtaaagaagtaggtctattttgctggaaaaaaaaaatgtctgctagttcagctacaagaaaattatgcctggatttaaagcgtaaaaaatctgaataactcttatttggtagaaatatatctgggaagtgcacgctgaaactaccctactcgtgacatttgggacttatgaacaaacagatttacaaacaactctcttaaagcctggtctgtttgggtgcagaggagcttatagtagacttcaaatgcacagatggaaatgcagataaccaaaaggaaagcaaaatcactctaatgctgtgtaatgacttaccctgcattttatttctatactaattgagatcaccatatgaactcttagtaaatttctaacttgttagaatctgagaagattagctgttatagccagcctgtcaaagaaatgggcatggaactgagttctgcgattactgaatgtagcatttccattatttcataagaatttgacccacaaacaaaactaaacatattttaaaatgatctatccacatcactgctcccttttctaactggattggggatacatggatgttagtggttgtagacactggttcaataacctaggcaggtagagaaacataagttgaaaatatttggaaaatacagattttaaaaataaggtcatgaaggccaggagtggtggctcacacctgtaatcccagcactttgggaggtggaggcaggcgaatcaccagaggtcatgaattcaagaccagcctggccaacatggtgaaaccccatctctgctaaaaaaaaaaaatacaaaaattggctgggcgtggttgcgggcacctgtaattccagctactcagagggctgagaaagcagaatcacttgaacacgtgaggtggaagttgcagtgagccgagattgcgccattgctctccagcctcagcaacaacagcgaaactcccactcaataataataataataataataataataataataatatcacaagttttacagaggcagctatgtgtttatctgttttttgcatggcttctgtaggtggtaaaatttcattagtgagtgctcaaaattagtgcagtgtatgttgtttcctaatgaaatacactgccagaaatgcaatagaaaaagatatataaataatataatacataataatagttcagagaagactctacctgatagaagacgaaccagatgtttctgtatcaggacctgaggacaggtaatcctctgtgcaactgcaaactgcattaatgctttcagaccattatgctagattgtaagagagaaggaagataaaaagatgagggaagatgagagacctaagtcatccacttaagagttggtaaaaaccaactctagtttgtcggaattagctgcagactcattatataccttatatcattgcaaataaattacaatattcttaatacctgtacaaggttttatggccttgctaaatttctaatagattttcttataaaaaagtggtattaaagctataattattttaattttcacataaaaagtgttttccccagagctgagcacactgtgtaccacaagtcttctagtcttctgtgccagctgtcagaaaaataagagggaaatggcagggaaggaatggcaacctcaattaccccttttgtcttcacagggctactctgcatatttctttagtactgttttccagggatcactatgtaaagaggtttaggcctggggcaggagtagagtcctacagtagtgtcagtatctgcccatcaaggagtcatgtcttaattttatttttgaattcagtatgatgattcatccagagctaagccagcattaatactcaatgttatataatggtgtaaaattagtgagaaggaaaaatataggaaacatcaggattttgaaatgtaacaaacaaagggagaaaaagtaatcatcacatgaaatctctgtatgaattacacttaacctctgagattgagtaagcgctgtaaagtgcacatgctattcagtttcctataagactgatgcagttccttttttccccactatagaattctgctaatttttacagaaaatgagtaaagattttttgtttttaataataaactgtgggggggaaaaaaggcatgccatgagttacatgtaccttgttggaatatacatacctgcctattttgaagtgctccaaacagaggttttccttcatctcccaatagattttctcaaagaataaaaaaaaataaaaataataaatcctgaatagtgctataatcatatactgtactttttatcaaatgttctttaataatatttttgatgagatgatttgcatttttccccttcaaagtcttgtgttttaagtctatgccaaaattttccaatttttgagtgagagaaaattagagaatcaaatgtatatcatttacaaattactagcataaaaaataaagcacctgcagcaatcttataagaatgcttgggaaaaacaaagcagcctggactgcttcttctcatttcagcatcttttttatgcaaaattttctaaaataagtaatttatatatgtaattatagcctattttgtttaaaaataatatgtaaggcagatacaaacaacttcattgctcttttgggtacaattttttttttgagacagactttcgctcttgttgcccaagctggagtgcaatggcgcgatctcggctcactgcaacctccacctcctgggctcaagcgattctcctgcctcagcctcctcagtagctgggattacaggcgtgcaccactacgccagctaaatttttgtatttttagtagaaacagggtttcagcatgttagccaggctggtctcgcacttctgaccttaggtgatccgcccacctcagccttccaaagtgctgggattacaggcgtgagccactgcgcccgacctcgggtacaattttaaaagaattagaaaagatcaataggaaaaaaagaaaatgagaccgggtgcagtggttcatgcctgtaatccctggactttgggtgggtgaggcaggaggactgcttgagctcagaagttcaagaccagcctggacaacatggtgaaaccctgtctctacaaaaaacacaaaaattagctgggcgtggtggcacatgcctatggtcccaactgctcaggaggctgaggtgggaggatcacctgagcctggggaggctaaggctgcagtgagccataactgcaccactgcactccagcctggacaacaaagtgagaccctgtctcaaaaaaaaaaaaaaaaaaaaaaagagaaagaaaaagagaaaattaaaataccaaaatcacagatttgtgttttgttgtccatggtatttattcctaaattactcttattttcactgatccttagcagcagatacgagtgtggaagcattttttttcatctttgcataaacagtaattcaaaggacgctttgttttgattcctcaactattatcctatgccaatgcattctgtacatatctctccatctccacagggactgagataagttagttgtttatgtactaagaataaagtagagcattatgcctgcttgatagaaaaagcacaatagtgaacacaatatgatattaatcaaatggaatccaattactagattatagaaccacatatgaaaagattcagctctatcagcagtgaatttcctatctcctttataacagactgtgccccctttttaatgttcaaggtctaaatataaattcttgatttcctaatgcttatcttccccaaaatagtaaagtgtgaaatagcttcactgaaagtctgaagagacttagcatgtcatgactccacaagaatgctttacatttcttatcaatttgttcagactctattttatataaacctcacctttcctatatcccacttgattgaatcatagcaaatataaactgatgtattatcctatacccatgatttaagtctaacaggtttggatgtgactttttttcccccaagcacatccacccacagtggctttattcagtcacatccccacccccacagctccctccaccaggcagacaggtgggaggccacgccacggcagtacccggggaccatgggccagcaaagggtcccggccagagggcaccaaccccaggaagacacggtccccacccggagcttccctgggctgcctcggcccctgagcccaccctgaggatctgtgctttgactctgacagggagcagcaggaagccgccagcccactgaccccctgggtatccttggaaggcacacggtggagtggtgactccagctcctgagcggcgcttcctcagctcccatgcccctgcatggtgctgggctcggcccaagatgtccaaccgcagtctggctctgacaaggatggtcacggcctagccacaggggcggctttgcccatcagtccccctggggcagcaactggatcccggcaggggcagagccgggatgggccctctctatgggcttaagatcaatgtaggcggaggctcactgggccaaggccaatgaacccactcataggagccctctgagggcaccggtagggggtctgctaagggcaggtgcccgtggcctggaacctgcctttgccaaggcactgaaagcgactcttaaactctattaagaaactaatgatagtatgtaggaaggctttgggaaaaaatgtggcttcaaggccgggtgtggtggctcacgcctgtaatcccagcactttgggaggctgaggcgggaggatcacgaggtcaagagatcgagaccatcctggccaacatggtgaaaccccgtctctactaaaaatacaaaaattggctgggcgtggtggcgtgcacctgtagtcccagctactcgggagcctgaggcaggagaattgcttgaatctgggaggcggaggttgtggtggccgagattgtgccactgcactccagtctgccaatagagcgagactctgtctcaaaaaaaaaaaaaaaaaaaaaaaaatatggcttcatgctacttaattcaaattatgaaatataagtgtcttgttacaaaaatacatttaaatgaagaaaatataatggactccattaaaaacaattaccaaaaatatatatattgaaagggaaatcaaagttggcttggataaagatagggaagaatcaccattcttaattttttccatgtaatattgcaccttgtccctataacgaacaaatgcactaacttaaaaaatctaagtgatccctcactgctacatttttctgtgcaaaattttcaatatggcagagaatttgatagtaggcttccctttagagctggtttctgcctgctaatctctcttaaactgcctcagtcttcctttcccctttccgttaatttttaggtgactttggtttcccctcacttcttctctcaaactataaaagaaagaaaaattactgaacacttctgagttgattcttttcttttttccttgaacctctataacttacatcatgctgttcctttaatatagatactaaaggaatatatgtgtgtgtgtgtgtgtgtgtgtgaacacacacacactttttagagacagggtctcactctgttgcccaggctggagtgcagtggtgcaaccatggctcactgcagcctcaaactcctggactcaaatgatcttcccacttcagcttcctgattacctaggattacaggtgcataccaccacgcctggctaattttttgtagacaatcttgctgtattgcccaggctggtctcaaactcctgctctcaagttatcctcccacctcagcctcccaaagctcagcctcccaggcataatccaccgtgcccagctttttaaaaatattttttttaacttatgttgcatatggccacaatcatagttaaaaagagatcaacataaaaaaattaccagaccaaatggcatgagccacactaatacactgaaatactaatagtcctcatacaagtcaaattattctgggccatcagtgaaaaaaagaatttaagaatgaatgatcaaagttaattctcactgaaacctccaaaccagttttcttatgagctttaccaattgcctggatagtgaaagcgcaggtgctccaggtcagcatggggactcgaggatccctttcatcaggtggcactttcaatccaattctataaattgttgtggcaaagagaataaccatttccttgatgctatttgaatatttaatcctataaataaaacaagaaaatttgtatgatttagtaaaaggagctacttagtaagaagtccaattaagtcctgaagcaacagaaacaatttaactgctttcaacataagtaaactgctctttgccaaattagagattagagcctccaaagatttattcagttggaaaaaaattggaagagcagaactgtattttctaaaggtagagaaacagctcttataaaatgctaatgacctacataacttcacttcctgtaaaagatgcagcaaatgctcacagctagaaggggttcaggttctaattaaaaaccagactgaacacagaaagaataaaattcagaggaacagatctaacctaacaagctttgatgcttggaaaaggaaccaaagaagtacttttgtgttgataggtatgtgtatgtgtttgtgttgtgtgtatgtgtgatatgataccatgtacctggagtgataatttccagttttctgaacttccatttataacaagtattttcagtagcaatgggatagataaacaaggatcacaactagaaaaactaccctggatactcaatattaatgaaataataatatctgatttgggtacattacatctctccaataacctaatgaggcaggatagaaggccattgcctcaattttacatgcaagaaaaatgaacgggtggtggcatggagtgacctgagacttttcagaaagtcacaaagcaagttagatgtaattttaaatgaagtctcataattctggtcctcttgtaggaccagacagaattggcatttttggtcctcttgtagggccacagagaactggcatttttgttggttaaaaatggttactcagaggcatagttcaccttaatatatattactttaatatctcaaaccacttcattttgttaatacaaataaaacaaacgagaaagaaacaagataatgggataaactattttacaaataaaaaagtaaggaaagatggaagcctacactgtttcctactcttattttcacaatcatttacaaagttctcttaactatttagatacttacgaagactcaacgccaaaactcaggatggaatggaactccaaagtagaatctcccattccttgattaaagaaaataggaattgggttttctccttataaattaaaaggaaaaagaaagaaaaatcatgaatgagtttagtctgacatacagttttctagcatttatttatttatttttgacagtctcactctgtcacccatgctggagcacagtggcatgatcatctgtagcttccatctcccaggctcaagcgatcctcccaatctccgcctcccaagtgactacaggcatgtgccaccatgcctgcctagtttttaaacaatttttttgtaaagatggggtcttcctctgctggccaggctggtcttgaactccttaagagatcctcccaccttggcctaccaaagtgctgggattacagacatgagccactgtgcccaagctttctagctttttaatactatacatgatcattttaggaaacttggaatatgctaataagcaatgaatgattaactgaagtttcgccatccagataaccactgttaacatttgggtgatattcttctgttccccatataaatattacatatatagaatttttttaagaggatgacataatactagcctgcatcttgcctttgcacctaatagatcatgaacatctttctataacagtaactttccctctattttgccatgtttaatgactgcataaatgttctcttgataaggcagcatatgttagtgaataagagtaaatgatctgaagccaagctgcctgggtttgaatcctagctctgccacttactgttactgcaaccttgtgtgaaagctaaacctctctgtagctccatttccttgtcaaattcaaatgctatttcccgacatgaaatgggttgtttttctctggttgctttcaagatttttaatctttttttttttttcaagagatgaggtcttagctgggcatgatggctcaaacctgtaatcctagcactttgggaggccgcagtgagaggatcaattgaggtcaggagttcaaaaccagcctggccaacatggtgaaacctcatctctactaaaaatacaaaaaattagcctggcgtggtggcgggtgcctgtaatcccagttacctgagaggctgaggcagaagaatcacttgaacccagggggtggagtctgcagtgagccgagatcgcaccactgcactccagcctgggcgacaaagcgacacgccatctcaaaaaaaaaaaagatgaggtctcgctatgttttgccggttggcttcaatttcctgggctcaaagcatcctcccacctcagcctcccaaatagctgggactacagacacgcaccactgtgcctggctctttattttttgttttcagcagtttgctttatgatgtgtctgagtgtggttttcttatctgcttgagatttactgaacttcttgaatctgcaaatttgtctttcaccaaatttgggaaattttcaaacaattatttcttcaaatattttttctgcattatttttcccttccttttgggacttcaatgacacaaatgtcaggttgaaaaaaaaaattgtcccatagacccctaaggatatatttttttgtcccccatctcttttctgtctgttctccagactgaataatttccactgacctaatttcacattcatggacactttacctcatctccagtctagtatatgtatttttgaaacaacatagccttgctgtgttgcccaggctggactgcagtggcatgattatagctcactgtaacttcaaactcctgggctcaagcgatcctctcctcagcctcccaagtacctaggactataggcacacaccaccaaacagagctaatttttattattattattttttatttttttagagatggggtcttattatattgcccaggctggtcttgaattcctggcctcaagtgatcttcctgcctgaacctcccacagtgctgttattataggcctgagccactgtgctcagccttctagtttactattgagcacatccagttaatttttgtttcatccagtattttttcaattctattatctccatacggttggtttttttagttcctatttttctgataacttctatctttcaactctttcaagagtgtttaccttcaccttatgtttaaggctaactagctgctttaaaactcttcgataagtttaacatttaaaacatctcaggattggcatttggttgtttttcccttgagaatcggtcagatttttctggttctttgtatgtcaagtaattctggatattatcttgtatatttggaatattacattgggaggttctggtcctgttaaaaacctctggaaacatgaacagttttaaagtgttttagaaggcaataaactcaggttcaaccagttctgtctcatcctctgtggatggtgattccaatgttagttttcagagcctgtgctgtggtgttttgatctgcccagcacatgtactcctcggggggttagcctgggacttgagtgatggtttaaatgaagcttacttctcaaaactttggctatgcctctttgagcctattctgcacatgtgcagcttggaggtgagcccaggacttgtgtggacctcaaaaatatgagagtccccttctatagttctctcctcttggggatttcccaccccagtcctcccactttctagctccaaagggcccttttccccagtttctctggccagaatgacatgtttttctcagttttagtctcccatgctgtcagtcagatttatgactgcggatgcccttggcgtgaagccacgaggcaaagacagaaaaaaatgatgaagattaaccttgtactctttggaacacaggagctccttttcccagttcctcaccacagagactggttttctcttgagattatgggcatctgcatggccaccatggctgtgcagctctatgcctgaggctggccttgggagaagaccagaggaaaaataaaataaacacactccttttatattctggctatgaggggcttcttttcctgatcctctgaccagaaagagatggcatttctcatggatttttgctgttcatgcttgttgtacagttctaggactcagctgttcttgagtgaaagttgggaaataaaggaagaaaaagcctcaggaaactcactacccgtaatgataattcttaaattttgactttagttcccatctgcctgctagtctacttttcagagacttcagctgctgtggtttttttgtatcctgtgaaagtatgaggaattagagattggattttatgaaatgtctttttttttttttttaaagacagagtctcgctgtatcacccaggctagagtacagtggtgcaatctcggctcactgcaacctccacctccccggttcatgcctcagattctcctgcctcaaccatccgagtagctgggattacaggcgcgggccaccaagcctgggtaatttttgtatttttagtagagacggggtttcaccatgttggccgggctggtcttgaactcctggcctcaagagatctgcctgcctcggcctcccaaagtgctgcgattacaagcgtgagccactgcacccagcttgaaatgtcttttaaaaagttacaatgacaagccaggtgttggtggcgggcaaccaactactcaggaggctgaggcacgagaattgcttacacctgggaggcggtggttgcagtgagctaaaatctcaccactgcactccagcctggggggcagagcgagactccatctcaaaaaaaaaaaaaggctgtaatgaccatattagttttcatctttaacctatttatttaagaagtttccatcaaggcactgttagaataaacccaatctgagcattgtctcttttgggctatgagctgtcttctaagcatggttttggccatactccatggatttgatctgtgttgttctcattgttaattgctaaatagtcactgatttctccatctctctctagctttttccttgcattcaacagttacatggaacagtattttaaaattcctaatttgttaggtttttgagctctcttttgttaagtattattttattgtattgtggatagtataagtatcgtacataatttccctttttgaaaactattgagattcttacatggcctaatttattaaccaatctgttattaataatccatggaaaggccaggcacagtggctcacacctataatccaaacactttgggaagccatggtgggagaatcacttgaggtcaggagttcaagatcagcctgggcaacacagcaagacgctgtctcaaaaaaaaaaaaaaaaaaaaaaaaaatccgtgggcatttgataaaaatatattctccaataggaacaaacttctgtagaacatattactaaatcaagcttaattttaaaaattctctaagtccttatttattaggatgacttgaccagccataaaactatctcccactatcactatgtttttgtttaattctacttatgtaccaaaacaacacagcgtgaaaataaatagaaactgaatttactatctgtcttttctcctaacctccccatatttgtaggcaatatagataaaatgcttacacattctctgcaatccttcctttacaatctcttggctgtttcttttccccaaacaattagtcattcaataagcattcagagcaaacttgtcaatgcttactattaataccaccacctctcaccatgtcatggtaggaccagtgcaactgattcctgattaatcttcttgagttatctcctcactcttgcaatctatctgcggcaccactcccacactaaaaagctaccagaataaatgctagtcacttgctcaaaaatttttaatcattccatgatttcttttttaaagttctctatttcaatagtttttccttagcttatgttcagtattttcttcccttaaaaatataggcttctaagtaaattagtgaatatgtttaaaagatactaatcactcttatgcttctttagacggtcacagaggtcctactgctaataaagtgatatttctacttaatgccatgtttgagacctccaattaaacatttagaggccaaaataacaataaaaaaactgatttaaggctgaatttttgagacctaaaaatcatgatgtaaaaccaacatgtcattctacatttttttaaataaaaagaaactaaattcacatatgtcaaagtcattttaaattactataaaaattaagaagaatctcttgtactgaattgcttctcggtgcttaaaacaagtagcaaaggctgggcacggtggctcacgcctgtaatcccagcactttgggaggccgaggcgggtggatcacaaggtcaggagatcaagaccatcctggctaacacggtgaaaccccgtctctactaaaaatacaaaaaaaaaaaaaaattagctgggcgcggtggcaggcgcctgtagtcccagctactcgagaggttgaggcaggagaatcgcgtgaacccgggaggtggagcttgcagtgagccgagatcacgccactgcactccagcctgggcgacagagcgagactccatctcaaaacaaacaaacaaacaaaaaaaaacaagtagcaaagtagttaagtacatgccaaaaatcacttcttagcaaatataagttcttttgttagaagagttttccacccaacagattgttatctcattagcacttgtggtaaaggttttgttataaaatgaaggaggaggggaaactgacaggacgttgccagactcattcattgctgactgttgtcttccatcattctgtgtttctacatgaccaagtccaaattcttacaaacctccacaactgccccatattctccactgttccccactgtgtactctcaactaaggtaggccaggctttttcaatgtctctgaaaatgccatgctcacagttccctaaaaacatttctgttttccacctgggttctcctttatccctaccacacatccaaattttatacaaggtcaaatcgaatctcattttttccatgacatcttcccttactacttcagcccctactgatcaattccttcttaaaaatcctatgagtcctattgttttatactataaaatctggctgttaatgctatttcctcttgtatcattcttaactgcgtaacatgcacacatatgaggtcaacgaggcagggaacataaaactttgtatgataacttaggctgggcacactggctcatgcctgtaatcctggtactctgggaggctgaggtaggaggattgcttgagtccaggagtttgagaccagtctgggcaacacagcgagaccttgtctctacaaaaaatttaaaaattagctgggtgtggtggtgtaagcctgtggttccagctacttgggaggctgaggtgggaggatcacttgtgcccaggaagttgaagctgcagtgagctgtactccagcctgggtgatgagcgagacctgtctaaacaaacaaacaaaaaaacaacaaacccccccaacaaaacaaacaaaaaacctttgtaacttagactatggtgatgagaaataaaaccatcaccgctatttcttcctctgtagcttttgtatacatccttcattttccttaaaagtacgtaactgaaaggacataattaaatcacaacagagggtaaaataatcagggaaaatgtggataaatacagaaagatatgaattgtagaaataagacataaatattttgagtagaatacctagaaatattcttgaatattttctaggtatggttttcatcaattttagatccaaagaggggatgagaagataattttttaaatactggactttgccttcaccctactgatttcactgcctaaaccaggggtcctcaaccccagggccatggacgagtaccagtctatggcctgttgggaaccttgggaatgggctgcacagcaggaggtgagcagcaggtgagcaaagctgcatcggaatttacagccgcttcccatcacttgcattgtcgcgtgagctccgcctcctgccagatcagcagccacattagattctcataggagcgcaaactctactatgaactgcccatgtgaggaatctaggttgcccactccttatgaaaatctaatgactgacaatctgtcactgtctcccatgacccccagatgggaccatctagtcgcaggaaaacaagcttagggctcccactgattctacattatggtgagttatataattatttcgttatatattacaatgtaataataatagaaataaaatgcacaataaatgtaatgcacttgaatcatcccaaaaccatccccctcatccgaggaaaaactgtcttccataaaaccggtccttggtgccaaaaaggttggggaccattggcctaaacaaaagacaacttttcctcactgtattttaaaaattcccactttatccttttaagcacatctccattaatagccatacttgtctcacaactgtaaagaatatgtaaataagatgatagttttaaaatgtttttgttattacaaacattactaaccacacattaatagtattagtaatagtaatggctaacatgtagcacttactatgtaccatggactattctactttacatataataactctgctaatccttcaaccaataaaataggtactattataatattattatccccgatttgcaaataagaagttgaggcacacagagcttaagtaacttgcccaagatcacataatcagtaagtggatcttagtgatttagatgaatcttggatctaagatttaaatctaagcagtttgactgcttggaataatcagatagatggacttgatagtataatcactgtctgtattgtctcctagtatgaaaaacgattaaatttaataaagcaatttaagccacttatttttagcttcaaaaacttctatttcctgatattcaagaaatctgtacttgcaaaccatattttagcccaataattatttaaaaaaataaagattctgacaccatcttcacatagctaatataaaataaatttaagcaaacctttagcatgtcttatattataacctgatattctggccagaacagtctgtatccaccgtgccagggtcaaaagttgagcaagagcatctgcattctcactgaaaaatgatatttaaaaattattacaaccatgggtacaaagtcaaatggaaaagctgaatttgtattatttccttggataaatggtcatataaaaaagttgagttcctccagattaatttcctaggtcacagaaacatgtgtctaaaaatgtagctttttggaaggggaaggaaattttaaacttacaagaaataagtcaccacccacatgccaatcacccacaggtagtaaatgtcagtaaatagaatcaccattctagttgctccagtcaaaaactaggtgttgtcattgatttctctgattccctcacaccccacattctaatctattaattaaccttgcaggttttatctttcaaatatatcccaagttcatcacttcttcctacctctcattactaccccctaatccaagtcacatcagccctcacttggattacttaaatagactcctaagtgttcttcctgcttctactcttgtgtttcatttaagtatgaattcatcatacagcagctagaagaattttctaaaaatgtaaataggatcatataacttctaatctttgctcataatcccttttatgatctggtctttgcttgctccattccatgttgccttcttgttgtgactcaaacatgatcatggggttccaaacttggagcctttgcttttttttttttttttttgagatggagtctcactctgtcgccaggctggaatgcagtagcacaatcttggctcactgcaaccaacctctgcctcctgggttcaagcgattctcctgcctcagcctcccgagttgctgggattacaagtgcctgccaccacgcccagctaatttttgtatttttagcagagacaaggtttcaccatgttggccaggctggtctcgatctcttgacctcgtgatccgcccgcctcagcctcccaaagtgctgggattacaggcgtgggccaccacacccaaccgagcctttgctcttgatatagcctgtgcttagaatttttttctcccagagaaaagcagtgattattcctcactttattcaggtctctgttcaaatgtcaccatctcagagaagagctccctgacaactctgtctataaatagcctcatgccccagtctgtcttcagccctttaacctactgctttagctttctcatagtattcctcactactcaacattttgttttatttttttattgccagtctctccttcctaaaatggacgtaaggacagggacttgagacagactgttattaagaacaaagaagggctgggtgcagtggctcaggcctgtagtccagtactttgagaggctgaggtgagtgggtcgcttgagcccaggagttagagaacagcctgggaaacatagtgaaaccctgtctctacaaaaaatacaaaaattagtggggtgtggtgacacatgcctgtggtcccagctacttgggaggctgaggtggaaggatcatctgagcccaagaaggttgaggctgaaatgagctaagatcacaccactgcactccagcacacagtgagaccctatctaaaaaaaaaaaccaagaaggactagaaacagtgttattaaaaataaaataggaatctttttattgaaagaatagtcttgagcaaaggtaaaatatataatgaactgtgccaaaatttacctatctgggcacaaatttgacctaagaagttttttttgttttcaaaaaatggaaatgtactatgactggttataaccaattttctttacagataccagtttattagttttaaattttttcgtaagtttgtattatacatttttaatcaaaatcttagttttgacagtttttatatgcttttatctttactatcttagattatattcatgctgatttcctaaaatccaaaaaaggcaaatataatcaactatatgggtaagtcgaagtatctaataaaactgctatgtataatcatgtatttcagatcctgagtaacagaattgttactatagattaaaagtgtgccagagttctaagagacctttaactagttctaagagttttaaggatcagttttctgaatttagaaagaactgctctgaagcatctgatccttaaagtcatcaaggaaagaagtagctaaatattctgttagagaacaatttacatagtttaataatcctattttgggggagccactgtgtaaaaaaggcttgtacaagaaattggaaagtcactttattatgatttcctttatctttgtcttctgctgtatagttaggtaaggctttggagtcaggtctgggtttgaatattaggtctgtcttgggacaagtaaaaactatccctagtctccaattccttatctttaaatggaaataacagtacctacttcaatggactactgtgataattaaataagataatgcagcatttgcttggtaaaatgcctaaaatatattaattactcaaatcaaagataattctttctcatgttaccacatacgttgaagaagacaatttcaatttaggtttatcaatgacatggaatattagagattagaacaactctttatttatttatttatttttgacacagagtgtagctctgtcgcccaggctggagtgcaatggtatggtctcggctcactgcaacctccacctcccgggttcaagcaattttcgtgcctcagcctcctgagtagctgggattacacgcatgtgccaccatgccaggctaatttttgtattcttagtagagatgggtttttgccatattggccaggctggtctcaaactcctgatctcaggtgatctgcctgcctcagcctctcaaagtgctgggattcaggcgtgaggcactgtgcccagccaaggttagagcaattcttttttttttttttttgagacggagtctcacattgttgcccaggctgtaatgcaatggctcaatcttggctcactacaactgccacctcccaggttcaagcaattctccttggctcagcctcccaagtagctgggattataggtgcccaccatcacacccaactaatttttttgtatttttagtacagacgggtttcattatgttggccaggctggtctccaactcctgacctcgtgatccgcccacctcggcttcccaaagtgctgggattacaggtgtaagccatggcgtcccgccagagcaagtctttatattgacccttctcgcccaacctatcacctttgaacttttatggggacataaaggtatttttatcaacaaaaccattttctttaggagaatttaggtttaccattacaaatccattgcattttaaagcaactgaaataatataaatattatactactgttatcatcatgtacaacagtgagaatatagaaatatataattaaatttccaagatgttatacaaaaaataataatttgctgttaattccatttacagatcagaatataaaaatttaaaaactcaaaatgcttaaaacactacccaaagagagatatataaaaacaaatctagtgtttctatttaatttttttagttaacatttgtccatatctctagagctatagcatttggatcttcagaaaaatgaaattaaaaataatacaaagatcattagagctatcagactccaactggcaactctaatgatggcaaagggccatatgaaaggaatgaattttttttgcatcttttctccttttgtgagtgctaaggcagaagtcagagttctattacttcaatggctgctggaaaatataaccacaatgtaaagatttgagtaaataaacattctagttctcttagagtccaaaaattaggcttttgatcacattttaaaagtataatacaagatataaaatgaaaaagtattaattcctttaaagaataaaaaacagtaatgtaacaaaaacaggcacaaattaaagaactaaagacaactttctatttgtttttgagacaggatctcgctttgtcacccaggctggagtgcagtggggcaatctcgactcactggagcttcaatctcctgggctccagtgattctcccacctcagccccctcaagtaactgggtctacaggcgtgtgccaccacacctggctaatttttttttttgtattttttgtagagatggggttttaccatgttacccaggctggtctcgaacccctgagctctggcaatccgcccatctcagtctcccaaagtgctgggatcacaggccactgcacctggccaacttttaaaaaattaaccaaaacataaattaaaatatacctgtttatcttttgaggttgcaaaggaataatggggatcacagtattgcacagagatttgcaaagagggcaaagatattctccactttccaagtcaaaaaggtcaacatgaatgcgctgctgagagctcagctgtacagcttcaaaatacctgcaaaattacaaagacacaggcccattcagaactacacatgcatctctacatgtgtatctctacttgctctaatccaagttttaaaaatctggaatttttgccccaataaacatctttagaacatacatgcaaaaacacacaagttgtaattatagaagaaacaggttgcccattattttggggacaaattggaaaatacatcagagcagatataaatttaaaataagtttattgaatcataactcatctcttgcctcaacagcatggtgatacagcatggacactactttcctcagtttctaatgatgaactgaagtagtgagggctatcatggaaaaattatatattgtaatctaaagccaaatgggtaaactctacacaaaagatttctcaggaattacatttttgaaattttatattttccagagatagaacgagaacttcttgtcctattcatcctattctatttcaaaggtacttttcacagctgtatgttttgacagaaattagatttttataaagattacttttttattatttatttgttgtgtttattaatttttttgagacgatgtttcgctcttgtctcccaagctggagtgcaatggcgcaatcttggctcactggaacctctgcctcctgggttcaagcgattctcctgcctcagcctccggaggagctgggattaaaagcatgtgccaccacactcagctaatttttgtatttttagtagagacagggttttaccacgttggccaggctggtctcaaactcctgacctcaggtgatcctcctgcctcggcctcccgaagtgctgagattacaggtgtgagccaccacgcccggccaattattactttttttacatgaatactgatgaagagcaactgattagtttatggagagcaagcacaaaggaacagtgaaaatctaaagttggtaactttacacaccactttccaactttgataataataattcatgcaaacagaattagtaattaaaactgtttcaattattcaaataagaagaaaggaaagaagacatgagaaaacatgcctttttgtggccttgagtgaacttcaatgttcctagtctctttcaagaacatgtcagaaggacaacttacttctgccagcacactgcgtgcattacatgaccacagcttcctgtataagttccatatgccaagtctggatccatgaaaagtgggtctagggcttctggtacaaggtataaaaaggagggaaaaagagagacaggttatcaggtccaaagtctaatcacaaactgtcttaggaatgtccaagcaaagtgtcacaatatcatgataggaggatatatagtaacaaaaagagaaaagtaatagtaacaaaagagaaaagcataaaggtagcctgtcagatatgattctaaaattagtatggattaataactctatctttgatttactttttaaccttgaatattgggtttaatctgcattatcttggttatttaagtgatcttctatgtttccaagataatttacttttttaattttaatagtaatttgataaataataattttaagggatacttaggggaattataacctcattaagaaaagcacagattggatctccctcttcctctctctctccctcctctcctctccctcctctccctcctctccctctccctgtccccggtctccctctgatgccaccaaagttgtgaaagccgaggctggactgtactgccgccatctcggctcactgcaacctccctgcctgattctcctgcctcagcctgcagagtgcctgggattgcaggcacacgccgccacgcctgactggtttttgcatttttttggtggagacggggtttcgccctgttggccgggctggtctccagctcctgaccgcgagtgatctgcctgcctcagcctcccgaggtgccgggattgcagacggagtctcgctcactcagtgctcaatggtgcccaggctggagtgcagtggcgtgatctcggctcgctacaaccccctcctcccagccgcctgccttggcctcccaaagtgccgagattgcagcctctgcccagccgccaccccgtctgggaagtgaggagcggctctgcctggccgcccatcgtctgggatgtgaggagcccctctgcccagccgcccagtctgggaagtgaggagcacctcttcccagccgccatcccgtctaggaagtgaggagtgtctctgcccggcacccatcgtctgagatgtggggagcacctctgccacgccgccccatctgggatgtgaggagtgcttctgcccagccgcgaccccgtctgggaactgaggagcgtctctgcccgaccgccaccccatctgggatgtgaggagtgtctctgcccagccgccccgtctgagaagtgaggagcccctccgcccggcagccaccccatctgggaagtgaagagcccctccgcccagcagccgccccatctgggaagtgaggagcatctccgcccggcagccgcccggtccaggaggtgggggggcagcctctgcccggccagctgccccttccgggagggaggtggggggcagcccccgcccggcagccgccccatccgggaggtggggggcagcccccgcctggccagccgccccatccgggagggaggtgaggggcagcccccgcccggccagccgccctgtcttggagggaggtggggggcagcccccgcccggccagccaccccatctgggagggaggtgggggggcagcccctgcccagccagccgctccgtctgggaggtgggggggcgcctctgtccagccaccccgtctgggaagtgaggagcccctctgcccggccaccaccccgtctgggaggtgtacccaacagctcattgagaacgggccatgatgacgatggcggttttgtggaatagaaaagggggaaatgtggggaaatgagagagatcagattgttactgtgtctgtgtagaaagaagtagacatgggagactccattttgttctgtactaagaaaaattcttctgccttgggatgctgttaatctataaccttacccccaaccccgtgctctctgaaacatgtgctgtgtccactcagggttaaatggattaagggcggggcaagatgtgctttgttaaacagatgcttgaaggcagcatgctcgttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccctctcggagaaacacccaagaatgatcaataaatactaaaaaaaaaaaaaagaaaaaaaaaaaaagaaaagaaaagcacagattgaggatttcaaattctggtttcatcacttgtaactcatggccatgggtaagttacttgacctctctgtgcctcaggtccttcatctataaaatggaactaatagtgataactaactcatagggctgttgtgaggattaagtaagtaaatacacataaagcacttaacaagtgcctggcaatgttaagttttcaataaatgctagtctttattatcactattattccaaggagcttgttttgtttgttttgagacagggtctcaccctgttgtggaccacaggctcatgcaaccatgcctggctaatatgtttgtaaagacgaggtttcgccatgttgcctaggctggtctcaaactcctgagctcaagtgatccacccacaccggcttcccaaagtgctgggattacaggcgtgagccaccatgtctggcctattccaaggatattttaaaataataatgatgctaaagcagctaattcctgatgtaataagtgcaataaattatctaattagcattcctgccaagaaaatgtttaacatgattctaatcaggaggcaacttaacaatcagataaattcagaatgtgacacattatacaaagcaagtggcctgaattcttcaaaaaagctactatcataaaaaaaggagggactaatctggattaaaatagagtaaaggaaatatagccaaagcaacacgtgtttgtttggatcctaagtgaaaaaaaaagtctaggaattgaagacattttgagaactgttggagaaaaattgattttatattagataatattcctggattattattactttcttaaatatgataatggtatggtagatatataacccttatttccaaatgtttttcaaatagtattttctttaattacacaggcatgaaaagaaatgcacaaaaggatatttattaaataatacatacctcctgagagttctatgggttttcccctgtgctgggttaaggcagtagatttctggacacaggccgataataccatggcattattttctattttcacctcctgttcttcttggcaaaggatgcacgtcagcacctccttttcagtaacagatggaccccgtttaggacccaaagcaattctagagtagtcactgactgctggggtgctaccaaaagaaatgatcagaaatgaggacacatgttttggtcacttgtcttcatattttggtagattttaagtaactataggcaagaaatataagaaagataataaaaataaaaatgatatttagcaatattaagttaaaagcttccccctttcctttgtggcttttatcagttatttgcttattacaaaatacaagtgttgctaagtgcaaaaaacagatgataaaatggaatgtatattataattttacttaatttactataccaataagctgggcttttttttttttctggatataaaagtaatacaggcttattgaataaattttggaaaatctataatagtataaaaaagtgttatattcccacaacctagagatacctactagtaaccttgtatatttccttctaggtctgctttctatttataatatacttcttcatataaataagatcacattacacagatctgcatcctgctctattcacttatagtatcttacatcattaaaacttcttcagaaacattttaaatggttgcacagctcttactgtatgtgccataatagtttttatccattccctgtcattaggcatttaggtttctattctattttggtcgctattcaaactaaaaaacttacaccttaatgattcagcaattcttagaatctactcttactgactgggcaaaactcaagatctactgaggcgtacaataatatttaaataatagcaaatatttgtaacatgctgattgtgaagctaggcactgtttcaaatactttacatgtttactcaatccttacaataatcctatgaggtaggtggtattattctgtctagagcagctcctgcaaagatgtcgctgcagcagtggaggcgtggctggggcaacgtgctccatgtagcccttgggttgggaacaggagggaaccccaccccttccaagtttgcagggcagaagccccgtgctcccgggcacagctgcaactgcccagctcagaagtgcgtgttctgagcctctccgcactcccaatgcccgctccgattttggagcaaagctgtggccaagcccaggcgctgccgcggccccggccaggtgtgtgcacactaggggcggtgctgacatgtcagccccctcctgccttggacccctctggtctttgggtgctgataagcatggaaggaaggccaagaggaaacaggtggctcagcatgggcctgcaggtgccccttggcacaaacagccagggagttgtggatgatatgttgatggcggcaggaggcagacaggttcctaggcagaaagggatgggtccccaagccaggaatggcctgaagcctggggaccggtatgtcagttacaggtggaatccacagcctggggtgagaatttatggtgctttctccgggtctgtccatgaaccagtcagcacacactttctctcttctgaagcccctaaaaaccccagactcagccagactcacatggagactacagctgcaggaaggagctacccaattcaagtctcctgacttgctgggatgacctgcctgtggaaaggagatacccactctggatctcctctccactgagtgctggacacttgttgggatgacctgcctgcagaaagagctacccactttgggtccctagagagctgttctgttgcttaataaagctctccaccttgctcaccctccagttgtccgtgtacctcattcttcctggatgcaggacaagaactcgggaaccaccaaatggcaggactgaaagagctagtaacataaacagggctgaaatgcccacacccaaagcttgccacgttgcaggtgacaagaaggagagaagagctgtggtcctttggggagcccacacctaggggctccctgagccagggctgtgacaccctctttggggcttcacagtttctggcatctctgagctgccaggtgccaccatattccccttgtccagacaagagtccctgcagcggaacctgctggtgcatatgatccagctgcaggcttgcacagagctggcccctgtccctgtgcctagagctccctgccctgcacagcagctggcgtgcctggctgtgtgcagtggccagaccctgcaggtgcccgcttatgcacccctggtcactccacacctggcttgcccttggcaggcatgggatccaggctggtagtgtcagtcaagtgcagcctgccaggccaagtgggcaggatgagcccagaaagaccaagcaaaattctggcaaaggtgccactggccacagaggtttctggctggaaaagcaacaccctaaggatcctgtgatacttccacttttcagatgaagaaactgaggcctagtgacaacaaaagactcaacccaatgattcatcaatagtatgtagtagagccaggatttaatccaggtaatctaggctcacagtccatgttctgaactactatacaatgttgtctctgtctgtgcaagaagctccctgaactatagtatatcattgaacaataaataaatattaatcatcatatatagatgaacttacctaacatagaatactctgcagcttttttgttttattttgtttgagacagagtcttgcactgttgccgggctggagtgcagtggcgcgatctcggctcactgcaatctctgcctcccaggttcaagtgattctccttgcctcggcctctgaagtagctgggattacaggcacctgccaccatgcccagctaatttttttgtatttttagtagagacggagtttcactatgttggccaggctggtctcaaactcctgacctcgtgatctgcctgccttggcctcccaaagtgctgggattacaggcgtaagccactgcgcccgccctactctgcagtttttaaaaggtgggactcactaagtgtggtaccacctcctaggaggcatctagcaataaattatgaaaggtttacttattgattgtcacaaggttctagtgggcgcaggatgcagtcccacaattcacaggacagtactacatgaaaaaaaaaaaagctgcctaaatgccaagactgaaaaacgctgagcttgttttgtatataagaacatacatagatttccaagacatactacagagtgaaaatgggaagttgtagagtgatatggacataatactatcaatgcaaataaaaccaaaggctgaatgacacgctataatttctgtggctacatatatttgtattaataacataggaaaaattctggcaagatacacataaaacttataaccagagaacctctgaggaggagcagaaagaagtccaggatttgggctggtgctcaaatggaactttagctttatctctgacattcagttttcaagaggaaatataactatgtaatttggctgggcacactagctcacgccttgtaatcccagcactctgggaggctgaagtgggaagatcacttgaggccaggagttcgagaccagcctggccaaaatggtgaaaccccatctctactaaaaatacaaaaaaaaaaaaaaaaaaaaaaatagccaggtgtggtggtgggagcctgtaatcccagctactcaggaggtggagaagggagaatcgcttgaacccaggaggcggaggttgcagtgagccgagatcacgccactgtactccagtctaggcgacaaagcaagactccatctcaagtgtgtgtgtgtaacactatgtaattaaaattttagctaggtgtggtgacacgcccatagtcccagctactcaggagggtaaggcaggaggatcacttgagcccaggagtttgaggctgtagtgtgtcataattatgcctgtgaagagccactgcattctagcctgggcaacatagtgagaccccatctcaaaaaaaaaaaactggttaaaaaaatatgagagaatatatttgagactttggaataggaaaagctttcttaaacaagatattaatacaaaaagttaaaactctaaaagactgataaatttgtctttatcaacactgcacacttctctatggctaaaccccataattaatgttaaagaaacagggacaaaatatggtaaacatatgtaacaaagctaagtattaataattttaagacttatataagtcagtaagacaagaggaaagcacccaatagagatgggcaaagaataataataggcaattcccagaggataaaatgtaaaaggtcagtgaataatcatatgagaagctgctcaacctagtactaaatagcaattggggaaattcagccagattggcacaaatctgtaattttaataatatcacattttcaagtactgaaaatagttaagtattagtgagaacaaagtaaattaggcacgtatatacactatcaggagcagaaactagtaaaaccactctggatggtaatgtggccacatctataaaaattttaacccagccctttcacttactggactccttgactaagtacttgcagagttccacaaggagacacatacaaaaagattctcacgaacagttctaaggaaaaattagaagcaacctaaatgtctaaagtcagatgaataaactattatataaccacatcagagaccactatgcagcagtcataaacaatgatgtagaatctacattataggccgggcacagtggctcacgcctgtaatcccagcgctttgggaggccgaggtgggcggatcatgaggtcaggagatcaagaccatcctggctaacacagtgaaaccccctctctactaaaaatacaaaaaaattagccaggcgtggtggcgggcgcctgtagtcccagttactcgggaggctgaggcaggagaatggcgtgaaccctggaggtggagcttgcagtgagccgagaccgtgccactgcactccagcctgggcgacagagtgagattccgtctcaaaaaaaaaaaaaaagaatctacattatagagtgacatgtactgatatcaaaagattcctaagacactgaaatagcaagctgcagacaaaatgtatggttaaaaaagaaaaaccactagaaaacacgaaacaagcctcactatttcttcatgtatacatgtttataaatgcatagaaagaggtctaagaacaatgataatttgtaatcatggttatgtgtggagaaagatcagtaatgcagagatggtcaaagggggacttcctgcattatttaaattgctttcaataagaacacattcaaaaatcacatgtccaattaatcaagcaataaaaataaataatgaaagcattaaggccataaatgaactctgagtacacctttgcttacaccttcttattttattgtcagtagtttctttctcactatttctaaatagtatgttgttaatacataatatctagaggtgggactttggcttgtcatttaaaatttccagttttattaccctatagtcagccaaggaaagcataccttcatatctttttatttttaatcactaatataatcattattctttatggtccttgttagcatactcagcttcaagattaaagatacatatcagataggatgtattgtgcctactagtattccaaaaccaaaattttctaaaagtatccacaagattttttttttgagatggagtctcactctgttgcccaagctggagtgcagtggcacaatctctgctcactacaacccctggctcccaagttcaggtgattctcgtgcctcagcctcctgagtagctgggactaaatgcacgcgtcaccacacccggctaatttttgtatttttagtagagacggggttttgcctgttggccaggctggtctcgaactcctgacctcagatgatccacctgcctcggcctcccaaagtgctgggattacagaggttagccactgctcacagccctcaacacatattgttttaaacagcagtgaaagcttgtctttaaaaagggccaaagtgggtactttcaatattttaaatttcttggaatgctgttcaaagtaacattatgtctcctcccttttatcactgtataatagcccacaaagcacagctcagaaaattaaccaatttctctaagagcataccacagtcagaactcagaaaaccagatttactgattccaattccaaggtgctatccatacctgtagttataggcaatgtctttcttctaagaaaaaaagaaaaacttgtataagccacctttttcaggcaaagaatttgtttccaataatgtaataactgcagtcatttttattagaaataataatgtgaaataagtgaactgatgtgtaaatgtgtacctaaaagtgctaatgcacacaaaataacgggttggttatctttttgtgcataaaggttcctaacctaactttactgcacactcaatgcatttatcagtataaaattatattcaataagtaccatagagtcttcactctgacctttctagaatgaaaatagttgaatttctcttgccataaaatccattttggaaaagcaaaatttaaagtgactatttaacttttcctccaaaaattgagttggcctctcctcctccccttccccctccccctccccacggtctccctctccctctctttccatggtctccctctgatgccgagctgaagctggactgtactgctgccatctcggctcactgcaacctccccgcctgattctcctgcctcagcctgcagagtgcctgcgattgcaggtgcacgctgccacgcctgactggttttcgtatttttttggtggagacagggtttcgctgtgttggccgggctggtctccagctcctaaccgcgagtgatccgccagcctcggcctcccgaggtgccgggattgcagacggagtctcgctcactcagtgctcaatggtgcccaggctggagtgcagtggcgtgatctcggcttgctacaacctccacctcccagccgcctgccttggcctcccaaagtgccgagattgcagcctctgcccagccgccaccccgtctgggaagtgaggagcgtctctgcctggccgcgcatcgtctgggatgtgaggagcccctctgcctggctgcccagtctggaaagtgaggagcatctctgcccggccgccatcccatctaggaagtgaggagcgcctcttcccggctgccatcccatctaggaagtgaggagcgtctctgccgggccacccatcgtctgagatgtggggagcgcctctgccccaccgccccgtctgggatgtgagtgcctctgcccggccgcgaccccgtctgggaggtgaggagcgtctctgcccagccgccccgtctgagaagtgaggagaccctccgcctggcagccgccccttctaagaagtgaggagcccctccgcccagcagccaccccatctgagaagtgaggagcccctccgcccggcagccaccccgtctgggaagtgaggaccgtctccgcccggcagccaccccgtccgggagggaggtggggggtcagcccctgcccggccagccgccccgtccgggagggaggtgggggtcagcccccgcccggccagccgccccgtcccagagggaggtggggggtcagcccccgcccggccagccaccccgtccgggagggaggtgtgggtcagcccccgcccggccagctgccctgtcagggagggaggtggggggtcagcccccgcccggccagacgccccgactgggagggaggttgggggtcagcccccgcccggccagccaccccgtccgggaggtggggggcacctcggcccggccgcccctactgggaagtgaggagcccctctgcccggccaccaccccgtctgggaggtgtacccaacagctcattgagaacgggccatgatgataatggtggttttgtggaacagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggtcacaaacactgcggaaggccgcagggtcctctgcctaggaaaaccaaagacctttgttcacttgtttatctgctgaccttccctccactattgtcctatgaccctgccaaatccccctctcggagaaacacccaagaatgatcaatttaaaaaaaaaaaattgagttggtaatttttggtttgctttattttacctctcttcctccataatggaatcttctttcccaggcatttctgatgtattgtcatacatgagtttatgagtttcaatgaagtttttctgtaaggcagacatctgagccatgatcttctggcgatgtagcctagcagcttcagcttttctttttcgttctgctttttctttatcatgagtaatctgggtattaagaaatgacaaatttaggtaagatccactgttaaacatttatatacgctgtttggatggcaaaattccttagaataagattctgaaaccctgattaccccttacatcctggattcagtttaatgtttcaaaattagcattacaggctgcatgacatcatacaactaattattcctttagttatttaaataatttactgtaaaaagctaagaaccttaaatatccaattaactgccttttatactcaatgcaggtaccttaagaaataaaattagataaaacaatttcaaaatcatttgtcaatcacttaatcactgacaatttaaacaatcttgatttctaacagttacttctaaatgcactgtgaaaaatgagaaatttaacaatttttttaactttaacaatattactgagatacatttggtgcatgttaattttctattcaaatttacatcgtgtgttttactgaacatgtaataaccacaaataatattattctaataatacaaattttagaatcatcaaaacctgattcactatattatagcaataacacaaatattattgcatttcattgaatctaagatataccattatcttatatttctctaaaacatgctgttgatgaaagtcatttattgtgagacatatcccaatttaagtcactaaaatatattaaaagttaataaaatatggtattttggttttttgtttttgggatggaatcttgctctgtcaccctggctggaatgcagtagcgtgattttggctcactgcaacctccgcctcctgggttcaagtgattttcgtgcctcagcctcccgagtagctgggactacatgagcaagccaccacattgggctaatttttgtatttttactagagacgtggtttggccatgttggccaggctggtcttgaactcccgacctcaagtgatctacccacctccgcctctcaaagagctgggatttctaacagagctctacgatatatcaatttctcctgtttttgcaaaatacaaaaattatactgagttgtcacgtaccattaatctccacaatatagaagcataatgaataaaagatggacagatctcatatacttcacaatcaacaggtttctcctaacaaaaaagcagtagctcccttataccagtaaagttcaaagacagagatgaatgtcaccattactacagtgttattacagtgtcatacctcatcattcttaatagattccgatcctgatgtggttgctacaattaaacaagatttttctcttaatcgcttcactgtgtcaaacatctgtgaaaaacagatgaaacgttaaaagagttagttagactgttagaccgaccaggaacagaaacattcactaatctgattttggcatcatatctccaaatgtctttcacttaaactatttcaatatatgaagaaaaaaagtgactctgactgtgacaaacgcctcccctggtcaatgagcaatccagctgaggaggaggccactggtagcagaatcagcagattcagtaggctgggggcatgcctctgttagctttcaagagatttgccaggaaacaaaaatttttttaatttgaaataatatttttgtgcaaaaacacataaaaacaaagacacaaaatggtgactgctctttgggaggcggaggcgggtaatctcagcactttgggaggccaaggcaggtggatcacctgaggtcaggagttagagatcagcctggccaacatagcaaaatcctgtctttactaaaaatacaaaaattagctgggcgtggtgacccatgcctgtgatgccagctacttgggaggctgaggcaggagaatcgcttgaacctgggaagtgaaggttgcagtgagctgagattgtgccactgcactccagcctgggtgacagagcgagaccctgtctcaaaaaaaaaaaaaagatacaaaatggaaagtaaaatcctcctctccctgattacaacacctctatcagaatatataatttttatatttacatctattttcataaaaagagatcttaccatacatactgtttcacacatcctcttttcacttaatcatttatcttcggagacatttcgacatttcttttttggtttgttgttttttttttttttaacagggtcttgctctgtcgcccaggcttgagcgcagtggtgcaatcttggctcactgcaagctacgcctcttgggtacatgccattctcctgcctcagcctcctgaatagctaggactacaggtgcccgccataacgcccggctaatttttgtatttttagtagagacggggtttcaccatgttagccaggatggtctcgatctcctgacctcatgatccgcccacctcagcctcccaaagtgctgggactacaggcatgagccatcgcgcccagctatcctcggagacatttccacaacagcttatacagaactgcctcattcttattaacaaagctcatggtttcagcatgaatgcattcattaattcattaattcattcattcgacagagtttcagtctgtcgtccaggctggagtgcaatggcacaatcttggctcactgcaacctgtctcctgggctcatgccatcttctcacctcagcctctcaagtagctgggactagaggcgcacaccaccatacccttgactaatttttgtattttttgtagagatggagtttttgccacattgtccaggctggtcttgaacttctgggctcaagcaagccacccaccttagcttcccaaagtgctggaactataggtgtgagtcactgtgcccagtaaaatttatttatattttgaaagaaccttggtctcatgaggaaaaatttcccacaatgaacacctacaacatagctttaaatcaaccatctggatagagtatctaatgtttttaacagcagatacatgtgcttttcagatattttgataataaaatttagtattctaattgaaaatgaattttcaggactagatctgcaattcataacaccatctctatgggatatgaatgctgaactaaatggtacctcgatttactttcttaatagttacctactttcgtttgattttataatcttaaaataatattggctagtttaacacaaatactacatattcataaaatctacttcaagaagaattttaataatatcactatctttttttttttgagacggagtctcgctttgtcgcccacgctggagtgcagtggtgttatctcggctcactgcaagctccacctcccgggttcaagccattctcctgcctcagcctcctgagtagctgggactacaggtacccgccaccacacctggctaatgttttttgtatttttagtagagacggggtttcaccatgttagccaggatggtctcgatctcctgacctcgtgaccccgccgcctcagtctcccaaagtgctgggattacaggcgtgagccaccacgccaggccaataatgatattacatcatgcttaaggactgtttctaataaaatggtaagaagagctgccctcttaaaagtataaatcagtaccaagatttccaattgataagaatgtgaaaaataactactttatatattctgattatcaaaacaatacttacctaaaaacatcagaatatcttaatgaatgcaatgagtgcagaagctccataatcctggcttcaggtttttttttttttttttttgagacagagtttcactctgtcgcccaggctggagtgcagtggtgcgatctcggctcactgcaacctccgccctcagagttcaggcgattctcctgcctcagcctcctgagtagctgggattacaggcgcctgccaccacgcctgccaccacgcccagctaattttttttttttttttgtatttttagtagagacagggtttcaccatcttggccaggctggtcttgaactactgatcttgtgatccacccgcctccgcctcccaaagtgctgggattacaggcgtgagccaccgtgcctggccggttttatgtttctatgtggaggttttccattaaagtaacattcctggcctctctctcccctgcttatttaattcactcgtctccaaaggcaatgctatctactcaatagctcaagcaccaaatccaggagtcatctttgatttccttttttctgagacagactcttgttctgttacccaggctggagtgcagtggtgcgatcttggctcaccgcaatctccacctccctggttcaagcaattctcctgcctcagcctcccaagtagctaggactacaggtgtgccccaccatgcctggctaattttttgtatttttagcagagatgaggtttcaccatgttagccagactggtctcgaactcctgacctcaggtgatctgcctgccttggcctcccaaagtgctgggattacaggtgctagccaccatgcccagcctcatctttgatttatttccttcatctctcccatcagactgatgagcaagtactatagattttatcttcatacaccttcgacatgcaccttaatcagttcagattcttactatctgcatcttagcctaggtcatgcttatttcatatcaagattactgcaacagtctcctaacagtttccttacttgtatgcctatcccccataatccatttactccacagcagccaataccatcttgtacaaatatagattaggtcacttaaaatcctccaatattttcccattgtcctaaaaaattatcactttatgctgacttataaggacctacaagatccggcccctggccacccctctgatctcattgcccacttttccatccctcacccattatgttccagccatactgaccttctttctggccaccacagagcttttgcactgctgttccctcttcctggagtactcttccagactcttctaagactgactccatgtcattaaggtcttagctctaatgtcgtgttttgagagaggccttccctaattacccaaagtaaccccttactcatctattgaattaccctgatatttttgtttatttatttgtttaatgtctgtccctcaactggagtatatgttccatgatagtaagcaccttgtctgccttgttccatctagaaatctataagtgagcatggcacatggtaggttttcagtaaagttgactaaataacgacaaaaaaaatgaataaatcttagtttatttttaaaactacaataaaatataggaaaatagaattattaacatgaaaaataagtgattatgaaaaccagtagtaaatgtctacaatggtacagtggtttaacactggaggcaagcagagaattcttaaatatttaaaccaagatatgatcactttacttttttagtttacctgaagtatccacgttatcatgtccttctggccttctaactggggaattcctttgagtttttccaaaagcatttgtatattcatggctgaacttcccaatccttttttaaaacacaaaatcacacatcataaatacataaagtcatctcttggtatcctcagggaattggtttcaggacccctgtggacatcaaagtccactaatgctcaattcccttatgtaaaatggtgtagtatttgcataaaatctatacacatgcttctgtatgctttaaatcatctctagattacttataatgcctaatacaatgtaaatgctatgtaaatagttattagataatattgtttagggaataatgacaagaaaaaaaagtctgtacatgttcagtacagtgacaaccatcctttttcctttttccccctgaatattttcaaactgcgatgggatgaatccctagatatggaacccacagatatggagggtcaattatgtcttcataattatgtacaaattacaatttctagttaatgttatttacattgataaccaaggtttgccaatcaatcccttaacttcattaattattcaatggacaaatctgcaattatatgaagtactggattacaatgatatgatctactaaatttaaaaatgactttaagtctctctcttacatcttttactggcactgctaagtgaaagctaccctaaatatctgtctctggtctttcctctgcttgactcaacatctaagcaaaagtgcttaatgagaaacaaaattgccaaaaatattgaagtggaggactgtatatccataaactgaataggtttttgatgtcttcagggatctaaaaaatacagcatgtaaatagaaaatgtttgtctcctattgtttttataatcaacatgcctggaatgtgctttgaaaaaaactatcttaatcaggtagcatttattagaaatctaatttaaaactatccttttcttccaagttgaatacaacgcaaaatgaacgttatcattcagatttctatcatttaaaattcagaaacaatatcttattaagacatgtcacttgaatgctatggttgacacagcagcaaatatttgataatactgagatgaggaatgaaagttaaaaaataccaatatatgcaaccaaaaaaaaaaaaaagtggggcgatcatgtagtaaaaagattgtagtaaagattatagtaagggattaaaaaatatattagtatacttgaaaatattagttacaaactaagaatgctaggaaaaaaattatttcagggttacctatgttttaaggactgacagattaaaactctgtaagatataaactttcaggattgacaaattaaaactccttaagatctagactttcaatgacaaatgtgttgaagagtgatactcaaacatacttgaagccttatgataaaagtcaaatgttacttcttcttcaggagctttttgaagctgttgcttctcttctagtaaacccaatgccagaatatgaaaagcctgaaggaggaaaataagagatctttaaaattgcgcttcttcaggtaaatatatttttaatttaattttaatttttttcagagactggtctcactctgtcacccaggttggagtgcagtggggcaatcctagcttactgcagccttaagctcttgggctcaagtgatcctcctgcctcagcctcctgagtagctggggactagaggtgcacacgaccacgcccagctaaattttttttggagggggcggggggtatagacagcatctcactatgttggccaggctggtcttaaactcctgcgctcaagtgatcctcctgcttcagcttcccaaagtgctgcaattacaggtatgggccaccatgcctagcaaggtaaatctattttaagtagaagtataaaaataagaaagctgataggtaaaaaacacggaaaggtttcagcagttcacattaagcagtttacagaaagagaaatgatgaatacacatatgaaaaatgttcaacctggcccggagctggtggctcacttctgtaatcccagcactttcggaggtttgggtgggtggatcacctgaggtcaggagttcatgaccagcctggtcaacatggtgaaaccttgtctctactaaaaatacaaaattagccaggtgtggtggtgggcatctgtaatcccagctgcttgggaggctgaggcaggagaatcgcttgaacccagaggcggaagttgcagtgagccaagattgtgtcactgcactccagcctactccagcctgggtgacaagtgaaactccatctcaaaaaaaaaaaaaaaaaaaaaaaaaaaagttcaacctcacttaaagaaaaatgagttgaaacaagatcatcctatttttcacctattacagtggcaaaaattttggtgtttagtaaaatatagagctggcataggtattgggaagtaggcacttttgaccatagtggtgatggtaaagtaaactggtataacatttttggaggccaatttgaaaacatctatcaaaaatgtaaaggtatataccaactattaggaattagtatgacaaatacgctcccttaggtatgcaaaaacatttgtataagaacgtacattttattgttctttgttacagcaaagacctagaaacacctgaatgtctattaataggagactactgaaacacattatatccatacaatggactacgcagctatcaagaataagtagatctatatgcactaatgtgcaatgatttccagaatatacaaaactttaacaatgcttatgtcctatatagcatactgggactcagggagagaaattttaacttggtttcaaacatatctctatggtttgaaatttactagtgaatgtatttatcagtgttataataaaaattgaggcacacatatggcaatgacagcatttagaacctgtagaccaacaatactcaaggaaaaaggaacatttagttaggcaggtataaataaatatggtgttacaactaccatgacgtggcataattaagtaacgtgtatttatctacaacagtaacaaggaaaagtagctgctttcactttagctaattctcctacctctatgaataattacacttttatccattttactaatgagaaaattattatttgctccttaaataggaagtggggaaacccaagactgacgtctagacctatcttcaaattttattatactgtctccttataattcaagtaaaattaaaaatataaaaaatcatgacacaataacaacatgtcaatttattagcataagtacacctgtttttgttttcatgggttttattaaacagaaatggttcccaagagtaaggatgctaaaaacacgagatcactaaaaaaaatttgtgctgtgtgtaagctatttttaatgacccctatgtttccggtgctctagatgtggttccaactgaagttagacctgagatcttccctagctccccaagaactctaggacttgatgtagagaaaatatttcaggtaaacaaaccatttggagcatcccttcggtccacaagttagaatctgtgtctattgcccgctcaaatacggtcctgagaatgtacatcatgatatcacagttgagaaggttaatcactttgctgaaagcagggcagaattcaggaggtggtggtggcggcaatgctataggaggtggggaatggatggggaaagagacaaacaggtacatttttatttgggttatcctacatactaaagtgcaaatgtcaaaaaataataggttacatgcaaaacaacacatgcttttttgctacctttccagtactgaaaatatcaatgttaagtgtaatgtaagtactatatcagtcacccaaaatgaactacatttgttatcaattttaaattcaatcactactgatatataccatatcttaatatgtgaataagaagcaaaaagctctttgcacttccttgagttgcccactctcaaaaaccaacaacaacaaaaaactatatgctttgctgatgtgaaaccacagaaaatagtcaaaatgagtcaattcagaatctcactttttaccttcatctttgttttcttgttttctccttttcttctgcatatgttcagcctataaaaaaatctatcattaaatatactgctttggaagcatgaaacaaatgaaatacattaaagcagtcaggaaagacccaaccacctattaaaatactttatatactgaagcatgtattcaaaatgcctctttgtcctagaaataaaattgtgttctagagaaacctaatgcaaaatagatgaggaatatccctgatcaaaaacttagtctccattattttctactgaaaatatttacccagtacctattatgcacagggtactatgctatgggctgtaaagtatttacttgataaggacaaagccagacatcaccttaactaactgatcaaacttaacatgatccttcatgggacaaaaagacgtatgtgcctaataatgggatgcaatatatcatttacatagtattcttgccaaaaactgtttaagctgaatctatttggtactctatagaaatgccgatgttacaaaagaaaaaaatgcaaaagaattatcttctaaattaaaggaaactattggccgggcgaggtggctcacgcctgtaatcccaggacgttgggaggccgaggtgggtggaatcatttgaggtcaggaatttgagaccagcctggacaacatggtgaaacccggtctttactaaaaatacaaaaattagccaggcatggtggcatgtgcctatagtcccagctactcaggatgctggggcaggagaatcacttgaacctgggaggtggaggttgcagtgagctgatatcgtgcaactacgttccagcctggacaacagagtgaggctccatttcacaaaacaaaaacaaaaacaaaaaacaaaacaaaacaaaaactaaagaaacatgacaatcaaatgagtgtgtgatgatgaagtccatgatgcttgattgaatcctcttcccaaaacagctattaaagacatatgtagtataatcaggaaaatctgaatattgcctgtatactagataagattattgattcaattttaattcttgggtgacataatgacctctattaataagaaccagcgtgaaactatagaaaaagcagaaaattttctgtggagttagaaagcataaagcatttaggtttatttactgaaaaggatacttttttctaccttgctatgctgggttttggagtaatgataaaagtacatattgaagtctttcagtgattcatcttttagttcataaactccatggcctgatacacctggtttcctaaatagatggaaaatacaagatgaactgcagtgttcttgaagtataaaatatagacaaaataaaaacctaaaaattaatctagaagtcaaatatacagaaaaaaattatgtctcatttagcttatgaaaaattccattgcaataataaaactaaaaacctacattgtgaacacaaagcctgataacagctaagctgtgttttataataatgaaattcaaacaaatctggagaagtttgttttatactatctagaactgataccatgccctatctctaaagcttcttagagatttaagagtctctgatgcctaaaggttgtctgttcaactaaagaacacttcattgaccttagacacttcattgtctaaggtcatatctaaaacagtagggagacatcataaccttagtaatttgcaaatgaaaatatactactgaatcctttatatagtactataaggaaaatcactgaggtcaaaaggagtactccatatttgttctaaacattaaacagcttttggtttctatccaatctctaagtcgaatatttcaatgaacattactagatcataagaaaagctataccctattttaaaagttatttgaaactagtaatgtatctgtaaacacaatactgtaacaagtagaaattcactatcagtatcgatttttcaaatttcaaagattaatacaattaaatttgtatttccattttatatactgaaatgaaaatattataaaatactgttttaattctaccagagaataatccaaaattagcatataaaataaaaatttataaaataaatgaaatcatgggttcagattaatgggaaagagagtatcagaaaagttcatttacttactatctaaataaatcacctaatatcataaatgagtatttctcattcacttgccaaaaacactcattttttcaacaaacaggtgctaagtgtctactgtgagcccctcattctcaccctttctaatctgtattccactcttattcttgggagttcaggcaagaacttcagagcttctacaaagtatccaaagtacaagaacaaagatcaaactaccttttagaataagcataaatattaagcacttacttaaatgtggccactttgtttatgacattctctaagccagtttcattattttcctgttgaaacaatatttttgtcatttttaccttcatataatgacttccacctctctgtgaagtgaaatacattttctactgcatctctgaagtactttgtaaataattttaaaaagatcaatttccactattaaaaaattaggtctaaaaccaattatctacgttttgggagaccaacttcgtaagaggtaagatgtatatataaactgtttaagaaaggttatctaagtttgccttcatatgtgtgtataagtacacacatacatctacagcatacacacatagtattaccaatacttcaaagaaaagaagctcttctttatgtagtatgttcatcaccctcatcatttatgtacatgcccatgctgtattaatccctaaaaccaaggtaacaaaattaatgagctccaactagttaatctatagcaatacatgtctagatgtcctaatatattctaccttttgcaagtttttttctgattgacctgatcttttccttaaatagggaacactatttttttacaaagtcatttaaaattaagataaggacctagtcaaactactacagtaagctcacagattcctgtaggcttgtaaagataagaaaggtaacctcccttaaaaatacatatatttggccgggcacagtggctcacacctgtaatcccagcactttgggaggccgaggcgggtagatcatgaggtcaggagttcgagaccagcctggccaacatagtgaaaccctgtctctactaaaaatataaaaattagccaggcatggtggtgcgcgcctgtagtcctagctactcaggaggctgaggcaggagaatcacttgaacacaggaggcggaggttaccgttagccaagatggcaccactgcactccagcctgggcaacagaccaagactccatcaaacaaaaaaaaaaaaacaaacaaacaacaacaaaaaaatatatatatatatattccttggccggatgcagtacatcacacctgtaattccagcactttgggaggccaagatgggtggatcacttgaggtcaggagttccagaccagcctggccaatatggtgaaatcccatctctaccaaaaataataaaaactagccgggtgtggtggcgtgcacctgtaatcccagctactcgggaggctgaggaaagaggatcgcttgaacccgggagacggaggttgcagtgagccaagattgtgccactacactccagcctgggtgacagagcgagacttcgtctcaaggagaaaaataaataaataaaaacaaatacacacacacgcacacacacacacatctctattctacctctttggaaagccttgacagcacaaataagtataattattttttaagaatcatttttctaactcatattcaaatctcagagggaaaaaacatgagactcataatctgtaggactattaccacagtatctgtatatacaaaaatacaaatgccacctgtggtggtcatgagaatgtaccttgcagacatctgattacagggagtaaataaccacgtgcctcaactgctgtgctctggtgaaactaaggccaagcttctcaccagtcattaccagacaatgagcaaggcagagatactaacgcaggctcattctgggagacatggggagggacagatggaaaggccattgaagcccagcagtctgggatgcttctatgtaactttccttccctctttatttcactgggaatcagattggcatcagaatctgatggctccccttgtcattcccagatcccttaccattgcctttaataaaaatcttaatgttttgtcacaagatctgcttctcagaagacccagattaacacaccacccagtttcagaagttccctttcaagaagttcccttttttcctctggagtaatctttattttaaagtaaacaaaaagtaaaggagtttctcccagaattaaaatttataccactaaaggatgaaggtgattggtttacatctataaggtaatgatataggactttttgcctaaaattttgaagtagtttccaattaaagaaaaagaaacatctaccccatcttgaggtacatagagataaaaccaaaatcagacttacattctcaggtaaatttttggcaatggcactgtgtggcatgggttcaatgcaaagcaagtgaatgatttctctcattgtgacctcttctttggtcacatttcccactccaggtacataacgctcacctagttcaaataattaaaaacaaaaaaaaagtagaataattattttctatttaaatctctccccatcagaagcacttacacacagaacactgcattaaattaaatctgtgagagaggggcaaaagttatttgaatgtgttcccaaatctgaataagaatctatgttgaaagacagaggcagaaaactgtgacctgaaggagaatccaggccttgtcttagcttacttacacacatacaaacaaacacacatacatatacatacatattcgtatacatacacatacacatactcacacattataaacaaggcccctcaaataaattagcatgtgtttctaacccagaacacatggctgatggcatctgaatgagcagtggccatcactgaatagcttttctttcaagatctttctcaattttgtctctacttgttatttaacaaagaacaaagtgaaaactgaaaaacacaatactttaaaatgtctttatgtgctaaatgacaaaacagtaatatgtattaaaaatgactggtgctgtgaaaatgcccacaaggtcagatttccattttcatcacaataaactgccaaatgaagagagaaaatagctaaaataagtatgagaacttcaccggtgtcaacagcatctaattccgattgccttaagaaggcttacaatatgtggccttatgttaccactgattttcaacactacagtatctgtatgaagtcctatgatatctataagagggttacaaagaaaccccttgcctaagagatttgatgaattctacaaatttgccaaagaacgactttttgttaagtgaattcgtttccaacacattcattcctctttacatttgtaaagcattttgtaatttccataacttttcaccaaaaacagtatcccctagaatttcagtgctagaagaaaccttagagatcacgtaggttacctccacattttacaaatcaggaatctgaggcccaaagaatgcaactgcatgctcttgaaagttggtagcaaggccaagactagagttcctgatactaaatccaaatatttttctatttcttaatgattttccactatagatcagaaatataattttttaaacaaaaatgttgactcctgagagtaatgaacttaaactcaggagcagagcaagtattaactaaaaatcaaatcacaagaaaaaaaaaacaataaatttgggcaaacacaataatagtaaaataacagtaggaaaaataaaacagtaaaaataaaacagcaaaattatactacaatattagagattctttacatagcactctaaggacaaatgcaaaaatttcccttgagttttcctaatttgaaaaagtatataatcaattttaaaatcttttacacattcttaatttgcccattttttcccatctgtttctaactggcatattctggacaggaaggtttaagtctcactcagcaataaaggcttactacactttctgctgagacatgtagctggtctagcaactagctctctgacaaacaataagtaaaaatgaatccatgtttacagacttaggtaacagctagaatccccaactaaagaactattcaaaccaaacagcgtttggtgcagtaaagtaaataacaaaagccagaatgagaagtcaaaaacaagatgacagccgggcgcggtggctcacgcctgtaatcccagcactttgggaggccaaggcaggcagatcatgaggtcaggagttcaagaccagcctggccaatatggtgaaaccccgtctctattaaaaaatatatacatatatacaaaaattggccaggcgtggtggcgcacacctgtggtcccagctactcaggaggctgaggcagaagaatcgcttgaatccaggaggcagaggttgcagtgagctgagatcgcaccactgcactccggcctgggcgacagagcaagactccgtctcaaaaaaacaaaacaaaacaaaacagaacaagatgatggcaatgaatgtaccaggtggtaaaatcaacacagactatgacatagcatatatttgtattcaataggttagaatatagtgtttctgcagcaaatatttatattaatctcaactgaatttctatgggtcaatgtcataacttgataaacattatttctggcaaagaacactctttttcttttctctaagtaaccttaacaaagctaagtatgaccaatatttgcagaaaataattaaacagaatgacataatgaaaatatatttcacttagacctataatatatataaaatttttagcactaaaggacctccaaataagtcaaaacatttacaaatcaggtactgaaaaataaaaatgtaaaatctgtgcttttgtgaaggtgattttctaaatgcagtatacgaataaggagtaaaatgatcaattatagttcatataaatggtctctctaaaaagtaacccatgttctatttcaaaacattgtgttttaatcttacccacaatatagatgaggacctgaagcatttcttctattagtgtattatattgtttaatcaaatcctatagaatcgaaaaagagtaaattagttatggaagaaccaaaaacctccataaaacatgcatttctggacgagactcatggtccatccagcctagtatttttcatccagtccagtattttttttgtatgtgtgcacagcacaaatagttacaatagttcccttttttgacatcaaattcaacaatacctggcatataattgctaaatactgtcatcattttcattatcattatcccccacatagtcataaataagcacacatgctaatcttcaactcttcttctattatttgctgccttcttacctgcgttagtgagaaagtgccttcaaatagattgccaacagttatatggtgagagtatccttctctaacacgcccctcatttaaactatgaaatcagatactgattttcactaagtataaaacaactaaaaattagctctgcattttatatcctattcatgttagccctttgcaagtaacttctatttttttcatttaaaaacattttttggccaggtgcagtggcatgcgccactgctcctggctatcccagagttctttaattcttaaatttgatttagaaattttatatgaggccaggtatggtggctcacacctgtaatcccagcactttgggaggccaaggtatgcggatcatgaggtcagaagtttgagaccagcctgaccaacatggtgaaatctcgtctccactaaaaatacaaaacttagccaggcgtggtggtgcgcccctgtaatcccagcaatttgggaggccaaggcatgtggatcacaaggtcaggagtttgagaccagcctgaccaacatcgtgaaacctcgtctctactaaaaatacaaaaattagccaggcatggtggcatgcgcctgtaatcccagcacgcctgtaatcctcaggaggctgaggcaggagaatcccttgaatccgggaggcagaggttgcagtgagccaagatcgagccactgcactccagcctgggcgacagagcgagacttcgtctcaaaaaggaaaaaaaaatttatatatttatttattatttttccaaagaaattttactagcaggagtaacttctaatttgaaagaataaaataatgtgatttcatgaattcaaaatagttaagggctactttataggctggtacttcaaatattcaaacaataaagacgtggctgggcacggtggctcacgcctataatcccagcaatttgagaggccagggcaggcagatcacttgagctcaggagtttgagactagcctggtcaacatggtgaaacctcgactctactaaaaatacaaaaaattggccaggtgtagtggctcacgcctgtgatcccagcactttggaaggccgaggcgggtggatcacaaggtcaggagttcgaaatcagcctggccaacatggtgaaaccccgtctctactaaaatacaaacattacctgggcatggtggtgcacacctataatcccagctacttggggaggctgaggcaggagaatggcttgaacccaggaggtggaggctgcagtgagccgattgtgccactgcactccagcctgggtgacagagcaacactccatctcaaaaataaataaataaataaataaataaataaataaataaataaatagataaataaatgagctgggcgtggtggcttatccctgcaggcccagctatgcaggaagctgaggtaagagaatcactagaatgggagaagaaggttgctttgagccaagatggcgccacagcactccagcctgggcgacagagtgagactctgtctcaaaaacaattaataaataaataaaataaaatttgtatattacctctgagacaacaaagataaaaaagaccaatgtctttatagatgtacatactgaaagagagagcttaaataggactttcttctgagagcaatttgacaatatgtattaagagcctgaagaaaaacatgttgttggccaggcacggtggctcaccagaactttgggaggccaaggcgggcagatcacccgaggtcagaagttcgagaccagcctggccaacatggagaaaccctgtctctactaaaaatacaaaattagctgggtgtggtggtgcatgcctgtaatcccagctattcaggaggctgaggcaagagaatcgcttgaacccggggtgggcagaggttatggtgagccgagatcgcgccattgcactctaacctgggcaacaagagcaaaacgccatctccaaaaaaaaaaaaaaaaagaaagaaaagaaagaaaaacacgttgttttatccaacaaatccacttctaaaaatgtgtcttaacaaaatagagaagtatttaaatactgagctacaaatgtttataagaccaaccaactagaaagacctcttcagtaatagactttaaagtataatgcatcatatagtgcaatcctatatagttattaaaaatgatgatataattgtgtacttatttcatgacaagaaaaaaaacttttcacaatatgttgttaagcataggaagcagattacaaaacagcacattcacaatgatacaatttttgttttaaaaacaagcaagacactaaaactttaaaagtgatcatttctaggaagcagtgtttttcatgtgattttttttctttgttaatctacatattctaatttttctagattaaaaagattatatatgtgtatatatgtgtgccatatgtatacatctcatttcaggaggtatggttaagaaataacttttaaaatatggctaaatatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagaacaaaaaaccaaacaccgcatattctcactcataggtgggaattgaacaatgagatcacatggacacaggaaggggaatatcacactctggagactgtggtggggtggggggaggggcgaaggatagcattgggagatatacctaatgctagatgacgagttagtgggtgcagcgcaccagcatggcacatgtatacatatgtaactaacctgcacaatgtgcacatgtaccctaaaacttaaagtataattttaaaaaatatggctaaatatgactgaaataaaatatgactgaaatagtaacaatatttcctttaaaattaattcacataatttacaggttgtatacctggtcttttgtagatatggtcttgttaaaagcctcggcaagttcatacctctgaagtaccagtaacaagaacttattgggatccattaaagatgcaccaatctgtgaaagaaatccagcatcatatttcttctgtattatatggagaaacattttgtctcatgtaggactgtcaaaaattaaaaagtttgcagaagataatgtagtagtcccttctatttctatgagtcataatcagtttaacagtgagagtattttaagttaaaaattattacattatcttctctccttagaaagaattcaagaaggaagatgaagacacaaatatcagaaacaatttaaataggtacctgaagcatgatgatatctttatcatacatttcttctctgcacttaacatcttggtaataaaacacctataaggtaataggtagaataaatcctaaaagaattattttatttcaagcaaaattctcaagaaaacctatccttaaaactttctctaagctagaaacccctcaaaatccttagtggcaaaaataagttgtaaatctatgaatcacttaaagggactagcgaggatgaagtgaagaaatatggcatgaaatcacttcagggttaaaaatgttctatattagttattactgtcatgtataacaagagaatttattttccctaagtttaaaatacctacttcaataaaagtaaaccaatttctacactcaatcataataccatttttttctttttttttttttaatttcattttaagttccaggatacatgtgcaagacatgtaggtttgttacagaggtaaacgcataataccatttttcttccaagtgctaactttacaagacctatttctccaccttttaagaaatgcaagggcaggctcagtggctcatgcctgtaatcccagcactttgggaggttcaggtgaccggatcacctgaggtcaggtgttcaagaccagcctggccaacatggtaaagccccatctctactaaaaacacaaaaattagccgggcatagtggtgtatgtctgtagtcccagctactggggaggctgaggcacgaaaatcacttgaaccccacaggcagaggttgcagtgagctgagattacaccactgcactccatagcctgggcagtagagtgagactctgtctcaaaaaaaaaaaaagaaaaaggaaaaaaaaaagaaaagaaaagcactgctgcatatttactccaaaatagaagaaaaaattacaaggtggccttcaattaagacagatggtggaaagactaaaggcctctaagtaaggtaattctcagaaaagaactatgttaatggggaggactctggtggtactaccggctttcccttaatttatcacacaagcatcctagtttataattcagatggaatacacagtgaacaggataggagaaatgtctatatagttcctagaactttcatttctaggagtttatacaagagaatagtaacatacactcagtaaaatctaggaacacagggtaaaatcatataagagaaaaaaattagaaaatgagcacattcataaatatgaataatagactttgctgtacctggctaataagagacagtccatttcttcgccacatctcagcaacaacctgggcaaccaacaccagacaacgtaaaggatattccactagtacctctacttgaaagtcctcctgaaatagagtgagttcaattttatcatttctcacagagcttagatgtgtctccaagttatgccactacatattcttcagttttctcacgtgaaaaatggaagagcttgaactagatgacgtctaagtccctgtgactcagattacaatgtactatatgaagatgtaaaattactaaatgggaattcctcaggtgggtttctaaatattatctccttctcgtccatcaaccaagagatattcagaaacagaatataagcaaatcaatacttagtagaatcacttacaaaagacacaaattcatgcagtcttgaaacagcacccagcctgcttaaacgtacatgaagacctaaagttaaaaaaacgagagagaaaatgagaaaacaaacccaatttgttaactagttaactcatcaagtttagaaacttgtgcgatttgatttggctgggcgcggtggctcatgcctgtaatctcagcactttgggaggcctaggtgggtggatcatctgaggtcaggagttcaagaccagcctggcccacatggtgaaagcccgtctctacaataatataaaaattagccgggcctgtaatcctagctacttgggaggctgaggcaggagaatcgcttgaacctgggaggcggaagttgcagtgagccaagatcatgccactgcacttcagcctgggtgacagagtgagactccgtcttaaaaaagaaagaaagaaacttgtgtgagttaaatgtatgtttactgagtttagaagtgacaatctagaatgcagactgttgatttctaattttgaaatacaatattactaacgtatttaaaatcctacaccatgcaaggtgtgctcataccttatttaaaaatgacaaactgtctctcaagatacctttattctgcctttagccacgtatcaaaagaaatgaaaattaatctaagtatttttaaggaaaatttttattttcattaaaaaggtacttttaacaaaaatttttattttcattaaaaaggcacttttaacaaaaatttttattttcattaaaaaggtacttttaacaaaaatttttattttcattaaaaaggtacttttaacaaaaatttttatttttattaaaaaggtacttttaacaaaaatttttatttttattaaaaaggtactttttacaaaaatttttatttttattaaaaaggtatttttaacaaaaatttttatttttattaaaaaggcatttttaataaaaatagaagcaatataaaatcacatgacatcaattatgccatatacaaacattaactcaaaatggatcaaagactttaaacacaggtttaaatataggtgctaaaactaaaaaataaaactcatacaagaaaacgtagggaaaagcttcataactttagatttgactcttcctatccatgagcatggaatgttcttccatttgtttgtgtcctcttttatttcgttgagcaatggtttgtatttctccttgaagaggtccttcacatcccttgtaagttggattcctaggtattttattctctttgaagcaattgtgaatgggagttcactcacgatttggctctctgtttgtctgttattggtgtataagaatgcttgtgatttttgcacattgattttgtatcctgagactttgctgaagttgcctatcagcttaaggagattttgggctgagacgatggggttttataaatatacaatcatgtcatctgcaaacagggacactttgacttcctcttttcctaactgaatacactttatttctttctcctgcctgactgccctggccagaacttccaacactatgttgaataggagtggtgagagaaggcatccttgtcttgtgcgggttttcaaagggaatgcttccagtttttgccctttcagtatgatattggctgtgggtttgtcataaatagctcttattattttgagatatgtcccatcaatatctaatttattgagactttttagcatgaagggctgttgaattttgtcaaaggccttttctgcatctatggagataatcatgtggtttttgtctttggttctgtttatatgctggattacatttattgatttgcatgcgttgactgtgaaaatgaccatgctgcccaaggtaatttatagatttaatgccatccccatcaagctaccaatgactttcttcacagaatgggaaaaaactgctttcaagttcatatggaaccaaaaaagagcccgcattgccaagtcaatcctaagccaaaagaacaaagctggaggcatcatgctacctgacttcaaactatactacaaggctacagtaaccaaaaacagcatggtactggtaccaaaacagagatatagaccaatgggactgaacagagccctcagaaatgataccacacatctacaaccatctgatctttgacaaacctgacaaaaacaagaaatggggaaaggattccctatttagtaaatggtgctgggaaaactggctagccatatgtagaaagttgaaactggatcccttccttacaccttatacaaaaattaattcaagatggattaaagacttaaatgtaagacctaaaccataaaaaccctagaagaaaacctaggcaataccattcaggacataggcatgggcaaggacttcatgtctaaaacaccaaaagcaatggcaacaaaagacaaaattgacaaatgggatccaattaaagagcttctgcacagcaaaagaaactaccgtcagagtgaacaggcaacctacagaatgggagaaaatttttgcaatctactcatctgacaaagggctaatatccagaatctacaaaggactcaaacaaatttacaagaaaaaacacaactccattgaaaagcaggcgaaggatatgaacagacacttctcaaaagaagacatttatgcagccaacagacacatgaaaaaatgttcatcatcactggccatcagagaaatgcaaatcaaaaccacaatgagattaccatctcacaccagttagaatggcgatcattaaaaagtcaggaaacaacaagtgctggagaggacgtggagaaataggaacacttttacactgttggtgggactgtaaactggttcaaccattgtggaagacagtgtggcgattcctcaaggatctagaactagaaataccatttgacccagcaatcccattactgggtatatacccaatggattataaatcatgctgctataaagacacatgcacacgtatgtttattgcagcactattcacaatagcaaagacttggaaccaacccaaatgtccatcaatgatagactggattaagaaaatgtggcacatatacaccatggaatactatgcagccataaaaaaggatgagttcatgccctttgtagggacatgaatgaagctggaaaccatcattctcagcaaactatcacagggacaaaaaaccaaacactgcatgttctcactcataggtgggaattgaataatgagaacacctggacacaagaaggggaacatcacacaccggggcctgtcgtggggttgggggaggggcccccaatgtatagggacccccctatacattaaatgacgagttaatgggtgcagcataccaacatggcacatgtatacatttgtaacaaacctgcatgttgtgcacctgtaccctagaacttaaagtataattaaaaaacaaaaaaacaaaaaaaaattagatttgacaatgagttttttggatatgacaccaaaagcacaggcaacaaaagaaaaaagtagataaattcaactataacaaaaactcctgtgtctcaaagaagaccatcaacagggtaaaaaggcaacccacagaatgggagaaaatatttgtaaatcacatatctgatgaacacttaatatctagaattatataagtaactccaactgaacagcaaaattaaaccagattaaaaaatgggcagagcacttgaatagacagttctccaaggaagatatacaaatggccaacaaacatttgaaaagctgatcaaaatcactaatcactagggacacgcaaatcaaaaccacaatgagatatcacttcatatccattagaatggttattatctgggggggaaaaaaggagaaatagcaagtgttggcaaggtgtagagaaaatggaatcctagtgcatgcgggtgggaatgtaaaatggtacagccactaaggaaaacactatgatggttcctcaaaaaaccaaacatagaattcccaaatgatccagcaattccacatttgggtatatacccaaaaaactgaaagcaaggacttgaagagatacttctacatccatgtcataacagcactattcataacagccaaaaggtagaagcaacccaagtgtccatcaacggataaatggatgaacaaaatgtggtatattcatacaatggaatattattcagcctttaaaaaaaaagggaattctgagatgtactacaacataaacctgaggacattatgctaggtgatataagccagtcacaaaaggacaaatactgtttgagtcaacttataataggtacctagagtagtcaaattcatagacacagagtggtagttgctagcgggtgtggggaggaggcaatggggaggtattgtttagtaataataattgtttaataaattattattctattcagttttggaagtttcatgcttagaagataaaaagcttttggagaaggatggtggtgatggttgtagaaaatgtgaatatacttagtgccactgaactgtacacttaaaaatggctaaaatgataagctttatgtcatgtacattttatcattgaaaatagaaatatatacacttcaataaagctattttttaaaaaccctgacaaatgaatggccaatttacatggaaatgcaaatgattaaggagaatctatgatttcttccttttaatgataaagaatgatacagataatacaccagtgaaattggtcagagaggaggtttagaaaccagcaaccagattttattatatttaaatttgggtgggagatgagttaccacgttagtccttaagtatatactctaaggatccataagttgacccagacaaaacaaagcccaggtaaataagcagctttaaatagatgttctggtgacagctccttgaaggacagtgacagcccttaactgcagtatctgacctgagcatgtctgtacatattgagcacagaacaaaaatagaaatgattctactaaatgaatacctagaaagaaagctaataggtatatgcaaaaagaaaaaacaaacactcaccagcaagggtcctagagagtggcagatgtatgcttacaagatcctcagatactctgtaggactttgtttccaaactatgtccacacgattgtactactgtcttgctactagatatgaaactggtactgcacctcatcacagctttgtgacattctttataagccacaagtaagagttcttcctaagaggaaaataagatacaaaaagttgacaagttttctactttaacactttttttgttttgttttgagacagcctgtcctgtggcctaggctggagtacagtggcataatcacagctcactgcagcctcaacctcctgggctcagtcacctgaggtgattctcccacctcagcctcctgagtagctgggactacaggcgcgtgccaccatgcccagtttttgtattttttgtagaggcagggtctccgcatgttggccaagctggttttgaactccggggctcaagtggttcacccaccttgacctcccaaagtgctagcattacaggtgtgggccaccatgcccagcataacatgcatcattcaataaatatttactaaatatgagtggaaaattgttctatgtattactaagtctacctccacaggatctgcaaacttgtaggaaacataagatatacctatatatgcacttataatcaaagtaaaaaataagtaccatgtaaatggtacagactaattgctctaagaggggggaaaaaaaagaatcacaaagaactgggaagacatatttgtgaaagcagcttctgatgggccctaaaagaatatgcataatttaagtatggggaaagataaggagaagatggcattctaagcagagatataaaataaataaagacaaaaataagagaaatacaactcctattcaggcagtggagaataaagagtagataaaatgaaagaatttacggatgaaattaacaagcatttgaactggaaatgtgccttggcacaggcatgtgaatacactgatggagtccgcagtgtaataatgtagccaacacactgcttcaggaagaattaatgtgggtcattgaagatggtagattggagaggataaagttagtagacaaagaaaccaacaggaagatgactataaagtaaagtgataagggtctgaactagggtggggccatcaggacaaaaaagaatgaacccatagaaaataatttagaattataaaatatatttgagataaggaagaatcaaatctgggtgaatacagaagggagacattaaagaccattcttttaagataatgtttctaatttaatcttgaaaaaggaactccatggtcaaaacagatgatttggaaacatccctctcagaaatcagcatactgactaactaaagggttttagaaattcagtagcggctgggcgcagtggctcacatctgcaatcctagcactttggaaggccgaggtgggcagatcacgaggtcaggagtttgagaccagcctggccaatatggtgaaaccccgtctctactaaaaaatacaaaacaaattagccgggtgtggtggtgcacacctgtagtcccagctactcaggaggctgaggcagcagaaccgcttgaacccaggaggcggaggttgcagtgagccaagttcgtgccactgcactccagcctgggtgacagagcgagactccatctcaaaggaaaaaaaagaaagaaagaaattcagtagctttaaaagaaaaaaaaatcctctttttgtttaacctgacatttctgaatcttacatgaacccagaacatttttcccttcaaaacaccagttaatgttgaacatatagaaaacagtggctctgagatttcccatatggatgaatttaatagtaatgtcattaataaaacaaggataatcaaaatgagaaaatgcaagttggaagtagaaggaaatgatgacaggtccatttaaaatattttgagtttgaggccaggtgtggtggctcatgcctataatcccagcactttgggaggccaaagaaagagaatcacttggaagtgaggagtttgagactagcctgggcaacacagagaaaccctgtctctgcaaaaaataaaaaaattaaaaattagctaggtgtggtggcatgtgcctgtagtcccagcgactttggaggctaaggtgggaggatcatgtgaggccaggaggtcaaggctgcagtgagccatgatagcgccactatactccagcctgggtgacagagtaagaccttgtctctaaaaacacacacacacactcacacacacagacacacacgtgtaagatctaaacaggaatgtctggcccacaaacagaagtgacactgtagcttaggagagtcatccctatgaacttttaactaagtggtagaaatacaagagaagagaaaagaatgtaagatatacacacatacacacttaccatcaaagtaaaaaaattttaaataccatgtaaatgggacaagctaattgccctaagacggcaaagaaaataatcacaaacaattaggaagacgtatttgtgaaaacatatttctgtaagaaagagaatattggggaatgtctcgtttagcaggcagaaggcactagaaaaaaaggtaatcactgactgaaataggtaatcgataataaatgtattaggataatgcctgtttgtgaaaaccagagggaaacaaagtttcaagatggttaaagtactcaagaaaatacaatgctacagataattcaaggaagatggaaactaaggaaagacctctgaatttggttaccaaatggatcctctgtgatttttttctaaatgcagttcttgtcaattgataagggcagaagccagactgtaaagaagtgttaggagctataagtgaagatactaaatgtagatgacttcagaaggtttggaagaagtcaagatgaaacctttgcctcatcacctaacaattgtgcatgccctccataaaagtgagggaagccaaaaaatacatgctgtgcttgctggacagtatttcctgtggtgattgtactaaaaagctacagtgctagattaaagtctactacatttgtgagtatggctgccactctgaacctatgaccaattgctggtggtgaagcagaagagattatagttcacaggggtgcaaaggcaagaaaggaggcttttattattgttgtttttaaaaataagcgagtcctgtgtgtttatagacaattgaataaaagagtaggaaacacaagtccagataattcaggaagctaactccaggaaaaagtaatataagtcagaaccaagagcctaggtagagtcattagacttagaaagagacaaaaaggaaaagaccaatagtgaagacgcagaaaaacttagtcactgaataggttatggtaacagacacagagaaagcagagatgatgagggaatttaacttagataatagcaattttctcagaaaataaataaatgaggtcatcattcttaaagggaatctagggtgggattacatatttaaagacggttatggtctaaaattgctgcttaaggaaatacattagttctatagtttgaaactaacacatacaacaaagctcttgaatgaataatctacccctctccattcctggaatatttaaaagtctactatggtcctcattatattattattaatatgcattttccagggaataaacgtgtgtataaatacatacatacacatgtataaaccctgctattccccaaaataagcaaaactaccacagggcacattttctactcaagtatatacagtttccccctaaatttaaaaagagaaattcaaatatgtaaaaagctactataaataataaaaactttacatcaaggaagctgcaacataaaactatactattaataattactaagaacttaaaaaggcactgatcctactaacaaattttacttacatcacaagcacaccactcttggaacatgagtaaaatattcttcaattgcatctgtatagcaatggcagcctcccaatcaggatccacttcaatgtgttgcccaacctgtcttcggatttcttccattccctgcaattacaagttggtcaacatacacctatctgagccctctctctttgctctgctcttggcaaaatataaaactgtcaggattcataacattttaacatggttgttacactgggtcagaatgcatgggttcaattcccagctctcaggtatgtgctcagggttagaacattaaccgcaaagcccagctctgtctggtatttctagctgtgtgaccctgggcaaattatttctaagcttggttactaaatggatcctttgagattttttcctaaatgcagttcttgtcaattgataagggcataaagtcagactctaaagaagtattagaagctaacaagtgaagatactaaatgtagatgaattaagagtatttaggagatgtcaagatgaaaacaagcaccttaacctcatcacccaacaactgtacatgctttccataagggtgagggagccaaaaaaatatgtgttgtgcttgctgcacatgcaagtaacccttacatgtaaaaggagaatattaatagtaactacttaataagattgctataaggctcaaaagagatcatgcatgaaaagtgcttactacacatttatcacatggtaagtattcagcaaacattaacagaagtagcaacagtaggccgggcatggcagctcacacctgtaatcccagcaccttgggaggtcaagagattgagaccatcctggccaacatggtgaaaccccacctctactaaaaatacaaaaattagctgggtgtggtggtgcatgcctgtaatcccagctacttgggagactgaggcaggagaatcgcttgaacctgggaggcggaggttgcagtgagccgagattgcaccattgcactccagcctggcaacagagcgagactctgtcttcgaaaaaaaaaaaaaagtagcaatagtaaactaaggtatataaaaggatctatcaaaacaggatgagtgagtcaatgtttaaatcttgtttctactttgctagataaattctttcttgtattaaaaccaaaatctgctttaaaaagactgcggttcaatttttaaaaataaatttcttttactgatgtacagaaaaatgatcatacctgcatacaggtaagaatcttcaaaaaagatcgaaaaccttcaaggaactgcattcttaatctttctgtccatattgtgggtttgctgatcaggatatacctatcgtttcaagaaagaaagaaatatttcatttatctattttgagataattttaaggttctcagggttatagacaatgttgatttataaaaattatggattctaatttctcacaataattagaagctctgagtagagctagaattatttattctgccttattttaaatacaaccagtaaaacatgaatgctctagaagaggcagatatcaagctaaacctgacttcacacactacattctcagaggttagtctgattaagtgaacctagaactgaccaagcctgtcacagctaactctggacaaccacagtacagattccctagaactgttcacacccatcagccaaagggccagctgaaattgtttcagcctcaggagatttggaacagattttctacctccagtttttcataacccagaacttggaagaaggatgtaagcacctgtcatcttgacttgcacatcaggatgtactagtttcaagagataaacaaactcattttagcctataatttgtatgattaatatttcttttggctgtaaagacaatgactggtttcatatacaatgggaacaatgtttatcatgaaatgagttatcaggaagtaattattaacaagtataaaatactattttgcacttgaccaatgagaataaattcctgttatattgcaggtgttgggaacataaacatggacacacctgtcctgaagttcatagtatagtgggaaaaacagatacacacagtagacagaaattcaatgttaaacactaaaataatgtataaaagaggtaatgtatggctcacgcctgtaatcccagcactttaggaggccgaggcaggtggatcacgaggtcaggagattgagaccatcctggctaacacagtgaaaccccgtctctactaaaaatacaaaaaattagctgggcgtggtggcgggtgcctgtagtcccagctactcgggaggctgaagcaggagaatggcgtgaacccaggaggcagagcttgcagtgagccgagatcgcaacactgcactccagcctgggtgacagcatgacacacaaaaaaagaagtaatgtaggtacataaagacaaagcaacaaagaaaatacattttttttgaactgcaaagataggattgtggtttaatttttctcactctttagatacccattaacatgcaaatgtacattaaaaatacaatcatcaaagaaacttataaagatttaattcaaatatactaattaccatctaaatctttcttttaaagtaaaagataaaaaagattaaagtttaaaatctgccacattgaacaaacggcattcatgttttgttgctttctagagcactactactcaaagtgtggtccactaaccagcagcaccagcctcacctgagtgctctttaaagaggcaacatgttgggctctaattagacctgctgaataagaagcttccctgcccccgttttttttttaaacttggccttactctgttgcccaggttggagtgcagtggtgcaatcatagctcaccacaatttcaaactctcaggctcgagtaatcctcctgcctcagcctcctcagtagctaagactacaggcgcgtgccaccaaacctggctaattttattttttgtagagacaaagtctcactatgttgcccaggctggttgcaacctcctggcctcaagcaatcctcctgcctcagccttccaaagcacatgagccaacgcaatcagccccagaatctgaacttaaggaagctccccagatgatttgcttctgcacagcaaaggaaactatcaacagagtgaagagacaaccaacagaatgggagaaaatttttgcaaactatgcatctgacaaagtcctaatagccagcatctataaggaaaataaataaatttacaaaaaagaaaaaatgaataagtgaggccgggtgcagtggctcacgcctgtaatcccagcactttaagaggccgaggtgggcagattgcctgagctcaggagttcaagaccaccctgggcaacacggtgaaaccccgtctccactaaaatatctccactaaattacaataaattagccaggcatgacagcatgtgcctgtagtcccagctattcgggaggctgaggcaggagaatcacttgaacccaggagactgaggttgcagtgagccaagatagtgctactgcattccagcctgggcaacagagcgagactccgtcttaaaaaaaaaaaaaaaaaagcggggcaggggagcaaaggataagaacagaacagacacttttcaaaagaagacatacatgctgccaacaattacatgaaataaagctcaacatcactgatcattggagaaatgcaaatcaaaaccacaatgagataccatctcacactagtcacaatggctactattaaaaagtaaaaagtcacagacgctggggaggttgcagggaaaaatgaatgctcatacactgttggtaggagcataaattaattcaagcattatggaagacagtgtgacaattccttgaagacctaaaaacagaaatgtcattcaacccggcaatttcattaccgggtattcacccaaaggaatataaattgttctattataaagacacatgcacacatacattcactgcagcattcacaatagcaaaggcatggaatcaacttaaatgcccatcagtgatagactggataaagaaaatttggtacatatacaccatggaatactatacagccagaaaaagaatgagatcacatcttttctgggaacatggatggagctagaggccattatccttagcaaactaacgcagaaacagaaaaccaaatactgcatgttctcacttacaagtgggaactaaatgatgagaacacatggacacatagaggggaacaacacacactggggtctatcagaggattgaggttgggaggagggagaggatcaggaaatatagctaatgggtactaggcttaatacttgggtgacaaaataatcttaacaacaaacccccatgacacaagtttacctatgtaacaagcctgcacatgtacccctgaactcaaaataaaagttaaataaaaattaaaaaaagcagctccccagatgatttgcattcacattaaaatctgagaagcactgatctagaagagaatttacatttttggtttctaacaatctcacatagctaatgagcaacctctatagatgacttaccaagtaaagaagatgtaagggattggaacaaacaaaagggtaaggaagggaaggaaaagaagtctgtagataaaaataggtggcaaaagcaatgggaaaagagggagaaaagtgtggacagggtgagacagtaagggagtgatttggtttgagagtgtgctatactttctggaaatggaacaaaggaataggttagagtaataaaagaataatattgttcctcaatagcaccaaggttcaactgcatctcttttctaagttgcatttccacaataaattagcaactgagaaacaaagtaccccatgagatacctcccaaaaagcaagtgacaaaactaaatagacataaattttttagaataagagaggtagcaatccctcccttctgtgttttcctaggcagatctcagttggagtactgtgttcatttcttggcacataaatggtatacatgcacctggaacaggttcagtagagaaggacaatgatttagaaggaattttaaccaacatgaaatgggactagttaaagaaataaatgcaactcaatgcagaaaagacctggcaggtatgactgctgcctttaaatacttcttcaagttaaatgagaattgaagttgttctgaatggacaaagagagaactagaaccagaaaataaaagctacaaaaaaagacaagagttcaatatacaataggaaactttctaatagttggaagaagctatccaaagttggaatgtgctgctttgagagaatgaaaatttcctaaggcaggctgaacagagtacctactagtaccaacaaacttatttcatgctgaggtacagtcagataaacacaaagctaaactatgaagacctacaaattctgacagaatttagactttatctgggaaagaaaatacattaagtgtggttattgctaactaatttaaaaacaaggtttcaggggaaattagtaaataaacatgtagggaaagagtaagatgtgactacagaatttctacaatgagagactgagaaagcaattaacacgaattatttgctaaataaagagtttttgtgattggtgtgttaggccaggtttcagagtagattttgtgttgttgtttatgtatcctgtgaggctacatgacatagtgaaaggaacatgagttttacagataaacggtgtttataatcaaatctcagttctgccacttactaggtttgtgacttgaggcaaatatttacaatctacaaagtaagattatatcaagtaccttctaagaatagtgcaagaatataatcaggtaagataagcaaagctccttggcacatagcagttactaataaatctcacaggattctcatgagagtgaattacacagtacctgcagaacaggtgttaattttcccttcccctggtcactggagatatctatatttaggttgggatagaggggaggaattgtaagcatcagaagatttaaagttgccttccaaactagacaccttaaagttctactataagggtaggtatttagggatgtgctggctctaaattattcaccgtagagattagctatagtcagagactcataaaatatgataaaacaagtgattatgcaccacttaactggatataaaaataactcagttataatacttcacagtaatgatagccatggtagagagatttttttctatattcactgacctaacaataactttaagtactgccattaggagtttttgttttgtacaacatgtaagttttgcataatttggctgagaaacaaatttcaattacaatggctatatattgattcactactgaatttacctaccatctccacttatactgaagataaaatataataatttactgaactttattttatttttttagagataggatcccgctctgttgcccaggctggagtgcagtggcatgatcacagtttactgtaacctcaaacccctgggctcaagtgatcctctcgcctctgcatcctgagtagctaggaatagaggcttgcactgctgtacctggctaatttttatttttatttttgtagaaacaaggtctcgctatgttgtccaggctggtctgatacagacgcaattttttttttttttttttgagatgcagtctcactccgttgccaggctggagtgcagtggcgcaatctttgctcactacaacctccacctcctgcgttcaagcgattcttctgcctcagcctcatggcaatttttaaaaaatggagtattttcagtctgcggttggttgaacccacagatgtggaacccacaaatacggaggatcaactgtatagcaaaaaggagttaaaaaaatgttaacagccagccgcagtagctcatgactgtaatcccaacactatgggaggccaaagcagaaggactgcttgaccccaggagtccaagtcagcctgggcaacaaaaagtgagactccgtctctacaaaacaataaaaaatttgccaggcatggtggcacgtgcctgtggtcccagctacatgggaggctgaggcaggaggatcactggagcccaggaggttgaggcttcagtgagccatgtttgcatcactgcactccagcttgggcaacacagcgagaccctgtctcaaaaaaaaaaagaaagaaatttatgtcaatagattgtctgaaactatgcacaaagagactatataggaaggacagaaccaaagtgtgtgagtggaagtgaatgaaaagtatggtaattacaatggcaatgcatttggtgaccccaggagatcccaagttcctgtaatgggcctctcctcaataccttctttactaaccaggttttacaactcaataagaagccttcactgaagacatttattaacgcgaggcagtaacagttctttgtacttgccatcattataaagagaattctggataaccaaaatgatcacaggattacttataagacacagcaaataagcacactgagtttaacaggtgccctcaccttttgacttgaacaacttactttaggtcacatattactgcatatactcttcccaatttgtcctggctataaccctggaagttgaatttattgttcctgtccaagtactcaggtaaaacttctagcagagtttcagtaatgacagagataacattctgctcttcaataagatgtcgagcctgcggaatatttcaagaatattttctttagcattaactcattgtggtatggacttaatttattcattcatttggttagtcagtatgtcatttttaataaatgtttgttattgaatgttaaacacagtccttagtttcactgaatagcaactactaagaagttattttctaaaagaaaaaattccctactcctcagtaactagacaacacctatctggatactccaagcccattagacaggttatctagataaatgtttatcatcagtaatgtggtggctcatgcctgtaatcccaggactttgggaggccgaggcaggcggatcacctgaactcaggagttcgagactatcctggtcaacatggcaaaaccccatctccacaaaaaatacaaaaattagccaggtgtggtggcaatgcctgtaatctcagttattcaggaggctgaggcaggagaatcgcttgaaccaggaggcggaggttgcagtgagccgagatcgtgctactacaccccagcctgagtgacagagagagacttcatctcaaaaaaaaaaatcacacaatgagcaagtataacaaagatatacttcatgacttctagcacactacgatctattctgaaatctcctccttaccccaatctaaactctcctctccatccttttgaaaaagtaaagtagaaacaattaaccaagtttggataactatctaattccagacaagaaaagaagtagggctgggcgcggtggctcacacttgtaatcccagcactttgggaggctaaggctggcagatcacctgaggtcaggagtttgagaccagcctggccaacatggtgaaaccccgtctctactaaaaatacaaaaatcaaccaggcgtggtggtgcctgcccgtagtcccagctacttgggtggctgaggcatgagaatcgcttgaacccgggaggcggaggctgcagtgagcccaggtcgtcccattgcactccagccagggcaacccagccaagactctgtctcaagaaacaaaaaacaaagaaaagaagtggtatacaaaggaagcagaatcttccactctcctcccaggcctatgcagcaccctctctcccaaatgcttgacaggcacaccctcccacttcttagttttatcttattctatctgcctacaaacaataacttaaaaataaaatatttttggtattgaaaaggcagtgttcataagttactctagaaagtaagaaaccagctctaggtgtcatctgcattgacgaggacatctgaaccaaggcagcgcctagttaactagtccttgggtagcactaaagtattcacatagcccaacttagtgattctaacattgttctaatttgattcaacattaagtggaattcttacaaagcaaaacaagttttacttagaaagactgaaaaggaataatcaatacataccagagtaggaacagtaaacatctgaactgaaagtgcagttatagagatacttctgtcatgatcatcactgatatattctttctgcagttgtttataatactgaaatatataagtagagaatcaattataaatcactactaaagacctttaaaaaatcccaattttaataactgctgcaggtttgtttctatctataaaatgtcaagtaatataattcctatttattaaggcaagatattatgatcagcaaaaatatcttagaaggagaataacaaacaacaaatcaagtaaaaattcacctactcaatttagcagagatagaagtggaaactattaaaatatacacataggttaaaaaacaaacaaacaaacaaacaaaaaacagaggactgcaatggtatagtttatcctttctccaaacagaatctggggcaatctttagcagcttccactctaatggtattgggcagggaatatattcaaagtatttaacaactgatatgacccagaaaaaccaaccaatcagattgaatccagccttaaacagaatggatgctggctgcaaataacttctttcccatactggtacataacagctgcaaaacaaccctgatatactgggagaacaaaaataggaatatactcagtcacataataggcatctattatgtgtaaggcacaaagttggatacttaacctactttaagttagatactttaccctccagaattcctacaaagtttaaggggtaaccatggtgtacaaaaaaaatcatctaagtagggagattagcttttgtataagaaaacaaaatttcatttcagatcacacatatggtccaatattctatatctgaagagttttagaagagaacatcttgagttgccatcactgctgaaggataagacatacaacaaatgtcttagttacttttaagtctgcatataaaatccaggtaatgcaggtatcttatcccacagtgtcatttgcctacaacaatcattatttctttctctgcttccaattccatcttgggtcctatatctatcttaagtcttacagaattgactgcaactcaaaatcagaggaaatcaacaagtatgactggcaagtatgattgccttatataaggcaaaataaaagattcaaaggagtccttgatctgtatacccttgcaatctaatttggtagatagacaaaaagatacagtaaggtaagagatacacgatagattaataaaacattaaaaagctgtaaattttagccttatgctttagcttccaaaaactaagtagaactcttggccacctaattcctgccccccactttagcatacacatctgttcttctttcctgctatacttttcaattagtcacttctattcttattgtaattttactaacaggcaaataaatgattaggaagactgaatgcatatgtgaatgtgataacctccctttgctctgggtcagtgggtcattttccacctatctcttctctaagaatgctgtttctatactagcaaataacatttgtgaaaatatttatataacgtatgagaacgaactttttttttttttttgagatgggagtctcactctgttgcccagactagagggcagtggcgcgatcttggctcactgcaacctctgcctctcaggttcaagtgattttcctgcctcagcctcctgagtagctgggactacaggcacctgccaccatgcctggctaatttttgtatttgtagtagagacggggtttcaccgtgttggccaggctggtctcgagctcctgacttcaaatgatccacccacctcagcctcccaaagtgctgggattacaggcgtgagccaacccgcagggccaagaacaaacttttgacaaagaaataaatcataacatttaatttttgattcataattatccctgtttctattaattcatttataaaaactgcctatttctatttattgatatctaatttataaataattaccttcacaaattccatagcaaagagttttttgtattccatctccataaaaaaactgctgaagatcaattcatgaaggatcttacgggcacctatagattattttggggagggtgggggaatgaggagaatcaccaaggcaaaaaccaaaaacattctggctattagagtggcagaatattataaaattacttcacatgcaaacagacctcaaatagtatttattgtattaatatttaataactggaatttaaaatacacacatatattgccttttccctctttttctgcacccctcccaccacttcatcttacacttcaatttactctctcccaaccttttcattctttttctatttcactgtacttttccttctccatgcttttagccttttacgttttgttcttcatttagatttttacaatgaaaatagcatctttttcgctactcgataatggcactactacctgaatatatagatacatgtatagacacatacatatatactctttttgactggctctcactaaatgaaaagactctataattaaaagacaacatccctgggttttaacaccaaagaatacatactgactggttaaactttatattcacatgtagtatcttatcaatcaagattacagatttaataactaatttaataaacaaaagatattacagctccactttaaggtcataatcttcctttgcttcctgacaaacagcataagcaaatgtctacttacctttataaagctttgcatcccaaagcattaacctgcttatgagacagggattctccgagtcaggttcttctctaaggcatgcttggcaaaagatctgcctaaagtcacctacaaacaaaagaggtcacacagttacacaacttgtattctttttctttttaaatagagatgagtctcactctgttgcccaggttggtcttgaactcctgggctcaagcgatccttccacctcagcctctcacagtgctggcattacagacatgagcccctgtactcagccataatttttattcttataacatttctcctaaaagtacatttcctataacatgtgaaaagaataatattaatcctcccacatttgaggcaaagaataattctgtcaacatcaaagactcaacagccaataaaaagatattatttgatactatgcacttgaaataatatcctaagatattatacatttgaaatgcaaccctgaaaattaatcaaagtgtataaaccaaaaaaaaaaaaaaaagaaaaactttatttcatactcaatgacattttaaaatttgtggctataaaacacatagtattttatcagaaacaagaaaaacaggaggtatgcttacttgaatagctcataattttgttcatccaggaaccaagacgcaaagcaaatttctgatgagccataatctctgagtgtaatacttctacatgaagtggatgttgagagacattttctgaatgactctacaaatgaagggaacgaaccaaaaaaatagcatttaaaatttgcttttagttaagggatttatacttcaaatgaagaaatcacataaccctgccagttccaaatctctgcatctaggtgccccaaaccacttcaacgacatcatcactcaaattattctacttgggctcttgtaatgtacattcatctttaacttctctttttccccctaattcagaaagttacctttatatcttcctttgcttcctggcaagcagcataagctcccgctttaacagcccgacgaccctaattatagacaaaagtgagaattaggtagtgaaatgataaccacaatcaataagcaatatgtagcccaaagacttaatgagctcttaactgagctctaatcgcgtgttgactaaaagttgtaagataccggaacaatatctgaaagacagatgcaaatgtttaacacctttatgaagtatgaaaactttaatacctctaggacagacagtctatagtttaagatgctgagtttcttgcctggcaggaatggcagttctttagttactgcagtgtcctctctacttatatgaaacaatgactcaggctttctaaacttctgctatgtatttaaaatatttttcatgaatgaattcacagctcttcaacatgtatcctatgatatacttgtggcccattaacgagcgggaagtatagctggactactgattccaccagtcctggaggcggtcatgcaaggtctatgtaggatttccttgtagctcattcttttacccacctgtaaaaattcatcattttctatatgtgccatgtgaaaaaagtcaggaagcactgtcttcctcatttaacctttacaatgaccctatgaagaaggtataccacattttacagatgataaaaagaaaaataagacagaagttaatttgtcccccaatcagaaagttagcaagtgacagattcagagatccatgacaagcatttcatctccagagtctgtacttttaaccatcctgtaatattccctctttagctgcttagtacataagcataagaactatccaaatatatttggactactaattacaccagtaaggttgccattacagaaaaaaaaaaaaaaagcacaaaaagccaggccataagagattgttaaaagaacagattggacaagaatagttacataaactcgagctcaatcagcttgtatgtatgtgatgctggcaattaacctaaagcagtggatctcaacaaacagggggaggaaaaccacctcacatccatattttttggctgctatcaaaaaataagaagggagttagctgctgatcatggtggatgggagacaggactagattggagctccgagctctgactcagatggacagagcagcacacagaggctcacatcatgaattttagctccagaacgactgtaagaacaaaccaggaatccagagaggacctacagaccttctgaagcaaggggactgctcctgcaggacctgggagacaccccaaatactcagtcccaatactggctatctttccagaggaaaagaagtcattatacgaaaaaagatacttgcacacgcatgtttatggcagttacaatttgcaattgcaaaatcacggcaccaactgaaatgcccatcagagtggataaagaaactgtgatagatatagatacacacacacacatatacacatacacatacatacacacacatatgtatatatacacacacacatatatgtatatatacacatacacaggctggaatactactcagccataaaaaggaatgaattaacggtatttgcagcaacctgggtgagattggagactattattctaagtgaagtaacttaggaatggaaaaacaaacattatatgttctcactgatgtgtgggagctaagctatgaggacgcaaaggcataagaatgatacaatggactttgggtactttgagggaagggtgggtgggggaagagggataaaagactacaaataggatgcagtgtatactgctgcggtgatgggtgcatcaaaatctcacaaatcaccattaaagaacttgctcatgtaaccaaataccacctgtactccaataacctagggaaaaaatgagttggctgtaaaaaaaaaaataataataacaagtaatgacaaggatgtggagaaacccttgtgcattgctggagaatacacaaaatggtgcagctgctatagaaaacaaaatggtggttcctcaagaaattagaaatagaattcccatatgatccagcaattccacttgtgggcatgtacccaaaagaactgaaagcaaggacttgaacggacttttgtgtatccatgttcataagagcattatccacaatagcagaaggtggaagcaacccaagcgtccactgacaagatgaacaggcaaacaaaatatggtgtgtgtgtatatatactgtatacagtacaatactgtacatatatgtatatatgtgtatatatatatacaaacagacaaatactgcatgatctcatttgtatgagatatctaaaatagtcaagctcttagaaagtagaattggtggttgccaggggatagagggaggggaaaagggggaattgttcaatggatataaagtttcagttttgcaagatggaaaagttctagagatctgttgcacgacaagatagttaacactagtatatggtacacctagaaaaagattaaaatggtaaattttatgttatgtagattttaccaccattaaaaatgttattgattgactgaatggagatggggtctcactctgttgttcaggctggaaggcagcggtgtgatcaaagctcactacagccttgaactcccaggctcagcctcctaagtagctgggactacaggaatccaacaaaaataacctttcttaatgaccaaaaaatacaggggtgggagtagatcaactgaagggaggcagtgtttttaaaatacgtgggcatttctttcctcttctcttccccatactcccaattctgatttcctaggcttgggctggcatgtctactctgaaaaaaaaaaaattatttccaagtgatttctaataggttacctttatcctcatactatagctgaaaacacagaactacaagtgtgtatctttaagggtttgtaaaacagactaactgcaacacagtttcttctagccaaggagtacattttttacttcaattgggtgtacaacattatctcatgtcctattttaccttttgaataatcatttattaaaaagcttttcttgcaatcaccatcaccttatggagctttgggaccccaaaacaagacaacctatcagtagatagattagctgtagctacaggccttctccactttgactatagaggagagcagtaacaggaataaaggctaagaagagatagggcaaacactgggagacacagatctttccgttccatatgaaaaccgacaaagcacagccccacgctttcccaagctaattcttctcctgggacactggtttatcctactggtatgtgtttttttagagtcctacgatcatgatagctcacagtaatcctaccacaataatatatcttgatatctaccaagattttcccttacaatctgcaatattaaccttgtacataagacggcaaaaatgtgacccaggagccaagtgcagtggctcacacctgtaatcccagcactttgggaggccaaggtgggtgaatcacctgagcccaggagttgaagacaagtgtgggcaacatactgagaccctgtctcttaaaataaaattaattttttaaaaatatgaactttaaaaagagcactattacatctttaaattttttcagaatgcctgccttttttttttttaattattattttttgagatggagtttcgttcatcgttgcccaggctggatgcaatggatgcaatggtgtgatcttggctcactgcaacctccacctcctgggttcaagtgattctcctgcctcagcctcccaagtagctgggtttacaggcatgcaccaccacgcctggctaattttgtatttctagtagggacggcgtttctccatgttggtcaggctggtctcaaactcccgacctcaggagatccgcccacctcagcctcccaaagtggtgggattacaggcgtgggccactgtgcccagcatttgaatgcctgtttctctcataagaacagtagagaatactcctttgaaggtagattcaatctgattcatcttggtatttcctcaaagtgctttaataaatgtttagtgaactcatttagagtaccacattttaagaaaatctttgataaactattatttacccgggggaggaggtggagagaaggaaatagagcttgatcactatgaggttattatcataggacagttgaagaaaacagaggaaagcaaacataagaaattacagttttttaaaactatttgatgggttgccatctgaaagcaaaagaagagcttttctggtttgttcaataagaaattagtctaaaaacacatggaggaagattttggctgaaaacaggaaaaaaatttttctaagaatgagagctgtccaacaagcaaagcagtcagagaaacaaactttctaagtgctaaaagcacaagttagagaaccagggatattgttctctcaatacaaggatggccaatttcacttgtttttcactatttcctatcttacatctttttttttttttttttgagatagaatctcgctccgttgcctaggctggagtgcagtggtgcaatctcagttcactgcaacctccacctcccaggttcaaacaattctcctgcctcagcctcctgagtagctgggattacaggcatgtgccactacgcccagctaattttgtatttttagtagagatggggtttcaccaggttggccagactagtctcccgacctcaggtgatccgcccgcctcagcctcccaaagtgctggaattacaggcatgagccaccacacccggccctatcttacatctttatcatcaaacagggtcctactaggacaaaaacaaaaggctccatttttctcctaagaaggatatttaaagattgtcttttaaggtctttgtgattacagccacctaacgttttctgaatgagacagggtataaatatatatttaataattgttgtgaaaatctaacatcccaagtagattttactttgtacaactagtactgtagttgaaaatcataagcctgattaacctttaaagttccttctatgacctataagtaaaatgtagcaatagtaatataggtattgacatctgaccaaatctggtaccattctgaaggactaaaaaatgttcgctaaataccccatttcactttctttttcttctattattttctgtcttcttttcctatctctattctttttgccttttctttctttgcccacttttctctttcttcctctgattcgttctcctttcctattctcttcctttcctttttttctccaacttttaatttccagggtacatgggcaggttttttacagaggtaaacgtgtgccatggtggtctgccgcagagatcaacccatcacctaggtattaagcccaggatccattagcgattcttcctgatactctctctacccccacacccccgacaggccccagagtgtgttgttccccacgaagtggccatgtgttctcatcattcagctccacttataaatgacagcatgcagtgtttggttttcttttcctgcattagtttgctaaggataacggcttccagctccatccacatccctgcaaaggacataatcttgttcctttttatggctgcatttctctaatgatcaatgatgttgagctttttttcatgtttgctggctgcatgtatgtcttcttttgagaagtgtctgttcatgtcttttgcctactttttggtgaggttgttggttttttttcttgcaaatttgtttaagttccttgtagactgggtactaaaccttcatcagatggacaaattgcaaaaatgttctcttattctgtaggttgttcactctgatgatagtttcttttgctatgcagaagctgtttagtttaattagatcccatttactaatttttgcttttgttgcaattgcttttggtgtttttgtcatgaaatctttgcccatgcctatggtcctgaatggtactgcctagatttttttctagggttttatagtttggggttttacatttaagtctttaatctatcttgagttaatttttgtataaggtatagggaaggggtccagtttcaattttctgcatatggctagccagttatcctagcaccatttattgaatagggaatcctttccccattgcttgtttttgtcatgtttgtcaataatcagatggttctaggtgtgtggtcttatttctgagttctctattatgttccattggtctatgtgtctgcttttgtaccagtaccatgctgttttggttactacagactagtagtataaagtagggtagcatggtgtctccagctttgttctttttgcttaggattatattggctatttaggcccttttttggttccatttgaatttttaaacagttttttctaattctgtgaagaacattaatggtagtttaatgggaataacattgaacctaaaaattactttgggcagtatggtcgtttttacaatggtgattcttcccatccatgaagatggaatgttttttcccatttgttcgtgtcctgttgagcagtggtttgtagttccccttgaagaggtccttcacttcccttattagctgtattcctaggtattttattctctctgtagcaattgtgaatgggaacttgttagaaatgaagaactgaactgcataccccatagcaaatcaaaatttgcattgttttgttttagtttttttgtagagacagagtctctttatgttggccaggctggtctcaaactcctggcctcaagcgatcctcctacctcagcctcccaaagtgctagaagtacaggcatgagccacagcacctggcccctagaatctgcatttttaataagatctattcatgtgaacattaaactttgaagaatgccattctaaccagaattcttatgtactcagaatgggttactggtgtgccaagatattgatcctcttagttttccaggtataaacacaggtttatgaaatagagataataatatgagtatcagtctcaaagagttgacttatggttatagggcttaaatgagatattacacataaagtataccatgtttgacatatgtaaatacttcataaatgttagctattattagctgttcgtacccttttgtttttttttgactccgtttgctttttcattaataatttgcgatcacataagctatacatacgaaacacagagaaagttaaccacctattctaattctatattaaaccatgcggtttttaaaaagtacattaaaaatgaaaaaattaaatgacgaatgtcatgctatttcttactctagattatactgcacccaagggcagggatgaggttaatattccttttatatacttatattacttgaagaacccattttgctctggatggatgttaaataaactgagccatagaattaatattactctaaaaataatttaaataaatcatgttaagacctcagaaattaccaacttttcataattcatacacttattcattcattcaataaataattataggaccagactaaagttgagatgacattcttacctacgctttgccaaataaattcagtaactttctaattatttaaaataaaagatgaaagttataaatagttatttaaaattatgatatacacacaaaactgaagttctaaccaatttacctaggatgtaaggaataaatggagaggatggtcagacctagcacaatactgagcaagggctcagtcaacatctggctgccaggaagctgacagaaaacagaaacgcaattcaaaaggagaccacaaacctctttgtcaatggcagtggtatgcaactgggcctctgcgagctcacagtcaagagctctttgtaggctgtatatgacgtggtcatatgaatggtgttcatcattgaaaaggacacaatagtatctttcatttttctccctgttagaaaaaaaacatatatatttggatactacaacaaataaaggaaaagtaaaaaaaaaaaaaaaaaagacaaaattaatacataacatctgtgtagtttccaacctgtgggaaagtaacaccataaaagtaatatagaatttgattttttttttttttttttttttgaaacagggtctcactctgtcacccaggctggagtgcagtgacgcaacctcgactcactgcaaccactcccttccaggctcaagcaatcctcccacctcagcctcctaagtatctgagactgcaggcacgtgtcaccacaccccagctaatttttgtattttttgtagagatgcttcgccattttctccaggctggttgcaaactcctgagctcaagcaatccgcctgttttgacctcccaaagtgccaggattataagcgtgagccactatgcccagcccagaatttgattttaagtggtatagtgccatcactttttaaaactctgataaaaatgtttccttttccatgtttttcccccaatttttcatattactttcaaaagtctcagttcagtgaccgtatgtttttgggttttgttttgttttgttttagatggaatctcactctgtcacccaggctggagtacggtggcgcaatcttagctcactgcaacctccgcctcccgtgtttaagtgattctcctgtctcagcctcctgagtagctgggattacaggtgcccaccaccacacttggctaatttttatatttttagtagagacagggtttcaccatgttggccaagctgctcttgaactcctgacctcaggtgatccacctgtctcggcctgactgtatgtttttaatactacccttaactcttgcttatctcctattctgacaaaaggagacaggcctcaggctcagaaccttgaagcaagcaatgataaataaacagattttattaacaattagttgttattgaatttatttttgtttttaccttctatttaagtgatactggtattaatgtacatttaagttagtttcaagaagtatacagtatagacttaagcgccagcactgccattttggcaacaggaccttaagacagctcacctaatcttttaatcttgctgagatgacagtgctttttcatctccaaaaggaacataatatctacattcaagagtgttatgaggatctcacaagatatgtaaaaacagctgccacgggctacatatgtgttcagtatttttttttttttttgagacggtctcgctctgtcacccaggctggagtgcagtggcgcaatctcggctcactgcaagctctgcctcctgggttcacgccattctcatgcctcagcctaccaagcagctgggaccacgggggcccgccatgatgcccagctaatttttgtatttttagtagagacagggtttcaccatgctagccaggatggtctcgatctcctgacgtcgtgatccacccacctcggcctcccaaagtgctgggattacaggcgtgagccgccgcgcccggcctatgttcccagttttaaacaatatgtaatatacttttacaatacgctcaattgatcctcaaaactctgaggggcatattttctcagccctcttatgttttagaaaacagagactaaaggggttaaaaggccaatatgtcatggtcacaatgccaacaggcaatgagagggcctagaactcagatgtgtgaacccaaagacccgtgctacccacataaaaaatgacactcaagcaatcctcgtttttttatgggcagatggctcatattatgtttaccaacataaagtgacttaaaaggtttaactgacattaacacctgttggaaattaacatatttgtggatgcagtttgtcatgacatttatttccacaagtggtttttagcctaataagagtcaaaatagtacatttaatgtctctattgattagaattcttacttctttctccctttaaaacaaaacaaatgaaaatagccagtaaactcaaagaatgactatttagatttgggctgcaattttgtgaaaatcctaatattacataggtagaaaaattctcacacaactcaaagttatcttcatatcaggtccagaattcctctttgcatttataaattaagagcaaatattactgtcactgaaagacttatggctaccagaaattgctgagttctagctaaaaaaaaaaaaaaaaaaaaaaaaaagctacatccctataatttcaataatcctagataccaccaaggcacaggggaaagggccatttcctcattcccatcaaacttttcttgatcaggacaagagctaaaaacccgggctaaatggagatacactgttccaaagtccctatctttgttaacgaacctcctgaggaaaccagacattagtccaggccaggatcaaagtgggcagtttacttacctagtgggatgagaggctgctaggtccttataaatcatttagaacaggaccccaaaaatgttgattttttttccgtaaaaattcaaagctcctgatacactactcttttggcttagcttctggatggtgcctagcaaagtatctcatacaaacggacattttgaaatattcccaagagataagtcactaagaatttttcataatgataattaggcagtaaataacaaaaacaattatcaaacacacattttgcaatacaaataaccatcactaaaacttgttccgtttgacagttttccccaccttatctggagttcaggaggcagttctttttcctcttcccatatagtcatttctacgacatattttatcactgaaggaaatattttcctggcttggacaattacctcttcattcaacggacagcgtgaattctataaaaaagccgagaaaaacatactagtcaagattgtatacaaataaatggataaggaaggtaatgttaagttaaaataatcactttgctgaattcattacaacatcgtccaggaatgaattcaagttgagctcaagagggttgctatatatttagatcagtttagcttaaccccttgtggccaagttggtgttactgatgacagaaaggaggcagaaccatgaagtctccccattagtgatatactctcttatgaatgttcctacctgcctttctgagtagctaattacgatgatatcacgtaacaactgtttatcccttatagcttacaaagacttttctcacagcttgtttccccagatcctcatggctctctctaagacagaacaggtattaatgacattgaaaagaaatagaacccagccagtcacagagggacaaatactatatgattctgctcatacgaagtatctaaagtagtcataataatagaagcagaagatagaaaggtggttgccaaaggctgggtgtaggcagaaggttgttcagtgggtaaagagtttcagtgtcacaagatgaaaaagttcttaagatctgttacacaacaatgtgaatatacttaatactactgaacgctatatctacactactgaactatattcttaaaaacggttaagatgataaattaatgtcatatgcttaaccataaaaaaaaagataaggaacccatctaagatcacagagcttacaaatagcagaaacatgactaaaatctgggtcttttgactcccacaaaaaagcaatgttcttttcattacaaaacattaataaaaagcttgttcaagccaatgagttatgaaatccatttgaatgctccatatcataagccatcagggaatgcaaacccaaatcacaatgagataccacttcacaactacctaggtggccataacaaaaaaagcagaaaataacaagtattggccaagatgtaaaaaataatgtaaaaagatcagcaagattgcaggatacaagataatgttacaaaaattacttgtatttccctcccacctcagcctcctgagtaactaggactataggcatgtgctaccacacctagctaattttaaaatttttgtagagatagggtctcctggcctcaagtgatccacccacttcagcctcccaaagtgctgggattacaggcatgagccactgcacccagccaccataataagcttttcatacgatataaaatgaagtacatagttttaacatctaaaaatcaatcaatgtaatacaccatataaacagaataaaaaatgactctttatggattctttaggatttttcatatacaaaatcacagttgcccaggttggtctctaactcctggtctcaaataagcctcctgcctgagtctcccaaagtgctgggattacaggcgtgagccaccagttgtgtgtattttatggccgaagatgtgtatattttatggttgtaactgataaaacagactggtgtctacaaaatcacgtcctctgcaaacagagctagttttacttctccctttccaacgtggatgccttttactacttttcttccctaaattccttggtagaacctccaatacaatattgaacagatatagcaaaagcagacatccttgtcttgtttctgacttcaggaggaaaacatccactgtttcagcattaactatgatattaactgtgagtttctcatagatgtcctttatcaggttgaggaagttcccttctaagtttgttgaaatatttttatcctgaaagggtactggattttgtcaaatgtttttgctacatctactgagatgataatgtggtttttattatatttatatggtgtattacattgattggttttcaaatgttaaaactatgtacttcattgtatatcatatgaaaagcttattatgctggctgggcgtggtggctcacacctgtaatcccagcactttgggaggccgaggcagatgaatcacttgaatccaggagttcgaatcagcctggccaacgtgatgaaaccccatctctactaaaaatataaaattagccggatgtggtgccatacgcctataatctcagctactcgggaagctgagacatgagaactgcttgaacccaggaggtggaggttacaatgagccgagatcataccactgtacttcagcctgggcgactctgtctcaaaaaaacaaaaaaaacaaaaacaaaaacaaaagcttattatgccatatcacttcattattaatgatgatgttaatattaatgactgatttcaggtgatgacagtatgataaccccattgtaaagtttcagttttttccccttatgactagcaaataatcaataatttagaagtatgtaaatgtaaatactgttcctcatcaacctaagtcttaagaattttagcatccttgtctgaatcaaatatttccttatggttgacaaaatgttgatttttctagttctatcattccttgtctaatagctagcatttctctagaaagaaaagcttttcctaatgaactagagatacttggttaccatgaaatacaattcttattgaaaaggcaggataagcgcttacttcattccctttaccaattttaatagtaagaaattgatagtacagctacttgtcattgtcagaaacaggttttacttcatctagctctcatttaggtttcattaggaactcacggatttttatatattcaatgtgattcaatcaattatattggttatttattgttttttcttttgatgcttcaattatccaagtaaggtcaatgtgaaccttttcaagctgggtcctacgttcttttgcatgagcttgccttatacttcccctgacccagacctggaaccaggtatttctgacaacaagaaataccttattgctgtaagagcagaatggtacttaaaagatcaacatatgtgccctacaggtgtttgctgctttagggatatccacaacagtttaaagagcgcaaaaactatttattccttgaagttgtgaaataattcatctgtaaaacttctgaacatggcattctggggcaagtactttcttgtgaaaattttctgaatttcttcaatgtaactgaccaagttttctctctgctttctaataaaaatattgcactctatactatctgataagataatccattttcaagtgtaattgcacaaaatcattaaaagagtattttataatcctcgtgattccttctgtatttgtgattctatggttattttcctattctcatttctaattgtctatatctgggcttgctcaaacttctttatttccttgactgggatatatctatgtaatctaattgacattttctttaagaaaagcaattactgaatttatatatcagctctacacttctaattcactatatgctactcttatctattaataattacttccttttgttcatttaggcttatatgttgtgtactattttcctttttgagatagtctcactctgtcgcccaggatggagtgcagtggcatgatcttggctcactgcaacctccacctcccaggttcaagtgattctcgtgcctcagtccccccaagtagctgcaattacaggtgtgtgccaccacacctggctaatttttgtatttttagtagagacagggtttcatcatgttggccaggctggtctcaaactcctgacctcaggtgattgagcctcccaaagtgccaggattacaggcatgagccatagcgcccgacctgtgtactcttatgtatcaagttgattgcttaacaaaacatattctgaattcatcttttcattgtaaattcattctctctttagagacattatcaaatccttagtttctttggagctagaaaaaaagcctccttacacctaaatatgagaataaaaacagcagggttctaactggaatctatacacataacatttattcttatctaatctcagcaaacttaaaatagttaacaatttttaacaaaatagcattcttacctcttttatagtacctgctcttccaggttcatgatttacacaaaaagggccagttttccatgcctctgtgtctccacagtcacagaaccctcctccagtagaagtatgcatctgataaaggaaaaatgagtttgtcttgatttcaaacattttactaagcatgaagaatgataaagatgactcaaataataaatgctcaccaatactccaaccttaattgagttcaatgtaatattaactggatgtaacaaaaaccattttcgattagttacctaaaaaacaaaccaacaaaccaaaacttccaaattctgaatacttcatcataacaaaaatgaactgccaaaattgataagcttttgaaacataactctaatttttaaataacagttgtttaaattttgactaatggagaagaatagattgcaaagtgtgcgaaaataatctatacaacacctagaattttttttttaattgttatactttaagttttagggtacatgtgcacattgtgcaggttagttacatacgtatacatgtgccatgctggtgtgctgcacccactaactcgtcatctagcattaggtatatctcccaatgctatccctccccactcccccctagaatttttgagtgataagatttttttttttttttgagatggagtttcgcttttgttgcccaggctggagtgcaatggcgtgatcttggctcaccgcaacctctgcctcccgggttcaagcgattctcctgcctcagcctcccaagtagctgggactacaggcatgcaccaccacgcctggctaattttgtatttttagtagagacggggtttctctacgttggtcaggctggtctcaaactcccgacctcaggtgatccgcccgcctcagcctgccaaagtgctgggattataggcataagccaccatgcccaacctgataagatttttttaattaaacaaacttaaaaaaactcatgccctctccctctccctctccctctccctctctccacggtctccttccatggtctccctctgatgccgagccaaagctggacggtactgctgccatctcggctcactgcaacctccccgcctgattctcctgcctcagcctgcagagtgcctgcgattgcaggcgcgcgccgccacgcctgactggttttcgttttttttttttttggtggagacggggttttgctgtgttggccgggccagtctccagcccctaaccgcgagtgatccgccagcctcggcctcccgaggcgccgggattgcagacggagtctcgttcactcagtgctcaatggtgcccaggctggagtgcagtggcgtgatctcagctcgctacaacctccacctcccagccgcctgccttggcctcccaaagtgccgagattgcagcctctgcacggccgccaccccgtctgggaagtgaggagcgtctctgcccggccgccatcccatctaggaagcgaggagcgcctcttccccgccgccatcccatctgggaagtgaggagcgtctctgcccggccgcccatcgtctgagatgtggggagcgcctctgccccgccgccctgtctgggatgtgaggagcgcctctgctgggccgcaaccctgtctgggaggtgaggagcctctctgcccggccgccccgtctgagaagtgaggaaaccctctgcctggcaaccgccccgtctgagaagtgaggagcccctccgtccggcagccaccccgtctgggaagtgaggagcgtctccgcctggcagccaccgcgtccgggagggaggtgggagggggtcagccccccgcccggccagccgccccgtccgggaggtgaggggcgcctctgcccggccgcccctactgggaagtgaggacccctctgcccggccagccgccccgtccgggagggaggtgggggggtcagccccccgcccggccagccgccctatccaggaggtgaggggcgcctctgcccggccgcccctactgggaagtgaggagcccctctgcctggccagccgccccgtcggggagggtggtgggggggtcagccccccgcccggccagccgccccatccgggaggtgaggggcgcttctgcccggccgcccctactgggaagtggggagcccctctgcccggccacgaccccgtctgggaggtgtgcccagcggctcattggggatgggccatgatgacaatggcggttttgtggaatagaagggcgggaagggtggggaggaaattgagaaatcggatggttgccgggtctgtgtggatggaagtagacatgggagacttttcattttgttctgtactaagaaaaattcttctgccttgggatcctgttgatctgtgaccttatccccaaccttgtgctctctgaaacatgtgctgtgtccactcagggttaaatggattaagggtgcgagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgggagaaacacccaagaatgatcaattaaaaaaaaaaaaatctgagaaaaaaaaaaataaaaataaaaataaaataaaaaaactcatgatgattacatagtacttaagaaatgtataaagtattttaatttacacaaatatcccatagcaactaaaacttatttataaactttatcctttcagtgttgttgaaaaaaaattatccaaaatatactacctcaggtagaggatgatggcaacaacctgattttgaatcttcctcaaaacttcctccaaaacataaaaagaataaggagaacactaaaaccatacattatccatactttcagcatttactaggagaacaacaaaaaaaattaccacaacgttcatatgacgtactccaaaggaattcccattgcctatcccttcaagcctgtgggtgcagatagcaagagaagggagcttaaaagactccatgaaaaagtacagaggtgcagaggacttagaagaaacactgaaacacagaaaaaagtcacccccaaaagagaaagcccaatgctaagggatgaaacctgaacatgagttgggacttgattcacaaagaaagtgagaaggacaagaggtggcaaactcagagaagcagtacttttggaagaaaatcagatacatttttacagagtggaaacccctaaagatgtggcaatgaaggaaaaagggatataagggaaaattctatagaaatgagagagaaacaagacgtgccaaaccctcccttcacatcaccaccactaatatcatcaacaaaaaaagaaattacacagaaaatggaagaactgacagaagagagcacttgtaacccttgagcatgaaatgagaaagaacagaaaaagcagcccatattcacataaacatgtaaaaattaaaaggggaggggcaaaaatgcaaataagagccaaaacccaatcacaaagctaaagaaaactataacacaatgctccaaactcaattacatggagtcaaacaagcatttggtgattatgacttgaatcagatgaaaacaccttgtatcagaaatagaaaaactggccaggcacagtggctcatgcctgcaatcccaatgctttgggaggtttgaagtgggaggatcactaaaggccaagagtttgagatcagcctgagcaatacagcaagatcccatttctacagaaaattaaaaaattagccaggtgtggtggcatgcacctgtagtaagtaatacataaactaaaaacagaaatggacaaaaaagcaggaataaatgagacttaattgaactcaggaaaaaaaaatacaagaagatgagaaaatcatgccagaaatgaattttacattacaaagtatccaaaatatagactcaaatgaaaagttaatgaataacattgaagcaaagcaggaatacaagagaatgaaaatgagatgaagtaaaaagtaggatcagagagaaagtcattgaaatgggggacaggcataagaaagccactataactggagtcaccgaagaagaaaatcaaaacaacggaacacaactaacatttaaaaccacagaccaggcacagtggctcatgcctgtaatcctacaccttgggaggccgaggcaggagggctgttttagcccagaagtttgagaccaacctgggcaacacagtgaaacctcgtctcggttaaaaaaaataatcgaattaaattaaaatgtaaaaacaaattaaaaataagactataaactaagaaaactttctgcaaataaaagaacacctgaatctgtacactaaaagggcccatgaattcttgagtgactaatcaactccaaaatatatcctagtaaaactatttgactttaaagataaaagtcctgagggtggccaggagcagtggctcacgcctgtaattccagcactttgggaggacgaggcgggtggatcatgaggtcaggagatcgagaccatcctggctaacacggtgaaaccccgtctctactaaaaaatacaaaaaaaattagccgggtatggtggtgggcgcctgtagtcccagctactcaggaggctgaggcaggagaatggagtgaacccgggagacagagattgcagtgagctgagatcgtgccactgcactccagcctgggcgacaaagcgagactccgtctcaaaaataaataaataaataaataaataaaagtcctgagggtattcaggtaaaagatgagatatcataatgacaagaaaatcatactggcattagacttctcagtaacaacatatgaaacaatagcagagtagtatttttaagtaaagaaaatgcaaactaaggatattatttccagccaagctataaaggtctgattttgaacatgtcaggactcagggaacactacacatgtacccttcttgaggtgtctatttgagcaagaatcagcaaactttctgtgtaaggaaccaaacaataaatattttaggttttgcaggccacatagcctctgtcaaattactcaatgctactgccgtattgcagaagcagccacagagaatacaaaagtgaataagcatggctttgctgcaataaaactttatttacgggcactgaaattttaatttcatataattttaatgtatcatgaaacatttttttaaactaaccatctaaaaatataaaaacattctcagctgtttgaagccatataaaaatagtgagccagatttgacccacaggctgtggtttatcattcccttccaccatcatcccccagccactagcaaccactgatttttttattgcctccccagttttgtcttttccaaaatgtcatacagttggaatcatacagtatgtagccttttcagaattgttgctttcatttatcaatatgtacttaaggtcccaccatgtgttttcatgacttgatagctcctttctttatagtactaagcaatattccattgtatgtatgtaccacagtttttccattcacctactgaaggacatcttggttgcttccaagttttgggaaatatgaagaaagctgctataaaacattcactggccgggcgtggtggctcacacctgtaatcccagcaatttgggaggccgaggtgggtggatcacttgaggtcaggagtttgagaccagcttaacatggtgaaaccccgtctctactaaaaatacaaacattagctgggcatggtggtacacatctgtaatcccagctacctgggaggctgaggcaagagaaatgcatgaacacaggaggtggaggttacagtgaaccaagattgtgccactgcactccagcatgggcaacagagccagactccatctcaaaaaaaaaacatttcgtgtgcagtttttttgtatggacataagttttcaattcatttgtgtaaataccaaggagtgctgttgttggatcatatgataaaagtatgtttacttctgtaaaaaactgttgaattatcttctgaagtagttataccatattgcatttccaccagttataagacttcctggccaggcacggtggctcacgcctgtaatcccagcacttcaggaggctgaggcgggtggatcacaaggtcaggagttcaagaccagcctgaccagcagagtgaaaccccatgtgtattaaaaatacaaaaattagccaggtgtggtggcgcacgcctgtaatcctagctactcaggaggctgaggcaggagaatcacttgaagccaggaggcggacgttgtggtgagccgagatcgcaccattgcactctagcctgggaaataacagcgacaccccatctcaaaaaaaaaaaaaaaaaaaaaaaagaaaagttcctgttgttccacatcctcaccagcatttggtgctgtcagtgctttggattttcactattctaataggtatatagtaacatctcattgttttaatttgcaattccctaatgacaaatgatgttgagcatcttttagtgtgtttactactgatcatttgtatatattcttgatgaagtgtctattcagatattttgtccattttttaaagggatggttttcttattcttgaattttaagagttctttgtataattttagcactggcctttttttaagatgtatgtttggcaaagtttttttgctcagtctatctcttgccattttattctcttaaaaatccatattttttaatccagtaattccacttctgagaacctatcctaaggaaataatcctacatataaaaaaattatttacacataaaggcatttactgtaacactgtttatcattttaaaaaaactgaaacccaaataaataccccaataataggtaaatttaaaaataaaatatggttaaatattatatacataatatgttcttaaaaaagcacaatgtataattttatatattttgctttttacatttaaaagtataacaaaattttatttttataactccacaaacttcctttgaaaactacatttttttcctgattaaaagagatagttgcagaaatacactctttttatagctcatttttctcatttaacaacatgaaaaaaacatttctattaaaaacaatctttaacagtaagtgtatgttcgtttctatgtatgtatttttgagaaagaatacacagaggtttactgtaagttttttttttagtagtaaactactgaaaggctagagatcacaaagaagggtcatattacacactgtagagcaaagagctcaaaattttgtttgttttcttgttctcaaaagttgttatggactattctgcaactgaaggtttatcttggtcctttcatcacataatatctgatcttgagtctccctaaaattactccttttttcttttctgtaaagcaacacacatcccttatctcttccaatcttttctttaaaatggctatgttcacatatcagagctgttatagcaggaatgtgaatactactcaagaatttggactagatggccatcagattcctgcttattcagaggttatggttatattttcttaccttgtaacgatgatttttatgaacactgtcctggaagcagtccatacagagtacacatgttggatcaattgcacaatccctgaaaaagatcagaaatcagattccaaaatttagatgactcccactgatgctcaaggtatgactataatacaatgtgaacaagtttcctctatggtacacaaactgaatatgaaaatgcttcaaaaactggattgttaaaatgttttgaacaaagataatattgctagcacaactttagtctcattttagccacatttaagtgtgtaggtctggatgtttggttttctttctgaaatcattctcataactttgggccttgacctggtttcgaactgttagattacaattcaaaaatagttttgtaaaaaataatccactttttccattaactaccatcatctcatcctattacataaacaaatatattttacaaaagctgattgctcattgttaaatgaggcttggataaagacaaagttcattagaatgcaagcaacataagggcagggatttctattcattgtacattgaagtgtcccgaacacctgcaatgatgcctggcatatagtgggtacttaatattcattgaacaaatgaaagaaattcaatccctcttcatctctcccttaataacaacttcttaaatgcattgttttatttaacattttggaggagacattaagaacaatataaattagtgcaaagtgcaggattattatttttttttcttttgagacaatctcactctgtcacccaggatggaacgcagtggaaggcagtggcataatcatagctcactgcaacctcagcctcccaggttcaagtgattctcgaacctcagcctcccaagtagctgggattacaggcatgcgccaccacgcccagctaattatttgtatttttagcagagacagggtttcaccatgctcgccaggctggtctcgaactcctgacctcaagtgatctgcccacctcagcctcccaaagtgctgggattacaggcgtgagcctctgcacctggccaggattaattttttaaatatcttatttagaagaattgaagagataaaattggggaattttaaaaagattttaaaaggctggccaggcttggtggctcacacctgtaatcccagcactatgggaggccaaggtgggcggatcacctgaggtcgggagttccagaccagcctgaccaacatggagaaaccccgtctctactaaaaatacaaaaaattagccaggcatggtggtgcttgcctgcaagcccagctactcaggaggttgaggcaggaaaattgcttgaacctgggaggtggaggttgcgggtgagctgagatagcgccactgtactctagcctaggcaataagagcgaaactctgtctcaaaaacaaacaaacaaacaaaaaacaacaacttaaaaagctaacaggaaatataggttgtctaataatattctgtaaaatatatatcatctatagacctatttagagtaggatttttcaaccttaatactactgacattttgggccagatatcatttgtcgggggtgaaccagactgtcctgtgcattaggatgtttagcaggaatcttggcctctacacactagatgccagtaccttcatccccagttgtaacaactaaaaatatctccatgaaacttttggagacatgaggtctgcaaatgtctagcatgctttagttgaaactgattgggctttagctaaaaatatgtaagaatataaatgacccttactatactatatagcaacatggtacacaaaatgcaaagactattttttcgtttgtttttgagatggagtcttgctctgttgcccaggctggagtgcagtggcacaatctcggctcaccacaacctctgtctcccgggttcaagcaattctctgcctcagcctcccgagtagctcggatcacaggcgcccaccaccatgcctggctaatttttgtagttttagcagagacggggtttcccatcttggccaggctggtcttgaactcctgacctcgtgatccacctgcctcggcctcccaaagtgctgggattacaggcatgaccacagcgcctggccaaggctattttttttcccctgagaaaagaacagaataaagaaagatagtatgttctaaacaactgttaactgtacataaaccagttaggcctagaattataaggaagtaaaaacaattctctgtatttataaagtttaaaactttacactcctaacctaaactagctctaagaaggaaaactaaatttcaaatttcaggcagaggtaaggagtaaaaacattctctgtgctgtcacgaagtttaaggcactgctctcacaaagaataaaaagcctaaagttgctttcagtttccctgccgctggcctcttctattcaactaaattacaactgtttctacaggttcaaaatcccttatgccagactctgaaatccaaatagctccaaaactgaaaggttttgggattgtaggtttggcaataaatctcacttggtggcaaaaaattactttaaatgacatgcgactacaggcatgatttatactacttgttatgaatattcacagatttcttaaagaaagattgtgtttgattacagtgtcccgccctgactctgctggggaagtattcagaattctgaaatggccccaaagagtttcaggtaagagtgtactggatatattatgaacaaggcaaaaatttatcactgacattccgttggagaacaggaagaaacagtgagcactatttaactggaagacatatatattcagaaacaagctatactagcaaaaaccaaactataacggtataataaaagaaaattaataagattaaatgtattataaatagcaataaaccaagacaagtacatcgtgaaatagatacaaaataccaagattgtaatacttggccaggatgcagtgactcatgcctgtaatcccagcactttgtgaggctgaggcatgtggatcacttgaggccaggagtttgagaccagcctagccaacatggtgaaaccttgtctctactaaaaatatgaaaattagccaggcatggtggcgggtgcctgtaatcccagccagacgtggtggcgggcacccgtaatcctagctacttgggcggctgaggcaggagaattgcttgaacctgggaggcagaggttgcagtgacgtgaccggagatcgcaccactgcactccagcctgggtcacacagcaagactctgtttcaaaaaaaaaaaaaaaaaaggattttaataattataatcaatcctgtaaatttctaattcttacctgcaagaataggttgtctctccacttttgaaaaccctcccacaaagctgaaatgctccactgtgcttcaatttctctaagcaaatatctggatcttctccaaataagtaccattccagtggagtgaatattgacatttgtacactttcctcctgcttttccaagtctgggtccatttcagcaaagtaaatttctggcaccaattgtgccaaatgatgcaagaaagcagtataaaaatcaacttgctgatcccaccactaaaagaaaagaagatgaaaattagactgacttacaagttccttcttaatcatctaggggcacaaataatgacataattctacaatttcaaagtaatttacagtatatttcatctttcaccaatacagaaggaaagtgggtgattaaaaaaattaagcttggaaataagcaactgctcacataccaccagtatctgaaaaaaaaaaaaaaaaaaagaagagtagctgtagtaagaattatccttcccttctgaaatggccaattcctgctatgtgaaggtggttctattatcagtcacaggctgtacagacaatgcattcatcaaaaattttgttttaggaaaccagagtatttaacaagagatcgaaatgaacataggccaaaattttgtaaacacaaaaagcactaaccataaaaggaaaaaaactagataaaatggacctcatcagaagtaaaaccttctgctctttaaaagaaactgttacagatggcttatttgcatgtgaaaacatgcttacattattagtcattagggaagcacaaattaaaatgacaatgagatacccctgtacaacctagtacagtggctaaaataaaaaactggcaatatcaaatgctaactaggccaaaagtgctttcccacctatagtcccatctcaggaggctgaagtgggaggactgcttgagcccaggagttcaaggctgtagcgtgtgcctgtgaataggcaccgcacttcagcctcgacaacacatagggagaccctgtctcttaaaaaacaaacaaaagacaaaaacaaaaacaaaacacatatgactcaaggcacatcatttaaaaacaacaacaaaaacttatccaaggagttttacaagctaatagaatcgggccgggcgcggtggctcacacctgtaatcccagcactttgggaggccgaggtgggtggatcacgaggtcaggagatcgagaccaccctggctaacacagtgaaaccccgcctctactaaaaatacaaaaaattagccaggcgtgctggcgggcgcctgtagtcccagctactcaggaggttgaggcaggaggatggcgtgaacccaggaggcggagcttgcagtgagccgagaatgcgccactgtactccagcctgggcgacagagtgagactccaactcaaaaaaaaaataaaataaaataattagaattaagattttagataaggttccataacaggtcattaaggaaagttacagatatttgattacatataaggcttttttagtttgtactaatgaacctcaatattccattcacaaataaattcaacctcaatattccatgcacaattaaaactttatggaaaatatgtttagattaggtattactatagaaattagtccattctctaaagggcaatttgtagacagttattaaaattttagatttacatatattttgacccagaaatgcccattctaggaatttattcctctgataaacatgtaaaaagaaagtatttttttttgcagcatgactatttttaatcgtcaaagactggaaacaaccgaaatgtcccaaaacaagagctgaataaatcatgggacattataaaaaaggagagggcacagatctatgtcctgatatggaacataaagcaaaagttacacaacagtgagtataatgtgctaccatttatactgggagaagggaggaaaagaaaaaagaagaggtgaaggagatgtatctgtatatgtttatatttgaatacaaaaatctctgaaaggattcaaaataaactgttagcagtagaaagagcctgggaaaaacttagcgttcactgtgttaacttttttactgttttaattttttactgtatatacacattatctatttgaaatcatttaaaaactttttcaatcctatacatttcatgtacagttattcataacagcaaaaaattaaaaacctgaatgtccgtgaagacagggtaataatctatcatttagccatactcatccaagtgtgaaaatatatatttacatccaccagatgtgcactataacatcacttgtaactgaagagatgaagtccacctaaatgtctatcaataaaggtatatccactgtggtacagtcataccactcaatgcagtcagaatgtcataaatactgttaagtggaaaaagaagctttaaacataatttcatttttgtaaaaagtaaaaaattatatatacttttaaaatttcaacacatttgggctttctttctttctttttttttttgagatgaaatttcgctcttgtcatccaggctggagtgccatggcaggatctcagcttactgtaacctctacttcctgggttcaagcgattttcctgcctcagcctcccaagtagctgggttttctaatttaatacatgtggaggcacatctctgcctatgcttccctaaacatagactaagggtctggaaggagaaacaacaaactattaataatggctacacagagggaaggagctggggaaaagaattagggattgtcacatttttactttcaacaatgttacattgtttgactttgttagacaagtgtcaatacttttgcaactaacaaaaaaaaaaaaacttttaaaaaatctacatgagggctggtgcacatggtggctcatgcctgtaatcccagcactttgggaggccgaggcgggcggatcacttgaggttaggagttcgagaccagcctgcctaacatgctgaaaccccgtctctactaaaaatacaaaaattggccaggcatgatggcatgcacctgtaatcccagctactcaggagtctgaggcacgagaattgcttgaacccgagaggcagaagttgcagtgagctgagatcatgccactgcactccagcctgagcgacagagtgagactccatttcaaaaaaaaaaaaactacatgagataatacgcccatttaaaaatgatgctggctgggtgaggtggcttatgcctgtaatcccagcactttgggaggccgagaagggcggattacgaggtcaggagatcaagaccatcctcactaacatggtgaaaccccatctctgctaaaaatacaaaacaaaattagccaggcgtggtggtaggcgcctgtagtcccagctactcgggaggctgaggcaggagaatgtcgtgaacccaggaggcggagcttgcagtaagctgagattgcgccactgcattccagcctgggcgacagagcgagagtccatctcaaccaaaaataaataaataaataaataataaaaaatgatgccaaatggtctcaaagtatctccaatgggaaagacagtaacagagagaaagacaccacaacattattgtattattttttttctttttaatagagaaggggtctcacctaggttggtcttgaactcttgggctcaagtgatcctccccacctcccaaggacatggatctgacggggactacaggctcatgccacagcacctggctgatttttgtgttatttttgcccaaaatgtataatctaattccaatcatgagaaaatatcatacaaacccaaaatgagggacattccatacaataactgcaaagtactctaaaagtgttaaggtcatgaaaacaaggaaagatcaagacattgttacagactggagacgagagagataactaaatgtaactgggatcctgggtgttatcctagaacagaaaaagcacatttgtgggaaaactgatgaaatgcaaatcagatctgtagttagtatttatattaatttcctgtccttgataattatactatggttatgcaaaatgttaacattacaggaaacagaaagagggaggtaaaagaactgtgctacaatttatgcaacattttttatagtctaagattaaaacaagaaatgatgctgaagaggtttatttactaatatggaaaggcattaataacaaacagttcagtaaagtaggttacaaagcagtatatataaaatctcaatttggttaaatattatatttacatttacatagagaaaaatcatgacgactatttaacaaaatattaacagaaatgggtggtgtgattttagcatattttcatggaattcattactctgcttatcgaatgagtaatatccttacagtgagtccatattttggaagtaattttataattttaaaattaaaatttattttactaataccttttaaaaataaatataccttccagtattcctactccaacttttctggggtactcatacacaaacaacttttctctacatacctggcaacaactacaactaacatagagataatatctaatgttctatgttatacctaaggttcttttcatcaacagcactaaatgaagaaaaaaaaaaaacttgcatattcagcgctacaaaccaaacaaaaaatcttactgttctacttaattataagaggcacagaactagctcttttcaatttgtcttgtttagaagaaatttaagagtaaaaaagagtacaagcccctcacatttcatagatgagaaagctgaatcacagggaagtaaactgacttgtccaaaatcatcaaatcaccagttggtatcaatgtcaggaacagaactaggtatcctaagtcctaaagttcagtgcccattctactaaaccaaacataaatatacagtttttattttatttatttatttatttttattttttttgaggtggagttttgctcttcttgcccaggctggagtgcaatggcacgatctcggcccatgcaacctctgcctcccgggttcaagcaattctcctgcctcagccacccgagtagctaggattacaggaacgtgccaccacgcctggctaattttgtatttttagtagagacggggtttttccatgttggtgaggctggtcttgaactcccgacctcaggtgatccgcccacctcagcctcccaaagtgctgggattacaggcatgagccactgtgtctggccaaatatacagttttaaaatctacctttactggcttgttcaatttcacattataggttgggcatcccacacccaaaaatcagaaaccaagacactcaaaggaaatgctcattgtaacattttggattttagattttcagatttggaatgttcaaccagtacaatacaaatattccaaaatctgaaaaaatccaaattccaaaacacaagggatactcaaccagtaatggtaaaataaacaaaacaataaagttttgccttcttaatttttgctttaactattgccttctttgtaattacaattacaaatgaagcctcttagctaacaactaccgaacactactgaaggctactaaatattcttaaattatatctgtcatcacatgctttataatgaataattgatattttaaaacatcatggctgggcatggtggctgtaatcccagtactatgggaggccgaggtgggtggatcacttgagctcaggagtttgagaccagcctaggcaacatggtgaaaccccgtctctactaaaaatacaaaaattagccaggtgtggtggtgcgcatctgtaatcccagctactcaggaggctgaggcaggagaatcacttgaacccgggaggtggaggttgcaatgagctgagatcatgccactgtacaccatctcaaaaaaaaaaaaaaaaaaaaaaaaaaaaaattagccagatgcggtggcacatacctgtggtcccagctattcgggaggctgaggtgggagaattgcttgagtcagagagggagaggtcagtgagcggagatcatgccactgcactccagcctgggcaacacagtgagaccccatctcaaaaaacaaaacaaattatactcttggctgatttaggcagaatgtctgggtgctgatgccttaaataccctctccatcagtctcactactagctctctgtccctccacccccacaccaacttatttatccctcaaggcccagctcaaggccaaccttagcgaatccttcactgatcagcccaagaaaatttttcttctgttaattctaatacagtatttgaaggcagtactcattctgtacttataccactggctgatatcattaattacctttaaatgtgtacatctagcctcttcaattagaatgtaagctccctgaggagaggaactttgctcttcaaatccctgtatcctataggcctagcacaagtacacaataaaagttatcagttaattgctaaatgctacacatttcttgccagagaaaacaaagcaaattttgataacattaagccttctataactttgtgtatagaattttttttttctaagacagagtcttgctctgtcaccaggctggaatgcagtggcacgatctcggctcactgcaacctctgccccctgggttcaagcgattctcctgcctcagcctcccaagtagctgggactacgggcgcgtgccaccccaaccagctaatttttgtatttttagtagaaacggggtttcaccatgttggccaggatggtctcaatctcttgaccttgtgatccgcctgccttggcctcccaaagtgctgggattacaggcgtgagccaccgcgcccagcctagaatttttatgggaaataaagttcagttacactcttcacaaaaatgttttccattattgccaaactgtggaaaatttttttcaactaaaataggtttgattttttgcctttggttggttgtttttaaaattttcccccattttcaacaggaataaaattaagaatttttaagtaccaagtccaggaaaaaaaaaataactgtttgaaattaagggaaagctttcctaattgactattctgtaaaaaacaagttcttaacaagttctcaacattaaaattcccaaacattccaaacatttccctcatccccaaggagactagagatatgttttcaactctgacccaacagcttagatgcctgtttgggaacatcattctgaaaaaggaacttacttaagtagattagttttgtttaaaccacaatttgaccttccttaaacaactgctagacatctacagagccttcagagcccagtaattgtttttctaattcttctttttaaagtggtaacaaaacctggaggcgctaccatttttcacagccactatggattagtaataattagagcatctctaggcaccaaaaatctttgattatacaatgttttcttctaatattattctacagactcaaaggtttacagcaaccaggcacaatggctcatgcctataaccctagccctttgggaggccaaggcaggcagatcactggagcccagaagttcaagaccagcgtaggcaacatggtaaaaccccatctctacaaaaaaacacaaaaattagctgggcatggtagcatgagcctgtagtcccaggtactcaggctgggtacctgagtgggaggatcacctgagcccaggaggttgaggctgcagcaagccctgatcgcgccaccgcacttcattcagcctggggaacagagtgaggctccgtctccaaaaaaaaaaaaaaaaaaaaaccaaaaaggcaagctcataactaagctaaaatctactttcctgtaacttttatcctgttactgaaataaaccaatataattcactctgctttttcatcagtcttttcaaataaatgaagataactattacgtctctcatttctagtctcttcatttcatggctaaactgaaaaaaagagaataaagaaatttggccagccctaaagacatggtatcctgaccactctccaacttgattacccttatgaaactgcacagcatgcttccataaagaggaataggactatttattaccttccttatcctgagcactaaactgcttcaaaagatcacattctgaaaaggcgtggtggctcagctgtaatcccaacactttgggaggctgaggcgggcggattacttgaggtcaggagtttgagaccagcctggccgacatgatgaaacctcatctctactaaaaatacaaaaaaattagctgggtgtggtggtgcacgcctgtagtcccagctcgggaggctgaggcaggagaatcgcttgaacctgggaggcagaggttgcagtgagctgagatcgtgccaccacactccagcctggaagacagagtgaaactccatctcaaaaaaaaaagcaaacaaacaaacaaacaacaaaaacatccattctcacattctttttttctttttaaatttttttctatttctttttcttttttattttcttttttatatatattttaaatcctctttttcctagctcctgcaagcaaagcattctttggctgctacatcacatgacttggttaaagtgcagacaactaaaacccttagatcaatcacatgtaagagacctagtcctataccaaatgaacctagatataaggctttactttcatcacaattaagttagttttgacacaatattcagcctatatgggatttatcctttacttgttatccctaccagccttgtgctgtctgtaaatatgataagtcttctatgcctttatggcattgataaaataagccagagtcaaatatagagccacatgacaagtccactctcttttctttcctgttgagataacgtataagcatgctgtcagaatttggtttttgaaaacattttgtccctcctaagggacaaattctctttgtcctatttgttgtattctctttttcatctctgtcataagtcatgccccaattttttaggctttccttgaagtatctggataagtaaaatctgctttcataaactctgaggtatctatttcatattctctttctgctgtatggaatatatatctgcaaaccaactaaaatcctctcttaaattacaaggcagaacatgtgtgtatttttaaaaaattgataaattaacagactttccctccagtggctaaagtcatttctggcttacccataaataccaaaacttcaaaggcattttaaaaggtggtccataaagacattaagtagttacagcttcactcctctaaacaagtcaaacagactttgttctgaagagtggcattaagtaaactattagaaagagaattatattcaagtgagtaacagtagactccattctggacagggtctgtgtcattcctgggcagcaagtgggcagttaggaaagtgcactaactctactggagtcttatcagtaacgtttacttaccacagcatatttccataagcactcagattagaattagagtgtgacaacattaaaaaaaaaaaaaaaaggctgcatcaaatgctttaaaaaaactaagctcatcaactatggtttattcaagaggaggcatgttaactgaaaatatcttgaaagaacatgtaggcggtcatagtaaatcacctggcattagaggtcttaatattttgtgttaggtcatctgaggcaaggggttaaaagcttaaggaaaattatttcacagagcacagcatatgcttaatacctttacagaaatggataaagtggcagcaagggaactccgaggtaaccctcaaagtcagcatccaaagaaaggatgggcaagatacaggcacacctcagagacatttcgggttcagtttaagactaccacaatagagtgaacataaagtgagtcacacaaatttttttggtttcccaatgcatatgaaagttatgtttacactacactatactaagagtgcaatagtatgaagtctttaaaaatgtacttaatgttaaaatactgctaaaaaatgctaatgatcatctgagtctttagaaagttgtcatctttttgctgatagggggatcttccctcaatattaatggctgactgattaggttggtgattgctaaacgtgggggtggctatggcaatttctctctttttttttttttttctgagacagagtctcactctatccctcagactggagtgcagtggcacgatctgggctcactgcaatctccgcctgccggattgaagcaattctcctgcctcagtctcccgagtagctgggattacaggcgcctggctcatttttgtatttttggtagagatggggtttcaccatgttggtcaggctggtctcaaactcctgaccttaggcaatccgcccacctcggcctcccaaagtgctgggattacagccgtgagccaacgcgcccggccaggcaatttcttaaaataagacaaccatgaagtctgccacattgattgaccttttcacaaaagatttctctgtagcatgtgatagcatgttaccaatggcagaacttctttcaaaactggagtcaatccttgccaactctgcggctgctttatcaactatgtttatggaatattctaaatcatttgttcttatttaaacaatgttcacagcatcttcaccaaaagtagattccatctcaagaaaccactttctctgctcatccagaagaaacaattcctcatccattaagttttatcatgtgtttacagcaattcagtcataacttcaacctccacttctaattctagttctcttatttctaccacatctgcagttacttcctctactaaagtcttgaacccctcaaagtcatccaggagggttggaatcaacttcttccaaactcctgttcatgttgatattttgacctcctcccacaaactatgaatgttcctaatggcatctagaatgctgaatcctttccaaaagtttttcaattgactttgcccacatctatcagaggaatcgtaatttatgaaagctatagttttatgaaatgtgtttcttaaatagtaagagttgagagttgcaattactccttgatccatgggctacagaatggatattgtgttagcaggcatgaaaataacatttatctccttgtatatctccatcagagcttttgggtgaccaaatgtattgtcaataagcagtatattttgaaaagaatcttttttttttctcagcagttctctacagtggacttaaaatattcagtaaatcatgttataacagatgtactgtcatccaggctttctagttccatttattcaacatacgcagagtagcataattcttaagtattcttggattttctgaatggtaaatggaaattggcttcaacttaaaattaccagctgcattagccgctagcaagagagtcagcctgtcctttgaagccaggcattgacttctctctagctatgaaagctctagatggcatcttcttccaacagaaggctgtttcgtttacatggaaaatctgtttagtgtagccaccttcatcaattatcttagctagatcttctgcataacttgctgcatcttctccatcaatcagcacttactgcttcacgctgcacttttatgttgtggagatggtttcttttcttaaacatcacgaaccaacctctgccagcttccaacttttcttctgcagcttcctcacttctctcagccttcggagaactgaagagagtgagggccttgctctttgattaggttttgccttaagggaatattgtggctggttcaatcttctatccagagcactaaaactttttccacatcatcagtaaggctgtttcactttcttattatttgtctgttcactagagtagcacttttaatttccttcaagaacttttcctctgcattcacaacttggctaactgcttggcacaagaggcataactcttggcctatgtcagctttcaacagccttcctcactaagcttcatcatttctagcttttgatttaaagtgagaaatgttgaactttccttttcactagaatacttagaggccattgtagggttaactggcttaattttagtattgtcccatcttagggtatagggatgcccaaggagacggagagagatggataagtagctggtcagtggggcagtcagaacaaacacagctttttttattatgtttgctgtcttttatggatgtggttcatggcaccccaaaacaattacaatagtaacatcaaaggtcactgatcacagatcatcataacagatataataatgaaaaagtttgaagtattgtgagaattaccaaaatgtgacacaatgacacgaagtgagcacacaatgttgaaaaaatggcactgaaaggcttccttgagacagggttgccatagactttcaatttgtaaagaactgattatctacaaagcacaataataaagctcaataaaataaggtatgcctgtatttcactggttcatctgtatcactgatttataaaagtatctatccagacacactctttgtgcagtactgaggacaaaaaccttttcatttgcaggatgtttggtattataagaagtcagtttccagcactagcacatctacactaagttactgttccttccctagactcttagttagtggggctgaatcagtcattttgacttagagttttagaactcaatttcacatctaattctatagaatctggcattaaaaaatcaaaatttccctaactccccaaaatagaaattatgagatggtgaaaaaacaaaagccattaggtcttgctaagatctggtgacaaagtacttcagttagactcaaaagacctacattttcatcagttttcccactcagagtgtgtccttactacacaaaactgtgctctggcctaaaacaatatagattcaaatttctaaggaaaatcatctccaattaaaatcacatataactcctcacttctatattgaagtcaagagattatgttgtattttaaagatcccctatagcccaggcacggtggctcacatctgtaatcccagcactttgggaggctgaggcgggtggatcacctgaggtcaggagtttgagaccagcccggccaacacggcaaaatcccgtctctactaaaaatacaaaaattaggtgggcatggtggtgtgcacctgtaatcccagctactcgggaggctgaggcaagagaattgcttgaacccaggaggcagaggtttcagagagccaagattgcaccactgcactccagcctgggtgacgtctccaaaaaaacaaaaaaaaaaagttcccctacagatatgagattatgggtacatttttctttgatttccataatgattattgcgtaaccataacaatattaaacttttaaaaaatcctcccatttcagcaggagacaactttgggaaataacagaaatattctataacctgatttggtggtagtcacacaagtatatacatttgttaaaatttatccaagaaacgccttaaatgggtacattttattgtatgtaaattatatctcaataatgttaatatctcttaacattctcagcttctattacccccacttcctctctacctcagtgtcttctcattcattcattcattcatacattcaataaaaactttgaagcaatgtgctagaaactagatacagctgtgaacaagcaacagttcaggccttcaagaacttcactgtctagaaggaaagacacatagtaaacaggtaacgtagagtacagtctgagacacgctacataaaaccataaaacaggagtatagaaagggtgctataggaacacacaagaggtgcctcttttttttttttttagacggagtctcactctgtcgcccagactggagtgcagtggtgtgatctcagctcactgcaagctccgcctcccaggttcacgccattctcctgcctcagcctcctgagtagctgggactacaggcgcccgccatcatgcccggctaattttttgtatttttagttgagaaggggtttcaccatgttagccaggacggtctcgatctcctgacctcataataaacccacctcggcctcccaaagtgctgggattacaggcatgagccactgcaccaggccaagaggtgcctttaacctggctctaccatcacaaaaacttgatgtgcccccatgtactcaaattctaaaatgcccctttctgaccacaaagttcagtcctcccacttatgtcaacctcatgccctttaacacctcaatcccaccaattccctccagatttcctgttttggcttttattacctccctgttcagcctggactcgaaggttagccactaccctaacatgccggctcattcccttttttctatctacaacctccatccaccaatcactactaatcttactacaataaatcattaatgttgatcctcagttattcattcatttaaaaatatttaagtgtcttctgtatcaatcacataccaagatacatcaatgtggccaggcatggtggctcatacctgtaatcccagcagtttgggaggctgaggcagatggatcatgaggtcaagagatcgagaccatcctggccaacatggtgaaaccccgtctctactaaaaacacaaaaattagctgggcatggtggcatgcccctgtagtcccagctactcaggaggctgaggcaggagaatcgcttgaatccgggaggcggaggttgcagtgagccgagatcgcaccacgcactccagcctggcgacagagcgagactccgtctcaaaaaaaaagatgcatcaatgaacaagtcacacatgatccttcccttcatggaacttacctctccctctggaggaagaaacagacattttgctaagtaaataaagacaatacagtaattacagattgtaataattgaaatgggagaaataaacaggttgctttgacagagaataagaggaacccatcttttagacagagtgtgtattaagaaaaagcagaggaagaacactctaggaaaagcaaacagcaagcaacagcacagaccctaaagcaaaatacagcttgggcttgtactaacaggccaggatgagtgaggagaatgtaacaggaaatgaggtggagatgcaggggctggaccaggcaaagtcttgaaggcttgtaatgagtttataagtataagagaaagccactgaggatttaggtaggagactgacatgatctcatttaatctttaaaagattactctggttgttctgtgcagaatggacaggaagagggcaacagtggaagcaaacagaccagttaggaagtcactgcagtagccaagacaacagagagtgacttggactacatgggtggagacagaattatttgtcttcaagagctatgatggaggtgctgtctactgagacagggacaacaaaactcttgatctgcctttctcctttcctctcctaaaatcttgtctttcctctcaatatatgacacaaccaaggccaggtgcgatggctcacatctgtaatcccagcaactggggaggccgaggtgggtggatcacttgaggtcgggagttcgagaccaggctggccaatatggtgaaaccccacctctactaaaaatacaaaaaaactggctgggcacggtggctcatgcctataatcccagcaatttgggaggctgaggtgggcggcttgcctgaggtcaggagttcaagaccaacctggccaacatggtgaaacccctctctttactaaaaatacaaaaattaaccaggcgtggtggcaggcacctgtaatcccagctacttggaaggttgaggcaggagaatcgcttgaacccgggaggtagaggtttcagtgagccgagatctcgccacgcactccagccttggcgacagagagagaccttggctcacaaaaaaaaaaaaaaaaaaaaaaaaagccaggcatggtggtgcatgcctgtaattccagctactcgggaggctgaggcaagagaatcacttgaacttgggacaaagaggttgcaatgagccgagatcataccgctggaaacaacacaaccgctgccatgaatgcttaaaccaaaaactgaggatgcagatatcatctattccttaccttttgcctcatgcctaatctatcagcaagtctttttgcttcttccatccttctaaaatctttctcacattcatcctcttcactctatctccaaggataacctttccagtgcaagctaccatcaactatggcttgggttacagcagcaacttcttaattgctcccactgtttgaaacaccagacatccaagtgaagatgtcaagtaggcagttggatttatgattctggagttcagaagtgagatgacacagagatataaatttgggaactgaatacatacaaatggtatttaaagtcacagaactagatgaaatcccctaggtagaggttataaacaggcaatagaaaagagctgagtatcatgccaagaggtatcttctgaaattgacttaaggaagaaaatctagtcgaggaagacagaaggcagaagttctggcagactacctcacaagtctcttgattcccaatttttctcagtcctcattatcatggacccaataaaccaccctctcaaaataataccccatgccatcacactactctcacctcctacgtgcttgcctattgtttccacgttcttacctcattcttccattttccacccgtttcaatcattcctgttctctctttctcatcatctctgtctcactctcttttcctctgtgtgtgtgtatatatatgcacacattttcctcctcaaagatcttatccgggctgggcgtagtggctcacgcctgtaatcccaccactttgggaggccaaggcagatggatcacttgaggtcaggagttcgagaccagcctggccatatggcaaaaccctgtctctactaaaaatacaaaaatcagccaggtgtggtggaacacacctgtaattccagctacttgggaggctgaggcacaagaattgcttgaacctgggaggtggaagttatagtgagccaagatggcaccactataccacagcctgggtgatggagtaggactctgtcttaaataaattaaattaaattaaaccctgtctctacaaaatatgcaaaaaattaactcggcatggtggcacatgcctatattcccagctactcaggaggttgaggtgggaagatcatctgagcccaagagattgaggctgcaatgagttgtttgtgccactgcactccaacctgggtgacaaagcgaaaccctgtctcaaaacaaaaaggatgttatccattcccacaacctcaactataaatttactgataacttccaaatacctagctaagtgttactcaaagtgtggcccatacaccactattacagaatcagcaggacatgcttgtgaaaatgcagattcttggacctcacctcagacctacagtatcagttcccctggtaattcttaagcaatggcttttatcaatgtccactaattcatacgtattattttatttgaattgcatgtgagataatgttaggaatactacagccttcacgcttactaatagcaatatgaatgaaaaaggatctgcagactaagaaggaagtttaaggaaatcagagactataaccagggattagactctaatggaaattgtacgattgcttaaacctctataaatgtcccatactatttaactttgtctaaagataaacaataaggagtagggggaacaactgagcttgtattgcttaacagcaaagtagtaaacttggaagccagtgtcataccatggctagaataaaattaaaaacagtaatagcttttaaaagagaaaaagagaaagagagaggtagaatgatctgtagggtcttcagtagacagagagatccaagccaaaaaaggggttataaagcttaacagtcacaggacttcatttactgacattactctaccttgaattaaaattatttgggcccttatattacctgtgtcaccagactgtgagttccttgaggctatattacacaatctacctactactttgcaaaacccaaagccctgcccaacaaaatctaataatatttcctgaggtaaagagttgccacataaattctagctcaattcctgtatcattatctccaattccaaattagtgacgtccagaatgatggggttttattgtattatctggaaaaaattaatgtatcaaagctttaaataaatattagtcttcagatacaaaactataacaattcttctgaccacagcagtttccccactccttctaacaagcaaaactcacaaactaccattaaaatgtttcagttgcttttaaatttgtcctacctcctcattccttatcatctcaaataagatgcttcctccttcaggaacagtagtgaagtgaatttgaactgctatttggggtggaggaaaacggcaagcactgacatagtcagtggccaaatcctttttccaactccctccctaccttgttcctacctcctagacagtctcttcagtccctggagttgactcatgccgtagctccctctgtagttccctctgttctcgcataaaacaatgttcaattgtatgcagggttaaaaaaaaaaacaaaaaaccttcaagaatgcttttaatctgtaatcccagcactttgggatgccgaggcaggtggatcacctgaggtcaggagttcgagatcagcctggccaacatggtgaaaccccgtctctaataaaaataaaaataaaaaaaattaggcaagcatggtggcaggcacctgtaatcccagctactcaagaggctgaggcaggagaattcctgaactcgggaatttgcagttcaattcctgaactcggaaggttgcagtgagccgagattacaccactgcacttcagcctgggcaacaagagcaaaactctgcctcaaaaaataaataaaataaaataatgtttttattaaactacaagccaaagaaacttcagaaaaaatgtgtatatcccaaatctctaaatgctgctatttagaaagacaaactaataaaacatcatgcggtgacagatatttgaatattttctacatatctccacactagatgccctgggcatccagaacattccctaacattgccccctactcttatcttcctcggcagctttctccctgtagctagtgactcaaatttgttcactatctgtgccttcccattctttcaaaatgcaagagcaaagtatagattccgacatcaattaatggtattgctctggcttgaaatgtttgggagtcctttcttcacctttaaaaagtagcgacagatgatgggtttctccactgagggttaggcctggggttcccaagatgctatacgcaaggacaattactacacctcacatctagacatgacttgacagtagcagcactacctaccaatatcaggtcccggccagcaggctatgcaataaaataccaggtgctgcgttcccatcatcaagagtaaagggttagtactgcttctatacgaaaatggctcttgctccaaccccgcctcggcccccacatcaaaccgtctaataacatcactggttctttctacttcagaatagagacatgcacacttgagatcatcaagaataatacataacaaagtcattatattccgtagacttggctggcagaaatgtgggttgcgactaactttttattcggtggcttccttccagatcaatccagataactccccctccccagagccgccataaggggtgaagccccacatcctcctaagcgcagtagggagggaccggggggaggacaaaagagacttgcctatagggacttacagatgccagacgctgaggggtctggggtaactccgcgctgatttccatcctctcagtacctccagcctcctcgtccgccatcttgagggaaactgacgcctgcagttgccgacccccggccagaggcaagcggaaacctgtggccgg

SEQ ID NO: 1642 - DNA, 4562 bp, Homo sapiens
tttaaagagggctgctcaactgcaaggacgctgtaagcaggaagagaagccacagcgcttcagaaaagagtgggacagggacaagcatatctaagaggctgaacatgaatccacagatcaggtacctctgcacgctttgtccgccaggcccctcctgccacttcctgccaggcggtcctgctgggcctcagccctggcctccccctgccccagccccacctctgggctccctcccccctggttcccccgctgcccccactcccagccaagctccttgccctgctgtgtggtcccacgactgctgcttctgaatgggccaccttccccacttgccccagcccagtccgcctgctgagactctcccccgaaaatcatgcccgggctggtgcttcccgccctgggagggtgcttcctctgtgtgcttcccactattcctgggagctctggaactgggagaattgaaccaaaggatgatttgagcaatcaggcattttgttctcagcgctttggtgcaatttctgtaagatttactttgtttcaatacaaagtcttaggagagggtgtgggggagggaatggtctctgtaccagaaaataagtcacttcttccaaagatgcctccactgtgagcagagtaggatgcacacgaccccagacacaggctcctcctctgtgagcaccgttcacctttcagaatgacacctgcaacatggagtgtaggaaaaaatatgatgatcaggagaaatgctcttattttaggccaggcacggtggcttatgcctgtaatcctagcactttgggaggctgaggcgggcgggtcacttgtggtcaggagtttgagaccagcctgactaacatggtgaaacctcgtctctactgaaaatacagaaaattagccaggggtgctggcgggcgtctgtaatcccagctacttgggaggctgaggcaggagaatcccttgaacccgaggggtggaggttgcagtgagctgagattgcaaactccagcctgggggacagagcgagatgccgtctttaaaaaaaaaaaaaaaaaagtagcagaaaaactgggaggttgagggtgttccattggtagccccagagctggggttccagctaggagaggtcaccccggccctgctgcccctgccagcgtcccctcctctttctctctccccgtcttcctgcctgggaaagcagcagacattctcagggctgtggagggatgggggaggcccagagcccagggacgtccaggcagctgtgttcagtgggcatcagccctgaggactccggtgcgggggtctctgcattggggtttctctcttgtgccttcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtagcaccaaagtcctagttacaccctaaataggagctaagcagctgggaatgcagaaaacgcaacaataagtgatgtgcccggcgtgggctctcctgtgtgcactttcctgccacatttctatttttttttttttttttttgagatggagtctcgctctgtcacccaggctggaatgcagtggtctgatttcagctcacggcaacctctgctttccaggttcacgcgattctcctgcctcagtctcccgagtagctgggattacaggcacctgccaccatgcccagccaattcttttgtatttttagtagaaacaggattttgccatgttggccaggctggtttcgaactcctgacctcaagtgatccaccagccttggcctcccaaagtgctaggattacatgcgtgagacaccatgcccctggcctcctccccacattatttatttatttatttatttattttgagacggagtcttgctctatcgcccaggctggagtgcagtggcacaatctcagctcactgcaagctccgcctcccgggttcacgccattctcctgcctcagcctcccaagtagctgggactacaggcgcccaccaccatgcccagctaattttttctttttttctttttttttttttttttagtagagacggggtttcatggtgttagccaagatggtctcgatctcctgacctcatgatccgcccgccttggcctcccaaagtgctgggattacaggcatgagccactgtgcccggcctccccacattttttaagtccatggcccagatcttcctccctgactctcctgtgatcagatcgtggagggggtttgcttcctcccaaaaggccttgtttagcgcccagcaccctcactcttgactttgtttcccaaaatcttgttatggagctgtgcgtccggcagtcctcgggaatcagcagctgtgggaagcggggggtgttgtgtccagcgctgtgtctgggccagtgactgcgggctggtggggccgcccccgccactgccctgattcctcagcagaaggcaggcagggaacaaagctgaccccagagagccaggccatagcaggggctgaggatgcctggtgaatggatgcctgggagaaaagatggcagaattcacacatgagtctatgagacagggaaagaatcaataaaataaagaaggaaggggccgggcacggcgcggtggctcatgcctgtaatcccagcactttgggaggctgaggcaggcggatcatgaggttgggagttcgagaccagcctggctaacatgatgaaacccagtctctactaaaaatacaaagattagccaggtgtgggggtgcatgcctgtagtcccagctactcaggaggctgaggcaggagaattgcttgaacctgggaggcagaggttgcagtgagccgagattgtgccactgcactccagccttggcgacagagcaagactccatctttgaaaaaaataaaaataaaagaataaagagagaaggagaaggatagaagaagggaaactcaatgaataaaacaccctggggcctactatgtagccagaaaaatgaaaagtaaagaaataaaataaggctgtgcatgtggtttatgctcatagtcccagagctttgggagggtgaggcaggaggatcgcttgagcccaagagttcaagatcagcctgggcaacatggtgaaaccccgtctctaaaaaaattatttaaaaaattaggcaggtgtggcggcatgcacctgcatcccagcttatcaggaggctgaggtgggaagattccttgagcctgggaggtcaaggctgcagtcagcccagatcccaccactgcaccccctaacctgtgcaccagagagagaccctgtctcaaaaatgagtaaataaggaaacggcccggggctccaggcccgccctctgctcccatcgccccacccctgcactcctcctgctcctggtctgagctcccctgtcctcctcctcctccttcgccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaaggtgagacgtggggggctgaggagagtgggtgcaggagggacagcatgaggggcagatggttctccaatgctgtggggcgggtcagtgtcccctgggtgtctgtggggaccgggccagcgcccactgcaactggcagcctggatacctgggctgggaggggagggcccagggccaggagagaggcctgctgggccctcactgttttctccttgttttttctcagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaa

SEQ ID NO: 1643 - DNA, 50046 bp, Homo sapiens
ttgcatcattgtgaggaaaaccacttagtattttatagtgaggtgactttacaagtaaagatcttcaagaagatttttatgtgatttaaaaaatcagcttagatgcttggaatttggattgttgcattcttgttctttggcacatcaagaggtaagattcataatttataataagttctttaaaaataatgagtatacttacatctaaaatgtaattgacatgaacttattctttagaaattactattgctaatttcattcttaagtagtttattgtttttatgaatatgtttaaaatattggctgcttatatttctttgtatttatttattttttcacttaacataaaattatcaatggaaaatgcatcacttaatactgaatgagtcttatgaacataaagaagcatctatttccaacaatataaaagagttgccggacagtcttgtgttgggctgctagctctgccacttactagtcttatgggcttagacattgaagtctcaatttcttcatttctaagaagggtacatagtaataaatgagaaaatatatacaaatttccaaattctgtagctgactcatagtagatactcaataattgaatgaattaactaattattaatgtcagttggaatgtccattttttttccacttcagtcacagttttctggagggctgttagtctgtggacatttcttaaacattaactcagtattcattgacatgtttgctctttatactatggactccttagacattacaatgtaaggagttagtgattttggctacttttaccatccatgtttaatattgtgcctataagcaaacattaaaattagttgatttattttaaccaaactagaatcaaataattttaatgttgaaagagatcaacccctttgttgtaaagtatcacgtagttggttgagatagtatggtggtaagaagacagtcgtcacatctaacattcagttcaaccaccggtttgaattctgaatcttcttgggttttagtcctcgttctgctgcttggtagttgcttaactttaaacaagtacttaacctttctaagcccagatgattgatctgtagaaacaggacagtaaccaaaataaaattatagggttgtgccaattaaataagatgcaagttgaccatctcgaatccaaaaatctaaaatctaaacttctccaaaatctgaaacattttaagcactaacatgatgccacaagcagaatatttcacatacaaatacttaaaacaaactttgtttcatgcataaaattattaaaatactgtataaaattacctttagcctatgtgtataaggtatatatgaaacataaatgaattttgtgttaagacttggaccctgtccccaagatatcttattgtgtatatgcaaacattccaaaacacaaaatctgaaacacttctggtcccaagcgttttggataagggatactcaatctgcaattcatgtaaaatgcttggcatgggatttgggacatattagtagtgagcaatcaataaatgttcgctcttatttacacagatgaagaaaacaaaacacagagagattcgttgtgtaacatcttggcgctagcttgtggaattggccaatcttgactttcagttcagtgtttttcagtccctggcctccagctcttctctattggataaaaaatgaaggagataggactatcattagttttcatatttcaagaactatattctattttgcatgattctcctgccccaggacagtcctaattgagtgctgaaagcagttagactggtgaaggcagaattaagaaataggcagtttgccctgatctgctgagatgatatttaaagccatgactacagacaggatcatcaagggagtgactgcaggtagagaaggaagatggaactactgagtcctaggacacttcctcattaagaaatcaggaagatgaaggcaaactagcaaacaagactgccaagaagtactcagtgaagtggtaggaaacctaggagagtcagcatcctagaagtcaatttaagatgaaagaaataacagcatgtttgtgtgaggctaggaatgatccagcagagaggaggaaagttggtaaagcaggagaaagagaagggagtaatgttgtgccttacccctcagtaggtgagagaagatggagtcttaataggatgaaggtttgcctttgcgagaaacaaagacagttcatctcttgtgaacagagtgaaggcaaaatagaagggcagatatctgcaggtagctggatagacacgctgggagcttgtaaaaggtctcttctctttgtttctggtttcctattgaaataggaaacagggtcatcagccaagaggtttggtgggcatgaagatgttggaggtttgagaggcaagaagaatgaaataacccaggagtctgggaaaatgaagggcctaggaaaatatgatatgatggctgggtagctttaagatctgctttaatttcataaccacaaattaaaagtgagatagtcagtacggtatgtgatttcctccaggcacattcagctgcacaggtgtagacaggaaataggtgaagtgttgggtttaaccagagttgtggttaagccaagtgaagcaagaacaggagagaagttcaaggagagtacaggggtatggttttaattgactgtaggatttacactggataagaagggaattgaggagagaaatgtctgcctaataagaagttattttaacaaaatacatacttatgtaaaatttagataatacatatatttctcctacacaccacatatctattacacaactgccataaatttaacaattgagcttacattcatttgtattattacctatatctcatctattaaatctgtaacagagtccattgccttcaatcttctggtacctaccatttatgctaatgacttccaaatgtaatctctccagctgaacttctccctggaatcccagtctcgtatatgcaaggtagctccacttaggtatctaattcatatagaatctacatatccaaaactgaactctcaatatctacccccaaatctgttcgtctcaaagttttcacaattaatggccttccagatgctctggccaaaacaccttgcatcatccttgacttttctttctgtcatacctcactgccaatcagtcagcacaactctttggatcctccctcaaaatccatgcagaacctgaccacttgtaaccacaccactgctaccaccctagtcttagccaccactgacttttatctagtttgttataatagtctcctaactggcctcttcctctaccttgcccagaagctaacccaagtcagtccatgtcacttttctgctcagagccctccagtggcttcccatctcacttcagagtaagagccagtgaactaccaaatgctacatgctttagccctctgttacctcctagcattaacccctgctcctcatccacctacccctattcaaactcctgggggccagatgcattacaaatgttagggttttttttattattttgaaacatgctatggtaaacatactgtatataatacataatttccagaaaaatctaggacagaaccccatatttaatcacatgcatatttatgtagtaaaatacatgactacgatcccacataatttaatctcatattaaatgggataaagactataaacagctttaggtctgttattgctgccaaactagttactgcaaactagaaaacaaataaatgaacaagcccaaaagcaactatttttccccagagatttttagattttgaaattgcagagtaagtcattgtggagctatgtcttctccctgtctccattccctgggccctagtcccggtgcctcctcattcctcagtcacagtaggctctctgcttccttgcagagtcttgtgctttccttccctctgtctggaatgctgtcccacacatctgcatgcggtttgctcctctcccccccaggtcttgatgcaaatgctaccctggacaccctatttaaactgcaaacccctcctcacctaaacacacaaacaccctcatcccttccctgctttaggttcctcctagcacctgtcactgttttaatgtagccatttttgaaaaacgtattcttatttattgtctgtctctacatcccctaactagattatatactccatgagggctagaattgttttctccaatgctgaattccagtgctaatagcatctggcaaataataggcacaaacaaatatttcttgaatagattatcgaacctactttccagcttttctatgtctttggaaaagcctgctcacagtaagatagagaagtgactcctttagagagtggaaattaggaagataagaactaatatgccaatttacatgatttcttaaccaattaacactagcttcatgtaatgtgctgtttttcaaatgtttctttaaagaattcttaggccaaaggggaaataaagcatttcaactagagaatatattaaaatacaatgactcaagaactgaagaaagtggaaaataaaataagtaaaggtgaagaaagcatttaagtaataaaaataaaaatataagtagaagtgaatcatacaaacaggaaagatagaattcataaacctatgtggcagttgcttaataaaactaatgatgccatgatggcaaatttaaataaagtgaaataacctcagatgtggatgaagttaaaatgactagactttgcataaatttatggtaaaagaattgaaattctagatgaaagtcttactacttacaccagaataaatcccaggtgggtaaacattcaaaagtaaaagataaaacattagaaagaagtatgaaagaaaagtgtgtaattgttaatagtcttggagtggccaggcacggtggctcatgcctgtaatcccagcactttgggaggtcgaggcgggcggatcacgaggtcaggagatccagactagcttggctaacatggtgaaaccctgtttctactaaaaatacaaaaaattagccaggtgtggaggtgcacacctgtaatcccagctacgcgggaggctgaagcaggagaatcgcttgaacctgggaagcggaggttgcagtgagctgagatcgtgccattgcactccagcttgagcaacaagagtaaaactccatctcaaaaaaaaaaaaaaaaaaaaaaaaaaaaaaaagtcttggagtgaggaagccttttccaaacaaaacaaaaccccaaagccactaagcaaaagcctgataattttgattgcataaatgcaaaatttctaaatgacaaaagtaaagtaaaacaaaaatatagacaacaaatttgagtatattttccagatatctgactaaaaggaagcaaatttctctactctttgaagagtttttacaaataaataagcaaaaacaaactttagaaaaatatgcataggacacaaagatctcatccacaaaagaggtacaaatggctagaaatgcacaaaaggatattcaaagtttctgataattaaataaatgcaaattaaaataacaacgggttttcattcttgtaggacatgtaaggttgtcatactggtggtacttacagaaactgaaatctacatacccttccatagtatgtagattgtattgttgttccccatattgactctccatccctttaagaccattatacacattcatctttgaccacatgacatggaagagagtattctaagtctagacacctttaagagcctttgcatggttccacagttgcatcattttcctttgccccaacagacacaggctcaaaacagagcctactcatttagcttggatcctgcaatgcagaaggctggtaaatcagagctaggcccaacctaaaaccactgcagccaaaggataacatgagcaagaaataaaccttaatttttgtaagccagtgagatgtgaggggctgtttattaccataaagtaacctagcaaaagctaggctatatctcccaattccacttagtgatagagtgaccggcataagggttcaattattttcctgccacaaatagcaatacatttctcttagatcatcactttttctaagtcttcattttttcacatgtatgacacataaggctaaatctgtttttggtattttttattagcagtagtaagacaaaaagaaaaaaccagactgggcatcatttggtaaagaagtactctttctctccttttgtgacctttttattattataaaggtaattcatatttattactgaaaatttgataacatagacaagtataaataagaaaattaaaaccactgggattcaccattaatattttggtacctttcttttaattttacttttttccattacagatattattacaaattctctataaacatttttaatggctgcataatattcctcaataccataattttaaaactatatcctttattattggccacttaagttattgacccaatttcaatgtattaactttatagcaaacattatttttacagaactattaatctttcaatcttttcttaagtggctttaataccttataatattgctcactgtgctttatcacatccattttcctttaactttacactctctgtgagcattttcttatggaaaaaagagcacagtggtagataaccctggtaagcgataaacatagaaaataaggactagttataaaaatcttcattttaaaatccatagactgaataatgtagttgaggacctggagaaaaaagcaacagaatgcaaaaaataagggcaactgggcattctagggaaaacagaaggctgttttagaaagccatgatccaactatgaagtcactggttcaaattagaaaaggatcagaatggattccaggcaggagaaatattaagaagctgcaatataataggaatatattgaagaaggcacatgttcattcttccaggaagagaaaaaaaggcaaccagagaatataggaaaacacaaacagtacaagagaggcatgatccaaatatggagtaacctacgatgacactgatcctgagtaattcaaatattaggaaagacaattcatttgaatcatctcctttgaagagaatgagtgtctgaacaatggaagtgcagtaaaggaaatgtaattatagcatgcgagttgattgaagccaaaaatatttatctagttataataatataaattctgttcattgattttcaactttttggagtcagcatgcagacaaaacatagaaggattaattttgcttatagagcaaagtctgaatattatcaattttgatagtatgaaaacaacattatgaagctgacagaccttggaagctggaagggaggaagagagggagagtcagtacctctaaaatcttcctcttaggaaactgggagtcaggttctaatgaatatgttgtatggatcaaaaaatagaaggttactgtttaaatttataatagaagccaataaatgagccaaaaaaaaaaaaaccaaccaaacaaaaaacaaaacagtgtattgaccgcattggaggaagaggtgagacaaagtgaagagtgggatgcgctgggttattgagctgttatctctcggcttcaagcctgcccttctggctgagctttgctgaggctggaatgtggccagtaccatcctaacaagtgtgggatgatatctcattaaggttttggtttacatttccatagtgattcacgatgttgagcatcttttcatatggctgttggccatttgtatgcttcttaaggaaaatgtctgtccaggtctttgcctattttaaaatttagttatttgctttttgctattaagttgtgtgagttccttaggtaatttttttacagaaatagagaaaacaatcctaaagttgttgtggaaccacaaaagactccaaataacaaagcaatcttaagaaagaagaacaaagctggaagcagcacacttcctgattcaaaactatatttactacaaaattatattaatcaagacagtgtgatactgacataaaaacagacacataaacaaatggaacagagtagagcgtgcagaaatacacccatgtgtatatggtcaactagtctttgacaagggtgccaagaatatgcaatgaggaaatgattggcttattcaccaaatggtgttgggaaaattggatatccacattcaaaagaataaaattgaacccttacgccatatacaaaattataaacctgtgtgtatatggtcagctagtctttgacaagggtgccaagaatataacaatgaggaaatgataggtttgttcaacaaatggtattgggaatattggatatccacatacaaaagaatgaaattgaacccttaccttatgccatatacaaaattaacttggaataaagacttaaatgtaagacttgaaattataaaactcctatgagaaaacatacgaaaaatctccttgttgctggctttagcaatgatcattttggaatatgacaacaaaagcacaggcaacgaaataaaataaataaacaagtgggattgcattaaacaaaaaagcttctgcacagtaaaggaactagtcaacaaaatgaaaaggcaaccctatagaataggagaaaatattttcaagccataaatccaataaggggttaatttccaaaattaaattctactttaactcatagtgagaaacacagcctctctctaagcctggttcctctatactgacactccacctttctgctgcaggaaaagaagtttgctatgaaaggttagggtgtttcaaagatggtttaccatggaccaggactttctcaacagagttggtaggtttaccctggtctccagagaagataaacactcgtttcctgctctacactatacacaatcccaatgcctatcaggtaagctaacttgcagccttcacacatggattattctaaaatataagatttgcctatagatacagaagacatagatacagtaacctattctgacatatgctattgacttaaatgcaaacatttcttttcagtattatgagtcagattttttctatgttatctgttctatattatctgttctgatatatctgatttaaatatgaagattgctcttatgttatttcataacaggtaaacttgatattatgttcagtcaatgtaccaactgagaaccttccatctgtaagactgaataagcaacaatgcctattgtctattgaattgaataaacagaacagtcttgactttattgcagtgggagaaatgacatgtacaaacaaatacctttcttgcaacacaaattatgatctgtgatgtaagatgcaactgaaagactctgggaacaaagtgaagaagagctcaccttgaggtcagggatggaaccaggtaacattttgaggaggacatgtatttgaggtgtatcctgcaggatgggcaaagtgctcacaagcagagataagcagggtaatggcaaaggaagtggcatgaacataaaggagagaaaccacaggcctgtctgatgaatgacgtgttgggttagtctgtgggcagagaaggagtcttcaaaagtaaggttagttagaaaagtagttgaggaacaaattgtatagttccttcctgtggagtttgtacttcatcctgtaagccatggggccccattgagagcttttcagagatgctttagggcatttactctggctgctgttgctctcttgtctgaagctggaagagactagaggtgactatgaggccatttagaactgtgctgtccaacatagtagccactagccacatgtgactattaaaattacaattaaataaaattaaaaactcaattcatcagccacaccagccacatttcaagtgctcaatagccacatgtggctagtggctaccatactggacattacagatatagaatatttccgtcatcacagaaaggtccatttgacaatgttaaatagaaagctatagtgcagtttggatcacacacgggaaacagcctgaactgcagtaatgaaagtggttatgataatagaaaatcaacatgatagacatcataaactagtctgagatttcacacgtaaatgattgggaaaatgataaccctcttatcagaaaaattgaggataaaagagaaggagttagattctggataggtggggcttgagcaggctgttggagatgttagtctaacagcgaagcaggcagcccagagctggagaaaaagattcaaaagtcttctggctggggttgcaaattgaaacccaaagagtacatgaaatctcagaagcagagaaacgagggcaggactaggagtggttggaggatctatatttagggagcaggaaaaaagtggggccagagaagatcatttccagtctttacctgaatctgtaacctcagggcttactttccatcaggcccatcacatactgctgggccttgccagccagggcagtcttctcctatgcactcctaccgtacaaatatggtctgatttgtagctctctactcaccagacacacatacatatgtacacactactctttactgaaatctgccagctatctgtagatgagtatttccctaaataatgttcttcacaccttctccacttccctccatttggaaagaatcatgtgtagttaaaccagatctgtacctgaattttgtaatggatagaagcctgattgtttgctgttaaagtgtttttcaacaaccaagatataggataaatcaaggtatgtacttaaaacaaggatttccacaggcctgacccatatgttatatgagtttgaccaattctgtagatgtggctgtctctagaacaaggaaaaaagttcttactatgggtatagagacacttataaagaaacattcctcaaaagcttgagttttataattatcaagaagtaaagagaggaatattacttagctttaaaaagaagtgaaatgccaatacataatataacatggatgaccattcaaaacattttgctaataagccagacacaaaaggacaaataatctatggtttcatttataggagatatctggagcaggtaatggagagttcctgtttaatgggtacagaattttagtttggggtgaaaacagttctggagaaagatggtagtgatagctgcatgacaatgtgaatgacttaatgccactgagtttgcactttaaaatggttaaaatgttgattttaatgttatgtatattttgacttcttttgcattttcatttttaaaatgtttggaaatacgtacaactttcatacagtttcagggtgctccagacacccgtggccacttcttgtaaaccactgactatttctagagcactttgagagactacaatatgatcatgatcaaattttgtaattaaacctaatgagggcaacagacacttctcagataagaaatgtgtcaattacagagctcccctactctaagtattcacaaggagacagataaatagtttctttattcctcctcctcctcctattcttcctccccgtcttcttcatcctcctcttccacttttttccgggcaactttagcaggacgctttgcgccatcaaactttactttcgacttatagtcagcaacatccttctcatactttttcagctttgccaccttagtgatgtaaggctgctttttcgctgccatttaagttattccacatctcacccagcttttttgccacgtctccaatagagaagccagggtttgtggatttgatctaggcgcagaattctgaacagaacaggaagaatccagacggtggccttttaggggcattaggatccttcttcttgcctcccttagctggttcataatccttcatttcccgatcatagcgcactttaatcacctttgccatttcatcaaatttagatttctctttcccggacattatcttccacctctcagagcgcttcttggaaaattctgcaaaattgacagggacctctgggtttttcttcttatgttcttctctgcacgtctgcacgaagaaggcataagcagacatcttgccgtttggtttctaggggtcacctttagccatcctgactgtattgttcgctagtagatcaacttttttttaagtgaagagaatctatgtagaatacaagtatttgggggcaccttctctgccttttaggatgttcagggcatatttatccacttaggactaactctattccctgatcttcactcttaggactcatcaggctcattgatccttttatccttttatataagtggccatgcacttgaattctgtggagcacggtcagtaaaacagaaggtgataaagacagtgtttaggtgaagctgggtcctactgccaatgaagagaaaattggaaaactaagtacttccctaaataatgttcttcacaccttccccacttccctccatttggaaagaatcatgtgtaattaaaccagatatgtatctgaattttgtaatggatggaagcctattgtttgctgttaaagtgtttttctaacaactgtgatataggatgagtcaaggtgtgtaattaaaataaggatttccacaggcctgactcatatgctatatgaattggactcatttataaacaaatcagaaattaactctacacagttaacatactctcttctccaagtgaggaattgtcaaaggtaaatgtggtgtggtacgataaacttggtcttctggaggtcacaggtctttacagttacctttctgtaagaataaaaccaaccgacttcccccatgaatccatgacaccttaacctagagtgacttatacagtcactggtggtgatggacatgttgcacacttccggtagtttctgtgtctgcagctttagtcaaggatagaacatacctaactggtaactattttttacttgctagagatgatatcactggaaatgtagtcatcagaatggattgatctcgtacctattatgcttcatgtctgctcagtcaaagaatgctaaaaggcccagataaaccttgatactttaattaacccttcctctcgataacctattctgtacaatattgacatcatttcctcgtttctatccttgtggcagcagaatctaagctgtcttcttttgatcccatgatggtgtatggagtttcccacatttatgttgaaaagctgctttagagggttgtgccagagtgaatgtgaaagtgttttctctacctattctacttgattaaactcctcattgatgtcagacaagatcacccatatcagcatacctggatggaaaacagatggcagatggcagggagacatgtgcaatgtatgatgtgaataaactcctttttacactagcatgacaacagatgctcagaccccacaatgcctgtcagaatgctattctcatgttgagaaaagaataaacaatttttttcggactaaattccctccaaaaggtttttcagatgtagaaatgggactatagtaggtgtttgaggcgctccagctgggcctaagagagttgaaatgagtgagcacctggattatcttagagacatagatggaatcatgtttttgtacttggattggattatttagcagaaaaatgcttcctagaaggcctgaagatgattgattttattgctcacttcagcaaatcccacatctggtttgggccctatcagcagagaacactataatcagaacatcgcttgagagcccagtggttaagcacctaacttcaaaggccatgtggatttgaactctggctccaggattcattagctgcagtactttttggcaagttacttggcccctcagagtccccttttctaatttttaaaattagtacctacttcacagtgttttgagagttaaatgagctactctataaagtgcttagaacaatgcctggcaaatagacagataggagtgttagctattataattactgagcaagccaacttatgactctcataaccattagcttacagtcttggagacactttacctagccagcaaattgtatgattaattgcattactattaaacacaggtagccagaaataggctctttgtttgaatttcataaatatctaaatgtgttgcttccaggttataggattcaccactgtcagacttgctatttgctgatttaagtattcattttttccaatagaattgcttatacttgtgccttttattgttttaaataacaaaatcacttaaatttatagtctcctaaagtctttgagagttttgttattaaggcaatccaacaaaatacaagaaatacaaaagaatatttgacataatcatataaaattatctccaatatgctggtgtatttcatgtgatgagattctaacctcaattccttactcataaagtggggtggacaacctccattttgccatgtttttggcatgcttctaggcatgttttaattctcatgaattacactgatcactgagaaatgttatacaaaaataagatttactgaaactatgatttaaacttcccaacattgtcttgcaaacattactttaaaaatcaaagattttttcctcgtgttgaattcgtatactgcattttataatgcattaactttttgagctagatgtggtggctcgtgcctataatcccagcaacttgggaggctgaggtaggaagatcacttgaggccaggagttcaagatcaccctaggcaacatagtgagaccctgtctctaaaaaaattgtttaaaattagccatgtgtggtgtcatgggtctgtaatccaactattcaggaggctgaggcggccagatggcttgagcccaggagtttgcaactgcagtgcgttatgatggagtcattgcacttcagcctgggcaacacagtgagacactgtctctaaataataataataataatttttggtacttttataatatgtagccataactatttagtaaaaatatattaaagaaggttgctaaagatcaaatttagtgaaaggctttcgagcagctttagaataggtctactaactattaaataatttttaattattatttttccttaatctctttctgcttgaaacaggagatcagtgcggttaattcttcaactatccaagcctcatattttggaacagacaagatcacccgtatcaacatagctggatggaaaacagatggcaaatggcagagagacatgtgcaatgtatgacatgaataagctcctttttacactagcatgcgagctttatgtttaacatgaatgtactttgcaaggtattgatgtatattcatggaaatcttccattcagttatccacaattatccgtgttctggggcctcaaattagttatccatttcccatttatttttattataaattgcacagattacaagggaagcaaatttgtataatcactcttgaataaattcttctcttgacaggagattaaatggtatgatcaatttctcatttaatttaagaaaaacaatttccaagttaactccatgaaattaatctttctctcctatacttaagattaatagactgctaacatcataagcagttaaatatttataaggccatatagtgaagataacattagtacctatctcacggagtgagaattaaatttatatatatgtgttttatatatataacacatatatataacacatatgtgtttatatatataacacatatatataaacacatatatataaatttaattctcactccgtgagataggtactaatgcataggtgctaattactaatgtgtgtgtgtgtgtgtgtatgtgtgtgtgtgtgtgtgtgtatgtatgtgtgtgtgcatatatatatatatatatatatatatatatatatatatatatgggttaggacatacgtatatatatgggttaggacagagcttagcctgtggtaggttctctattaacacctaagtattactccattttcatactgctataaagaactgccctagactgggtaatttataaaggaaagaggtttaattgactcacagttcagcatagctggggaggcctcaggaaacttacaatcacggcggaaggcaccgcttcactaggcagcaggaaggagaagtgccaagtgaagggggaagaatcccttataaaaccatcagatctcataagaactcactatcacgaaaacggcacgggggaaaccacccccatgaatcaattacctcgacctggtctctcctttgagacgtgcagattatggggattatggggattacaaatcaagataagatttggtcggggacacaaagtctaaccatatcaacctactagtataatttcttattatggaatcaagtgttgagacacgtcggtttccttgaacacttatttatttaatatttatataaatctttgtgccaggtgttgctacagctggaagatataaattgcattaatttagattggatcaacggttcacgggaatacatccatgctgtaaacaatctccgtgttgttggtgctgaggtggcttattttattgatgttctcatggtaagaagagttgatttttttttaattatattgaattggttttggatattaacactcagaagttgggacaatttaatgtctttttttattagcttagacaggtactgaacatgtgaaataataagcatttgtatatggcagacaaaaaaggaaaagtttcttcgcagtaaagagtctgtggttatttgaagcaccactaggtggcagtgtgtctacacaggctcatcactaaaaactgcccccgcaaggtcactgccttggtcagcatgttagaccacctcaatcagtttcatcaattgtaaatctatccttagaattataaattgttaccatccttcaaatattatttgtttagaatatgacatgtattttcacacaaaaacagggttctgtgcctgtgaattagttaggtctgtaggccagtccagacacaactatttaacacacatattctctaaaggaattaaatagaccttgctatttattaggcctatactctgcgacattcacgaatctccaaatgctttctaaaaagtaatttcccaccctaaaatgcagtgtagtaaaatctaaagatgcataatcctttcagatttttaaggagggttcattcattcattcaacaaatatatatttcactctgcacttactgtgggctaggcatggaagatatgacttgtaagtaagacagtgtttctgctctgacaaaatgtacactctagtaggcaatggaggcacacacagaaacaaatgaacaagaaaatgtcagttggtgacaagtactgggtgaagaaaatgcaaggcagtagaatggagaatggcagaagcagaaacaaattgtatgaacaaccaggttaggtgatatttgaacattgaccactgtcagtaaacatcctgaagaaggaattagggatccaaagactcatttatgccccgacacttctctatcttctctttccactctatcagggaagactaaggtacaagatctttagagaaagtctttgaaaggatgaaatcagattcatcttcatcttctctttataaaaaaaaaaagccagctgtaagcttttgtgagtttctttattgaccttagggcctgagctgtgggctttcctatgtccaataaataaataatagtggttcataggaagctgacaggagatgtttgcagaactgaagggaaaaatgtttgttgaattaaaatgttcattgaattgaataggcagccttgaagtgggaaaagggtttagggtgagtgggctccagggcctctggggataattcaggattcaagcttaaagaaggagcagctaaaggaacagctgagtctcttctccacctctctttctgtcatctcatcacaagttactagcccaccacaattcaccacctggattggtactgaggcaagcaggtgcttgggaatggggtaggaagatggggaagaaggagaagaatgaaggggataagggctgagagtgatctcaaataccaacctatataaggagataggaaagaaaatagtcatttaaaatagcggcaacagtcggccgggagtggtggctaatgcctgtaatcccagcactttgggaggccaaggcgggtagatcacaaggtcaggagatcgagaccatcctggcgaacaaaatgaaaccccgtctttactaaaaatacaaaaaattagctgggtgtgttggcgggcacctgtagtcccagctactcgggaggctgaggcaggagaatggtgtgaacccgggaggcggagcttgcagtaagccgagatggcgccgctgcactccagcttgggccagagtgcgacgctgcgtctcaaaaaaaaaaaaaaaaaaaaaaaaaaatagtggcaacagtagaggaagggatgttctaatgaccatgtagcattcattggcagttattcacatatgtaaatgagagagaaaatattctttgttctgtgacttataaaactgtcataactggtggaaaaaaatggaatatttgatcaaatgaaaaatgtatgcaagtataaatcaattgcttgattttcatgataattatgagagcctgaaacttaggtgaaactaaaaatgcttgctcaggagtgacattattaagataataggaatagggagacctggatccttctttctctgacaagcacactgattcaacagtaacagacaaattttctttgtgagaaattaagaaactagttgagaggctcttacatcctgggtaaatataaaaccagctacaacgaaggccagaggaaaatttgagataccttcttgtcttaacttctacctctgacccagcaccatatgatctgaaggaaactcctagcttcccgcttcaccttgtggacagaaaaagtgggacgtcatatccaatgtttcagcttttctgggggctgcttagggtaatcacttcaatctcacatgtcttggagcactgatagaacccagaatattttagtatctaggggccaatgagaacaaagatgggaagaaagatgtcattcaagcagtcactatagccccttcccctagctcagtgcagacaaacaaagtgattgagtagaataccctagatcccatgttctccttgggaggaaaagagttaaactgcaaatcaaaagttccaacttttccaggggctgcctgagagactgatttctgtcttgactctcttggaagtgctgatggcactcagcttattctagatgcttgagggctgctaagaatgaagatagtagtttggaccagcacaaagttttgacaggtgcccagaactgttggctaggctgattggtgagagtcttctcccacaaagaacaatccatgaacaccctcgcagaggtggctattttttctaatgtgcaaataccaacataaagagtcaaggaaaatgaagaaacaatatataccaaagaaacagattcatctccagaaactaaccctaatgaaacagagatatatgatttaactgacagagaattccaactaaccatcataaaaatgttaaatgaggtcaggagaatgaatattgcatgaacaaagtgacaatttcaacaagaagattaaaaaaatataaaaagtaccaaacaaatcttggagcaaaagaatataataattgaaggctgagcgtggtggcccatgcctgcaatcacaacattttgggaggccaagacaggcagatcacttgatgtcaggaagtcgagaccaacctggtcagcatggtgaaaccccatctctactaaaaatacaaaaaagtagctggtcatggtggcgcgcacctgtaatcccagctacatgggaggctaaggcataagaatcacttgaacctgggaggcggaggttgcagtgagctgagatggtgccactgcactccagcctgggtaacagactgcactccagcctgggcagcagagtgagactccatcaaaaaaaaaaaaaaatgaaagaggaaggaaggaaggagagagagagagagaaaaggaaggaaggaaggaaagaaagaaagaaagagaaagaaagaaagaaaagaaacagaaagaaagagggaaagtatgtggaaatataaaactctctggtaaaggtaaacatatagacaaatacaaaatactgtaacatgtgtgtgtaaattacttttaattctagtataaaagttaaaagacaaaagtattaagaataactataactaaaaatatgttaatggatacacaataaaaaagacgtaattatgacatcaataacatgaagcatgtgatgtgaacaagtaaaagtgttgactttggcgtatatgattgaaattaagttgttatctccttaaaatacactattatactattataagatattttatgtaaaccctatggtagtcacaaagaaagtacctatagaaaatacacgaaagatttaaaaaagctatcaaagtatattaacacaaaaaatcaacaaaacacaaaggaagacaacaagagaggaaaagaggaccaaagaactataagacagaaaggtaggaaacaatttttttaaatggtaatagtggtccgatgtggtggctcatgcctgtaatcccagtactttgggaagctgacgtgggaggatcacttgagacctggagttcaacacaagcctgggcaacatagtgagaccctgtctctataaaaaggtgttttgttttgttttgttttgttttgttttgttttgttttagggctgggtgcggtggcccacacctgtaatcccagcactttgtgagaccgaggcaggcggatcacttgaggtcaagagttcaagaccagcctggccaacgtggtgaaatcccatatctactaaaaatacaaaaattagctggccatactggtgggtgcctgtaatcccacctactcaggaggctaaggcaggacaattgcttgaacctgggaggcagaggttgcagtgagccaagatagtgccattacactccagccttggcaatagagcaagactccatctcaaaaaaaaaaaaaaaaaaaaatttctaattagctgggcgtggtaacatgcacccgtagtcctagatactcaggaggctgaggcaggaggattctttgagtccaaaggtttgaaggtacactgagctgtgataatgatcttgccactgcactccagcctgactggcagagcaagaccctgtctcaaaacgagacaaaacaaacaaaaaacaataagtccttctccatcaataatactttaaatgtaaatgtattaaactctctaatcaaaagatatagagtgattgaatagatagttttgaaaagatttaactacatgctgtctacaagagattcattttatattttggagacacacataggtttaaagtgaagagatggaaaagaataatcaacacaaatggtaaccataagaaaacaaatgaatgtacttgtatctgacaaaatagactttacgtcagaaagtatcacaagtgacaaaggtcattatataatgataaaagaatcaattcaccaggaagatataataattataaatatatatacacccaacaccagagtacctaaatatataaagcaaacattgacagattggaagggagaaatacacagcagtgaaataatagtaggagccttcattatctgattttcaataatggatagatcacctagatggaaaacaaataagaagaaaacttatttgaacaacaacttcagcaacactatagaccaaatggacctaacacatgtgcatagaatatttcacccaacagcagaatacactttcgtctcaggtacacacagaaccttcgccaggatagatcacaagtgaggtcagaacaaaatcttagccaactcaagaagattgcaatcataccaagtatctttcttgaccacagtagaatgaaactagaaatcaatagcaaaaggaaaactggaaaatacacaaatatgtgcaaattaaacagaaaacttttaaacaaccaatgggtcaaagaataaatcaaaagagaaattataaaataccattagacaaatgaaaacaaaaacacaacataccaaaacctatgggattcagcaaaagcaaactaagaaggaagtttatagtgataaacacctaaatttaaaaagaaaaaagctctccattcaacaacctaactttatacctaaaagaactagatcaagcttgcccaacccacagcccagaacagctttgaatgtggccccacacaaatttgtaaactttcttaaaacattatgagatttatgcatggaccttatttttaagctcatcagatatcattagtgttaatttattttatgtgtggcccaagacaattcttcttccactgtggcatggggaaaccaaaaaattggatacccctgaactagataaaggagaataaacttattctaaagttagcagaagaagggaaataataaaaattacagtagaaatgaacaaaatagtgaatacaaaaacaatattaagaaatgaacaaaactacaagttggtttgttgaaaagatgaacaacatttacaaacctttagctagactaaaaaaaacttgagaagactaacatttaaaaaataagaaataaaaaggagacatgacaattgagaccacagaaataaaaggaacatgagactagtataaataattacacaacaaaatttaagataacctagaagaaatagataaattcctagaaacatacaacataccaaagctgaatcatgaagaaacagaaaatctgaacagacctgtattaaagaagacacaaataaatggaaaaacatcctgtgttcatgaatcaaaagagtcaatattatcaaaatgttcatactacccaaagctatctacagattcaacgtaatacctatcaaaattccagtggccttttttttaacagaaatagtaaaaacaattgtgaaatgtatatggaagcacaaaggaccctgaatagccaaaacaatctcgagaaagaagaactaagctggaatcatcacagttcctgatttcaaaatttattatgaaagtacagcaattaaagcagtgtggcactggcataaagacagaatagagatctcagaaggaaactcatgtatgtatggtcaactgatcttccacaagggtgccaagaatacacaatgaagaaaggataggctcttcctacaactggcattgggaaagctggatatccacataaaaatgaattaaatttgacccttgtcttacactatatacacacacacacaaatcaatttgaaatagattatagacaaacataacacctaaaactataaaactcctagaaaaaaacatagaagaaaagctttatgacattggacttgacaatgatttcctggatatttcaccaaaatcacaggcagcaaaagcaaaaatagacaaagaggaggatgtgctttggatgcgtgtcccctccaaatcttatgttgaaatgtggtcatcaatttggaggtgggaatagtgggaggtttggaatcatgggggtggatcccccatgaatggcttagtgccatcctcttgatgatgagtgagttcttgctcagttagttcacacaatatctgtttgtttaaaagagcatggtacctccccacttactctcttgctcctgctcttgccatgtgataccccagtcccacctttgccttccaccgtgattgtaagcttccggacataagcagatgctggcactatgctttatgtatagcctacagaaccatgagccaattaaacctcttttctttatgaattacccagccttagatatttcttcatagcaacacaagaatgaactaacacaaaaaaaattagtaaaaaggagcagggcattgctataaagatacttcaaaatgtggaagtgattttggagctgggaaatgagcaatgttgggagagttgtggggctcagaagaatacaggaagatgagggaaagtttgaaacttcttagagacttgttaaatggttgtgaccaaaatgatgatagagatatggacagtgaaatccaggctgatgaagtctcagatagaaatgacaaagttattgggaactggagtaagggtcacccatgttacaccctaccaaagtgcttagctgcattgtgtccacaccctggggatctgtggtatgttgaacttaagagtaatgacttcaggtatctagcagaagaagtttctaagcagcaaagcattcaagatatgacctggctgcttctaacaatctacaatcagatatgggagcaaataaatgacttaaagttggaacttatatttcaaagggaagcaaaacattgaagtttggaaaatttgcagcctagcctagccatgtggcagacaaaaaaagctttttcaagagcagaatgtaagtgggctgtggagcaaccatttgctagagagattagcatgactaaaagggagctgggtgctactatccaagacaatggggaaaaggcctgaaaggcatttcagagatctttgaggcagcccctcccatcacaagcccagatgtctaaaaggaaagaatggtttcagaacccaggcctagggtgccactgccctgctcagccttcaggacactgctccctgcatcccagctgctcaggctccaccctcagcaactagggccccagatacagcttagaacacagctctggagggtgcaagccatgagccttggcagttttcaagtggtgttaaatctgcagatgctcagagtgcaagtgtgaaggaagcttggcagcttccacctagatttcagaggatgtatagataagtctgtgtgcccaggcagaagtctgctgcaggggcagagcccccacagagaaactctactaaggcaatgccaagaagaaatgtggggttggaacccccacacagagtccccactggggaactgcctagtggatctgtgggaaggggctcctgccctccagatcccagaatgttagatccactggaagatccatgattataaaaactggcaggcactcaactccaaccccagagagcagcatgtgggttgcacccagagaagccacaggggcagggctgcccaaggccttgggatcccactcctcacaccagaatatggaacatggagtcaaggattatgttggatctttaagatttaatgcctgccctgctgggtttcagatttgcatggggcctattacctctttcttttggccaatttctcttttttggaattgaactgtttacccaattcctgtacctcccttatgtcttggaagtaaataacttgttttttattttacaggctcataggtaaaaggaacttggccttgagtctcagatgagaactttgactttgagctttgagttgatgctagaatgattaatatgttgggggaagagtaagaagggatgattgtattttgcaatgtgaaacggacatgaggtgtaggggggccaggagtggaatgatatggtttggatgtgtgtcccctccaaatctcatattgaaatgtcatccccaatttggaaatggggcttagtgggaggtattagatcatggggatgaatctctcatgaatggtttagtgccacccccttggtgatgagtgagtacttgctcggttagttcacacaagatctgattgtaaagagcacggcccctccccacttgccttttactcctgctctcactctgtgatacaccagctcctcctttgccttccccgatgattctaagctccctgaggcctcaccagaagcagatgccagcactatttaagttctgggatacatgtgcagaatgtgcaggttttttacataggtatagacgtgccgtgatggtttgctgcacctatcaacccatcatctaggttttaagccctgcattcattaggtatttgtcttaatgctctccctccccttgtcccccacccccaacaggccgcacgatgtgttgttccctccctgtgtccatgtgttctcattgttcaactcccacttacgagtgagaacattcagtgtttggttttctgttctggtgttagtttgctgagaatgatggcttccagcttcatctgtgtccctgcaaaggacatgatctcattcttttttttttgagatttgagacggagtttcgctctgttgcccaggctggagtgcagtggcctgatctcagctcactgcaacctctgccttctgggttcaagtgattctcctgcttcagcttactgagtagctgggattacaggcacacaccaccacgactggctaatttttctatttttttagtagagatgggtttcactatgttggtcaggctggtctcgaactcctgacctcgtgatctgcccgcctcagcctcccaaagtgctgggattacaggcgtgagcccccacgcctggcagatgtaccattttttaataatgagagtgttttaaacctactcttagcaattttgaaatatacaatgcattactattaatgctaagcaataaatctcagaaacttattcctcctgtgtaactgaagctttgtacccactaatcaatatctccctattcaccacaccccaatctcagtccctgataactactattatcctctacttacgtagtttgactttttaaaattccacatattaagtgaggtcatgcagtgtttgtctttctatgcctggcttctttcacttagcatgtcttccatgttgtcacaaatgacagaatttcctttttcattgtgcaggtataacacattttctttatccattaattcattgatggacacaggttgattccatatttcggctattgagaataatgctgcaatgaaatggaagtgcaaatatctcttcttcagcataatgattttgatacctttgcatatattcccagaagtgagattgatagatcatatagtaattctatttttagtttttcaaggcacctccatattattctccatagtggctatacctatttacgttccctccacagtgttcaagttttcccttttctccaaatctttgacagctcttgtttaatttataagagacattctaacagatgtgaggtgatatctcattgtgatgttgatttgcatttctctaatgattaaggatgttcaacattttttcataaatctgttggccatttgtatgtcttcttttgataactattcaaatcctttgcccattttcaattggatcatttgctttcttgatattgagttatttgagtttgtgaatattcttaaaagctcctgttttaaaaccaaagttatcccatacattttctagtgttgccttaacctgggatacagacacaggcaaggtggataactgtaggaatgagctgcctttgatgcatgttgtgagcatgctgaaaggatttgggcctcaggaaggatcagcatggagctagaagccacgaatatagttgttagggctgttctcctgtttccaaggaccacaggccagccccttagcacaaggaggagagctcctatagaaggcattcttccaagctcatctgttctccttcagttggataaggatgtaggcagaggtgtcactttgtgactttaccagtccctgtcttatgtgcaaaagggagaaccatgttgatccttttttttttctatttttaaagcatatttaagctattccaccgctgtttttaaaatacttattctgttaaacaattctttcagaaaaaatttgaatattccccttctaaagtgcacttgattggccacagcttgggagcacacctggctggggaagctgggtcaaggataccaggccttggaagaataactggtaagcatgccctgcagttgggccttgagtgtgtttaaatattgtttacacacactaccaagtatctgaacaccaagtaatactgcagaagaaaatataagatactacaaaatgtgattccaatgaaataaaacgtgaacgtgttttcagagcagaaatgtgcagattcgcttcaagggggttcattgcagcgttgtctgtggtgacaaagtaagagaaactatgtgttccctcacccgcaattgaatggttgaagcaattataacacattccatcctttgggatttcataccagtaatgcaaagagtgaggtttacctagacgtaggagtagaatggtggttatgagaggctgggaagggaagaagagaggggaggctaaagagaagttggttaacaggtacaaaaatccatagctagaaggagtacattctagtacatgatacagaaattacagttaacaataatttattacatgtttcaaaatagctagaagagaaggactgtaatgttcccaacacgaagaaaagatgaatgattatggcgatggatgtcccaattaccctgatttgatcattacacattgtatacatgtctcaaaataccacatgtgcccccaaaatatggacaactattatatatcaatttttaaaagttatttttaaaaagaatgagtttgaatcccactgattgtcctggacgttcctgacacacttggactgcagcttactcagttgttaccatttttaatattatccctggatataccgttaagtctaaaaataagttgcggagcaaagtatatagcatgaattgggtttgggggtataataattaatcatgtctcctccccacattctgttttccaaaccaattgtgtgagatggatgaaggtcaaagcaacagctcctttaccaacaggcggggctggcctctccctctgcatccccccaccaacagccagtaagcaagccccacgtctccttcatctgccttttccctgtccatcctctggtcattgtcctggctcagtccctcatctcttgcctgcattttggccttggtccccgctggtgccccagcctagtcttctacaaatactgccaggcttatctttccaggtgcaggccatgccactccactgctccaaatctctcagggtgtctccttgtgtgaagcctcttagcttgtcacgtaaacttgtcatgtttcatcacagtttttcatgctctgtgcctttgcacgtgctgttgtccctcttgctgagcattcactgtccatttgtcaagattcatctcaaatgtttcctcctcaggcaggaattaattctctgtgcttctcataccctttgacatgtgcctcttttgtgtttgaaaacacaaatattatatcacatggtcttataattatggatgagcctgttatttttaacagaaagcctccttactgcattgactccaggcttggccacagaagcgtattttctctttgttaaactgctgtgctctgtgtgcatgtgtgtgtacgtgctcgctctctctctcacacacacacacatacatgcacactttaaattcaaatctcaatttagaacacagtttttaaaaaaatacctagaagtccaaattgggattattttgtctctgcaatctgttgatataacaggcttattcctgctataagtcatctctcttctcctaactctctgctcctaaatcctcctcactcacctccaccaccaccaccaccattcttatttagaataataaaaactgaactttttcactgaagtcattatgtgaccctttgtggtcaattttcaagcccagaaaaaagaaggaatgagttcctcttttgaagatggaacctcatggggcctcacagcctcaggcaggctgagtgaagcagaacacataactgcatttacaattcatactgggttatgatcaattcaaagagattttgtttttattaagttttttcaaaaatcagatactatttaactctagtttttcccatcaggtgaattatcctgctgggtaaatagaaaacagatttttaaaggttttctgaatgtccaaagaattaatattatgtggatgttttaatctatattcctctgagaaattagtttttgggcaatcatgttccttgagtaatagaagaactgagacctcacaaacagattttagctgtataattaaccacttaaaaacaaaattaatatgataaacatattaaggacatacataagtttttatgtctttggtatttatgtataagtggtaagtagttgtcataataaatatagttagggggttactcagctgattctgcttttatttatttttatttataaacagtatcaacgcttttcttatttgaggaaaaattactctcattttgctgacacacacgtaccaaaatacacatacatactacacactcagatcctaaacgattagttctcactcatgtagtaagaggtcatgtctgtctccctaaggttaattaataggttgaacctaataattctcttcccttctgtagacttttctcctgagatatcctagaacaacaaattcaatgttccctcttccttacgtcttggaaagactgtcttttttttttttttttaatctgattgccttgtcctccaatcaataagatctgaggtatacctatcttgggatgtttctctccaggaatcctgactttattagaaagttgtgtgtaatcacactagtaaaataaaaattcttccaagagttgaagattaattgtgagataaatactttttcctctttgttaagcgcgaatggttcattcatatgcatgttgcattacttcattgatctctttgtctaagtgtctttccatctgtgctctgagttcccccgctttgtggacttaagtcatttgttcactttttttcaggtcttgtcaatagaagcgctgtgctgaaacgaaccccttccctcctggcctctcatttccttctaaatgatgccctagcctattgcattcctctagatccaagctccacaaagttgaaagtggagtgattgcatttccttagggttcattctctccttgacccactgctacctagcttctttccccaaaaccactattgccagatcactagtggctttttgtggaactctatcagacattttgactctgtgttttacttgacccctctgcagaatttgtcccagtggacccctcccgccttgctgaagtgctcccttctcttagcttctatgattccgcatcttcttggttgtctttgtttttttgactccctctctccaggctacttcatgaatttcttttcttttgcctttgcctatctgttcatattcttcaagtttccattctaggcccactcttctctcctgttgcttttctataatcactcttttagtgattatattagtcagaaaaataaaaaaaaaaaaaaacacatcctatgacaagctaagtgtgctgagcacacaccccagactgtgacacagacattccttccttgctgatgccacattcccagaggtgtcaacggcaatgctactctgcatccttcccactccgggatccagcctctatatcacagcaaagggattttgctaaaatataaatctgatcataaatctcccctgcttgcaagcttacaacagcttcccattgatgaccacatcatgtccaaactccttgacatggctcagctgacatctggctcctgctagcaatactaccttcatcttccaccgaatcctagaactctacacaccagccttagcaaactagttacagtttcccaaacacgatgctttcatctggaggccgtgtacttctctgtcctcccctgggttgctggccaccttacctttgccctggccaattcttctggcccttcagatctctactagtgtttcttttctttttctttttttgagatggagtcttgctctgtcacccaggctagagtgcagtcgcacaatcttggctcactgcaacctccacctccttgattcaagtgattctcctgcctcagcctcccaagtagctggcgttacacgtgcccactaccatgcctggctaaattttgtacttttagtagagacggggtttcaccatcttggcctggctggtgtcgaactcctgacctcgtgatccacccgcctcggcctccgagggtgctgggattacaggtgtgagccaccgcgcccagccatgtttcttatctcttgcagaagcatgtcctagttccgcaagactgggttatatgtggcttctctgtgcttggataacacttatgatcaccactgcctctgcacggaggacactgactggggtgcctttcccatcaaatggaaaatcccttgaagacaaagcaaggtcttattcctcatatctgaatgctaaacctagttcctggcacatactaggtgcttgacaaataattgtcaaatacagaaatgattgaatatgtgaaagatcataacattttaaagaattccagctatcttgcccttattttacgaaacatttgaacatgacgcaatgggatgagagtctggacacctggcctcttagtccagtttgcctctaacacatgataaccttgtccagtcacttcacttccctgggcttcgggcttttcatttgtattactattaatgaaagtagaactaagtgagccatagctcaggacaaggattctgttattttaattgtgttgctttgtagattcatctttacacatcaaagagtggttgtgtttttaatttaatttaattttttgcctacaaatgttgcttttcaagaacctttgtaattcataaccttattgtatatatggtattccatatacagaccctagaatagccactgtgatttttttaatttgttagctgttttggcattgtctcaacatagcattacttatctgtagatacttgacattgcaatatatagagaccctacatttatagatttaggttatgtatctgtactttttcctgagtgatctttgattgatagaaataatgtaggaaaggacacatgcttccaaagtaacaacaatattaatgtgcacttccatagaacatgtcttggttgtgctttctctagggttggacccagctgggccatttttccacaacactccaaaggaagtcaggctagacccctcggatgccaactttgttgacgttattcatacaaatgcagctcgcatcctctttgagcttggtaagttttaacagaatcagaaacttcattgaagcatagaggagatttttagaggcatttaccctgtttttatttatttcaggtgttggaaccattgatgcttgtggtcatcttgacttttacccaaatggagggaagcacatgccaggatgtgaagacttaattacacctttactgaaatttaacttcaatgcttacaaaaaaggtaaatactttctaaactatgaatgctactgatgcatattcacttagctctctccttagatgggatccacctacttttgtgtataatatacatataaaatgtattttctctcaaaacacagttgcatataagaagctctcccacctgttctcagatccacaagatcgggtaccgtgtcttcattaactttgtatccctggtgccttatcaatctctagcatattgcagtcactcaatataaacaaggaaggtgtgttattcactcagcaaatatgtattgagtgtttactatgtgctaggcattattctaggaacagcaaatatggaaatgaatacaaaagacaaaggtgcctccctgatggagttcattttctaacttgttaggaaaccaataaatagtgtaagagctaaggggacaaaataaagcattgaaggggaatatgatgtgttggtgacagtgaaggtaaagtagaagaagaaaattgttgacaggatggtaagggagtccttactgaaaagatgacctaaaggagttagccttatagacaccaaggggagaggcattccaggccaacagggggaagcaagtgtaagggctgaaaacaggagtcagcctggcaggttcacgacagtgaggagcctgttgtggctgaaactaggtaaaaggaaagaagtagggcataaggttggagagggaaccaggcagagggcaataacacaggactttgtggatggtagaaaagacttaagctttcactcaaatgagataggagccatgagtggattttgagcagagaagagacgtggtttgagttacttgtaacaagaatcactctggatgctgtaattacaaattaaacaagtagtatttaactttttatagtagtttccaataataatagttacaatatctatatggcatcaagttaaaaggcaccgaaaggttattatttgggaaatttgttcttccctatctctacatttcatcatataattaatgaaatacattacccataatatataataataataatatatatatatatgatgatatgataatggatacctggatgattctgaatatctcatagcccaatcccctgtagtcaagatatcaaggagttgaaattacttgctctttcatttggctgttgtagaggaaagatacagagatcatagtattgagtgtaactcaggtatctacttcactagaaataaattacaaaggtttaatatttgctctgaaagagaaaatgtgatcagaagtatatatttgtaatgactatattttaaaaacccacacaactgtctaatctacaggtgcaacaaataagaattaaggccaatttcacctagttcagataagcaaaattcatacaaaagaggcatattataaaattgattttccccattattttctatattacgactatgaatcctttctattaggacaaaatatagctcagaagacttcattacataattaattgttatacacagatcatatgaaattttatgaaagattaattcaactaaaatatacatttatcataagctatcattttgagacattttaagatttcctataactttattggattaaaagaacatttatcattcatgttaaacctttggatgagttttaagacttcaagatgttctattttacttaaatttattactaacaaaccattacttttaaaattaatagtttgctatattctaatgaaccgtcttgtctaaatcacaattaattgtgaatataaatctatagatatacagagacctaatgtaagagaagtctttgtttaataaaaatggatgatgccaattattaatctgtgctgacgatattacattatttctgaaactattctgtctcagttctctattgtgtaacaaaccacagtgaacaattacaagaaaaattgttattgcccagcgttctgagggtcagaattcaggcagagttctcctgagattctgcttcgtgtggtgttggctggagcaactcaggtgactgcatccagttgggggctgagctgggctaagctggatgaggaggtctgagatgaccctccgtgtcaggaaccctgggacttgttctcctctgtcaggtggtctgtcatccttcaggacctctctccccagacaggtagcctggatttcataatattgcaactgggtttcaggacagtaagagtggatgctggaaggtcttttaaggccttagaacttaaccaatgtcagtttctccacagaactgatcttggttctttgctactgggcaaagcaagttacaagatcagcctgtaatggggcaggggtatttttaacatggcctccatgttgagagaaggaatggttacataatactgcaaatgggtgaggacccaggaaggagtcatttgttggaagcaattattacataataattatactgcatatgctaaaaccaaaatctagtttctcaaagattggctaagctgtgtaggtcattcaaagaatagtccacgccattcagtaaaaatattgttatgtaaaataaaagaaagcataaatggctgggcacagtggctcacacctgtaatcccagcactttgagaggctgaggcaggaggatcacttgagacttgaggccaggagttcaagaccagcctgggcacaacaagatagtgaggcctcatctctaaaataaaaaaagaagaagaagaagaagaaagaaaagaaagaataaatgactagaatgttatgaaaattttggaatgtgcagatgtatttagatcttattattattccaataatcctaactattgatggcaataatgtcatgcttgataatgacaaaactaattcatctttagcattctttataaaaccccccacttgttacacctttaacccagcactggttcacaatgctgactgttttgtgattgaataggagggagttcagttattcttgcagaaacagagaggcagagtcttaactggtctacaatggagatactatatgcacagggatattgtgtcagaggtcctagtgatacaggatttttttccatgctgcttcaccagccagagacctccacagcctgcagtgcctctgcttgagtttcacttgcacctgctgggctcaccactggacttatctcacccacttggcctggcagcctgtgctcagctcactctgctgacctggatctcacacctgccaagggtgagccaggcatgcccactgctgtggtagggcaggtggcttcaggccagtacaggcactggttccacacgaggctgtggctggaccaggcatactgcaagcagcttccaccttgggcaccagcttctgaacgagggaaatgtggtggtgccaaaaaaacttggagatggcaggaaccacgcagccccaaagggggtgttacatacagcatgttacagctgtggcttagggagccttgaggtctaagcccccaggaaacattacggcttgtttgtgttacagctcatttgttcccaccctctgcacagttcagcgaataggggtgtgtctcacattgtttgatcccattgctgtactccagaccacagctcttgggctgtcccagccccactgcagcttcctgatgcgtggggtgggatggctacagtgtttcagcagctcctttggcacctgctgtttggtgggtctcaggttcttgtcccacgtccaggaagaaagaggttacacagacaactgaagagtgagcatggtggagaagagttttatcgagtgaccaaacagctcttggatgagaggggaacccaaagtgggtagcccctatctgaaggcaggtagttcccacccaaaggcaggtagtccccagagtgtggcttagtctgggctttttataggctcagaatgagggaggtgttggctgtaggtagccttggaaaaagcaacattagattggttaaaaaaccttgttcaggctgggtgcggtggctcacacctgcaatcccagcactttgggaggcctaggtgggtggatcacgaggtcagatcaagaccatcctggctaacatggtgaaaccccgtctctactaaaaacacaaaaaattagccggcgtggtggtgggcgcctgtagtcccagctactcgggaggctgaggcaggagaatggcgtgaaccccggaggtggagcttgcagtgagccgagattgcaccactgcactccagcctgggtgacagagccagactccatctaaaaaaaaaacaaaacaaacaaacaaacaaacaaaaaaccttgttcagaaagaaccaaaaacgttgttcaggaaagaccaggcaaacaggaatcgaagttctcactctggtcagggactttacctggaactggcagcttcgttttcaggcttcacactgtttttggcttaaaggttgggtttcactgaggacacacccctatctgcctaggaaattgtctgcctcctgccactgtcactaggaagtgactcagtatatttgtgtcaaagcacaaagtcattcacatttgcttttgcttatttccacttcttgaatgtcccttttgagtcacataattctttggtacaaataaaattatatgtaactttgataaatgtacaatatccaagcctagacaaaaggtctggccctcccaactcaagaagactgccacttacagttactgtttctaagatatggtttatgctaccagttatcagttaattgctatcagttaattgggaattgttttcacagaaatggcttccttctttgactgtaaccatgcccgaagttatcaattttatgctgaaagcattcttaatcctgatgcatttattgcttatccttgtagatcctacacatcttttaaagcagtaagtaaatcatcttacttggaatttaattataaagtaattttttgaaacacaatcatccagctaaacattagggctttgtgtaggtagcaaaaaaaatgcacctgccattttgggaaataatggattgtttctgtgctgagtactgaacagtagctgggattgctggagggttgaaataactcaaccaactatttgtattctggttgtttcagctcctttgaaaattatatacaattttgcttttttggccatttgttatgcagtaattagatgttactgtgtaacaggcataagtctagggcaaaaatatttctgcatatatattttaaatgtcatcttcaaagatgccctaagaaggctgaaccaatcaatagctacaaccaaacatattactatttacttggaacatgaaaattattttattaaaatttaattatttatacagagcagaactaaagcatagatagctcacaggagctctacacagatcaatatgtgacaaactaccaaatctgattttacttgagtaaaagaaagaaaatctattttgtagtgggaagtggaaaagatcttcattcttgtgctttagagacctaatcccctgttttatcacggtagaaaatgtgggctgttcagctgaagtttatggtaagtaatagtacttcgtgaataagtgctgtgttgtgacatgaagaagcatgtcccttttgctacagagcttggcagatggacgggtttaggccatcctgtcagtttcctgccattcttggaaagcttgacagccaaacagtagcattttccacatatcctccttgtccccgacctctctcttcttcctgcctcggctgctactctgagcacccacgggatcctggcatttacttctaggagaagcaggcccttggagtctttgtatatttggagataagagttaatctgccaaattggagtacccttagaagctagctcatgccacatggatgctacttgtggttacaaactattagaatgaatcaatttccttgacgtactttattgtactgtaccctaatagtcatacaatcaaagtgtgtcagagccagctgtggcatgcacctgtagtcccagctacttgggaggttgatgcaggagatctcttaagcccagaaatttgaggctacagtgtgctatgatcatgcctctgaataacaactgcattccagactgggtgacaaattgagactccatctcaaaaaataaataaataaataaataggatgttacagtagccctagcctaaatgtctatggtttattaaattaaaagttcaaagcctaaaatagcaaatactcaagcactgctacccatgtttttaaaatgttcacatttcattccttttcctttagatttttaaaacatacaaataaaattaaagaagcaaacgaccttatattcccttcaatccttcccctaaggcagagttgaatttgatatgtatcaaataaatgctttcatattatgtttctggatttgctgttttcattaaatattataaatataaaatttgaaatttacattgatgtagatagatctaatgtatttattttataggaatcaggcataatttattgattagttctcctactaatgtgagtttttattgtttccagtttttgttattaaaagtaatgtcggccgggcgcggtggctcacgcttgtaatcccagcactttgggaggccgaggaaggcggatcactaggtcaggagatcgagaccatcctggttaacatggtgaaaccctgtctctactaaaaatacaaaaaattagccgggcgtggtggcgggtgcctgtagtcctagctactcgggaggctgaggcaggagaatggcatcaacccgggaggcggagcttgcagtgagccaagatcgggccactgcactccagcctgggcaacagagccagactctgtctcgcaaaaaaaaaaaaaaaaaaaaaaaaaagcaacgtctaccaactctgccatctttgtatgtctctttatgtacttgagtggaattccttcatggcatacaacagaagtgaaattatcaaagcatacatgcatttccttctttattagacattaccaaatcactgtttaaaatgtctatcgattgctaaagaaaaataaaaatgaaggccacaatttagatataacccaaggccacccatgaccacatagccaaaaccaagtcatcctgattttccagaaacactagctctaatcataaatgaaacacaaaaacataagctttacctccttgtccgcgtgattcagggaaatgaaaccaatcagctgtagacaaatcaacataaatatctctacttgccctagagaagaatgttaatgcataatagccaatcaccaaaaaaggtcaaaatacttccgcctttataaactgtcttgtgactgctgtaagcgggggcttcttaccattttcagtttgaagtctcccagctcaaggactgttcttttgtgtgcagagcaaatttttaaaaattaaaaaatttgatctgattatatttttgacattttaaaaattatattccaggctgggaatgcagtgaagaacaatacaactttccatcagaagcaaatgagaattcccctattacacgtattcagtgttgccaattgctttaatgtttgcaaatctgctgaatatgaaattttaccttgttttaattaacatatgcttgacaactagtaagactgaacatcttgcatagttattgactatttgagtttcctcttccgtggattgtctattcatatcatctacccatttttctaatagggagtttctctttttccctcagttggttttgttttatttttgaaaacagacatggtggcctgttaggcacttttaaaatgcatatcctttatttagatcctggagatttattattatttaataatatatagcgagtttattgaaggacaacatttctaattacataagtaatcacctttcattttctgtcatcagggaaattgcttcttttgttccaaagaaggttgcccaacaatgggtcattttgctgatagatttcacttcaaaaatatgaagactaatggatcacattattttttaaacacagggtccctttccccatttgcccgtaagtatcatagctaagtttaattgtaatgctttaaggtacttatctttaaaaattcaacagtttttattgagtgtctactaaataactgggcattaggccagactgggatttcagtgaagaacaacacagtgaggtctttaattgagtttaggctagtgggaaagacagcaagtaaaatctcagttccaatcctgcgtaataaactttctcttaggaaacattcaagatatgtgcagagcataaaggtcagagagcctttcgaggaaaagagatttctaagctgactcctgaaggatgagtaagagggagaagggaagtattccaggcagaagtgaccacgtctgtaaatgcctggaagtaagagagagcagaaactgaaagaaggccctgccaggattgtagagactgggaggacagtgatagcagatgaagtgggagagacaaatcaggtcagatcatgaggcaagggccttgtgtcccaagtggagaggttgggctttgtctgtgggtgaatggaaagccattgaagggtattaagaattaccagattatttttatttttagaaaaatcactttagtttctgcatggattagaaggccacaagatggaagcagggtgcctgttacacaattattgccacaattcaggcaaaaaaaaaaaaaaaatagaagtagagaggttgcaaagatagttagaaggtggaagcaaaatggacctaggtgaatggatttaaaaatgcagaaaagcaaggagtcaaggacaattctggctgtggatgagctgtcattctctgagcttgacgacacaggaagaaaggctagtttggagcaagatgataggctagtttctccatgttacgttggagctgcctttagggtttgagagtgtgtgtgcaccatgaggcaggtagagatacggatctcagcctctggaaatggatgtgttctacagatagagagttgggagtcactcagactgtagtcagtgtggtgaaagtggatgacatcactacccaagaagaatgtgccagataagaagtaaagatagcagagaaagaggcccctgcaaaggagactgaagaatgggcagagagaaggaagaccagcaaagcttatcgttaaaagagccaaggaaagaaagttgagcaggaagagaggagacatacaccacagcaaatatatatatatatataatttttttttttttgagatggagtcttgctctgtcgcccaggctggagtgcagtggtgcgatctcggctcactgcaagctccacctcccaggttcatgccattctcctgcctcagcctcccaagtagctgggattacaggcgccgccaccacgctaggctagttttttgtatttttagtagagacggggtttcaccgtgttagccaggatggtctccatctcctgacctcgtgatctgaccgcctcggactcccaaagtgctgggattacaggcgtgaggccccgagcccggcccacaccaaatatttttatgacttctaaaaatggaagtcctgtgtcttcttttgtctatttcctttgtattgtggtcaaatgagacagggccccatagaggctcattggatgaagaaacagttcaacccttagtgagcttggctggggtggtttcagtggagagacagcagggggagccaggttccagtagaatgggcggagaagagaaagaaaattctttggcaatgattaactcatgaattaaaattcctctctggtaggtttctttcccctttcaattattttcaaataatcatatgaagaattgcattttttcagtttgttattaagcgtacagtaatttcagaattcagaataaaagatctgtttagctctagatgtaaaaagtcacatttggccatttgcaagggaatgatctactgacagatactatattgatctgtatctacgtgtactgggcattcttagcacatatccctgcaggagaagaagaatgactcactttgcctctaaatgattataaaagcatacatcttcttgcccaattggtttcctagatttttctggattaattgtcacattatggcaaataaaaacttggctatagaaagtatacatactatatatatgccacacaatacaaaggaaataggcaaaagaagacacaggacttccatttttaaaagtcataaaaatgcctggaaaaataaataattttcttttaaaatattattaaactatttattctggaaaattaaaatgtgacccataatgtgtatttttaaacgtagtttttcaccaaattcactgaaactaaagttgtatttttgcatgaatatgtgcagcactgttcaaatacaaccctgaaaattttatttccattaaaggatccaggaagtcatacttcccatgtgtttttaaccctttctctccctttccttcttgtttccttatatctaggttggaggcacaaattgtctgttaaactcagtggaagcgaagtcactcaaggaactgtctttcttcgtgtaggcggggcagttaggaaaactggggagtttgccattgtcaggtaggcagagtgagaaactgacgctttgcacagtgctgggggctcagtaacactaagtgagactggctcagtaagctgtttagtcttctcttttcctacaattccacaggctaccatggtatctttgatttttctttttacttcatgttttccaaatataaagtagaaatcataatatgtattttctctacagttccaactagaaacagaaaatgttaggaagtgataacatgaaaatacagatctagataatagagcaagtggaaaaaactgacggtattcaagatatatttttaatcccattcacttaatattatacaaatataagcatatatttttatttgtgtcagtaacaaataagacatttatataaattgctaaatttctaataagctgtctaagcattacccacagatacaggacatgtgttagaatagtcagaggttaaaaataatccagttcagatgttcattttgtatcttttgctaaaccctccttttatcttgaaattttcttaatcttttatttgttcagccttagcatttttgtattatgttcatgtccattattttattctgtaatttatgtcagaattaacattatacctactaattagatgcaaccttttctgcaaacagatgaatgtattaggtgttttatctctgtgatttccatcatcctcaaacactgggcacaggcacgaaaagcagagattttgtggttattttgtcagttgagagatgcatccgttttatcactggcagagtttctgcaggtcatcttgccttggtccaactgcctgtaaatataagctcagtgaatgatgatctggatcctgattggtgcacaggctccagcccacccttctcctaaccatgtctcccaccatttgactttattccaccttcagttcagcgaggctacactgtttgcactacccagtactgaatagatcctacccttacctttctgcaggacttcacccatgctgtttctttgctgcagatactttttcctgtctgctattttgtttctacctcttcttcatggctccatcaagcctccctctgagagcagttcagcataatcatgtgcctgtggttttgaggctcacaggacgctgggtaaagctgtgtgatttgtgccctgcacagaggcatctaacctggggcagctggtgatgaatatgcagtttctgcctcttttaagatttgtgagagcgtttccacatctctgttcttttgataacggccgaagaagctgtttgtaatgctgttgcatagttacccaatcctcttttaagaataagtaagcattgaaggttcacagcagatgtgtcatcttgaaatgaagtcagctagctaaatttgtatgctggtttagttctattcttcaaacaagttttataagtccagcttctccatgctcatggataggcagaatcaatatcattaaaatggcaatatcaataacatgaaaagacagatctagataattgagcaagtggaaacaaaatgatggtatataaggtatatttttaatcccatccatttaatactatacaaatgtaagcatatatttttacttgtgcaactcacaaataaataagaccattatataagttgctaaatttctttttctttctttctttcttttttttgagttggagtctcactctgtcacccaggctggagtgtagtggcatgatctcacctcactgcaacttccccttcccgggttcaagtgattatcctgcctcagcctcctgggtaactgagattacaggtgcccaccaccatgcctggctaatttttgtatttttagtagagacggggttcaccatgtttgccaggctgatctcgaactcctagcctcaagtgatccacccacttcggcctcccaaaatactggtattataggcctgagccaccgcacctggccaaactgctaaatttctaataggctatctacgcccaaagcaatttatagattcaatgctatctatattaaactaccattgagtttcttcacagaaatagatgaaactattttaaaattcatatggaaccaaaaaaaaaaaaaaaaaaaagatcccaaatagccaaggcaatcctaaacaaaaagaacaaagctggaggcatcatgctacccaacttcaaactacactacagggctacagtaaccaaaacagcatggtactgctacaaaaacagacacatagacccaacggaatagagaatagagaatccagaaataaggccgcatacctatagctatctgatctctgacaaacctgtcaaaaacaagcaatggggaaagaatcccctactcaataaatggtgctgggatacctggctagccatatgccaaagactgaaactggacctcttgcttacaccatatattacaagaattaactcaagatagattaaagacttaaatgtaaaacccagaactataaaaaccctggaaaacaacttaggtaataccactcaggacacaggcacaggcaaagatttcatgatgaagatgccaaaagcaattgcaacgaaagcaaaaattaacaaatgggatctaattaaactaaagagcttcgacacagcaaaacaaactatcaacagagtgaacagacaacctacagaatgggagaaaactttggcaacctatccatctgataaacgtctaatatcccacatctgtaaggaacttaaacaaatttacaaggcaaaaacaaacaactacattaccaagcgggcaaaggacatcaacagacacttttcaaaagaagacatatgcatggccatcaagcatatgaaaaaaagctcaacatcactgatcattagagaaatgcaaatcaaaactacaataagataccatctcacaccagtcagaatggctattattaaaagtcaaaaaataacatgctggtgaggttttggagaaaaaggaacacctatacactgctggttggaatgtaaatttgttcaaccattgtggaaggcctcaaagacctaaagacagaaatatcatttgacccagcaatcgcattactgattatatacccaaaggaatagaaattgttctattgtaaagacacatgcatgcatatgttcatgcagcactattcacaacagcaaagacatggaatcaacccatgtgcccatcaatgacagactggataaagaaaatgtggtacttatataccatggaatactatgcagccataaaaaagaatgagatcatgtcctttgcaggaacatggatggagctggaggccattatccttagcaaactaatgcaggaacaggaaaccaaatactgaatgttctcacttataagtgggagctaaatgatgagaacacatggacacacagaaggaaacaacacacaccaggacctatcagagggtgaagggtgggaggagggagaggatcaggaaaaataactaatgggtactaggcttaatgtctgggtgatgaagtaatctgtacaacagacacatgtttacctatgtacctgcacatgtacccctgaccttgtttaaaaaaaatgtccagcttcaccataggttatatcttagctaattgggcttctagtgacataaagggctgcaatgtatgggcaatgagtgaagatagttcttggaataacagaaagattacccttaagaacttggaagaacagtttcctctggtaattaaatcaattaattctactagtaatataataagacagaccctaggaatagcaatattcattcgttaattcattcagcaaatatgtaggtgcctacgctgtaccaggaactgttctaattgctggggatgcagacacaggtccgtctttcacagagcttatatttgcagtttgagtagacaaatgatacattaacagaagaatagttataagttatgaagaaataaggaaaggtgatacagtatggagcaacatggggacaaatttagattggattgtagcttaatcatttactaactatagtttaatttattttaccaacacaacaaaaaaagggactgtttcatcagaaggagaatattagcaatagccataggaaatgggagtcaggaagctcttatgggtaagagatgttggtttgggtgccacgaccaatctgggtcacagtggagaatttttgcatgatggggaaaaaacaagtcattggtttcactttgccttggatggaacataccttatgccttgagatatggcacctctctctgctctattgccgtgatcaacaaaatgtcttttgatcactagtttagttacccaattccttttatgtggttaaagaaggtaccagaaaaagggcacgggagcactctggttaatcgaagggaggtatttccacactgtgaattggtgaacaggctcctggtttgtagataagtcttgtgtacatttagtccactattgagagtttcttgatttcctggtgtcagtataatctggtttctgatactacaaagccaagaccagatctttcactatggagaaatcacaataatgcctctctaggtattctctaaaaatcacctagccaagctttccatttacttcacccttctttcaaacttcagaaccatgctattctgagatgctgatcaatacacatggaaagaataaatctcctacaagcaaatgctagcaaatacaagtttctcttccatagtgcatacacagatgtgttttctttcattcagtgctgtgaatacccagtgcaaacttacgagtcttatttttgtttacagtggaaaacttgagccaggcatgacttacacaaaattaatcgatgcagatgttaacgttggaaacattacaagtgttcagttcatctggaaaaaacatttgtttgaagattctcagaataagttgggagcagaaatggtgataaatacatctgggaaatatggatataagtaagtattgctttttccttttcattttcgtagtttacattttataaatggtgtttaaacccacagataatttgaaatgtgcaagtagcataaaaatttatagactttgaaattttgcaattaaagaaagggaaaagttaagaaaccaatgctatatgtgcagaagtgttagaaaataagaattactcattaaatcgggggatctaccgtgtctttttcttccctggcatcaggttaaaattccttttttttttccttaaaaactttcagatctaccttctgtagccaagacattatgggacctaatattctccagaacctgaaaccatgctaatctcagatacagtcttgatggatttctttagtaggagcaatgaagaaaagtgtctccttccacctggcatccagaccaaatttgacccttgtaaatgacttagtcatttacaagggtcttactcagagtcaagtacgggtttgctttttttctgtgtagaatgttcatctaactgcaccttaaaaacacactgaaccctgggacaaaagataattactatgatctgtaggaatctggatatcattgacaaaatagagctgttttggaattttcctgaataagaggaggtgatgcaaatgtatgttgagtgtataaactcactggacaaaagtaagcctctggcttgctgagtttttgaagtatattttcaggtataataatcattgttctaaaattatataaaactatttgttatgttgttaaatcttgctgagacaaattatgactatagtgcatgatatatagtagattataaccttgtgggttgatgtgtctatctagtaataataaaaactaatgagatggcactagtatttccaaggtgttccttggtgttcagggtgtgcacaagagagattttggagcttatctgttatgtgttcatcagttagcaatgggacctgaagttcaacaacccagggtatagcccccttcctccaaagtccctgccacaggagaattactcctctccctgggtcttgaatgctctatggtgaatttgtatttagcctcaaggcagcatttcatttgtaaagcacttgggtaaccctttgttcttgcaataacaatattataatatttaa

SEQ ID NO: 1644 - DNA, 71024 bp, Homo sapiens
gtcatttataaagaaaagaggcttaatagattcacagttccacatggctgaggaggcctcaggaaacttacaatcatggcagaaggggaagcaggcaagtcttacatggcagcagatgagagagagagtgtgtgtaaaggaggaattgtcaaacacttataaaaccatcagatctcatgagaactaactcactatcccaagaacagcatggggacaactgcccccgtgatccaatcacctcccgtcaggtccctcccttgacacatggggattataattcaagatgagatttgggtggggacatatagccaaaccatatcaaatagcaattaaaaaaaatcacataagaaaagacactcttaataaaatacaaatagaaaatgaaaaaaaaccaactcataaacttggtttaaataatccatttgtattgggtcttagtaagaatactactactagtaactattatcaagcaactactgtgtcatgtacttttcacacattcttttaattaaaaactctccactaacccttacagttcagtattatccttgttttacagatgaagaaaagccaaagagaagttatataactggcaagtttctctggctccccgcctgcaccactgctcaccagattgcatgaagagggaggcagctgtaacacctcatcccgttgatctccagggaactcagatacttgtttccacgtccaggaaaccgcaaactaagctctttgaagcatcagcaaaccttgctaagtgacacgtgaatgccatttggatacatattctaatctttcaagtagaaaggacagtcagactgcctcatctgtaacatccaagggatctgagaacagacattcagtccaggtgttgaacatcaacatcattataggaaaatggtcaaagagaacaatggcacacgttaagagaacatattaatagggcaagatgtatagtaaactaagttttcaagaagtattttatcatttttatgctctctactaaaagctgaccactgtagagtggatacacattgctacatacagcaactctacagtggacagcttttagtagtaagcataaaaatggctttatgttctcatgttctctgtgtagccataccacacgttgctacaccaggaacatgagtacatataaccattacatatacatacctgtatgtatgtatattagttacatatacatatgtacagtatatacatgtatatatattgaacccttggaagggatcagcaaagaggaggactcaataaaaaaagactagaatagaactagaagagagagaagcccagggagagcttcaagaagagtgctcaacagggccaaatgcgcagaggtcaaatagaaggttaagaagtgcccagtggatttggcaaccagagtcactggtaaccttcaaaagaacaatttcagtagattgttaagggcaaaagccagtttacagtaggttaaggagacaaagggagataaaaattcccaacattccattcattcatctatcccagtgtgtacagagtgattactgtgtgtttgttggcagttgactctaaaaagaaggctagaaatgaggctttttaatttttcccaagtactatgagctctgttggcctacaaaatactcagtgctgtgattcactcatttgtgctttgcatatataatatagtacaaactgctaaagatatttttaaaaaatatattttcacaggggtacaagcgatccatgattatacccactatgtttgtttcttctccactcaaagttactcattccctgtagctgaagattgaggacctgatatcatttggacatttctgctggatcaaatggtatcttctcaaaatgaaagtccttccacttcgagtacagtgtctgaactccagttgcaatatcctccaccacaaaactttcaatttttataactggaatctcaaatgtcttgtacttcacatggattccccagtcatggctgcagttctgtcgggcacagaatatctttgctcttttttcaaaacttgaaaactgctttggcttgggatgtggtctactcacaaagcattccttaaaagcatctccaagcacagtgtaatggcattcctacagatgaagggatggaataacacacaaaagagaacgttagaaccagtacataattgtgatttaaaaaaaaaaaaaagaaaaccccacaataatctgaggcaaagaacaggtgggtctcacttattttacaattggaggaaaaaaaaaaatagattcacccaaagtccagaggatccatgcacctgactcccctctacaggcagggtggggttgcaagtgaggacactgggcacctcataaagaagaagattaagaaggttccaggtaacccagcttctgaaggtagatactcattattcaaaaacagaagcgatgtttgctgaaaatttgtgaagctgaagttcaccagtggccctggcaggcacaatccaaaggatacagggaaaacgaccaaggtcaagatgcaattgaagaaggtcagggactaatgtgtccacaggccccacctagagtcaactttagagtaaacagctcagaaacaaatgcagatccaacatactagtccctcaggaaaacatagggtctaaaagggccatttttagtagaacaatcacccaaattggagctgaaaggaccttttacagctaaagaagcagacttagaaaggtaagggaacttagcaatatgactcctaataggctttttgcccaaacagctgagctgatgagagatttctgctttctgaagacgaacggaacatcctgaagtaataactcctcatctgagccagcccagcccctccactgtgccccccatgcaagagttataccccatatttctctttggagatttttctaaccctttctctgaaagttttaagaaagaaatataaggctgcaatagaaggctaatctgcagatgtcacattttacaaataaggagatattttgttttcattataaaagtgatccatagcccaaaaggaatgtttggaaaacataaggtagtaggaaaagagaaaaaaagtcatggaatctcaccaccaaaatattaatacattttggtatagttcccctagcctttgtttttctgtagcaaggtaggttttttgactttttctcttgacaatgacaatgaatgtatttgctgctgttgtttcacacagctacaaagtagcatctttacaattctgtgttctggttacttttttccttattaccattagtttgtaagcagtttttcattatactacataaacttcataattttttaaaataaactttactttggaacaattttagatttaaagaaaaattgcaaagatatcccagaaaatttctgcataccctttacccagtttccccaaatgttaacatctcatataccacagcacatttgtcaaaaccaagataattaacatcagtacattactattatctaaactacagattttaccactctttctctagttgtatcctttatctgttccaggagctaatccaggacacgtcattgcatttagcatgacttttttttttttttttttgagacagagtcttgctctgtcacccaggctggagcgcagtggcgcgatatcagctcaccgcaacctctgcctcccggttcaagcgattctcctgcctcagcctcccgagtaactaagattacagccacctgccactacgcccagctaacttttttatttttagtagagacggggtttcaccatgttggccgggctggtctcgaactcctgacctcgtgatcgcccaccttggcctcccaaagtgttttgattacaggcatgagccactatgcctggccaaaaactatttctttattattgaacatttagtatttttttttcacttcttagctttttttaaatacacagatcatggccacagtaacaatggaaataatagtagttttattataaatatttcaccaacagtaagctgtagctagtgctaaaacatgaccaggcactttgtaaaaaggcagcttacctctatcactcttacgtcagctgtgtaacatgccaaggctttgcactttctgcagagcagttttttattttccttatcaggtacaggttttggtttttcttgactatctctgatgaatttttcatgagtctgtatatgcagaatctaatgcaaaaagaaagaccgcaaatgtaatttgagtacaacatatatagcaagaaacaggcacagatacgtacaatacatatacatgcacgcacatgtataatcattcatatacaacttccatgaacatatggtacctgactttgtaaaatcacagattttattggttctcctaacttagtattagtcaatgcttaattgtggcctccaattagtctttcaatttcttcatcaaaaatgctcataaaagcactaaagatgtccatagaatagtcatatgaactatgctttctactttagtgtttggcaaaacttgggaaaaaaaacaaaacctgtaccagatatacaatatgcgctgtttcaggcataattatatccatttgcaggcacaaactcagtgagtgatacaacaggcagaagagcccctgatatggtttggctgtgtcctcacccaaatctcaacttgaattgtatcttaacagaattcccacgtgttatgggagggacccagggggaggtaattgaatcatggggggccagtctttcctgtgctattcttatgatagtgattgtgtctcacaagacctgatgggtttatcagcgtttccacttttgcttcttcctcatttttctcttgccgctgccatgtaagaagtgccttctgcctccctccgtgattctgaggcctccccagccatgtggaactgtaagtccaattaaacctctttgttttcccaatctcggttatgtctttgtcagtggcatgaaaacagactaatacagcccccaacatctaaaaccttttttctctctccccttcagccacagggaatattgttgcatatgtatagtatgattgtattctaattcaaaatctaggccttggctaagaacatggtccaacttagaaccatggacatgatattataaaactcttcataccaataaacagaaagatctcaaactgaatgaaaaaaaaagacaatcatagatgccaacactgagaagagaaagattttaaagcacctaataaagatgcttcgatgggcaattataaatacttttgaaacataaagagaaaacataaaggctcaacaatgaaatggaagacataaagtttagaactgaaagatacaaccaaaataaaaagttcaatggatgggctttccatagcagaatggaagggacaaagaaaagagtcagtgaactgaaagaacaacagaaattacccaatctgaacaacaaaaaaatacactggggaaaaaaaaagcgcaaagtctcaaggacccgtaggactataaaaaatgatgtcatggcactggagttctgcaaggagtgaagaaagagcagggcttaaaaagtattcacagaaatgacctccaaatatatcccaaatttaacaagctacatcaaccaggattcaagaagctgaacaagctccaaacaggataaaccccttcaaaaaacactctaagacaggttataattaaatttatgaaaactgaagaaaaaaatcttgaaagcagccagaaaaaaaaaaaaaaatgacaccttacccatagggggaaatcagtctgaataacaggagatttgtcattagaaacgatggaggctacctggaagtggcacaatattttttaaacgctgaaagaaaagaacagtccaccccagaaccctagactcagcaaaatgccaccttcaaaaataaaggagaaatgaagacattcttagatgaaggaacactgagaatctgtcatcagcagatttaccctaaaagaatggctaaaagaagttttctaaacagaggaaatgataaaaggaaccctgaagcctcatgaaggaagaaagaacacactgatttcctccatgtcttctatggaagattctgtccgtcccactggtttatggtttatggtggcgcctctccatatcagattatgctttcacgtgtcccaggtggatccagacagcctaggtgcaaatagtgtccctgtcacttagcagctatgtgatttggggcaagtgcctcgtttctttacatacaaaatgggacaatagcatctgcttcacggactgtcaggagataacatgagtttatgactgctcaggcctgcccagcacagggtaaatgcccatcaccgttgcctcttctctgttaggctagtcttatgctaagagccatgaaaatgttaatggggtggcttgtagttttgtattgataaggcaatctccattcattagggattgccttatcaatacgaaactactagctacccccatttttatttttctagaaatatagctattttcatctatttattattttatataaactctagaaccattttatcaagttaaaagtatcatttatgctttcaatatggtttgtgacacgtgaataagcaaatttggggtgaatgcacgtgtttaaaatattcagtcattccattcaagagcatggcatttcttttatcttaatatctcccagtaaaatttttttatttgtcctcatttctgcttcaaacttttctgattaggctggtagatgtaatggtgaaacagatgggttctaccaactctaccatgaactagctgtgtgatctactggcactgaagctattcaagtctcagtttcctgcctataaaatgacataggaggcactactgtatggattgctgtaaagcctattgatgtaagtaaagcatttgcagggactgttggagagtcagtgttctacatgcatgagctacacttattgtcactgcgaatggaaatctccctcccccttatatcttttaattggttacggatcatacatagataatatattgattaccataccacttcaaattcaaatttgctttatataaaaaaaaaattagatctagcttttttttttttttttttttttgagacagagtctcattttgtcacccaggctggaatgcagtggcacaatctcagctcactgcaacttccagctcctgggttcaaatgattctcctgcctcagcctcccaagtagctgggattacaggcaggtgccaccacatccagctaatttttgtatttttagtagagatggggcttcaccatgtcagccaggctggtcttgaactcctgacctcaggttatccacccacctcagcctcccaaagtgctggcattacaggtgtaagccaccacacccggcttcctttcccccactccccctttttgagatagattcctactatgttgccctggctggacttgaactcttgggcttaaatgatcctcccatgtagctggcgcaataggcgtgagccatcatgcccagctagacctagaatgttttgatttaaaaaaacaaatatactggctgggcacagtagctcacgcctgtaatcccagcactttgggatatgccgaggctggcatatcacttgagtccagagttcaagaccagcctgggcgacatagcaaagccccatctctactaaaactacaaaaattagtgatgcgtggtggcacacacctgtagtcctagctgcttgggaggctgagattgcagtgagccaatatcacaccactgcactccagcctgggctctgtctcaaaaaaataaataagaaataattaaaaaattaaaaaccaaatataatttccccttccccacttcttggccccatcccacctgaaattatcttcattatttttgtaaaaataaagggtgtccaggcctcctgtttttaatccaatttttcagttgtaaaactgttacattatatgtatttatcccattctttcctttggacaaatttctagaattgaaatccctgggttatatgatacacattttcctatgagcaattttaattttcttttttaatttctttttcagatatggttctaatcactacttaagcagaatagaggttaccaggaaagaaggtgaaaatataaccttgcctttcaggcatccaactttttaaaaaaattcacttataatggtattcaattatatactgaaattcaattaaatactaataatctcaaatattttaagtgttactctaggcaataggtataaatcctaataagttaaaactattacagctatacttaaaactaagtaaaaatcaataactgggtaaagaggctcaaccaatcataagttaagtctatggcatactgaccttcacccatgcaacctgtggctaaagaagcagcctagctccacacactgaggtggagaaaagcaaactatcttaattatgtgtagtcatgggtatgcatgttggaagttctttgttcagaatgaactttctttcaccccatctttattctctgctccatgaggaaagaaaaacagcttcctcctcattctgatttcaaataaaccttcacaaccacaactgtcataccgttcatcccttattcctccagaatgaaacaccaccaaatcctgaagcgtccaccatggaaatcagttcttggatacctctgggctgtctacatgttaagatggctgcagagtgaccagagaattctggggcgggggatggggagtgctctagtgacagcaggccacacacagacaatggacagtacagctggggcgctggggaagaaagcagtctgccagtactctgctcatccctctccctttcctgttcttgcagattgccctaaagagctccaagcttttgccctctgttctgcagagttccttccttccgttaaaacccatatacagggaccaggatgctcaaacccaaaccccaaacccttatcaaagcacccacaaaaggggggctcacccctagaaccataattccctttagtcttaagaatataagattttccctacctcgttatacttttactaagcctttttttgtttgtttttttgagacggagtcttactctgttgcccaggctggagtgcagtggcgcgatctcggctcactgcaagctctgcctcccgggttcacgccattctcctgcctcagcctcccgagtagctgggactacaggtgcccgtcaccgcgcctggctaattttttgtatttttagtagagacggggtttcaccgtggtctcaatctcctgacctcgtgatccacccgcctcggcctcccaaagtgctgggattacaggcatgagccaccgcgcccggcctttactaagcctttgaaagcaaatccttcccctttgagcagggcagctgggcctggtcatgtatgataggacagggataccaacacaactcaggcttcccagctgccagtaactcccagctacactggttatagggcttcttgttccctaccatctctgcctatctatctgtaagtgttacgggaaccccaaatgctattacatagcctgattcaacagatacttaacccatttcctcctcaccccactccttatcctggtgtgctggctacaaaagaatgcctacatctggtctagcctctctcttcctcaacagacttttactctgttgcttctgtcacatgagtctaagtagcttgtcacctaggagaagagataaaaattatgccatggctattaaaactcgtggttttaaaacgtgtattggcaatatattttacaaaatggaaaggtggctcagtgaagagagaatagagaatcccatccccagtaaaactaagggaggaactaaataatttccctgcaattcttctcactgaaaatgtggaagaggtggttctagataacttaatctcccagctttaggaagaaaaatgtttttagactagtaaacattgacaaagttttgatttgtgtcctaaaataagtgttaatctgctttagataattgatggtcaatactttttggagcacagagattatgactttttaaaattatagacactatggagttggtctattaaactgtaaggttcatcttcatgaagttaaactatgtctcacacttctgtccagtaacagctctcatttcttgggcacgtattttatgccaggcgctaagagatgcaatgcatacatctcatttatcctcatgaccaccctgggagttaaatactattattttccccactttttacatgaggagattgattatttaaaagacagagcaactgcctgaggtcacacatcttgcaactgatagaactgggatttgaaccatggattctagtgttaaagctctcccctagccctgcagtgatcatgcttccagagattctgagatgaaaatctctgcaatgggtctggagaaagtatgggtatgtgtttcttgactttctccaatctgatttcatgtttctgtgttacggaaattacaatgaaatgaaggtcattacactaagaggttgatctgaataggcatcccattccaaggtgtatatcattgtccacagctataaaaagacattccaatacctgcacagtgacctaggagcttttctctgaggactctttggagagagatttaaggaagagactaagaacagctgttttttccagtattaggatatagtcctcgagatgaactgtcaactagagaaatcctagctcaatttgccttttagatctgaaaacataacttcagttattagcactattaaatataatttaacctcattgacatttaaaaacagaatgaatttaatattcactaagtataaactttttgttgtaatataacactctaagcaatatgataaaagataccaaccatcctcctcacattccctgatagttatttatggtcagatgctggaagaataacgtagacttaccttttccctaaatactgcttcgtcccatgtctgaaggcgtaaaatagagtcattcatcattttttctttgtacatgtttatttgttctttttcaattacaccagcattactagtcagaaggaagcacttgctacctcttgctcttcctctgcctattagaaaataaatattttagttggtgtttttgacttaaagctctgatataatctgcaaataggtaaacaaatagaggtactcctaaaattcaactttggttcactgaatcccacttcccaggaaagttgagctgttaaagagtgaactcatgaggcaggattgcttgaacccaggagtttgaagctgcagtgagctaggattacaccactgcactctagcctgggtgacagagcaagacctatctcaaaaaaaaaaaaaaaaaaaaaaaaaaagactcaaatgcaggtgtgcacctgcatgttaaatatgtggaaaaactaggagcccaccttaggctggctttctcagggtctcaacaatgcagggtgattagacagccgtactgtcagaaacactgctttaaagatacctacatgaacccccagtatgacactgtgatggctctaagatgagcagtaaacaggccctccttcaagaaccttctagacaatgaggaaataagatctcttcataaccagcaaaacataggtggaaaattttaagtgctattacaaagacagatataaaaggttataggctttatatgttcaaaagagagatttttgccagctgggaggattagggtcaggtgatatggaggcaggggaagaggtaaaatgaagagtagcagtatctgagcagttccgtcaacaagcaataagtgaggaagtcaggttggcggaagtggataatgcacaaaagggaagaatgggaaataaagttggaatgaaataggtgttggattttggaaactctttagcatcaagtaaattggggaaccactggtgtttcaatacaaggaagtgacacgatcgagctgtttttcaggaaaagtaatatgatagctgtacttatggaattttaagaagaaaaggaaaaaggaggaaagaatagttaggagactagtcaagtccaggtggggcagaacaactctggagtatcccttcttgaatacagggggcccttcagcccaccagcaccaccatgaaaggtttacatgttgactggcaaagcttcaatccaagttggaattattcttccataaatatatcagtcaatgccaggcaagtgagcagcatcattgtaagaatcaaagtagagtttatgttagtgaacaaaactgtagccaccttaagggccaatgataccaaagtgcactgtgccattggtcacatactcaaccatggctcagtaaagagaaaggccagaatgacacatacacttataaatcagtcaaaacagaatccatgtaggaatggcctcaaagcttctcttacctctggtttggatcattttgatgacattgcccacatactcataaaggatgacaagattgcactgtgcaatgtcaatgccttcatcagcaactgaggtggcaatcagaatattgtgatctccactggctttgaatgcatccaatatacacttctgtgccgggagggtcattcctgtgtcagagtaagagggcattatacaactcaccaaagagggaacttcccccttgaaaaaacagctactaattatggaatgcttattatatgccaagtactgtgataagtactttatatccatgatctcacaacacacctaggcagtgggatctattcctatgcctgtttcagaaaggacatttagggtggcatctaacactcagactctgccacaagactgagttcaaatcccagctctgggggacttactagttgtatggctttagccatattatccaagaaatagacatttttgcagaaatatcaacacctaattgtaacacctttacatgtgtgtaagaatttatagctgacaaaacattttcacatcttctcactcaccagagcatcataaagccctataggtcaaagggtaagtgctctgattccccttaacaaacgagggtcgtgccaggcatggtggttcacgcctatagtcataacactttaggaggccaaggcaggtgaatcacttgagcctaggagtttgaaatcagcctggttaacacagggagaacccatctctacaaaaaatttaagaattagctgggcatggtggcacacacctgtagccccagctactcaggaggcttaggtaagagaatcacctgagctggggaagttgaggctgcagtgagccatgatggcactactacactccagcctgggcaagagaatgagactctatcttaaaaaaaaaaaagacacaaatgaggggcttgaggttccagaagtgaggtaaactgacaagctagctatcagcagtgttgggccttgaacttcagtttaagaccctaatagtgtgcactgttggggtgtctgcctccccatacacaaactaagaatcattttctgccacacccacccacaatacagttgtattatgtttctctatgaaagaggcaatgctatctgctcaccaatcttgtttctttctcctgctaggcacacacagctgaattatatttcgcaatctaaactgtcactaatggcatgtagacagaggtcatgtgtgtctcttccaaaccagacccctaaaaattgtccatgttcttgttatttctcatcaatggaccagataaggtcatagtggaggatttggagaccccctgtgatgacagagccataacaaggaaggagcctgggtccctacaataagtggaagaggatggagcagagcccccacccctacctatctacacttgggagcataagtgagcagagcccccacccctacctatccacatctgtgagtgtgagctataacttttattttgccctgcccctgagatcgtgagggttgtctgttagagcaattagattacactgatttatacacagcctgttcctggctgcagctactggactgaaataagcatttgaactatgttgggccaatccaattcttccctcttggaatctgaaattgggattggagacaggtagtaaatcaggaaggtgtggggcagtcatgaatggagaagcagagacagcaatctgtaaagggaaaactgtgaagcagatgtgcaggattcaggattgcaattgtccacaaagcccgagtgcacttccgaactgcgggttctatggtagacccaattatcccggtagcagccacacccccttctacttagactagcgtaagtgggtttctgttaatcggggaaaagaaaggatcttgactaagacaaccacatactgccttctaatatcctgcgatagtggaggctaaatttaaattgtctgaatacagtgtgaagtttggatgtgataatcacccagtttgtgtaatcatggcggacacccaaaatggtggctcaaacaatatgcgcacttcaaaccgtgtggatcctaaagacatctacgtttatctattagtagaatcacctgatctccactcactgctcacagggcggacccacctcaggcaggtagagcaaggtaatccatattactttccattacctagctggcagtggactcaagagtttgtggaaaaagatcccttgtggtttttgaattatttaccattcaaagtcatgaaaattcaaatgcaggcagctttattttcagaaagttgcttaaaaatcaatctctaaacattattttgattttacttttgagctttctttatccagaatactttttttaaagatacatactttctgttatttttgaatccatgtattctcagtaaaaccaaaatcaaacaaatgatgagcattgtggaccattacataaaagttctggatgtgaatagtaactaacatttaacatacattgagcactcaccacatgccaggcattgttctaaaccagaagtgggcaaactttttccataagggctagatgtatagtaaatactttaggctctgtgggtcatgctgtctcagctacccaacactgccattatagttggaaagcagccacagacaatacatacatgaatggtcatgactgtgttcccccaaaaagttattttatagacaatgaaatttgaattgcacaaacctttcacatgtcataaaatattcttttgattttttttcaaacaaaaatcattctcagctcaagagtcattcataagcaggcagtgagccagattttgctactgacattaaccctctcagctaggtactattattatttttccatttgacagatgaagaaagtaagtcatgaagaggttaggtaacctgcttcttcatgaaacaggaaattaagaaatggaaatgtggaaatatacaaatttagcaaactgaacttttgcttgtttacatgcagctttttgtaaaaaaaggtgttcacaattcttctagcttaactgtgcaaggaagaggatcagaccagaaacaaattcagctaaaattgtcttaatttactggtaaatcaagtttaacccattcgataaaagctatagagttcacactgataaactgagtgaagaaaatacttcagtggtctctacctcagggttaacagaatttatagaagctccaattggctaggcatggtgtttcacacctgtaatcccagcattttgggaggtcaaggtggcagattacttgaggccaggagttcaagaccagcctggccaacatggcaaaatcctgtccctactaaaaatacaaaaattagctgggcatggtggtgtgcacctgtaatcccagctacttgggaggctgaggcatgagaatcacttgaaactggaaggttgcagtgagctgagttcgtgccactgcactctagcctggaaaacagagcaagactctgtctcaaaaataaaataaaataaataaaagttccaattttttcctaatatatttccagcccaaatcttgagatatattttgctaaggccaaaacaatttcttttcaccatcatcatctactaaacaatgagcatctctggaacagacatcatacgtgattaatttcttagtttattcatctattcagtcaaacatttattcagcaattatggcttgtcagataaaaataatgattaaaaggtccatttttatccacaaggagctcacattttgtagaagaaaaatataaataagaagctataattgagtatgatgagcacagaaaggatgctatgcgaatgtggaagaaggagctctctaccagtttttggaggttggggaaggctacatggcagaagcacaatgcctggcacagcacaagttataaataaatgttgttgaatgaacggatgaataaatgaacaaaccaataagaaaatatttcctgagtgtctacttgtggaggaacaacaaagtttgaaaatcaaggaggactcatgttggagtcagatcgcagagaactttgaatcccaaccacaaaaatatggtgttagacttcatttggtgagccactttttaagatctgaatctacttttcatatttatgaagtttaaaaatgacatgaagggaaagtgcgagggtgataactagggactgacagggtgggtatgggagggtgcttattataaacaacactaaataggaagacttgtcagtgccagtcactgaggggtggggggcacagctgtgaggtggtcaggatgagggcgggccacctaggatcctcccagataataacacaggcagccttttatcctttgaccactctagctggatttcagaattgtctgcttggactttttaaaattgtaaaatacataatatacacaaaagctatgcatatctactgcttaaagaataacaataaaacagaaatagaacatttctatttctagacaatcttaatctattggttgaaaatttgagcaggatgataatgcgtgcaagcatgacttaaaaaacaaccctggctttgtctgcaggacatatgagaggaggcaatgtctacaaggaaagagcctggagtggtttttggcatttgagcattgtgatggctttttgatgcattaacttggctaggccaaacaacagttcccagtaattcatctaggtactgctctgaagagattttaccgatgggattcaagtccctaatcagttgactttaagtcagatcaaaagagagttcactccaggtgggcctggcctaatcaggtgagccttttaaaagacggcttaggccttctccaaagtcagagactccaaacagctcatgtctggggggttccagtctgttcctgatagtctcttcctgactacctgccctacacgcttcagacttgctttgccagcccaattgtgtaaaattccttgcaagaaatctctgtatatatgcatatgtggacacatatacaacacacacctctcatatatatgtataatcacctactgcttttgcttctgtggttaaaccttgactgatagaagcattaaaacagaacttgaaatatatattaaaacagaatttgaaatatatattatatatatacacacacacatatacatacacacacacacatattcttaaatgcataatccactaaatctaattcactatatataaatacctgtgttctgatttgttttgccacgtccagtcaatatgccaggttttagaaaactgagtttaggatttccttcaatccaattttttaaagcctgaaaatgaaaagcaattatcaattggacactccttataaatcatttgtattaattcaatattgaaatacatgcaaaaagaaaaaaatttaaagttagtacacgtacagttttcagactgacaaacctgagaaaaaaagcattttggaattgaactctatgtaataattaactaaaatggcatagatctctgtaacctgatatggtttaatctctaagactttttttttttttttttttgagatggagtcttggtctaccgcctaggctggagtgcagtggcacgatcttcgctcactgcaacctccgcctcccaggttcaagcaattctttgcctcagcctcccgagtagctgggattacaggcatcagcaaccatgcatggctaatttttgtatttttagtagagacaggatttcatcatgttggccaggctggtcttgaattcctgacctcgtgatccacccacctcatcctcccaaagtgctgggattacaggcatgagccaccgcacctggccatctctaagacatttttaaaagaaaaaacaaaagttcaaaaatagtgggtatgtagaataagtgagtttagcatgatcacaggacaggagatcaatatacataattcaactgaatttctacatactagcaacaaactattggaatttcaaaagtttttaagtactggacacagtggctcacacttataatcccagcattttgggaggccgaggcaggagagtcacttgagcccaggagttcaagaccaacctcggcaacatggcaaaagcctgtctctactaaaaatacaaaaattagctgggcatggtggcacacacctgtagtctcagctactcaggaagctgaggcaagagaatcgcttgaaccggggaggcataggttgcagtgagccgaggttgtgccactgcactccggcctgggtgacagaccgagactccgtctcaaaattaaataaataaaaataaaaattagctgggtgtggtggtttacacctgcagtcccagctactggggaggctgagatgggagaatcacctgagctagggaagttgaggctgcagtgagctgtgatcacactagtgtactccaacctgggcaatgagagtgagaccctgtctcaaaaaaaaaaaaaaaaaaaaaaggttttaaagtaccatttataatagcatcaaaaaattaatacctaggtataagtctaacaaaatatgtgcagaatctgctgaaaatgacaaaacactgataaaagaaaccaaagaacatctggttagtctacctctaaggtagccctcaatgatctccaccttctgtattcagatcctcatgtaatcccctcccctgagtgtgaaggggacttactgacttgcttctaatgaataaaatacaacagatgcaatgtggcatcatttccaagatgaagttatgactgtggcttccaaattagacaccctctatctcaatctctgggatcactctctctaggggaagccatctgctggtctgtgagatggacctgtggagaggcccacatgagtgaactcagaggctcttcagccaacagccatatgagaggagtttggaagttaaccttccccagtcaagccatggccagcaccttcactgcagcctcatgagagatcttcagccggaaacacccagttaaattgtttccagattcatggctcacagatattgtaagataatagatgtttgttgtttccagacactcagttttagggtaattgttcctcagcattatataactaatacggaagccatatataaataaagagatatactatggtcatggattagaacactcaatattgtcaagatgtcattcctccccaattttatctttatgtatttttaaaaatattttattttttcaagaccaagtctcactccatcactcggctggagagcagtggtgcaatctcagctcaccgcagccttcacctcccaggttcaagtgattctcctgcctcagtctcccaagtatctgtgattacaggtgcaagccaccacgctaggctaatttttgtatttttagtagagacagggtttcaccatgttggccaggctgatgtcaaactcctgacttcaagtgatccgcccgcctcagcctcccaaagtgctgggattacaggtgtgagccaccatgcccagcctcagttttgtgttcagattcaataaaatcccagcagattttttcatagatgtggaccagctgcctctaaaatgtatatagaaaggcaaaggaacatagctaaaaacaacctttaaaaaaaaaattggaggactcacatcaccccatgtcaagacttactatcaagctacagtgatcaagacagcatggaatgggtgaagaggtgtatgtatggatcaataaacaaaacagagaatccagaaacagatccatgcaaatatagtcaactgatgttttcagaagttacaaaggcaattcagtgaagaaaggatagtcttgtcaacatagagaactggaacaactgaatgtccatacacaaaaagaaaaaaaaaagaaagcatctcaaccaatacctcacgccttatacaaaattaatttaaaattgactgtagacctaaatgtaaaatgtaaagctgtaacgcttctagatgataacatagtgaaaatccttgtgaccttaggtaagcaaaggatttttagagataataccaccacaggcaaaaacccataaaagaaaaaactgatatactgaactttgtcaaaacttaaaactttccatctgcaaaagatactgtcaagagaataagcagacaagccacagaccagaagaaaatatctgcaaatcacatttctgacagaggacttttttgtcagactataaaaagaattctcaaaaactcaatcagatgatataccaatcttttcaaaagattggttttcaaagatctgaacagacacctcaccaaggcagttacagatcgctaacaagcagaagaaagatgttcagccatattactcattagtgaaatgaaaattaaaactctaatgaggtatcattacctactcacaaaatgactaaaatttaaaaagtaaaaaaaggaagaaatgcttgctctacaagtatcaatacttacaattagagtgactaacatagtgacagcatgaagccaggttccaaaactttgagagggcaaggtgggaggattatgtgaggccaggaattcaagaccagtctaggcaacataacaagaccccacctctacaaaaataaataaacaaattagctgggcatggtggcagatgactgtagtcccacgcatggtggcagagggtgatgaggtgggagaatcgcttgagtttgagaggttgagggtgcagagagccatgactgcaccactgcattccagcctaggtgacagagtgagaccccgtctctaagtgggggaaaaaaaaacaacacagtgaggcattagagtattagtataaggataaacatataatcagaacagaatagagaaactcagaacagactcacacatacacatatatggtttcttgaccgtagagagaaaacggctttttttttttttttagacacaggttctacctctgttgctcaggctggagtgcagagtacgctgtcatgatcactgcagcctcaatcaatcctctagccttagcctcccaagtaactggaactacaggtgcacagcaccagctaatttttcttttttaagagatgaggtctcactatgttgcccaggcaggtcttgaactcttggccccaagcaattctcctgccttgatttcccaaacttctgggattacaggcgtgagacaccatacccagcccaatcttttcaatgaatagtgctgggtccatttgttatctacaaggagaaaaaaagcttacgtccacaagtgctctggttttcacaaagagaattgttattgtctctgggtttaagtggtactcttcttgtaagatgaagcagaggtcttcaagtttaggattctcattgctgggatccctggaaacactttctagttcctgcagcttttctgcaaatgggaaacattttataaatggcttataaattctaaaaatttagaacacactgtgacctttagctatcgttcaaacagctgatctctaaatctttgaccagaattttatgagtagtaagtactgttttaaattggtacaaccttttaagaggtaatttggcaatatatatcaaaacataatacacacacatcttttgatccaataattctacatctaagaatttgagacacagttatatttagaaaattatggaagaggtctccaaggatttcactgtaccactgttcagggtgtaaaagaaaaacagaaaacctaagtacccaacaatagggaaacagttcaaaagatcatgggctatgcatctgatgttaatacaatgtggctgtgaaaattaataagggagctatgtacatgatatatatgataccaaaaatattttaaggttaaaaaaatcaaggtaaggacagtatgttcagtattatcccatctttaaaaatatagtcaggccgggtgtggtggctcacacctgtaatcccagcactttgggaggctgagatgggtggatcacctgaggtcaggggttcaagaccagactggtcaacatgctgaaaccccatctctacttaaaatacaaaaattagccaggcgtggtgatgggcgcctataatcccagctcctcaggaggatgaggcaggagaatcacttgaacctgggaagcaggggttacagtgagccaagatctcaccactgcactacagcctgggaaagagaatgatactctgtctcaaaaaaaaggaaaaagaaaaaaaatacatatagttataaaacaggggtgtgttacagccagatcataccggactatgggactatgggagtcaactgttgtggtttctgttttatcggtttttgtttttgttttttttcctgagatggagtctcctggcactcaggctggagtgcagtggtgcgctcttggctcactgcaacctctgctttctgagttcaagcgattcttctgcctcagcctctcaagtaactgggattacaggtgcgtgccaccatatctggctaatattttgtatctttagtagagatggggtttcaccatgttggccaggctggtcttgaactcctgacctcaggtggcccacccatctcagcctcccaaagtgctggcactacaggtgtgagccaccatgcctggccaattgttaaattttattactttttacaattatctacgcttttgaggttagttacacctattgttatctatatggtagaaatactatagaatgatgtgctgctgctcatctctttttaacactagttcaatgacatcatgttggtagcctggaattcactacagtgggagcagttataccatggaaatcaagaaaacacaaaaaatcagtgctttattgattgactgattgattgagataaggactcactctaccacccaagctggggtccagtggtgcaatctcggctcactgcaacgtctgccttccaggctcaggtgatcctcccacctcagcctcccaaggagctgggaccacaggagcataccactatgctcagctaatttttgtattttttgtagagatggggtttcgccatgctgcccagactgatctccagctcctgagctcaagtaatccacccacctcagcctcccaaagtgccatggtgacaagtgtgagccaccatgcccggcttaatttatgttgagagtttagacttatgaacatgatcaaaaaataataatacagattaaatttagctattacattgaatagcacaaaatattgagaaacattctcccagtttttgaaaaactattatacagttcagcaaaaaattgcttgcatcactggcaaacgagtgaagttccaacatacacctttgttgtttcatctttatcttctaacattaatgaaactatataccaacaaccatatcagaaagaaccacacttctttgtcattgcaacccttggttggccatggatacaaaaaatctgcaaaaaccaccaaaagcattctatgagaaccaattggctatgtggaatttacaataaagaatagtttatttttatttataaattgtggtttgtataactcctctatatcaataaaataataagcttatgtacatatatatgcatacattttttctctagtgggttgttaaatattaaccagcacagcactggttacacatatgtacagtaaatacttaggtagaggccaaaaaaaccccaaaattattagcactaattacctttgggaaagaattcaaaacagggagaaggaaaacttttttttgtttgtttaatatctattttttaatcatatgcaggcagtgagattatgtgccattttggtttcctctttatgtaaaaatatatataggccaggcacagtggctcatgcctgtaattccagcattttgggaggcagagacgggtggatcacttgaggtcaggagtttgagaccaatctggccaacatggcaaaactccatctctactaaaaatacaaaaattagccgggtgtggtggcgcacacctgcagtcctggctactcgggaggctgagacatgagaattgcctgaatccgggaggcagaggttgcagtgagccatgattgagccactgcacttgaccctgggcgacaaagcaagactccatctcaaaaaaaaaaaaaaagtatacataaattatggtttttttaatatcgttaaaacactttttcatatttttaaagctttataaaattactaaaaaagaacgttaaacaaaaagaatgctactgtctgtgaaccatatgggaaacaccctttgcaaatcttgtttttccttcttctaaatagggaatggtataagcaacagactcttcccataggtactagatttcattgaagctaaatagtcctaccatctccatcttcctacatccaggacaactccctaagcatccccaagtttatatatattaaatgcaatacatgtttgttttgccattccagtcaccaagaatgctactgtggcttcctcctctgaaaacaccactcaccttcaaatctctgagtaagatcttgctcaatctcatcgaatcctgctgctcggacattgctgaagaagtctttcaagtaatccagagcatctttcattcgtgcatgctcactgataatgagggcatcattatatttctgttgaaagtaaaaactgtctcaatatgcttccaatgtctaacacattcactgtatttaagttcaattcgttgtatttaacgaattgttttaagaaaacttttcttttcaaatctattccaacttagctttttaaagatgaatggcctctaacagttatgtaacaaaatctttgaaccaaatactgttaaaagaaaactcaattagctagtaacattaattatcatcactttggattattgaattttaccttagaaaagaaaaactgcacgaaaaacacatatcaaaatttaaaaataaggaaagtaaatcaacttccacatcaacctgcctcataattccaacatttcacttgatttctatatacatctgaagccatcactaaattgtcagtgtaccttccaaaatgatggccctgaccacatccatcaaatgtacaactaagctaactaaaattctacaaatgcatgctaattgaatgcattttaatatattttcaatggctggataagcagaggtgatagctgtcactatagttccttaacttcttggtgagccagagaacctggatttctgagcatggggcgtcaccaaaggtgaagaaatgtgtgcttcaggacatagcaacagaactttccacttgctgagctttcaagatgctgtcactggactggtcttgtatctggaataatgttctctcacaatcacccaattttttccaaccatgtcagttaatgctagaggcatggcatagaatctgagcctttatttcagtcctgttgcctgcagtatgaaatttcagaaaggaaatcgagatgatgttgaatgggacaacttttggagtttgcttcataagaactttctggaaaggttcctaagtgagctcttgaggacaggatgagaagttgatgttatcttggcttccacggtgccactcccagtaggtgctgtgaccagaatacgactcttaaaaagaggaacgtacccgcaaatgtgaagtgtataaaaacagggctttacaaatcctgctctcttcatctttgtctggcatctggaacaccatgcatgctttctgaactgtaacaatccattgttcatatttctgtgttccaaattccctattttgaatttgagataagttttctgttaaaaaaaaaaaaaaaagtttttcactgtctcatatggtcagtcatttagggttataaacaggcctcaccctctaattttctttttctttttttttttcctcgaggcagagtctcgctctgatgcccaggctgtagtacaatggcacgatcttggctcaccgcaacctccacctcccggattcaagcgattctcctgcctcagcctgctaagtagctgagactacaggcgtgtgccatcacgcctggctaatttttgtatttttagtagagacagggtttcaccatgttgtcaagctggtttcaaactcctgacctcaggtgatccgcctgcctcggtctcccaaagtgctgggattacaggcgtgagccactgcacctggcctaattttctttcttactctctgcaaacaggatattcctcctgaaatagtcttaagtcatctagttaaaactatttaactggattcagactggtgaaaaggtggaagcagggtacctgaggtgggaggagtaagaaaatagaaactcatgtgactccatcaccatctctccatccttctgctccttcccccattgagataacaccactgtgctgctggataatatgacaacctccaaactgttctccctacctcttgccttgttccctcccttgagttttaagcagtgcatctgtgtgtttgtttgtgtgtgtgtgtgtgtgtgtgtgtgtgtttgattgtttcttgagtactgtgtaccaagaatcaaagtaccttacattcataatttcatttaattttcacaacccatgagatacatattacatttcatatattgggaaactgaagttcagaaaagccaagtaataagtaatttacccatagtcacacagcaagtacgtggagaaagggcaggaattcaaacccacatgtgtcagatgcccaagctctactggctctatgagctgacaaccaaagcagcccagaaataaaacagtagacatgaaaaacccaactttgcctttaaaaatgaagaagtaaaaataacaggtctcaagagcttcatcagaggaggatatataaaagcaggagattggccggccgcagtggctcatgcctgtaatcccagcactttgggagccccaggcgggtggatcacgaggtcaagagattgagatcaccctggccaacagggtgaaaccccgtttctactaaaaatacaaaaattagctgggggtggtggcacgcacctgaagtcccagctacttaggagactgaggcaggagaatcgcttgaacccaggagacggaggttgcagtgaaccgagatcacgtcactgtactccagcctggcgacagagtgagactcttaaaaaaaaaaaaaatcaaggaggagatttaggactcagttcaccctatgttctgctttgctgtgaacttgggcctcctgttctccagagcagcattctcagggccaagcatagaatcggccctcaaaagacacttatcacacatgcatctgtctgtgtgcatctcctaggataagcctcagttgcttggttcaaagctggggcatctgctgtggtccaggctctgtgtagggtgctggggataagatgaggagactatggctgtgttctcaagcagctgagtctgtgagttactctggtatcagttcgccagggctcctcatgaagagcacagtacaacaaaagtcacaagcaagagctgtatttctgggttaaattcttcccctcactcattcattttcaataataggaacaaaggaggctacccaaacaagtagtattgacatgcttctttccaagttgcagctacagcgaggtggccagcagtaaagaagatgagccaacaggtactgattgaacctgggtaggtgtaaaaatagcctaagcagtttagagatgagcagctaactggattcggactggcaaaaaggtggaggcagggtacgggaggtgggaggagtaagaaaatagaaactcacgtgactccatcaccgtctctccatccttctgctacttccccaattcaaaccacatcagtgtgctgctggataatatgacaatctccaaactggtctcccttcctcttgccttgttccctctaacccatactctacccagtggttagagggagtttgcaaaattgcagatgagaaatcatcccaccccactgcttaaaagcctttagtggtcctgcagccaaaatcctgccccagctcacacactcctccccatgctctggcctctgcttgcttttgcttctcatttctggccactctcctttcagcattctacaggactaatggaagtccctatactctttctagtctcctggcctttgcatatgctattccctgtgcctgaaacacaccttatcacccccaccacaccagctgctttagtattagtattacttctctaattttggtcttaccatcagactagaaatgccctgaggccaggggctgtatcttagggttcatgctgtattcccatcacctagcccattccttagcactaaatgaatgaacatatgcatgaacacattcgggaaactgctaaatcaaaaggattcaggtagggaagtagtagaatataacattggaaagataagtagaacctgggtgttcaggcagggctcagactgcaggttagaggcgtgaagattatcctgtaggcaaagggtttttaagcaggacagggacatgataaaatgtattcatgaagactaactagttcatgagaggttgaatggaagagagagcagaggtaggcaaaatcagctagaaggctgttagaacaattataatagaaattaaactgtgaaagaaaaggggagagaaaagcaaaataagtgtgagaggagacactccatgaggtgtcttacagacgtcacatttaacatccctaaaactcaaaactcaaaaccttgtacctgccaaggctgcttctagtcctggtaccaggaccacccactggcattcatagaggtgcctaagccagatgcctggggggaaatcagcccctcctgcccctttctcatccccacccaaatccgtttagccattcaatcataacactcacagttggaagcatctcacatgtgtctccttccttctccaatccatctctactgcctctctttggtccttctcattcactggtatctttattacgtcactaatcagttttaatcttcacttttttccccattgtttttaggataaaattcaaatccaggcccttcactgtcttcccctggcccatctctagtcgcactcctttaatgctgggaaatgtgctgggtgattgtccctagatataaatctgagccagtagaggaatggtggtttcattcaggtgaacaggaaagtcaggagggaaagctgatttagaaggtagagaaagcaatgaactgacttaagtatggttatttttcaggtgcatgtgtctggatgaacttactttggatttaaaaggaaaaaaaggaagaaagaaagaatagaggaggacatataaggctcctaaataacctataatcaaggaagacaacctctggatatggtcttgacattgtctgaactaaggagaacacaaaaagacgatagtgaacaataaatggctattccccagtagagagaacacaaaatatgagatttatctcaccgaggtctttgcagattctctttgccagactctctgtgtccctcatcagctgagctatgatgtatttaaatttgtcgctaatccgtgattccactttcctgaaaactagagacgtcaaaaaaaaaagaaaaagaaaaaaagagtgagtatattttcaggaaggacagattgtagttcaaagtaggtatctctaaaacctttctctgcctttgatacttcctctgaaaaacctaaggttccaggctaactggcaggtggtccagatgatacaacaaatgctcaaaatgcaatggctccctgttgcttcttgtactgattctaacacctgtctttcatggtgtaggtctaactagcttctttttttttttttttttttttttgattgagaccaagtctcactgtgtcacccaggctggagtacagtggcgcgatctcggctcactgcaacctccgtctcccaggttcaagtgattcttctgcctcagcctcccaagtagctgggacaacaggcgcacaccaccatgcccagctaatttttgtatttttagtagagacggggcttcaccatattggccaggctggtctcgaactcctgagctggtgacccacccgccttggcctcccaaagtgctgggattacaagcgtgatccaccgcacccggcctaaccagcttcttactgtggctgtcctgttacctcctctctgatgaggcgggcatctctcatgtctctgcaagtgccacaatctaaccctgtctctgtgctttgatattctccctccccacacagctcccagcagtattcacactgatcctaccatttatcaatatattatttcagcctaattattaattgcctgcaatgtgccatgctttgattatagacagttgaaagaacacacttcatgctccatacagggctgtgatcttaagggagagaaatatacatggctaactaaccgtagcagttctctaacagaagtacatgtaaagtgtagccgggtgtggtggctcacacctgtaatcctaacactttgggaggccgaggagggtggatcacttgaggtcaggaattcaagaccagcctggccaacatggtgaaaccctgtctgtactaaaaatacaaaaaattagccaggcgtgatggcacacgcttgtaattccagctactcaggagactgaggcaggagaatcacttgaacccaggaggtggaggtttgcagtgagccgagatcgcaccactgcactccagcctgggcaacagcacgagactctgtctcaaaaaaaaaaaaaaaaaaaagaagtagtacacgcaaagtgtcacaaaacacagggaaagtaacacctaattcttccagggaagtcagagttgtagaataaatacaggaagaagaaagaagaaagcaagagtagtcatgtatattccatcacaacttggcaaagaaaaagaaaaaaaaaaaagagcagtgatgtacaaaggaagcacagacaaaaggtgggagagagaaagcacacggcatgattgaggagcccagaggaatgcaacatggttgggtttatgaatgtttggaggtgatgaagctcagagggcaggaggaaccggattgtaaagaaattcatatgtgacactgaaaagttgggatcaggtacatcaaaatccttacttacaagcagccttcaaaaaggaacttatctacaccactccctattacatgtctatttgttctacctcagaaatacagtcacatactactcagagagcaagggtgaagtcatatatattttctgtatccctctcttcctttcagggttagtgtaataataacatcaataaacaactgttagtcatattaaaaaatcatatctgatctttggaggagtgacatcatgaattcagatcattccatttcaactaaaatgatcaaatacatattcaaacagtgatgaccacacaggcacagagcatgggaaaaggctgagtgagcccagctcttggctatctgatgcctaaattctctcatcacctcttttgcattgctagtacatttataagaggtttttggaagcaaagaggaagaatgtttgctctctacaggccacttctgaggttcatccattgcttgggatgagagctcagttagagaggctaaaaaatgtgactgttactcaagttcaaggttaaatattttctactaaacagagagagggtcaaagttcagtattcgtctagatggctctgaactagaggtagtagagagtaacagaatctcaaaggcttgttattggatccaacttacacttctggggcttataaacaacttgctccagttcctccagattgtgtttgactgttgctatcactgacgcatcaagagaagcacacagcttgcagatataatccaaggcttcatctgtgtttttggcatccccaacaccaaccgaggcagtcagcccaatgacctgtaaggagcattcaaaatcattagatgtctgagaaatggtacaatgtttccacaacccctcatataactctttcctgctggggtagggcgtttttttgtttttactaacacacagtgtatggcacatggaggcacataatgcatatttactaagtgaacaaatgaataaaggaaacaaaattcataatgagttgtacaatatggacttgggacctgagaaggacatcttcagtgtggccataagagtaagaaaataggagttaggaagattatagctcttctgaagcattcgtctgactttggagatacctggggcagtgggcctgaagatcctccaagtttctgatctagataattaaacatgatcatattgtacgggtgttgtttactagtgttgtggcattcatcaaatatcatcaaagtaaagatggatagtgatggaatcgttccctttttaaggttgttcacaagaatctgtggagttaaaatgatgatgtcattgttctcaacaatctgttccactgggacattctcagctgttgctccagaaatgcctgtaactctatacctgggaaatgacagaaattccatattactaaccacgatgtggataaggaaccacaaagatgaaatgctagatcagaacatcaactgattaaattctccctgagtccaaaagaagaatagctgtaggcaagtccttagcacagagcctgacacatagtaagagatcaataaatccaagctagttgtaatttatagtactatatattattttaagtcactaagagagaaaagagtacgtaaaagaataatatcaaataaattataaaatcactaaagaagttaaatgtgccacgtaaacatcaaatttattcctgaagtcatttactccccatagaagggcaaaccaggggagtttaagttttctggtacatctaacaaaaaagacttgaatccatgaagggataacatctggattataaaaaagctgaatctaatataaatttttttaaatcatttgtcaaaaacaaaacagaaaacacatcaattacatgaagctggagaaaaagaagttgaagcaactattatacctacccatgtctttcaaagtattttgagaatacagatttctgctgttcatacactgggatctgattcgcaaaaaagacaactttccccttttgtccttgtgggaattttttaagatgatgttcacatataagcagtgaaacaaaggtttttccacaaccttttaacatgtaaggaaaaaagaaaacatgtaactcatatattagatatttctctggaaaggtgtttatttttggctcttctaataccactgagctgactaattaattgataatttaaatatgttaatgattacagaatttacactatgactaaaaaatatcaagctgctccctaagtagcatgccaacagccaggacccaaaagcaagctaaaagaggacacttttctttaccttctcatgaaaggtaaagaaaatacattaaatacattaatgtacataattaattaattacataatcccataaaaaacattaggattatattaggacagttttctcaaaagacacatggaacaaggaaaaaactgaaacttgcccattctgtcccagtattcaacaaaagaaaaaaaaggaagcaaacagaaaaactatgtaagtaatggcaataggcttacctgtaggagcacatattattgtgttttttcctttcatagcaggcaaagcaagctctaattggtaatttcttggtttaaatgggctgtacaagtttgtatcagacacttctggaatacaaaaggagcaaaattaccaaacagttcctgctctgaggaatcacggcaatagctacagtctaatgtccacaaattctgactccagcaagaagatcctcattggagaaagtttagaatcctttctcttggtaaccattctagcttttccactaatttgaagtacagaattctctcagtgacaaagtattgatggcaagaaagaaaaaaaaaaaaacatgaattattttttatacaatcatggaaggctaacagaaaccaaagaaagaatggccccattcagggtaagacaagctgtctactaaaggcaatgctgtatgtgaaaaaagcaacaaatcctcccacgatctttgaagaaaaccaaactgttaacattggattctcaaagcaatttcttattaaggagcaataatgctttgtcgttcttcaagttctcaaatgatattttctctcaacataaccagaagttttaaaaaataatcaaaggctttatctcaataacaggtaggcatataaatcattaagagctagcaaagactttggaaattatctactgagtctaacctacccattttagagaaagggagaatttctaaaaggttaagtgaattaaactcacacgaaagacatgtaaaggccaggtgcagtggctcatgcctgtaatcccagcacttgggaggctgaggtggatggatcacttgaggtcaggagttcaagaacagcctggccgacatgctgaaatccccacctctccaaaaaaaatacaaaaattaaccagatgtggtggcacatgcctgtggtcccagctacttgggagactgaggcaggagaatcacttgaacccaaggttgcagtgagctgagattgtgccactgcacgccagcctgagcaacagagcgagagactcagtctcaaaaaacaataacaacaacaacaacaaaaggcatgcaagaatcttcacgtgtcagaaaatttaaagcaactcatattcatgtatctgttttttttttccaaggggtaacagattttattctgaaatgaccaaaaaaacaaaacaaaacaaaaaaacttgtaacattcagttgcagacgtaatctgcacattttctctttatgatgttattctaatatcatttttcttctaccaccactattaatcccaatttccttcctgatactcttttatacataactttttattatggcatattatgcaacttgccggtctcataaaaccatcaagaaaatatgctttgagaagcataagggggcctcacagggccacagctaacttatacagtgcctttgtgtaaatgacaaaagggagctcctcttggaggacacagcccctcagtgcactgtgttgcaaacgacacaggctggatctcagcccctactcaacctctcagccaggcgcatttgggtagcacactaacttcatcaacttgcagggcagcccagggatcctaaaaggaaattgagcaagtgactcagaaatagaagtagtatttatttagaaagcaaggttgatttgggaattcatagacattgggttttggtgaagactctatttgcatttccaatatagacacgcccatactttcttagtggtagaagaagaaaaaaaagatagtaaaagaagaaaaaaagatagtggaagaactaggagagaatggcattctaaatatagaaaaagtatctattgtaacataaattctctttactttcttaattttccttacaaaacttttcacaaggctgtgactttgggtactgcaaaacaagcccccacaccaaataccagaagagcaccattatggaaaaggacaaacaataccaggtacctgaaggtggacatgaattctcactaagattctggcattctggatcttcttggtagaaaatctgtatgtcagaagtttccatcttatcctcaagatcttctgtttcaacatcttttatacctttttaagaccaaaaaagtcttagaatcttcacataatctgattatagttttgatggtgaaagctccacaaaatggtcataacactaagatttttaacttctattaaaatttctcacaaccactccccttcaccttttaaaacagttgaaagaatcattttgagtttaaaatctcaatttggcgttgacctccaatgtaatttagagctatattactcaaagtgtggaacgtattgccctactgaatcagaatccacattttaacaagacctcggagggattcgtatgcaccaaaaaaaaaaaaaaaaaaaaagagcatgatttagcagacattcatgtcttccttttctgactgactcttgacccattaaatcagatgtgtatttatacagtttctgaaacaacttatgatctaaagaagcctaggaaagctaagaccagatattcagatgtttaccaaactcagcctttgaaacaatgctgagtgtcagcttcaagaaaccaaatgatagttcagacacttaatgacaaccaattctttcacccgtcggattcagttccagatggcttccagtaagagaaccaggcaatgtctgtcaagaaatcaactctgaaaagggggtaagtcctggagtttgaacctttaactctagaattctcaagctatttctctgataatctaaacttagactgagagttcggattttgccttcctcaaatcctttgggccagatgggctaattctggatgagagtggttttccccagtccatttttaggggttatatgcaaccaaactaattttgtaggcaagtaactgcctccctcccagaatccagcttcctgctggtctcgcgttagagatgtagctctggctatctgaggggaaaaacgcctctgatgggatgtaaaagaccggttggaatgagcgagtcctaagtagagctgtgaggagggtacagtgtcttacctttctctacaatccacagttcactgaacttgttcctttctttctccaaagcaagtttcaaagttttgggccagttttccttgtctgatctgagaaggcattccaccaatttctctgcacctgccatcatccccttagtagagcaaatctaagcaaggtaactgtagtttattgatcaattatctcaaaagttttccctttatcaatttttactgaagaaatgtcagtcatgtactatctgatttaaagccattgtacattacagctcagtgggtcatatccatgacaatttttgccccatccaacacagtcttttaagatactttttccttcatctttgtcctttacacatgatgtcactatgtcaagccaagccttctcatcacctctaagttcttatacctatcctcatcagcaatattaagaaaataatcatttgacaaccattcccaatatgggtatattggcatatagcaatatttggaaacagataacaaaatattaacaaatttttcttcagggttgaggaatttgtatgacttttactaaccataataactaaagtttattgtacacatactctgtgcaagacatacatgagtactttacatatattatctcattacccttatgaaaataccatattataaggtaacattattatttccattttacacacaaggaaacagatagatattcagagaaactaagtaacttgcccaagatcataccgctagtggttgagctatgattctaacaaaattcatctgtgtccagagtctaaacacttaactgctagagtctgtagccctttctcatttgctcaactgttcaatttaaatttgcataaaatactattcacagactgtggtgattttaactgaaaatagggcaaacttcaaaaaaactttgtgacataaaaattactcagttcacattaaaagtactattctggctgagcacggtggctcacgcctgtaatcccagcactttgagaggccaaggcgggtggatcacgaggtcaggagttcgagaccagcctgaccaacatggtgaaaccccatctctactaaaaatacaaaaattagctgggcatggtagcacgcacctgtaatcccagctactcgagaggcgaggcaggagaattggttgaactcaggaggcggaggttgcaatgagccgagatcacaccattgcactccagcctgggcgacagagcgagactccgtctcaaaaaaaaaaaagtactattctatgagtacttttgtgggtttcaatgatctttctcaggtctaaaacagtatagaaaacagaagaccttcccatgttataattatttcccccaattttagtattttatattaacttacctgtagaatttcttcacattcctgattaattaaacattcagacagatcagaaatgatatcggttgggataattctggttttaaattctggttgtaaacgttttaaaagtaatctatactcctccaacttttcaatttttttgaaatcccaactttcaatggcttcataaagtccagaataacctgaaaaaaaagaaaaaaaatgtggacttttatgaaaccaactgaaaaatactttgagattagtatcatagaaatcatgtttgaatgtatggtggtagaattcaaaaaatatctgtaaattacccccaattgtcattgatttttcaaaaagaaaacagtattcattttagtcagccaacactttaggtcttctagcaatatttattatctattgggaaaaagtactaaggaaaactttgaagtcttacattttgatcttagtataaaatctttcttccaaagtgactcatagacttcacctacaatccctgatttgtctttaaaaagtcagagtcaacaggtttattaagtatcttctcagtggaaagcagtaaagaaggcaaaaagaaatataaaccttaattcctgcccacaaggaactttccttctaatttttctaagataatattaagtaaatgggaaatttacttaatattattctacatgcctttaaaagatatttatttaaaaatcatatttagaaagttcagagaaaaatactaatggccaagaaacatacataagatgttcaacctcattcttttttaaaattgtagtaaaaaacagataaaacatttaccatcttaactatttttaaatgtacagttcagtcgtgttaaattcattttgttataaaaaaaaaatccagacctttttcaccttgcaaatctaaaactctatgaaacaactattcctttttctctcctcacccctgctcctggtaaccaccactctttctgtttctatgaatctgactactttagataatctatataggtggcaaaatacaatatttgtctttttgtgactggcttatttcactcagcacagcaccctcaatgtatgtccattttgcaggatgtgccaggatttccttttttttttaaggctgaataatattccattgtatgtgtatatcacattttgttgatccattcatcactgatggacatttgagttgcttctaccttgtaagctatcacgaataatgctactatcaacatggatgtgcaaatatctcatcaataccttgctttcaattcttttggaaatacaccagaagcagaattgctggatcatatggtgatatatattttcaattttttgagggactgccatactgttttccatggctgttaacaccattttacaatcctaccaatcaggcacagggttgcagtttctccacatcctcacctatatgcattattttctgtttttattttattttattttttgaggcagagtcttgctctgtcacccaggctagagtgcagtggcacgatctcggctcactgcaaactctgcctcccgggttcaagcaattctcctgcctcagcctcctgagtagctgggattacaggcacccgccaccgcacccagctaatttttgtattttttagtagagatggggtttcaccatcttggccaggctggtcttgaactcctgacctcacgatccacccgcctcggccttccaaagtgctgggattacaggcatgagccactgtgcccagctttgtttttgtttttatagaagccattgtaatgggggtgaggtgatattgcattatggctttgaatttctctgatgattactgatgttgaatatctttccatatgctcattagccatttgtatatcatatttggataaatgtctattcaagtcctttgccttttttttttttttttttgagatggagtctcgctctgtcacccaggctggagtgcagtggcatgatctctgctcactgcaacatccacctcctgggttcaagcaattctcctgccacagcctcccgagtagctgggactacaggcgtgtgacaccacgcccagctatgtgtacttttagtagagacagggttttgccatgttggccaggctggtcttgaactcctgacctcaggtgatccacctgcctcagcctcccaaagtgctgggattgcctattttttaatttgattttttgtctttgagttgcaggagttcttgatatagtctacatattaaccccttatcaggtatatgatttgcaaacattttctctcattccatgggttgacttttcaccctattatgtcctttgaggcacataagtttcatatagtcccatttgtctattttttcacttttgttgcttatgcttctgatatcatgtccaagaaatcactgccaattccagtgtcatgaagtttttcccctatgctttcttctaggagttttaatagttttaggtcttatatttgctctttaatgcattttgatttgattttgtatatagtgtgtgatggttaattttctgtgtcaacttgactgggcttagggatgcccagatagctggtaaaacattacttttgggtgtgtctgtaagggtgttttcagaacagattatcatttgaatcagactgaataaagaaattcaccctcactgatgtgtgcagacatcatccaatccattaaagaccaaaacagaacaaaaagggagaagaagggcaaattctcttttcttgagctcatcatttcttttgcccttggacatcagaggtcctggttctcaggccttcagactctgaattacaccaactgctcttctgattctccagattgtggacagcagatcatgggacatctcagcctccacaatcatgtgagccaattccaaaaatatatatacacatacatgtaagtaacaatgtgtatacatatcccatcatatgtacacacacataaatatatcctattgcttttgtttctctggagaactctaatacatggtataagtgtcaaaattcattcttttgcatatggatatccagttttcccaacaacatttgctgaagagactgtcctttccccattgagtggtcttggtatctttgagcatatacttgagaatttatttctgggtgctcttttggcctatttgtctgtctttatggcagtgccacatcattttgattgctacagatgtgtaatgtgttttgaaattaggagaggtgaggcctcctggtttattcttcattatcaaaattttacctattcaagatgccttgagattctctataaattttggataattttttctatttctacaaaaaaaatgccattgcgattttgatagggattgcattgaatctgcagttcgcttttggtagtataggcaacttaagtctttaattcatgaatggggatgtctttccatttatttgtgttatctttcattctttcagcaatgttttgttgtttccagggtatgagtcttttatctccttggttaggtttcttcctaagtattttaatctttttaatgctattataaatggaattgttaccttaatttcttttttggattatttgttaatatatagacatgcgactaattttgaggtgttgattttgtgtcctgaaacttttctgaattagttctaatagttttttctaaaatctttagggttttctacatataagattctgccatcggctgggcgcagtggctcacgcctgtaatccaagcactttgggaggccgaggcaggcggatcacaaggtcaggagattgagaccatcctggttaacacggtgaaaccccgtctctactaaaaatacaaaaaattagccaggcatggcggcgagcacctgtagtcccagctactcgggaggctgaggcaggagaatggcatgaacccaggaggcggagcttgcagtgagccgagattgcgccactgcactccatccagcctgggcgacagagcgagactccgtctcaaaaaatgaatgaatgaataaataaataaataaataattctgccatctgcaaacagattattttccttcttcctttccaatttggataccttgtctttctttttcttgcctaactgctccagctaggacttccaatactaaaccttattcaatttttaaaatgaaaattaaaagtactgtttttacctgacaggttggtaaggattaaaataacttataatatccagattaatcatatccccaaagtggagaaacagtgctttctctgatgagaaacagaaaccagccctttggaaagacttgctccattgctgatttcaaccaacctcctgactgcccctccctttagcagtttcaacacaccaaccaaccagcacttcttcctgataagagaccaccaaccacagagtgggtctggccagtctatgaaggatgtgcagtgagagttttcatgtcctctgcttcaccttctgacatcagagggccaaaaactccacccttggatcttgctaacactgccagtttttgaacatgggtcccatagaaaggcatgaagctcacctgcccaggtgcatgcttctactttcatgactcctcctgtagcttactgaatatttggtcaccctattcagcataaatctctgttttactctccccaccctccaagtgcctgtttcctgcttctggcccgaggctacacttcccagcctgtcaaaatggccaccatgcagactgcaaccctttatgaaaaataaagctctcctttccaaatttatgaacttcatgattcttctgttgatagaaaacaccatagctctgaaaacagaaatgtaaaaattatgtaatatttgatgcatgtaccagaatatttgcaacatatataataaagagtataacaagaaaaggaacatatgtgaacctactatccaacttaagaaccaccatattccagctgggtgcagtggctcatgcctgtaatctcaacactttgggaggctgaggcaggtggatcacctgaggtcaggagttggaggccaacctgaccaatgtggcaaaaccccatctctactaaaaatacaataattagccagatgtggtggtggccacctgtaatcccagctactcaggaggctgagacatgaaaatagctcgaacccgggaggcggaggttgcagtgagccaagatcgtgccattgcactccagcctgggcaacagagcgagactctgtctcaaaaaaaaaaaaaaaaaaaaaaagatttccattaaatatcttctttaagccttagcactgttggacttcagttttgctattcagtagttataaaatgttatctcactgtgttcctaatttacaattcccaaattcctaattgggctgagaatcttttacatttattcacttttcattcttcgtattcattgaaatgtttgtccaaattttttgctctatgtatgttttctttctttttccagttgattttaagactttttttaatatattctagattctaatcctttggtgattatacattttgaaaatatcttctcccagagtttgtgatttgtttttttttttttttttttttgctttctttatagtgtttttgataaacatgatgtaaggaatacaaatgtatttatttattcgtacccacatgggcataaaagttagcgtttgttttttaaatacagggtttatttatttatttatttatttaaatttgagaaggagtttcactcattgcccaagctggagtgcaatggcgcaatctcagctcactgcaacctctgcctcctgggttcaagcaattctccttcctcagcctcccgggtagctgggattacaggtgcccaccaccacgcctggctaatttttgtatttttagtaaagacagggttttgccaagttgtccaggctgttctcaaactcctgacgtcaggtaatctgcctgcctcatcctcccaaagtgctgggattacaggtgtgagccaccacacccggcccagggtttgttttttaaatacaggggtctccctatgttgcccaggctggagtgcagcagcgccatcatagctcactgcagcctcaaactcctggactctagcagtcctcctgcctcagcctcctgagaggctgggactacaggcacacgccaccatgtccagcttgagtttgttcggcttttaatattattctgtttataaatgctattttttgaatagctcctcctttcccagtaatcctcttttctcagtgatgtctaatatatcaggtttccataaagatatggtcctaattagagggtctctattctgtttcaatggtcagtttgtcaatgccaaaaccaacatttcactgtctcaatgcctgtagctttctaataaatgctaacgtgtagaaagaaaagccccaatctactaaatttgtcttctttaggggtgtcttgactattgttgggtcgtaattcttccatatacattgtagaatcaacctgccacactcactgaaaaagtatgtaggatttttattagaattatattgaatatacagatcaatgtagggagaactgatatttttatgatctcaagcctccttctctatgtgcatgggtatgtttttccatttaggacttctttaatatcttttaataacattttatcattttctccattcagaccttatacatcttttgttagatttattcctaaatacattacaattgttattattaaaaatgatacttcattttggattacattttttgtttgcttccattgggcagaaatgcaactaatttttgtatactggtcttatatccaaataatcttgctaaactcttccattagtgacaataatctctctgcagattcttttgttggatgtttcaggtagacaattatatcatctgcctaaaaacagtctttacattgtctcagactaagaggcatgaactataagtggatacttcaaatttaatagcttttcacttttacagtattgtcaagcagcaaagtaatatcctctgatttgtgattaaaaagaatgaactaacctgcatggtctagggcatccaaaaagccacggaaccagccttcctcctggagctccaacaggaacttgagaaaaagtgtggcagcctccattgggcccttgttgtttttctcagcctgaatatactgcacctcttctacaaacagaagcaaaaatgactcatcaaactgcagaactattaatcattagaagaaaaaccagaaaaggatcaccagaccttcccaaatagggacaggaattgtaccaagtcacagcattggaagaatctttggagaagcagcaaaacctctgcccaggccgactgtgcccattcttcaccaagccactcttcccatcctctctggaaacctacagtttggtgtggaggtctgagcacacattctagaaaaggagtttcttgaagatgtgtaaaaaaatctccctgcaaaaagggagaagtcatggtggcctcaaactatcctcctccctcagcctctcaaagtactgggattacaggtgtgagccactgcacccagcctctacaaaaaaaaaaaaaaaaaaaaatttttttaattagttgggtgtggtggctcacacctgtagtctcagctactttggaggctgaggtgggaggatcacttgaaccaaggagttcaaggttcccgtaagctatggtggcatcactgcactccagcctggacaacagagtgaaaacttgtcttgaaataggacaaagaaaggagaaggaaggaagtaagggatacttccatggtccttttgggagaaaattatctaccaacctgctggtggtcattctaactttgtacactaatttcatgcccagggagtagtaataaaaatgctaccatggtatgacctgatacttgataattttctgggttttctttcccattgttgatggaatgcaaattccaagggagtaagcaagttgtcaggctggtgaaccactatattctcatagattagaagaagacctagcacgtaatagacaataaacaaaggtatgtttaatgaatgaaggaagagaagaaggaatgccttataatcttgctctacttaaaaggatctctgccaaggtctctgtcttgacaacaataaaatcaaccctttcaaaaaataaaattcaatggtttttggaactgtgaatccatgactactattttagtacattttcatcactataaaaagaaaacctatatccattagcagtcattccctactctccctctccttagccccaggcaaacactaatcaaattgagtctccatggatttgcctattttacacatttcatattaatggaatcatacaatacatagtctatgtctggcctcttactttgcataatgtttttaaggtttaaccatgttgtagcacgttattattcattcctttttattgccaaataatatcccactgtatggatacaccacattttgtttatccactcatcagtgggcatttgatttgtgtccacattttggttattacaaatagacatgctatgaacattcatgagcaattttatgtgacgatgtatatattcatttctcttgagtacacacataggtgtgagatttctagttcttatggtaactccatttttaacattatagggaattgtcaaaccattttcccaaggagctgcaccatcttacattcccaccagtaatctaagaggattccaatttccacacatccttgacagtacttcttaccatcgttttcattttagccttctgtattagtttcctgtggctgcaataacgaattaggacaaaccaggtggtttaaacaatagaggcttattctctctgttcttggaggccagaattgtgaatcatggtgttagcagagtcatgcttcctctgaaggctctggggagaatgcattccttgcccttccggtttctggtagctgctggcattccttggcttgtgacaacactccctccaactttgccttctgtttctctggcttgtggccacatcactccaatctctgcctatgttttcacacagcattctcgttgtctctatgtcttcacatggctgttttcttagagggacaccagtcatattgaactaggggcctgccctactctagtatgacctcatcgtaactaattacctctgtaaagaaacagtctcccaataaatcacattctgaagtactggggtttaggactttaacatatattttgggtagggggacacaattcaactcataacagcaacctatcttgtcacctatcccagcttccctggacccacaatcctaccgtattccattgagtcagttcattctgttcctaagcccattccttacagctgtacttttgttcccaggcctccctgctgcttgagcttcctttcaacatgctaacagccattacagatattccacgtggagatgcaaatttatcccagccacagctaccgccttcccagataaactgccttgcagtatgctgggcagttcacatttactttgcatgtggtcaggcccatccttctactacctggccccaatatctgctgctacagagtagtgacaatttcctcaaaagcaccaacaatgcagacaaaacttcatctttgacagtatttcccactgcctttgctgtcctggggcccattgtgatgtcaaacctcagcttctcaaggtagaatttcttgatcccttctctgctttctcagtctccttactgactaaagctctttattgactactgactaaagtacttacactgcatagtatatagtaaatgtgggcctgtcttccacctgaaactgtgacttggaacatttgtcttgtgatcatcagcacagtacctggctcacgcatgtgtccagaaagtgctaccaaaggaatggatactcagaatactgcccacctggtgcccctccagaatcatggttggcctttgactccaaaatactataaaaaatctgcagctgggcacagtggctcacacctctaatcccaccactttgggaggccaaggtgggtggatcacttgaggtcaggagttcaagaccagcctggccaacatggtgaaaccccgtctctactaaaaatacacaaattagccaggcgcggtggctggtgcctataatcccagctactcgggaggctgaggcaggagaatcacttgaaccagggagacagaagttgccatgagccgagatcatgccactccactccagcctgggtaatagagcaagactccaaacacacacacacacacacacacacacacacccaggtctgccttgaaacatcctggacaacctgtgagtgagaaaagtgctgcagcttccagggtaccatgcaagttctccaggagaaacatggcttcagtgctccttttccaagacgttactagcgtcaataatcacaatatctgattgcagagagggttagagtaaacgagatgctggatgtgggcacggggggaatgtggataagctccctttgctttccacggatggcaaaaaaatatgagtcaaaagttttatatccagccataacactcattagtgtctctggtccctgactgaatcctcactgataaagtatagttgtcacagcccggcacagtggctcacgcctgtaatcccagcactttgggaggccaaggtgggtggatcacttgagtccaggagttcgagactagcctggccaacatggtgaaaccctgtctctactaaaaatacaaaaattagccgggcatggtggccagtgcctataatcccagctactcgggaggctgaggcaggagaatcgcttgaaccccagagatggaggctgcagtgagctgagagctgagatcccaccactgcactccagcccaggcaacagagcaaggctgtctcaaaaacatatatatatatattatacatttaatatatataaaatatataaaatatatttaatacataaaatatataaaatatatttaatacataaaatatataaaatatatttaatacataaaatatataaaatatatttaatacataaaatatataaaatatatttaatacataaaatatataaaatatatttaatacataaaatatataatatataaaagtatatattatatctattatatatagatataatatatatttaaacatatatattatatatttattctatattatatatcatatatattttatatataatatatatgtttaaatatatatctattatatacaatagatatataatatataattttatacattatatattttatatattaaatatataatagatacaatatatatgtcacaattaaagttaaccaatgaatccagagcctccaaagcagcctagaaaaaaatagggaatagagaaaaactttatcaatctaatagaaaatagaaaaaggagttgaacccaaaaggtatgtggacagagatgcacattataaagtaaaaaggcataaataagaaaaatgtaaatcaacttcataacaatggttgcctctgcagagggaatcaaaagaagacctcaagggtatctttcacattaaaaattaagaagttcttcagggtgctttttcttttaacttactttccggtatttttattgtgattgtactctataaattagcatagggagaattgacatgtttacaaacctatagtccccaggcacaaacataggctgtctcttcctcactcaaatcagagacagatttctcttcagggacttcatagttttcttcatatcatttcagcattttttttgttaaatgtatgactatcttcaatcacacgtaatatcctctagaaaccatccttctacatatctaattatgtgtataaatatatagttttaaataagtaagatttaacaaatctgctcttttccactcagtggattacaggtgttgtttcctattaataaatatgtacctacatcaacttttagtggctgcatagttttatgtcacataaatgtagtataatttaatgtattcctttaacacgaaactaaaatgcgtttagtacacacccatctatgtctttacctgctttaccaacttttccctggaataagttctcagaagtataattcctcagtttaacagtatatgcttttaaatgtggaggccaggcgcggtggctcatgcctgtaatcccagcactttgggaggccaaggcaggcggatcacttgaggtcaggagttcaagaccatcctggccaacatggtgaaacccccatctcttctaaaaatagaaaaattagccaggcgtggtggcttgcacccgtaatcccagctactcaggaggctgaggtaggaaaatcacttaaacctgggaggtggagattgcagtgagctgagattgcgccactgcactccagcataggcaacagagtgagactctgtctcaatcaatcaatcaatcaatccataaatgaataaatgaatcaatgaaggaaggaatgaatgttaatacattttccccaactaccttccaaactgtactaaccctccatcgatagtgtatgaatgatatttccctccatagcactgaatttgctcaatcttcataacctttgcaaaactgagagacaaaaacagaccaaacaaacaaacttcactgtttttaatgatttcttgtgggatttcttccacctttggccagtgtcttttgttttggttatttcttaatacatttcctgttcatgtctcacagctagttttgagaggtcattcatatttttttctaaattggatttgtaagaatcttttatgcatttagggaaatgttatataatctggtttgtttttccagtatatgaaaatactgtttttccagtataatctcacttgttttccagtagataaaaatgcgtggcctccgtttttattttattttacgtatctattgcaacaagactgaatgaactctgttagttccagtaatttgggggaattttgtttttgttctttattttggccagtttgctttctttggagttaactggctgttctttttgcaattacttcagtcaaattaattaattcataagtgttcattcttttgaaataccaataaatccatttaggctataaattctgattaaaagcttattacatcttaaaatatataatatgttggctgattgccgtgcttacttttgaaagtagctatacttgtttagattttctcattctgctagaagttactcaaaaggatgctattttgaaattctgtgaaaatttttttaaacctatgattaatttctgggatatagaataatagctaacagtaatttaataccatgcagtttaatttccaaaacacccaaacatggtttttattctgattttacaaatgaggaaactgaggcatacgagagttaagacatttgcccagtatcacagagcctacaaatttgaaaataaaactcataaaagttatgctttgggaatttattaaatatttatctgtaactcatataggatcactttggcaaagctttttaagaattggaggagaaggatatatttgctatatgatacaaaatggaaaacatagacattaaatcaaccttattaaacagatcatttatgcttttattatcatttatctgacttagcagtactaataaagatatcttataattcccatatttcttgacgttttctaatatttaataaacaaagatttatgtgtaccaaatcttcactgatatctcaatacctttatcattttatcttaatactttccactagtgcaatttaagtataattcttgctttctttacgtatgcatttatttaatatatatttgtcccttctttatctcttttttatttatttattatttatgagacagggtcttgttccattgcccaagcagaagtacagtagcatgatcatagctcaccataggctcaattttcggggctcaagcaatcctcccacctcaggttcccaaagtgctggaattacaggcatgagctgccaagtctggcccccatttttattttttatgttattagactttacatgggtctctggcagatgaccaaaacctggattctgctttctgactcattcacacctatttaaaagatgtttgacctaattacatggccatagctgatataactagttttccttgtgttatcttgtttatatttccctttcctatattttctggttagcttaaattactagtttcttttctcctctcaagaacaacaaaacatataaaacctcatttaaatggtatcattatctgtaaccattcatatagctttttaaaactacagaagcaagtggaaaatggtaatattttaagtctcccccttttgaggcaagggatttaactcttatttatcataattttccctagctcctaacagactcaatctaaaattttaaaccaaagtatttacttaatttttttttttttttttttactatatgaaaatcctctcttaaaaaatgcttgactaggaaccagggcaagatggccaaaaaaggaacagctccggtctgcagctcacagagagatcaacacagaaggcgggtgatttctgcatttccaacagaggtacccggttcacctcactgggactggatagacagtgggtgcagcccacagacagcgagctgaagcagggtagggtgtcacctcacctgggaagcacaaggggtctgggaactccctcccctagccaagggaagccatgagggactgtgccatgaggaacagtgcaccctggcccagatactatgcttttccccccaagtcttcgcaaccagcagaccaggagattccctccggtgcctatgccaccagggatctgggtttcaagcacaaatctgggtggccatttgggcagacactgagctagctgcagttttttttttcatacctcagtgacacctggaatgccagcaagacagaaccattcactctcctggaaagggggctgaagccagggagccaagtggtctagcacagcaaatcccacccctacagagcccagcaagctaaaatccactagcttgaaattctcgctgccagcacaacaatctgaagttgacctgggatgctcaagcttggttgggggaggggcatccacaattactgaggcttgagtaggccctattcccctcacagtgtaaacaaagccaccaggaagttcaaactgggtagaccctactgcagcttggcaaagccactatagctagactgcctctctagattcctcactctaggcagggcatctctgaaaaaaagccagcagccccactcaggggcttacagataaaactcccatttccctgggagagggcacctggggaaaagggcagctgtgggcacagcttcagcagacttaaatgttgctgcctgctggctctgaagagagcaacagatctcccagcacagtgcttgagctctgctaacggacagactgcctccttaagtgggtccctgatacctgtgcctcctggtggggagacacctcctaccagggtcaacagacacctcatacaggagagctccagctggcatctggcaggtgcccctctgggaggaagcttccaaaggaaggaacaggcagcaatctttgctgttctgcagcctccactggtgatacccaggcaaacagggtctggagtggacatccagcaaactccagcagacctgcagctgaggggcctgttagaaggaaaactaacaaacaggaatatcatcaatatcaacgaaaaggacatccacacagataactcatctgaaggtcaccaacatgaaagaccaagggcagataaatccatgaagatgaggaaacgccagtgcaaaaaggcagaaaaaaaatgtgatcctcttctcctccaaaggatcacaactccttgccagcaacggaacaaaactggacggagaatgagtttgacaaattgacagaagtaggcttcagaaggtgggtaataagaaactcctctgagctaaaggagcatgttctaacccaatgcaaggaagctacaaaccttgaaaaaaggttagaggagtgacaactagaataaccagtttagagaaggacctgaatgacctgatgtagccaaaaaacacagcacgagaactttgtgaagcatacacaactatcaatagctgaatcaatcaagcagaagaaaggatatcagagattgaagatgaatttaatgaaataaagcatgaagacaagattagagaaaaaaagaatgaaaaggaatgaacaaagcttccaagaaatatgggactatgtgaaaagaccaaacctatgtttgattggtgtacccgaaagtgacggggagaatggaaccaagttggaaaactctcgtcaggatgttatccaggagaacgtccccaacctagcaatacaggccaacattcaaattcaggaaatacagagaacaccacaaagatactcctcgagaagaacaaccccaagacacataatcatcagattcaccaaggttgaaatggaggaaaaatgttaggtgcagccagagagaaaggttgagttactcacaaagggaagcccatcagactaacagcagatctctctgtagaaaccctacaagccagaagagagtgggggccaatattcaacattcttaaagacaagaattttcaacccagaatttcatatacagccaaactaagatttataagcaaagaagaaataaaatcctttacagacaagcaaatgctgagagattttgtcaccaccaggcctgccttacaagagctcctgaaggaagcactaaatatggaaaggaaaactggtaccagccactgcaaaaacataccaaattgtaaagaccatcgacactatgaagaaactgcatcaactaacaggcaaaataaccagctagcatcataatgacaggatcaaattcacacataacaatattaaccttaagtgtgaatgggctaaatgccccaattaaaagacacagactggcaaattggataaagagtcaagacccattggtgtgctgtattcaggagacccatctcacatgtaaagacacacataggctcaaaatacagggatggaggaagatttaccaagcaaatggaaagaaaaaaaaaaagcaggggttgcaatcccagtctctgataaaacagattttaaaccaacaaagatcaaaaaagagaaagaagggcattatataatagtaaagggatcaatgcaacaagaagagctaactatgctaaatacatatgcacccaatacaggaatacccagattcataaagcaagttcttacagacctacaaagagacttagactcccacacaataatagtgggagactttaacaccccactgtcaataatagatcaacaaaacagaaaattaacaagaatattcaggacttgaactcagctctggacaaagctgacctagtagacatctacagaactctccaccccagatgaatagaatatacattcttctcagcaccacatcatacttattctaaaattgaccacataataggaaataaaacactcctcagcaaatgcaaaagaacggaaatcataacagtctgtcagaacacagtgcaatcaaattagaactgaggattaagaaactcactcaaaactgcacaactacatggaaactgaacaacctgctcctgaatgactacagggtaaatatgaaatgaaggcagaaataaataagttctttgaaaccaatgagaacaaagacacaacgtaccagaatctctgggacacatttaaagcagtgtgtagatggaaatttatagcactaaatgcccacaggagaaagagggaaagatctaaaatcaacatcataatatcacaattaaaagaaccagagaagcaagagcaaacaaattcaaaagctagcaaaagacaagaaataactaagatcagagcagaactgaaggagatagagacacagaaaacccttcaaaaaaatcagtgaatccaggagctggttttttgaaaagattaacaaatatatagaccacaagccagtttaataaagaagaagagagagatgactcaaatagatacaataaaaataataaaggggatgtcaccagtgatcccacagaaatacaaactaccatcacagaatactataaacacctctacacaaatacactagaaaatctagaagaaatggataaattcctagacacatataccctccaagactaaaccaggaagaagtcaaatccctgaagagaccaataacaagttgtggcagtaatggcctaccaaccaaaaaaagcccaggaccagatggattcacagctgaattctaccagaggtacaaagaggagcttataccattccttctgaaactattcccaacaatagaaaaagagggactcctccctaactcattttatgaggccaacatcaccctgataccaaaacctggcagaggcaaaaccaaaaaagaaaatttcaggccaatattcctgatgaacattgatgcaaaaatcctcaataaaatactggcaaactgaatccagcagcatatcaaaaagcttattcaccataatcaggtctgcttcatccctgggatacaaggctggttcaacatatacaaatcaataaatgtaatccatcacataaacagaactaatgacaaaaaccacatgattatctcaatagatgcagaaaacgccgttgataaaattcaacagcccttcatgctaaaaactctcaataaactaggtattgatggaatgtatctcagaataataaagagctatttatgacaaacccacagccaatatcatactgaatgggcaaaagttggaagcatttcctttgaaaaccagcacaagacaaagatgccctctctccccactcctattcaacatactgttggaagttctggccagagcaattaggcaagagaaagaaataaagggtattcaattaggaaaacagaaagtccaattgtccctgttggcagatgacatgattgtatatctagaaaaccccatcatctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattactacaaaaagaataaaatacctaggaatccaacttacaagggatgtgaaggacctcttcaaggagaactacaaaccactgctcaatgaaataaaagaggatacaaacaaatggaagaacattccatgctcacgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatagccaagacaatcctaagcaaaaaagaacaaagctgaaggcatcatgctacctgacttcaaactatactacaaggctacagtaatcaaaagagcatggtactgctaccaaaacagattatcagatatatagaccaatggaacagaacagtcatcagaaataatgccacacatctacaaccatatggtctttgacaaccctgacaaaaagaagcaatggggaaaggattccctatttaataaatgttgttgggaaaactgactagccatatacagaaaactgaaactggaccacttccttacaccttagacaaaaattaactcaagatggattaaagacttaaatgtaagacctaaaaccataaagtccctagaagaaaacctaggcaataccattcaggacataggcacgggcaaagacttcatgactaaaacaccaaaagcaatggcaacaaaaatcaaaattggcaaatagaatctaattaaactaaagagcttctgcacagctaaagaaactatcatcagaatgaacaggcaaactacagaatgagagaaaatttttgcaatctatccatctgacaaagggctaatatccagaatctacaaggaacttaaacaaatttaaaagaaagaaacaaccccatcaaaaagtgggtgcaggatatgagcagacatttctcaaatgaagacatttataccacgaacaaacatatgaaaaaatgctcatcatcactggtcattacagaaatgcaaatcaaaaccacaatgagataccatctcatgccagttataatggcaatcattaaaaagtcaggaaacaacagatgctggagaggatgtggagaaacaggaacgcttttacacttttggtgggagtgtaaattagttcaaccattgtggaagacagtgtgggtgattcctcaaggatctagaaccagagatatcctttgacccagcaatcccattactgggtatataccaaactattgtaaatcattctcctataaagacacatgcacatgtatgtgtcttgcggcattgttcacaacagcaaagacttggaaccaacccaaatgcccatcaatgataaactggataaagaaaatatggcacatatacaccatggaatactacgcagccataaaaaagaatgagttcatgtcctttgcagggtcatggatgaagctggaaaccatcattctcagcaaactaacacaggaacagaaaacctaacaccgtatgttctcactcataagtgggagttgaacagtaagaacacatggacacagggaggggaacatcacacactggggcctgttgggggctgggaggataggggagggatagcattagaagaaatacctaatggagatgatggtttgatgggtgcagcaaaccaccatggcacgtgtatacctatgtaacaaacctgcacgttctgcacatgtgtcccagaacttaaagtataatttaaaaaagaaatgcttgactattgcacttacctttgtggacaaatttataaaattatttaaaatcaactctacatgcctagtttcaacattcacgaccaatccttgcattacaagaactcctttttttaagctaatttttttcagttcccattgtttggaatcacatttccagtaatttctgtaagaaatatatatgagaccccacatatataataatgttttcttcttgcttacatacataaatacctggctaaatataaaataggggcaactttgttttaccttttaaatgctgcacagagttttactctttagttacattagagttgcagagaagtcagagaccaacttgatgttgattccgttagaggaaacctgagtaatcttatttgtggccaggcatggtggctcacgcctgtaatcctagcactttgagaggccaaggcgtgcggaccacaaggccaggagttcgagaccagcctgaccaacatggtgaaaccccatctcacttgaacccagaagtggatgttgcagtgagccgagatcagaccactgcactccagcctgggtgacagagcaggactctgtctcaaaaaaaaaaaaaaaaagccacacgtttgtttttcctgaatgtttacatgattatttcttcatctgagaaatatgaaaatcctactaatgtattcccttctcaataaactcacatgcaaagtgctgtttctttctcagacaagtaaaattttctattttttccatttatctttgcttctgtcttctctctcctttcttggaacccacagtgtaaccaaattgtatagactggatttgtgtgaagatactattaagcactacctcccttgtaatttttcatttgtgaatcatattttcaaaagaactgcctacatttatcttctccacttccttgccctctatttattcctgagtctactcttgcagttagtttcccaaccatcttatacctttaccttcatccctattccacagaaactagtcctgtgggtggccccaaaagtcaataatgccaaagtaagggaacgtttttttagttctgacagaccttgggttctcagcatcattcagccatgttatccaccacatcattctcccttggtttccgtgatgcctccttgcccacatatgtggcactctttcccagtctcttttcctcctctgctcatctcttaaatgagtgcttgcacaggattccgtcccaggctctttctactcacactccaaaaagcaatcttgaaactgaccacagtcccacagacatttattccagaaaaacagaaattgacccttctggtctttaaacttgaagcttacacttgttttatctgagatcctttctcaggcaaaagaccaccaggcctctcaaaaagtatcaaactgaaattcaccagattatcacatccagacaatgaggccaggcccctcattcatcatgattgcttcctgagttcctgttttcccacacagttacatttcttccctgctatataaacccctaattttagtgggtcagggagatggagttgagactaatctctcatcttcttggctacagctcccaattaaaggcttcttccctggcaatacttgttgtctccctgtttggctttctgtgtggctaccaggaggacctaggccaaacccctggtgcttcagtaacagatttttgtggctgggttgctgtggtctaggagtctcagaagccctcctaagcaactgcccacccaattttggctggaagtgagttttggtctctctggccctgctgctgccagccccagctgagttcctgattgctaggaagaacagcctttgaaatgtgacactggcatctggataagtgagtgtcctttcttggcccagacagcaagatctgctcaatttgaaaattttaaaaggagcttccatttgcaggttaaaccagcccaactgactaagaaagggaagcaccctgactctcagtatgatactctagagagcgtgtttgtaatttctgtgtttgtgtctggccaagttagtgtcttttttgggtaccagacagtgggatcggcttctctcaatttggaaaattcctaagaaatttctgtttgcaggttaataaagcccgattgagagagaaaagcacctcgactgtttcagtttggacactgttcgggcttgtctattgcttcagcagtcggattgtgttttgttgattgtatgtgtcaatatagtaatgggaaattagaattcaacaaacaaatattcttttgtactacgtttgccccaatattctttggaatctggagttggctgttgaatgggaaagccaggtggagtcccatgtattctggcttttatgccgctgttttaagcagggttgggcctggtgagtagtttccacatgacgttcttctgtagtgctgtttggccccaggtttctttggaatctagcttctaaaaatcaaactgccatggaaactgctttacccaaaattctggttcacagccttcattggattaccgattggagcaaacaaattttagccatgtggacttggttgtagattcgtgagtttgtattgctatctcatggctagagttccaaggtaaaagctgttggatctttgtgtgtgtatacatgtttagatgtgtttatctagatgtacattaactatgttatacactatacctaccaaattggcttataaataagagtgctcataaattaagtccaaagtgtttttcaagttcacatgacttcagtaaatctttaataaacaagctgtctttaaaattattggtaaaataaaaatagaaatgtcttcagaattgtcagcatacatttttgtctcggctttatatttgtctcagctagataatttgaggtatcagagtttggcagcaggttataaagctataaacccagtgaatatttgtgtgaattctttataagactaatttaatgctgttagtttaatgaaaacagctgaatcttctgagttattgatcaaaatgcccacgtattaattttaaggttatttaggtgaacacctgacattcacaggttataaaatggttaagaaggaaatgatgcagaaataatctagataaactgctaaaaataaataaaatgtaaatggtcaaatgctgtaaatgaacttttggcataatcggaaatataatcattggatgtttgagtcatttccaattaagaaaaggttatgatgtggggaacatgtttctaaaaattgtggaatggttctcatctataaaatactaatatctgctaggcagctcaagatttcttgcttcctaggtttttactgaaatttaaggttgttactaaggataagaattctagttcatatgtaattctatatataaaatgtgcaaaagacaatgtgtttttattcagaaaaaaattttatctaactcagaagttatctaaagtttattaataattatggacttgaaaggttacttatgaaacaaggtagaaaagaacaagtagacgagagagatgtggagaaagttatgagtataaagatgtatttttggtaaggaaggttataaagaaaataattttgtatgacaaagcatcttataatggtattttttttgtcctaaagtaaaatgactgtttaaaaaaaaaaaaagaagaagaaaaagaacgaaaatccaggacaaatcagaaagtctaagcatatcatagatggtgtgtgtaagtcatgtagtttctttcctatttctttgtgtgtctacctttatgtacagacagagaaaatacaaagtataaaaggcttaaataatattctcttaaaaccagatagaatattggagaaatctggctaattaacactgctcatagttaaagctcttagtcttgatgaaagtaaaataagaaatattgtaaagaaacacattggcagtttggcaatcctttcttaatatagttaaccatgaagccagataaaagccagatatagcaacaaccaaatttcacctacatgcttgcattgcttcacactgtatttgctcttctgcatagatatactatcattacagtataatacttactggtcggcctcctccagagtagctgggattatagttgtgtgccatcatgcctggccaatttttgtatttttagtagagatggggttttaccatgttggccaggctggtctcaaactcctggcctcaagtgattcacccatcttggcctcccaaagtgctgagattacaggcctgagccaccacgcccagcctaaagtgaatttcttaattgcacaaaatatatagtggtattggtgaacttaaagacattaaattgtgcatcaggaacaaaatattcatcatgtgtttttttggctctgggtaacactatagcctccaagttaaactgagtagaaaattttcaggttggtttcctgtttgttttttcttttaatttgcatttatttgctgtttcttcttctttaggttttacttatatatacatattaataaaaccattgatggcttttagtttctaatgtaaggaaggcttttatttggttccatgaataatcattttgtttcctatgcatttccagtatctcatcatttgctctacttatccaaagttcctaagctacctttttcaagcttccaaaaattgttggtggacaccagcctttaaaatttgtttggttttgcttacctctaatgaactagagagctataagaactttaagattcctggcaaaaaataataaaaggtttattcttctaagttctgaacagaaatagtacattattattggttatttggaaaagtaggtgagagaaatgtttaagtggtgtttatttccaaggtaattcaattcaataaacaatagcggtttcagatcttttcctttaatgaggcaaaactgctatatgggtacaaagtcttaatattcagaaaaaaattggctttgtctttaaggaaattatattgattgggctttctctcaaactaatttagttgtgtttactattattaagattaaataacatttacttggattaagtcataaaaaaaattataagactttctagtgttttttttatcctaagccatttatcactgatgggccttcacatgtatacttgaaaacaaaatatgtacatacaagtgttatgccagtttgaagattctagtggtgtaagtcacttaaatcagttgtcagtactttatctagaaaccaatcttggaaatgtatgatgaggctctttcaaaatagctgaaaagaaattactgtgtgcttattgtcactttgtccttgttttgttgtatactttttaaatgaaagatttatcttcatattgaatttccaaaactgatacttgcatttaccatttttttttttaatgatggaaagaaaagttaactatcttactttggtaagtttggcacaggacttaccacatttttgaggctctaggtcacagttttgtcactagaatgctagcagataaatgcaaggagtaacctaaccactttaatacaatggattgtataatgggttgaagtgtttcagacagtaactactaggcaccaaatcccagggttttattttgtgacatattagagagaatgatgaggtttcctgcagtataaatatgctattaaataattcttaggaaacaattatttagtaattcaaaggcctttgactcctggatccaaaaaagacaccaatacctgctaaatcttgagcactgacaccaaatgaagcctcgtcttcagactcaggagaaggtgacaatcaaaatgaactgctttcatgagacatagggctagaaattaaaaccattcaatccctctacgcccaggaactattgcacaaaaggtgagcacgtgagcttgtaagggctgattttgagttataaaattagttcagggtttttctataaattaaacattaacatcaaaagcacactgatgcaaggccaatgtctgggcccctgtgtcataacagggttttcttggagcattactctactctttaataggaaatcgtaaaacgttataaaaagatggctgggtgtggtggctcaggctgggcgtggtggctcaggccggggctggtgactcaggccgggtgtggtggctcacgcctgtaatcccagcactttgggaggccgaggcaggcggatcagctgaggccacgagttggagaccagcctggccaacatggtgaaaccccgtctctactaaaaatacaaaaattagccaagtgtggtggcatggcctgtaatcccagctactagggaggttgaggcaggagaattgcttgaacccaggaggcagaggttgcagtgagccaagatcgcaccactgtagcctgggcaacagagccagacaccatctcaaaaaaaaaaaaaaaaaaaaaaacttcacagaaatcctatcttatagtcaaactgattaaaattcggcttataaggttttattaaaattagctttaacattaaaaatataccatacaaaggtaaaatttgatgttctcttttgaataaaatgtttgtataatattgacataaaatatttgtttaccttttgagtgaactgtggggggaagaaaaggaagagggagagacatttagttggcctcatgctgtctttattaggccttattgttgggaaactgagtcgcctatcaaagggtaaatgtgtttgttttatctttttggctaaatgaataactattttgtagcgacctgtgatcctattttgtgatatcaagtgtcttaaatctttgatactgacagacttcccaacagcaaatatttcaagttctaaattcagggggttttttttaacctcaaactaacttttttgtgtattagcttccttgaattccaatacagacagacatgttaggcttctttggtatattagaattatacaggcagcattatcaaatgtgaggtggtatttaacttcctttgggttatatttgtatagatgtgctattaatatgtgttgcaggactatatgagattcctaaaattctgatatgtcttaatatatggtgtcagtaatgatgattattatgttaaattgttgtatgccaacagaaaaaaaaatttccttgtcaactgtgtctttatggctctcctaagacttttgtcattgcaattgttgttttgcattgattcttttcaaaaagtgacttataatcagatatagtccagagcttgtttatttaggggacttcatgaaaaggagtcttgaatgcagatttctgataactttggagactgtgccactggaatacagaaaacttctaggactcttaattagagtccctcttaattaaaaggctgacatgtttataaagattactaacccaatatgaaacacagcaggagttgattgcatggactgaactaatgtgggactgaaataattttttatggttttgtttgaaaaagtctggagaatttttgttttttggaatctggagaattttttcttttaagctcttcataacctttaagaatacagtatattaagtagagtatacccttttaaacagaatttgaggcattttctctctccctaatttctccagaatttataaactatttgtgaatattcttagttcatggcaatgtgttttcttgcatacatttaataaaaatctgttttcttttataaggggacacagttggaggaacaagttattttcccagggctttgactgaaatggccttgtgagaggttccagcaaagccaattaggagagcccatatggacaataatttttgctgcactttgtgtgggtaaataagccaagtatatgtaactgaggcttattttgcaggtaggcccatccagctgtgatatgtctttggtggaagcggggaacagtaatgatacagattgtgtctcagaagaaaactatagtattagattaacttttgattcctggatggccacgtggtcacccatagtatggaactgcccaccacgccattcctcagcatgaagctgccagaaagattgaggatcagattccccatgatccaggaattgataaatagaaagagggggactgaaaccaacacaatagtcccatatacaattctttcgaataaacatggaaattgaccctcctgatcttaaagctgaaacttatatttgttttatctgagttccttccccaggaaaaggacccccaggcctctcaaaaggtataaaagaactgaaactcatcagaccatcacatccagacaatgagacaccaggcccctcatttatcatgattgcttccttacccctccagagtccattttccaacacctagttatatttctttccttctatccatacccctaatttcaacgggtcagggagatggatttgagactgatctcctacctcctttgctgcagctcccaattaaagccttggcaaaacttgttgtctcagtgattggctttatgtgcagccagcaaaagaacctaggctgaatccctggtgtttcagtaacaattgcacccactctcattgtttcagcaaggatctccacattaatgtctccccaactgtggacccttttcctgaactccacacctgtgcagccaacaatctgatgaacatctcttcatggatgtatccaaggcatacaaacccagcatacctaaatccgaatttttctcctcctcctgcaaacctgtccctcttcccacatttcctatctcagaaactaccatttattcacccaaggaccaaagccagagacctggaagtcatttccaccctgtcctcacccttacctcctcaccacaactccccaagagacctattgattatactttccaaatgtgtcttgaatccatccatttctccccattcctccggattcctattttcctaactggtatccttgcttccagtttttccactctgctgtcctggcatcattgcatctgccattctctctctccctgtcttgtacctattcaagccattcctcaaactgaagtcaaagtcgtttttctacaatgcaaattctattttggtcccctctccttatcacatttcagtggataaagtccaaaactgttcatatcccacttctgcttgcctgtcaagtttcatctctctgaactcctgcctctctctccacaatgccaccatactaatattttctggatacctggaacactctagtttctctttcaccttggacctttgcacataaggagccctctaactgcaatttattgtctccttccagctaatttttcctctttctttagacctcagttcaaatgccaaatatctgggaagctttggctgtgccctttggactctagtagacatcccagcttttttccatcaaagcactgctgcactttattatttactattttgttacctgcattcacatagacacactaatcactattagggcagggacagtttctactgtgctcatcattgcttcctcaactttcaatgacactattaggtaataggtgctgagtaaattacctccaatgctaacataatactgacacgagttgcttattttattccatcaaagtgtatcaaatcaatatatgagtgcatgaaaaaatggaattcacaccagttgttagtgtttcttccaagtacttcttcaggtgccaagctacactggtcactagaatgccattccacaacctttcttttagttttgtagagcaattagcattcaagttagttgccggtcttaacgccatttccaaaaactgcaataacatcaggaaagactggcacttggagacttttaggattcccaggccccctctcatcgacttttttttgtttttcggttttttttttttttttttttttttttttggagacaagagtctcacgatgtcacccaggctgagtgcagtggtgcgatctcaccataacctctgcctccctggttcaagcgattttcattcctcagcctcctgagtagctgggactacaggagtgcaccactacgcctggctaattttgtatttttcggtagagacggggtttcaccatattggccaagctggtctcgaactcctgaccttgtgatccacccgcctaggcctcccaaagtgctggctgcagggagccgaaggcccttgggatgtgaccaactcagcattccgctggaggctatatgatcaaacagcaaactgtttatcatgaatgcagcacctgggcaaactcacactgccttgccaccaaatggtttgctgagcgcctcactccctggcgccaggctccttgaaattatttattgagaaatctagcacctattgttcaaagaatgcagtcttgcaagcctgctgtgaatcaagcagccagccaacaagcacctccccttctcgctatctcttttgcctaataagaagggctgtgtaaagctcagggcccttgtccactagaggcaaggtgccccctgaccccttcttccagatatactcttttgtctcttgtcttttattcccgcgttcgcccctctttgttcagtcccctaggtccgtgcgggttacatagtggcaccccgaacagcaacagcatcgggtgctctacagctgggattacagcgtgagggaccacgcccggcctcatcgatatcttttaagtaccacctcctttcacctctttcccagaagcctctgctcatctccagcacaaagtaattcgatacaaatttacaaaatggtcattacccaggatcacctgtctccgaagttagatggaaacacctgtattaaagcctaaagctattcggtctggaaaagtccggctcctctccagcttccacttctttaggcgtgcaaataagattcggcagagtaagcatcaacttcctttaagctcagaccgcactttgtgctcagtactgtaattatctgccctttgtgtcccatcccttggactgtaatgtatactaaggaagagcccttatcttatttctcaatctctgtcagtacccagccaagcacacagtagactttaatattagtgaaaataaatgaaacaaaatttcttccccagctttgaacctaaatagatgagcacccttaagcaagtcacttcacctcgctggaactcagtttccccacctaggcctccgagggctcctcaaactctggcaacctctagcctaaaatgctgcggagatcttaccacaaacctggggagtctggcaggctctctgcattgattaaaagaagggaacgaagcaagagaaaaacaagtcctcaattgttttccgccgagaaggcgccgctggagacactcaccctccctaaaccagggggccatgtagctcaggatgtaggtagggtccagggtcttccggatataatcctggaaggcttgcaggctgcgtcgctgctcggtggtcatgccggcctctgcttgcagctagctacgttccccgcaggctgtgcctcactagctttaaagccgggtaggaggagggcgtggcgagcggggaaagcagggattttccgaggaaatgaggccggacgcgaggcggagctgcataggaactttaataacta

SEQ ID NO: 1645 - DNA, 51072 bp, Homo sapiens
gtcagcttgtacacagatgctttattttggatgttaatatgtcaacattgtatgcaagattctcttacaatgaagttttccatatatcacaaaactcaatttagtcagggtaattgctgtattaatgtgaaaaccttacaataaaatgcagtattatgtatgtgtagtcagtttccatgcaagtatggctgctacatgttatgtctggcatttgtataacatactgaaagaaactcagaggaacaaaacagtataaaggtgacttaagatgcctgacatgtttaagataaaaaatcttgcaaaaagcaacaaagcagttaactgaaggattcaaccagtaccaacccaaatatgtattatgtccaataagcccagacttatccacaatatattaccatttaggataatttaatgctcaagaaaaaatatgctttaaaaaatatagccttacaagatattatactttggtgattgcagactatgtatatccaggtaagggctacattaaaaacaacaacaacaaaaaaccattatgtgctattagttcaaggtaactgaaatgatccagtatgagtttgctacaatcattggtttcactaagtgaaatttctgtgagaagttcattaattagaaagcaatcaacatacttaaacatgctaagaggattcaaattggtttatctatttatcaataaggcataatcttagtaccatacattttcttcacttctcactatatatatatataaatatatatatatataaaatatgcaaaaactagcaagtagatttaaatagcttaaaacccttttaggtctactgttcaagagctaagcattaaaatacttagtatttccatttctattaacatacaaacagagcagaaaatcttaacctgctttcattttgttttataaggcatagtagtattttggtatttgcaagaatttgcctggtaatggttgattccatttagttaacttgagaacttgccatcatttgttttttatcttttcacacagtgcaagtggtggtcgctctttccttctctcgtagcagcaagccgattctgctattttctatagcagcatacttcaggagtggagagggagagagtgtgtcaattataaataattcaaactacagtgtacaattctatttacctgtcagtgtttaagttgacagcacaccattatatgactgaaaaaaaattacatataatctctaccacaaaagcaaataaaaattctttcaagaagaaataaaataagtgcaaacacctaaaacaggcaactgaagcaactgttgtaacctgtagagaaacacaaaacatttaaaaaaggacaaaatatttttataaataaaagataatgttctccacttctgaaacactgagtaaatataaacttctaagtgcagactgtttttagggaccaaggtaccatattattttttaaacaaaatgcaaaaatttcaaacacatatacaaatcaccagattaatgtatatgaccacccccgatataatttaaaaagaaaatattaaattattatttagtacatttttagaactactttataaccagcatgatttaaagggcatagtgcaacatttaggtagatgtgacatacagtatagatattgtattctttgcagctataacttactactgtttcatacttaaagtcaaaattattctttactgtgttagctgtaataacaggaaacaacattggcttctaggcaccctgtatacgtataaatatctacatttaagctttaaaaataaaaataaattataaaaacagacttctttccaatttacaaagttctcctgctcctacatactgtacaatacattcaacaaaactctcagctcctctgagattaagaaaatactatttactaataaagaaaaaactcttttttgaatgctttttgttttcagtactatgctcaaataaatacatttaacactgtagttaattttactgcttctgaaaaaaaaaacaaaaaattagtagtgcaactttctatccttcctttaaattccttttcaatgtgtttctttgtaaatggtagcctaagtaaatcagcacatgggcaaaagtacttcataaaatcatgtgtgctttccatacatagactaatttcagaaatcatatatactcatacacctatctataacaaaactgcagcatcaagagagtagcaacatatatcttgtgaagaaaatatatgagaatttacttttagaaatccatgaacattctattattttcccatcttgttctttaaaaacaatttttaaaaatctcatctcttaaaaaataaactatgaaactatctaccccttaagtgacttactagctttctgcctactatatagaatagaaaaaagatgctgtattaaaagggctatcttacaactttaaaaacaactaattgagaaaaatttcactgcaacctaatttagtagagactgcagtaagggagtggggcatttcatcaattttaataacaattacagtatgagagctcttgaagtactactggtagctgtgtaagtactcagatatcttcttgcttgttcagtcataataagttggtcttctgtcttcccataaaccactgtttcccattcacaatttgactagaaaggaaatattaatagtgacatgaaaattattaaaatagctatctatatcacaattagactcttaaagtcagttattttaactgattagatattttataaacaataattataaaaatgttttaacaatggcactgtatttttttaataataatgttttaaaatatatactgaaatattttttatcaagtttttaaaaagtcaattattttagctatctatattgcttacaggcctatggaggcagtttaaaagtcttgtccccaataattccccccaaatcaaatgagtcttaacatggaaataaatgttagtctttattgcttcaaaattttgcaaaagatttaaagagaggatgtaatgtcaaaaaatgagccaagaatgctttatttacaaattaggaaatatattcataacaaaaaatcaagcttatgtttttttccttcccttattttaaagattactatgttatagatgtgatcttctatataataactttccccaaaagttctatgttaattaaacgccaggaactcaaatcattttacatggattaagagaatgtgctacatggctcttagaaagcagtggctgaaaacagatgtaaggtggtcatatgtaattgccaaagacgttttcaaggtatgcttcaatatcaggaatactagtgctgcagtcactgtggcataaagaagaaaatttcctactcaatgaactctcaaattctctggggtaaactcttaatgcagtaaaaatttttccaaccttcatttgcagttacacactggtcgtatcccaacagaaaaaaaaaaggactttgttttacaacttctgagccaaaaagttcactggaaaccatggtaccaacaaaatcatgctgaaactgcttccaaccacttaccctttttcagaatagcaattagggctatacatatttgttacaggagaagaggtgccagaagtagatttatatatctttagtttaaaaaagatacagtgcttaggaaatcaccagaccagtctttggttacagcttcaattgtttagtttatatgtgccctgatgaatgagtcgctcaaacccaaatgtgagtgataaaataatggtaaatgtttagttactgttacaatcaattttgaatttaaaagaaaaagtataatttgtgatcagtaaatccaaagtgatcattgactaaacaaaaacaaaaatcactaaagaaatttataaatccatacctgaagattcttttccaatttgacaactttggaagtgttagggtttggtttctttttagtaagtgtatatgttttgttggttgaatttatatcttgtttttcaggaatcaagttgcacctattgtcatgtatttccaataatggtatcattaataaggatgtagtaaatctattttctgactaagagagaaaaaagaaagaggaaaataactaattcaaaaatggagacaaatggagggactactgagtaagtggtaatggaagccctgtttatttccctccaagaaagcatttggctctgatgaaatttctagtaatgtagtaatattattttggaaatgaaccaaagataaactttgatatttaaaatcttgagaactacgattttttgacatcagatataaggcagctaactcctctcataacaaaagaaatataaaaaaaagtaaataaaatattctctacagtgaatagtttctctgtgaattaggcaaaatgatactaagataaaaattctccatgaatttctaatgaactggctacacaatgagtaagaaataagaacctctaggacttaaagcaaccatttaaaataacaacaataataatcctttacaaacctgcatgtctgaaatgtcttcagtcaacagttgagtgcctgattcttctttttcccaattatctaagactagtgattttctgactttcttcccagaagcggtattctagaatgagtaatttatgtagaagctttatggcaaagtctcttggatacaataagacttttattaacaataatactagaagattacctcttgtttgcagcttttgtaagcaggttcatcttcctctttgaggaataggtctgttccagtttcttcttttaaaacttcccgaatatcttcttccaagaaagcaagtggctgggactaaattgttttttaaaatgttgtaaaaagtcatttatagcaattcctttttctccctatatataggaaacccatcttttatacttgtccattattgtcataattttctcctagcccctatagatacattaattaaattaattcatgttgtggcaaaacaatattatacatttgcaagtactgagtaaagaatagcaatttcttctttctaggctactaaacaaaaatcttccttttggggaaaccactgtagctcctgcttcaggtcaggatcttcagaattaaacagaaaagaaagatgttatttctcaagttttttttacataaaaacaggaaatatagaacatattgggaatacactagctcttattctacttttattgtacttattacatagtatgtaattactagttaacacgtttgttaccaccaagattgtgagatacttgagagcaatggtcaggtcattttcatctttgtatacctagcctaagcaaagagctgacacagtatccaagaagacagagagagtgagtgtgtgtgtgtgtgtgtgtgtgtgtagtgtgggagggtaggttacagagagatagacacttgagtgtcagctgagtgatgaaatagtctcaaaatattattcatctagctttctgtcaaataggtaagcacaacttataacccagaaaaaatttaaaaattatatctaacttatacctttcataaccaagatatacttgaaaaggtaataaaacctctactaaataaaagaactggcagcacttaataaccagcagctgctgggcatggtggctcatgcctgtaatcccactttgggaggctgaggcgggtggatcatgaagtcaagagatcatgatcatcctggccaacatggtgaaaccccatctctactaaaaacacaaaaattagccgggggtggtggtgtgcaccccgggaggctgaggcatgagaattgcttgaacccaggaggcagaagttgcagtgagccgaaatcacgccactggactccagcctgggcaacagagccagactccgtctcaaaaaaaaaaaaaaaacaacaacaacaaaacaaaaaacaaaaaaacaccagcagcttatgtccccagccagcaaagttagagagaatggtattcatatataaatgagatttcacagcacttacaaaaacttttaagatgaaaacaaatgttaaaagtattctcatctagactgagacatacaggaattatgttagtgtttccgtatacttctcaaagagcttattattattatttacttatttatttattgagatggaatcttgctctgtcacccaggctggagtgtagtagcataatctcagttcactgcaacctccacaacccccaccctctggttcaaccgattctcctgcctcagcctcccgagtagctgggatcaaccgagtagctagcacaacctgccacaacgcctggctaattttttgtatttttactagagacggggtttcaccatgttggccaagctggtctcaaactcctgacctcaggaggtgatttgcccacctcagcctcccaaagtgctgggatcacaggtgtgagccaccacccccggtctcaaagagctttttaatgatggtatttcaccaagaacataaagtattcttttttcaaattaacttttaagttcaggggtccaagtgcatgtttgttacataagtaaacatggggggttgttgtataggttatttcatcacccagccgggcgcagtggctcatgcctgtaatcccagcactttgggagaccgaggcgggcagatcacgaggtcaggagttcaagaccatcctggctaacatggtgaaaccccgtctctactaaaaatacaaaaattagccagggtggtggtgggcacctgtaatcccagctacttgggaagctgaggcaggagaatcgcttgaaactagaaggcagaggttgcagtgagccgagatcgcgccactacactctagcctgggcaacaagggtgaaactccatctcaaaaaaagaaaaaagattatttcatcacccaagtattaagcctagtacccattagttatttttcctgatcctctctcttcccaccttccactctctgaaaggccccagtgtgtgctgttcctctctatacgtccacatgttcccatcatttagctcccatttataaatgagaacatgcagtatttggttttctgtttctgtgttggtttgctgaggataatggcttccagctctatccatgtccttgcaaaggacatgacctcattcttttttatggctgcatagtattctatggtgcatacgtaccgcattttcttttttttttttttccttaattttttttgaggtggggtctcactctgtcacccaggctagagtgcagtggtataatatcagctcactgcaacctctacctcccagggtcaagcgatcctcccacttcagtctcccaagtagctagagccacaggtgcacaccaccatgcccagttcattttttgtattttcagtagagatggggtttcaccatgttgcccaggctggtcttgaattcctgagctcaaatgatctgcctgtcttgatctcccaaagtgctggaattacaggtatgagccactgcatccagcccacattttcttgatctagtctagtattcttaaaaagatctggaggtttttctccctttaagaatacaaatgtcctagaatagggctaagacagattaattcattcactagcaagaattattctcttaattgttctaatgtgtcaaaagcaaagaactcctgcatttaatacttttcaggtttgatactaccaaacttaatatttctacagtttttagccttttgagtaatttatagtaaatattaaaagaatcggtttattaaaagggcaacagatatttaagatatacctgattaaaattccaaagccaatctccaagaagtgcatttgactcatagtaagatacaaaagaaagctaagtggttagcatatagtagatgctcagtaaataactggaggaggagcaggagaaatgaaaagtcagcttactgcaaagagatgtatgagcctatagatattctaggaattttaatttataaatcattgccttccttttatcttaaattgctgatgcaaataatctattttggcaatggtcaaattctatccaaagagctgtgagtgctgctggtattaaatttaaaatgtcagaaggctagtaaacaaatggacaaggactttaggtatttgaaacctattacaaatatacttttgtttttgtctttttttttttttttcaaacagagctgcactctgtcctttaggctggagtgcagtggcttcatcaccactcactgtagcctccacttcccaggctcaaacaaacctcctaggactactacaagagcatactaccacacccagctatcaaattataatttttattccacttatatgttcaccaaatgaccctgactcactgcagaatttttaaatgctttcaaatcattgtttacttgtctaatccccaattagtctacatgaccctatgaaggcaggaaccatacttgaccttttcaacattctttccatccctaaagcctagtacagtgcctggaacctattaggcactcaatcaatatttgctgaattaatgatgaatttttaaaataaacagcaaaacactgaaacagcctaaatcaatcaggtaattccatacaatggaatattatgcaaacgttaaaaattatgggataaatatatacatttacttggttaaattaaaaaagtgttataaaataataaagtgtggtcatactcttgttttattaatgtatacgcataaataaaaactctaggaagctctaaaggaaatatgattgttcacagcagtacatggagctaaatgacaaaaagacttgatcaaccctactacgtaccctttaacacagtattttgaaaaaaagactagaagatgtgcgtgtgtaacatgcttttgggcagaaaattaattaaatcaagtaaactagaatttgttaatgaatctaaccaaaaagtgactaaaaatagaagaacataactaaaaaaccctggaagttaccaatattttaaaaatcgtatttctaaagaacttgtcagaaatctgtatctgcctaaaatgcccatcactgttccaaggtatttcaaaggtggtaagatatatgaaagcacagtaactagaacacttcccagtcctattcattcgtgaactactaccacaaatactattattagaataatagcagcaaccaagcacacagtacttgaaactcagacaagcccctttaattacatcatctctttcagcttcacaataacaatttggggtgtgttttatgatctcctttgcatagaaaaggaaactgagccttttcctaattagtttcctaaagaggtaccctgattagtttcctaaatattatcatgaaagtgcttcagtatatcaaaatattaaaattattttattctaatacatgtaaccatgactgaaactactaaaatgtatatttcagtattaagaaaagtgttccgacagggcgcagtggctcactcctgtaatcccagcactttgggaggccgaaggtgggtggatcacgaggtcaggagatcgagaccatcctggccaacatggtgaaaccccatttctactaaaaatacaaaaattagctgggcgtggtggcgcaagcctgtagtccaagctactcaggaggctgggggagaatcacctgaacccaggaggcggaggttgcagtgagccaagaatgagccactgcactccatcctggtgacagagcaagactgcgtctcaaaaaaaaaaaaaaggaaaaaggaaaagagttccactgacacctgatgttttctctagatgctataaagttaagaattcaaaacaagccaagcaagggtttatttacaagttaaagaaaaaggtgaacacaaattcaaacttgaaaattaggccaggtgtggtggctcacgcttgtaatcctagcactttgggaggccgaggtgggggggaggggggtggatcacctgaggtcaggagttcaagaccaggctggccaatgtggtgaaaccccatctctactaaaaatacaaaaattagctgggtgtggtggcgggcacctgtaataccagctactaaggaggctgaggcatgaggatcacttgaacccagggggtggaggttacagtgagctgagatcgcgccacttcactctagcctgggcgacaaagtaagactccgtctcaaaaaaaaaacaaaaaaaaaaccttgaaaatcaaaagataaagctttgtatctgtttcagtaaatatctttttttaaatgttaaaaatcaaagtgataaaaatcataatttgtgttttattaaaattaggaaaattattaaaaataaaatgaatatacataccacaattttaagaggtccatattttttctcctgagcagcaagcgcattcttaaaaggagtaggagttcttggtgtggtacccagtatagatcttctaatagtaggtgttctaaacctatccagtcatttagatatttatgttatagtcacgatctgatttcatacaagttaatgaaagcaaagcaatttaagcacacgctaaattttcttacacatatatatatgcttcatttaaacattctaagactattttaaagtatgcccacctatggtaattctgatttcaatcaatcatcttaaaatagaaaaaaagaattaatatagaaaaaagtactagaaatgtttgaaaaagtactagaaatgattgaaatcaaagtttgacactatatttcagttggttttcactgtcctaaggagaaaacataaggttatgatttaaaaaaaaaattctggccggccacagtggctcacacctataatcccagcactttgggaggctgagatgggcagatcacctgaggtcagaagtccaagaccagcctggccaacatagtgaaaccccatctctactacatacacaatattaaccaggcatggtggcacatgcctgtaatcccagctactcgggtggctgaggcaggagaatcacttgaacccgggaggcagaggttgcagtgagccgagatctcaccattgcattccagcctgggcaacgagagcaaaattccatctcaaacaaacaaaacaaaacaaaacaaaaaaaattctaagtcctgtaggaataggaattatgatacttgctatttatatgcacaaaaagctaatctactttaacactgtgctccccattttctctaacacaattatttaatacctacttaccctacattttccttttgatctttgggagttgtttccttatgaagaggagttgtaatgagagctttctgcccacaaataggggttgatgtaaatgaaggattttctatattaagttgttcattaccaggacatgtgttgaaaaactagaaagggaagagagtttaaagacgacttctagaacatcaaaatccctacacaaatattaaactgataagattttcaaattatttcttcatacctcttaaaaaaagcttatgaataatattacacttatactccatggaaattatgctccatgagggtaggaatttttgtctggtttgttcatttttgtctccccagctcttagaacagtgtttagcacatataggaattcaagaaacatttaacaaatattcaaaagttacaaaaaaaatactaaaaatttaaaaaacagtatattatcaaatagagatctatagaaaccataaacagctgctgtgttaaatgtaacagttttgtacaacagtgtgtaactgaaaaaacaagttttttagctcttattaataaatgaccttaagtggctttttctatgagagtattttaatttagaatataataataatgctttgctgataagaaatacagctgtctggcaaatttgcctatctagaacacagaacagaacctctaagcagtcaaaactggcataacagagtccattttctaaattatataatttacaattgtgaaatactaatttatttttgcagtcaaaagattagaaacagtgatatgaagccatagaaatggcttcaaagctacttataactagaatgaagtctagctctgtcacttctggctctgaatacttgaatttattttaccctaagattagtaatcaaaccctcttttacacgataaaatccaagcagtttgccatgggaaataagcatctttcagccacttctaccttagaattcacacttcaacaaaaattgctagcatgcaaaactccagaatagaaaactgctagtatgcccaagcctacttcactttctccagtgctttttaactctgagagcagggctgggagtgaacagactattcacattgtagtctacagaaatggcatcccctgaagcatgggtgcacaatttttagagatctgtgttctgccagatcctgcttatctccccagcctcaaaatatacctccaataatatcccagcattctccatgtttgtttgaccattaaactcccttcttcctccttaaactttgtagcctctgccaaacactttcagaaaacatcagcttcatctcttactaactgttgcctttgacaagtggctcaacttcagaattttattccacctaactccttttgaaagagcattaactgagatgctataagaagattgtttggaggctgggagcagtggctcacgcctgtaatcccagcactttgggaggccgaggcgggcagatcacctaaggttgggagttcaagaccagcctgaccaacatggagaaactctgtctttactaaaaatacaaaattagccgggcgtggtggcacatgcctgtaatcccagctactcgggaggctgagccaggagaatcacttgaacccgggaggcggaggttgcggtgagccgagatggtgccattgcaccccagcctgggcaacaagagcaaaactccatctcaaagaaaaaaaaaaaagcgtttggcaaacagcctggagcatagcaagtgttcaataggaaactgtcctaacataaacatctactgtccagggatattacaagaggagaaagtaagtaggtagttctagacatccttaggaaacctcttgacacattaaattcttacagtaagcaattatctaagtttcttccaaagaacattaaaaggaaaaacctcagtgggcaaactaaacaaattactctaaataggtaaggccactttaatctttatcaggtatatctatcgaacagtagtcagtcaggaaaccggatcttagtctcagccttgcattagataactttgggcaaatcaatgttacctttccgggcttgttttctgatgagttctataaagatatgggactacaagataaagaaaatgtccctctaaaaactgtagtataatatcatgtagaaccgggagcagtggctcacgcctgtaatcccaacactttgggagccaaggcaggtggattacttgagctcaggagttcaagaccagcttgggcaacatggtaaaaccccatctctacaaaaaatacaaaaattagctaggtgtggtggcacgcatctatagtccaggctacttggggggctgaggcgggaagatcacttgagcctcggtggttgaggttgcggtgagccgtgtttgtgccactgcactccaacctcggcaacaaagtgagtccctgtctccaaaatataaataaataaataaataaataaatatttgcagctactacattttgtgagatactttctattctctcagagttcagtattctcaagtatacatttaaacacattatttttatatgttatcaaagctaccaactgctagtaaggatgttaaagatctaatttaatgtaactcattgacatttagaaacataaacaaaatgaacaccactacctgtgaaggagaaaatggtagtgttttcagtggtgtatgttttagcgccatattaccaccatcgttcaatgagccatccctaagttcgctgcctggggaatgacccactcgcatttttctcttctttctgaggatggctggtggagtgctaaacttggctatatttggggatgttaaaggaacagcttcactgttgccaccattacaagtgttttttttcccttcaagtacaagactgacgttaaattggcattccatggctccttcattgtgctgaattctcattaatttaactggggtggatttgataggagaagcagcagcatcagaaatatcaaaactggtaacgtcactccatgctacaggatcctgcaataaattaaactgttaataaagttaatgctgtaacctagttaaatctgctcttgaacacaggatgatgatttccacagagttaattaacaactcattttatcagtaaaaatgctttccttggacattttttttaagcaagaccatttaagaggaacagattatggctttcctatgattccaaaatacataatagttcatctaattcagtagttgaagcttactgtcaaagtactttaagaacaaatgataagttattatcaaaaattaagttattatcaaaaagtatatttcgtcataaaacttcacattctactgcacatcaggaagacaccatcaaattctgcataatcatttggtaatgtgtatggaacgtgttaaaaatggtgatatactttgatccagaaattcaatttaacctaaagacataatcatgattttgcacaaagctttatatgttatctgtagtactgaaaaagtagacactaagcttatccaccatgatcaagcaggcttcatccctgggatgcaaggctggttcaatatacgcaaatcaataaatgtaatccagcatataaacaaaaccaaagacaaaaaccacatgattatctcaatagatgcggaaaaggcctttgacaaaattcaacaacccttcatgctaaaaactctcaataaattaggtattgatgggacgtatctcaaaataataagagctatctatgacaaacccacagccaatatcatactgaatgggcgaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccagcttacaagggacgtgaaggacctcttcaaggagaactacaaactactgctcaatgaaataaaagaggatacaaacaaatggaagaacattccatgctcatgggtaggaagaatcaatatcgtgaaaatggccatactgcccaaggtaatttatagattcagtgccatccccatcaagctaccaatgactttcttcacagaattggaaaaaactactttaaagttcatatggaaccaaaaaagagcccacatcaccaagtcaatcctaagccaaaagaacaaagctggaggcatcatgctacctgatttcaaactatactacaaggctacagtaaccaaaacagcatggtactggtaccaaaacagagatatagatcaatggaacagaacagagccctcagaaataatgccgcgttatctacaactatctgatctttgacaaacatgagaaaaacaagcaatggggaaaggattccctatttaataaatggtgctgggaaaactggctagccatatgcagaaagctgaaactggatcccttccttacaccttatacaaaaattaattcaagatggattaaagacttaaacgttagacctaaaaccataaaaacccgagaagaaaacctaggcattaccattcaggacataggcatggacaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccctatcaaaaagtgggcaaaggatatcaacagacacttctcaaaagaagacatttatgcagccaaaagacacttgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaactattgcggaagtcagtgtggcgattcctcagggatctagaatagaaataccatttgacccagccatcccattactgggtatatacccaaaggactataaatcatgctgctataaagacacatgcacacatatgtttattgaggcactattcacaatagcaaagacttggaaccaacccaaatgtccaacaatgatagactggattaagaaaatgtggcacatatataccatggaatactatgcagccataaaaaaggatgagttcatgtcctttgtagggacatggatgaaattggaaatcatcattctcagtaaactatcgcaaggacagaaaaccaaacactgcatgttctcactcataaatgggaattgaacaatgagaacatatggacacaggaaggggaacatcacactctggggactgttgtgggatggggggagtggggagggatagcattaggagatatacctaatgctaaatgacgagttaatgggtgcagcacaccagcatggcacacgtatacatatgtaactaacctgcatattgtgcacatgtaccctaaaacttaaagtataataataataaaaaaattaaaaaaaaattttttttaaaaaaatgaaaaagtagacactacctaaatgtccaataataatagttgggtaaatatattttcttatattcatttgatggaatactacaaagcccctaaaattcaaatttaggccaggcatggtggctcatgcctgtaatcccagcactttgggaggccgaggtgggaggatcacttgaggtcaggagttcaagaccagcctggccaacatgatgaaaccccatctccactaaaaatataaaaattagctgggtgtggtggcaggcacctgtaatcccagctactcagaaggctgaggcaggagaatcgcttgaacccaggaggcacaggttgcagtgaactgagattgcaccactacactccagcctgggcgacagagtgagatgccatcttaaaaaaaaaaaaatcaagtttaaaaaaggaaacagaaacatgctcatgacagggtggaaaacaaaaaaaaatccacaaatataatacagaagtgtatttttgggtttaaaaatataatgttttctgagtatagaacacagactgaaaggaatacatcaaattattaactctgggtttatgaaggactttaattttcttttttatagttttctctagtttccagctttctctaatgcacttgtataacttatataataaaaaatgaattaagtttttaatttttaaaaattcctcacaaggcacatacttgagaaaaatttaaacttttttcccctagaagccactgcaaaatatcagaacaaaattaagcatggcatacaaaacataaaactggtcaatgtccaaaactgagtttctgagcatgaaatcatataactaaaattgaacttttgataatcttacaattttttacttacagattcaataagttctagagtctctgcaaattctgggatggtctgcaaagaggataacacagcgtttgcctccacggccaggaactttgtgggtgaattctgctgagcagacacaggctgattttcatccatactgtaaaactcactagtgtgctcgtcaaggctatttagagtattagacatgttatcatccatgaggaaactaccagaccagctagaaaaacttccaggctgctaaaggtacaaaagaaatttgaatattatttgtcattctcaatgtaggcataaattcagatttcaacacatttcaattaggctaaaaacatagtagcaaatattttgtctttcctcaaaattggtatacttttttcattaaacttcatgctttgactatgtttcttttttctaattaaaatttttaatctatacaatcatgatgagataaaacaagcatttacatacaacataaagtccaaactcttagaatctggctactcccttccttccaaacttcatttctcaacacttctactcaagagctatatatttaaaccttatcatgtgtatctatttattcctggtagttatcagaaatacccaactatagcacttgcaattccccagtgaattatatactcttttgacctggagtgcctttgcacatattgctgctccctctatctattaataaaatgctctgtaacctactgaccagggaagctcttcttttttttttttttttctgagattggagttttcactcagttgcccaggctggggtacagcggtgctctctcggctcactgcaacttccacctcctgggttcaagcaattctcctgcctcagcctcccgggtagctgggattacaggtacccatcaccacacccggttaattttttgtatttttagtagagacagggtttcaccatgttggccaggctggtctcaaactcctgacctcaggtgatccgcccacctcagcctcccaaagggaagctattcttaagacacagttcaaatactggaaagtacttcatctgattatacacttttatctgcttcatttataataatgtcctaattcatttatcttgctaatatataatcattgtccttcaaggctgagttcacttaggacttctaggaacccttccctgatgacaacaatctaaatcaagcacctctcctgtatgttaccataaactttgtgacttacaaattgtcaaaattcaaagacagaattctaaaaatagcaagagagaacaggtacggtggctcacgcacatagtcccagcactttgggaagtcaaggcaggcagattgcttgagcccaggagtttgagaacagtttggccaacataacgaaaccccatctctacaaaaaatacaaaaattagctgggcatggtaccatgcgcctgtagtcccagaactcgagaggctgaggtgagggcatcacttgaacccaggaagtcaaggctgcagcaaactgtgatcacaccaccacactccagcctggctgacagagtgagacccttatcaaaagaaaattaaaaataaaaactgcaaagtaaaagtattacatcccatatatggaaatctttattagataacagcagatttatttgaaaaaatcttacaggccagaagagaatgaaatgatatatttgagaagcactgaaaaaagaaaaatgcctgccaagaatacccagcaaagctatccttcagaaatgagggagaaataaagtctttcccagactttttctttttaaatggtgggaattcatcaccactagatcagccttacaagaagtgctcaaaaaagtcctatacctgaaagcaaaaagataacagacactattatgaaaatatgtaaaagtataaaattcactagtagagcaggtacacaaaggagaaagataaaataatcaaaccactgtactacagaaaaccaccaaactgcaataataaacattaagagaggaagaaaggaacaaagaatacacaaaaacagaaaataattaacaaaatgaaaagagtaagtcttcacatatcagtaataaccctgaatgtaaacagattaagctctacacttaaaagacatagactagctgaatggattaaaaacacatgacccaactatatgctgcctacaaaaactcatgtcacctgtaaagacacatacggactgaatgtaaaaggatggaaaaagatattctatgcaaacagaaactaaaagcaagcaggaatagctatactcatatcagataaagcataatttaaactaaaaactataaaaagaagctgggcatggtagcacatgcctgcaaccacagcactttgggaggccaaggtgggctcaggagtttgaaaccagcctcggcaacatggcaaaactccatctctacaaaaaaaaaaaaaaaaaaaaaaaaaaattagctggacatggcagcacatgcctgtggtccccgctacttgggaggctgaggtgaaagcatcaccttagcctggaaggtcgaggttacagagagccaagatcacagcactgtatttcagcctggggggacggagtgaaaccctgcctcaaaaaaaaaaaaaaaaccctataaaaaaagacaaaaaaggtcaatatataatgataaagggatcaattcagcaaaagaatataattgtaaatatatatgcaccaatatcagagcacccagctacatcaagcaaatactatttgatctaaaaggagtaatagattccaataaaaaatagttggagacttcaacaccccattctcagcaatgaaagatcatctagacagaaaaatcaacaaagaaacaaacattggctttaaattgcacatttatactgaatgagcctaacagacatctacagaatatttcatccaatatctgcagaatatacattcttttcatcagcacattcttcatgacagaccacgtattaggccacaaaataagtctgaacaaatttaacagaattaaagacatatcaaatacctttttggaccacaatgaaataaaactagaaatcaataacaaaaggaacttttgaaatcgtaaacggaaattaaacaacatgctcctgaacaaccaataggtcaatgaagaaattaagaaggaaaccaaaacatttctggaaacaaatgaaaagtagaaacaaacataccaacacctatgggatacagcaaaagcagtatcaaaagggaagtttatagaaataaatacctacaccaaaaaagtagaaacatttcaaataaacaatgtagctagaaaaataagaacaaaccaaacccaaagctagcagaggaaaataaataataaaaatcaaagcagaaataaacaaaactgagacaaacaaatacaaataatcaatgaaatgagaagttgactttttaaagaaataaacgaaattgacaaactgctggccagactaaccaagaaaaaaaaaagacccaaataaataaaatcagaaacaaaaaaggagacattacaactaataccacaggaatacaaaggatcattagaggttatcatgaataactgtgtatccaattagaaaacttaccagaaatggataaacttctggatagatataacctatcaagattgaaccaagaagaaacagaaaacctgaacagaccaattacaagtagcaagactgaatgtgcaataaaacgtctcctataaaattaaagcccaggacccaatggcttcattgcagaattctaccaaacatataaagaagaactatcaattcttttccaattctctcagaaaactgaagagtaaggaatttttccaaactcattctacaaggtcaacattaccctgataccaaaaccaaataaagaaaactgtaagccaatatccctgatgaacatagatgcaaaaagacattcaccaagatcaaatggaatttatcccagggatgtaaggatgattcaacatacataaatcaataaataaaatcaaatatcaatagaataaagattatctcaatagacatgaaaaatcatttgataaaatcaacatcccttcacgataaaaactctcaacaagttaactatagaaaaaacacacaataaaggccatatatgacaaaaccacagccaacatcatactgaacaaggaaaagttgaaagctttttctctaagatctcaaatgagacaaggatgtccattttcaccacttctattcaacacagtactggaagtcctagccaaaacaattaggcaagagaaaaagaaaaggcatccaaaatggaaaaaaggaagtcaaactgtccccatttgcagacaacatgaacttatatatagaaaaccctataaccctatataaagctcctctaaaaaaactcttagaactgacaaacaaatggggtaatgttgcaggacaaaacatcaacacacaaaaaatcagtcgtgttttggctgggcatggtggctcacgcctgtaatatcagcactttgggaggacaaagcaggaggatcacttgaggtcaggagttcaagaccagcctgggcaagatagcgagacccccatctctaaaattaaaaaataaaataaaataaatcagtagtgtttctatacaccaacaacaaactagcacaaaaagaaatcaagaaagcaatgccatttacaatagctacaaaaaaataaaatacgtaggataaattaaaccaagaaggtaaaagatttctacaagaaaaactacaaaacactgataaaaaaaattgaagaggacatgaaaaaatacaaagatctcccatgttcaagaattagaagaattaatattgtgaaaatgaccatattaccaaaagtaatctacggttcagtgcaatctttatcaaaataccaacgacattctccccaaaagtagcaaaaacaatgctaaaattcatttaaaaaactacaaatagctaaagtaatcctgagcaaaaaaacaaacaaacaaacaaacaaaaacaaagctggaggcatcacactaacacgcttccaaatattctatatagagctgtagtaaccaaaacagcatggtactggaacagaatacataacccagaaataaatccacgcatttacagactctcaacaaaggcaccaagaacactgatggaagaagagagagtctcttcaataaataatgctgggaaaactggatatccatatgcagaaaaatgaaactagctccctatctctcaccatattaaaaaaacctccttttttgtgaaagaagaaaatcaattcaaaatggatgaaagacttaaatttaacacccaaaatataaaactactagaagaaaacataaaggctgggcacagtggcctcatgcctgtaatcccagcactttgggaggccgaggcaggcagatcacttgaggtcaggagttcgagaccagcctggccaacatggtgaaacctcgtctctcctaaaaataccaaaaaattagctgggcgtggtggcaggcacctgtaatcccagctactcaggaggctgaggcaggagaacctccaaaaggcggaggttgcagtgaaccgagatcgcgccactgccactgcactccagcctgggtgacaagaatgaagctttgtctcaaaaaaagaaagaaaacataggagaaatgttttaggacattgtttgggcaaaaattttatggggaagacctcaaaaacacaggcagtaaaagcaaaaatagacaaatgggattatattaaactaaaaagcttctgcacagcaaaggaggcaatcaacagaatgaagagagaaatgatgtacaggatgggagaaaatatttgcaaactattaaccaacaaaggattaatatctagactagacaaaaaaatcaacaacaaaaaatactaataataatctggtttgggttttgttttttggtgtttttttttttttttttttttgagataaggtccggctctgttgcccaggctacactgcaatggtgccatcccagctcactgcaccctccacctcccaggctcgagccatcctcccacctcagcattctgagtagctgggactacaggtgctcaccaccacgcctggctaagttttgtattttttgtaaagatggggtttcaccatgttgcccaggctggtctcgaactcatgagctcaagcaatctacccaccttagcctctcaaagtgttggaattacaagcatgagacaaggcacccagccaataatctgacttaaaataggcaaatgagctgaaccaatatttctcaaaagaaaacatacaaatggacaatgggtatattaaaaaatgctcaatatcactagtcatcagggaaatgcaaatcaaaaccacgatgagatatcatctcacccttgtcagaatgactattatcaaaaagacaaaaaataacagatgctggcaaagatgtggagaaaggggaactctactgttggaaggaatgtaaattagtacagccattatcaaaaacactatggaggctcttcaaaaaactaaaaatagactatgatatgatgcagtaatcccactactgggtatgtatccaaaggaaagaaaatcatatatgtacttccatgtttattatagcactattcacagatatggaatcaacctaattgcctatcaacagatgaataaagcaagaaaatgtgctgtgtctgtatatttatacacacacacatacatagacacataaccacataatactatttagccataaaaataacatgaaattctatcatttgtggcaacacaaatgaagttggaggacattatgttaaatgaaataagccaggcagagaaagataaacactgtaggttctcacttacatgtggaagctaaaaaagtagatctcatagaagtatagagaagaatagtggctactagaggagaagaaggggagccaaggaagggaagcggagaagggagagtagccaaaggttggttaatggatatataagtacaactagagaggaggagtaagttccagtgttctatagcactatagggtaactataattaacagcaacttgttgtatattttcaaataactataaaagcaggatttaaatgttcccaacacaaagaaatgataaatgtttgaggtgatggatatgctaattaccaagacttgaccaagacacattgcatacatgtatcaaaatagtacactgtacacccagaaaatatgtacaattattgtgtcaattaaaaataataataaaagcaaaaaaaaaacccttgtgccttattttatcatatactatcctgtttcttgtgtaggttcccactgcagagtaaaacctgaagtcagagactatgtcatttttctttatctctttagaaatgtacactaggcaatttacttatcttgcaagcctagttttctagtgttttataattaaaaaataagaaaagaggccttgaagagttatgaatgagaaacaacatgtaaagtgtgtagcatttttcatggggcccagttatcgccctctttgtgtgttggatctttttctcacccgcataccaactgaaaggtatgtggtttggagggaactccaaactttctgagatgatgaaaatgttctatatttccagctgctcaatatgggagccactagccatataagcaactgatatgtggctagtgcaactaatgaactgaattttaagttttgtttaaaattaaatgtggctagtaactgccatatggtagacagcacactggaagtctataggaagcactgaataatggtaactattactactaaaagtaaaaattttcagaatgttctagggattcactataaaatgttacatttcaacctaaataaggtaataaaacactgttgcaaagcaaattcgatgtgttttataaataaaagaaattaaagtaatcttatttcatttcattattttccatttcattagcatagccaccttctgacttgacaatcactttcaggagacagcatggttttcctctcatgctggagggaacacgtggttccctccaaaccacatacctttcagttggtatgcaggtgagaaaaagatccaacacacaaatagggcgataactgggcccagtgaaaaaaccataggttacaatcagacagacctaaatgtgaatctcttttttttttttttttttttgagacagggtctcactctgtcgtccaggctggaatgcactagcccgatctcagctcactgcaaactccacctcccaggctcaagtgatcctcccacctcaccttcccaagtagctgggactacaggagcgcaccatcacacctgattagtttttgtattttttgcagagacagggtttcgccatgttgcccaggctggtctcgaactcctggcctcaagtaatctgcctgcctcagcctcccaaagtgttgggattacaggcgttgagtcactacattcggccctaaatgtgaactctctaatgaaattctacccacttaacagagttaacatcaggattaccaagcatacatataaaacattcacaagagtagagctcaatggatactcagtaaaatggcagtcaatattgtcacataactgtttaggaaaaaaaactttagggagggcacggtggctcatgcctgtaatcccaacactttgggaggccaaggcaggtggatcacgaggtcaggaaatcaagaccatcctggccaacatgatgaaaccccgtttctactaataacacaaaaattagctgggtatggtggcacatgcctgtaatctcagctactcaggaggctgaagcaggagaatcgcttgaaccagggagttggaggttgcagtgagccgagatcacgctactgcactccagccgggcgacagtgtaagactccaacacaaaaagaaattaaaaaaatgcttcatatgggtatggagtctattctactggctgcagcaacttccctctagatttcagaatatacacttattcaaccaaatctttatgagaacagattttagatagtgagttctaaaaagaaaataactttcttcctttttaatgcaaaatattcattcctttagttatatttttcctgttaaattaaaaaagggtaagattctattaaaaatccaaaatggtttaaacatgatataatcatctacaaatgctgattctctaaccataattctttgtggcttttttttttttgagacaggttcttgctctgtcacccaggctgaagtgcagtgatatgatcatagctcaccgcagcctcaaacccctgagcttaaacaatcctctccctcctcagccttttgagtagctgggactacaggcacgtgccaccatgcctggctaatttatttatttatttttaagatggggtcttgctctgttgcccaggttggagtgcaggggtgtgataactgctgactgcagcctcgacctcccaggctcaagtgatccttctgcctcagcctcctgagtagctggagccacaggcatgtgccaccatgcctatctatttctttttaaattttttgtagagatggggtctcactatgttgccaaggctggtctcaaactcctgggcttaagtgaccctcccacctcagcctctcaaagtcctgagattacaggcatgagccaccaagcccagtctatttgtagcttcttaacaaaacaaattaactttaaggtaagtatatgtcaggtcttcctagttgctcatggtttttgcagtttcaaaacagaaactgcaacatagggaaatctcgtctctacaaaaagtatttttttttattagccaagtgtggtggcacacacctgtggtcttagctacccaggaagctgaggtgggaggactgcttaaacctaagaggctgaggctgcagtgagccatgatcgtaccactgcactccagcctaggcaacagaccaagaccctgactcaaaaaatcccaaaaaaacaaaaaacagaaattgcttttcttatggtatatatcttgcctattataatcaataaatatcatttttattaatatcctcttaagtagtataaagacatcaccagttgcctcataatactatttcaagatctcaggttatcttcttagtaattttgcctgagttcccagtcactctcaatattctgtcctctcattcagtcccaaacaaaaaataaacaaacaaacccttttctaaatgtaaaaaggggcaaggaatggtggctcatgtctgtaatcccagtactttgggaggccaaggtgggcaaatcacttgaggttaggtgttcaagactaccctggggaatatggtgaaatgccatctctactaaaacaattttaaaaattagccgggcatgttggtacatgcctgtaatcccagctactcaggaggctgaggcaggagaatcacttgaacccaggagccttctgggtagttaggaccacaggtgtgcaccaccacacttagctaatcaaaaaaaaaaaaaaaactttttgtagggccaagattgcaccactgcactcccgcttgagtgagagagtgagactctgtctcaaaaaaaaataatactaatactaataaaaataataaggctcaaggcattattttaaatttttaaaaatgttatttaaaggaagggtaggatgaagggagggacagggaaatatatgttaaagaatacaaaatcacagctagatagaaggaacaagttctagtgttctatatcactgtaggatgactacagttaacaatattaaatagtttcaaatagttagaagcagggatattcaatgttcccaagacagagaaattataactaatttgagatgatagatatgctaattaccatgatctggtcagtatacattacatgtacagaaacatcactgtgtaccccacgaatatgtacaattatttcccaatttaaaaattttaatttggttaggtgcggtggctcacgccctaatcccagcactttgggaggctgaggcaggaggatcacgaggtcaggagatcgagatcatcctggctaacacggtgaaacctagtctctactaaaaatataaaaaattagctgggagtggtggcaggcgcctgcagtcccagctactcagaggctgaggcaggagaatgacgtgaacccaggaggcggagcttgcagtgagccaagatcacgccactgcactccagcctgggcaacagagcaaaactctgtctcaaaaaaaaaaaaatttttttttaatttaaaaacctaagaaaagttatttaaatataaacttgtatctttcttttaaccaatctagcataacctgcttaattctactagaatgattacctttgatcctaacttaacactcctagttagtctcatcagccaaatcttacacaatagttttcacatgtggtaaccaacacccaacatctatataaaatttcttcttttagaagaattgtttagagagcataaaatctaaatgttcctttttccatatatttttagtgttattacttttttaaatttactgaactcatattctaaatctagtaaataggaaaaaattttcaaagagaataaaaataattttggagctcataaatccctctacatctattcaattctttattttaaaaagaattaaacccatcattacatggaatgtctaaaataaagccaaagcctaatctaaacacacataattttcacaaatatatatgtgtgtatatttatatatatatacacacatatataagattttactttacatctgctttgcatttatgactcaagaagtatcctaatacagaacattgtaaattatgctcaaagaaatgcatatcaaaatcaggcaaccttgggccaggcacagaggctcacacctataatcccagcactttgggaggccaaggcaggagaatcacttgagcccaggagtttgagaccagcctgagcaacacggtgaaaccccatctctacaaaaataaaaaaaaattgtcaggcatggtggcaggcacctgtagtcccagctacttgagaggctgaggtggggcatcatttgagcccaggaggtcaaggcttcagtgagcagtgattacaccactgcatttctgcctgggtgacagagcaagaccctgtctcaaaaagaaaaagaaaaaaacaggcaacctcaaagttgcaaattaaaaaaaaacaaaactatttttactccatattaaaatctgcagtcatactgagtatgctttctagctgataaaaatgacaaaaagcatatatgaaagattctaacaatacaaataacaagcttatttcttactgatggaattcgctttcttctaacttcattctcagctgacataagaagcatctcaagttcctttattttcttttccttatcaggatcttcatcaatgaagggttgctaaaataagttaaataaaagagaaaacaggatgcttatataattgctttattattagtattctcatttttattttcttctatgcaacatgaaatatactttttctaataaagcttaatgctactaaatactaactactcattatcacaatccctctggtatctaaagaggtgctggcaaatattttcaacttaaaagatttgggaaaattttaatgacttaaaaaatgttgcatcatctctatcagctgaaatgtatgtctgaaatattttatatttttaaatcttaataaatatattctatacaatttagcaaaaatatgtccattcccaacttgaatgctttaccttgaaagaatgaaatgactaccatactggtatcatcaatcacatttgtacagtttatatttcttcaaactcacttacacactttcttctttatagttagagtactccaagtaggacagatcgtattatttttatactagtttaatagatgaggaaatagatactattaggcttttaaaaatgtgactgaacacatttcctttggttttcgttataaataaaagttacctgaataaaggcagaagtaggctgaacatgttctatacaattgccttcaggtgacacatactgatacccagggatctaaaaagtaattaatgcattattatcatacatataatgctataaatgttgaaaatctgaagcaaatgacaaaaacttttgacacagtatcaatataaaaaacttagaaagtacctgtattaattttgaaatgttatacctataatactttcttatctattaaataactacagctccactcctagaatctatgattaaaagtcgtaacacttagaaaagactttttttcagatgaaatatgagaattacttagcctagatttatcagccagtttattaaatctgacattcaccaaatatatttaaacatctactattagaagggttgctctatctcctaaagaaaacaaagtaattgtgttcctatgtgtccatatgaatgaagcactcacaaggacagagacctgaagcaagtttttcaatgttcatatctcctacttttatcaccaccccatgccaaagtcttcttctattacttgtcttagaaaaacaatcagaatcactcacatacttttaatagatatactgatgataggctaagtatcattctgcttcttttctaaaacatctgtaataagaattttcaagatacatataaatttagtaagcagtagtggaaagaaatatgagaggaggtgtttttaaaagccttaaaatcggggccgggtacagtggcccacccctgtaattccagcactttgggaggctgagggggtatggtcgcttgagcccaggagtccaagaccagcctgggcaacatggcaagaccctgtttttacaaaaaataaaaaaattagccaggtgtagtggagcacgcctgtagtcccagctactcaggaggccgaagcaggaggatcacatgagcccagaaggttgaggctgcagcgagctgtgtgcgcaccactgcattccagcctggtaacagaaagagattctgtctcaaaaagaaaaaaaaaaagccttaaaatcaaaaaccataaatatgaaattgtctgctttccgtaatggtctacctaaatcactatataatgcagaatcattatgtataacttctaacatagagcttaacttttagaatactcgattagtaccacttattgctcaacttggtaactctaatgaattagaaacgtatctttcccaaacttttcatgaaaatctgtgacagtattttaaacccatctattcttttatcaagtcacacatataataaaattattttattagtttaaattaattgaataatgaatatatctaaattaaaagggaaacaattcttacagtataagaaatatcctcatctttccaacatatttagattaagactgttaaatactctgttggccccatgtattatctttctacgagttaaaaaaataaatttaaatgataaactttctaagacagaagcagaatgtttcagtttatgctgctgaaatctagactctaaagaaaaatgtgaagaaacataataaaaaccttaaggtattgagtatcagcagataattatactgtcttcacatgttttcctattgttaatgaaaatgtcattactctaagtggttcttttaaaatgatgcttaaaaaacttaacaatgtccacaaaatgtcaaaaatcaaatctgaggcatagtaagcacagatttttaatatcttgcccaattttatcttttggtagaaaactactaagtcctgacttaatctttacaatttatgtgacaagaaccaagaattgctcattgtgaaaaatggcataacaggtagacagggaaatgtaaaacaaatctcatgaagactcctacactaatttcttccaagtagaaaaatgcactgtaagggacaacatagagcttgccccattttgagctcgtgtaatacctactttaatgaatcatctaaacaaagactaaaattacccaagtgattagttattagggggaaaagcaaagttgaatgccagcaaaatccaattaattaccacacccccaaaacaattacttatttttgctactttctcttttaagccattttatatatacctacctcttagagataagcaatactataattacgccaaaattgtttaaatggaaagtacaatagaatgttaaagcacagatgaccattagctttgaatcataaatgaagattcaaagaatcagagtattaggaaatgtacatagtttcttgatgtaaaaattacatataaaaggaaacattttaataaatttgttctcaaaatatttataaatcaaagttacacatttttttcagtttgtctatttaccccttaatacgcattgtatttgtcctattaagaaaccaaacatcttcccatatagcaacttaagaaaattttttaaataataaaggtattaaaagtatgtgcctgaacaggtatgtaaaactgattctgggtttgcatatgatccatagctgcacaaggtttgtgttgaagtttagatgaagatcgttctgattttattccatcttgtaaatagccctcctgttccacttttcttcgcatagtagaattccaatgatttttgatagaattatcagtcctaagaaaggaaaggtatgatttaaaaagaaaaaaggattccacagatttcaacactgtgttaacttgtacaaagtgcttaaaacaaatttttacactgatgaaattagatacttttttcttaatttttcttttggagtttctactcaggaagataggtattttttaaaaattcaaaagataaactgtatgtgcatatgtcaggcatagttctaagcaccagaaatattgcagtgagtaaggcaaagtaggtcactgctctcgtggagcttacactctccttggaagtgtgggagtgggaaggaaggaagaatagaaaaacaaataaatgaataaaaaattcactacaatgcaaataaagtaggataagaaaagtgggtaacggagtaattttggtttggttagaacaaaccagctatacgagaacagaaagaaaaaaagagcattccagataaagagtatagcaagggccaaggtcttaagccaggaacaaacatgatcatgaaaagcaaatcacaaactaaagaatcccagtattctttttcacttcttagaacaaaatatttatggtaagaaagagttaattggctcccttcttatctaaggttccctttataaaaatgaaaatcttcaacctatggttacttgcaaatttcatccctcataaaatatacacacataaagcaggttttcagtaaatgttaaggcactaagctaggttctatgaaaagtaagaagacgtataagagattaaaagcatctagacctggtttaataacttgaataaaaaatttaacactatgccttaatatcttatctataaaacaaagatagcaatgtttgctcagtatactttccaagtctataaaaattaagaatacatgaaaaagcacttaatgctataaagtactatacagatagagattacagcaacaaaagacaaatgcgtatcttctaagttatgaattttcacaaggttgttggtctgctgtactaaacgctattagaaaacatatgaaccagtacaatgtagagtgtacttagcacatcactgcctctgaggaaaatttggtattttagccacatgaatatatatactacttccatggtttggatcataccataattaattaagattgaattttccccaacacactttcatagcagtttactgtagctagcatatcattccctggtcttacacatagaacgcaatatgaaagaaatcttagatttagattcttttccaacagagtttatacaaagggggtctcacttgattgacactgatatgtcaacatgattttaggagtgtattaaatgtttatataatctaaaatctatcattttattgtacaaattattgccataaaataattcattaaaaaagtaatcataccctttaccacagaatttagtacaaatggtcccaaaggttgcttatgttatatagtctacattttaattacaaatttaaaaaataagtcatcggggacttgcaaatgtatttaacagtaaggtaataaaggtcatgtttaagtacagaaaaatatatatacatttatataagcaccttcctggaagtagtttggcaatttctgcccaacgatttcccaaccgcttatgtgcttcatagatgatcctgtcctcctcttctgtccaggaagatttctttacctcaggattcagatgattatgccatctttctctacactgcttgcctattcttccttttaaatgttttgcaattaaagaccatctttttggcccatatttctgaactaattcaataacctaggaaacagaaaaacaaagtttaaaaaagcattaccttcaaagaattttaaaacataattcaagaataccattttaaataaatgcattaaatccaagccacaactacaatttgttaaaaaaaaattaccaataaatacccctttagcatttgccagcttcaaaaattgatgccaaactcatctaaaaatccaaggggctaattaaagactcttgaaattcaattgctttcacaccctattaatttgaaataactgtaaacatgctgaaacttgtacattttctactcctacatctaaaaaaaaaaaaaaaaaaaaaaaaaacgcttcagccaaaagcaaaaaacaaaaatacaattaggaagcagaaagattctaccaagttattggttgtcatttcttcctttctcaaactgaaaggacacagattacatattcttttttccacattttacagttgtttttatttcacctaaaattgcaagaatagttattccagcccactttacctcactgccctatgtcaaatatcatctcataaacattttatattggtagactaagtttaatatatgttgatattttcactatatgtgtctatttactatctttaaaactaaaatttcaggctttggtaaatgcatttttaaacaagatcacacattttaaaacttaggagtagccatcaagtaaatcagtgcagtctaggtgaagtaactttaaagtttgttctggctgggcatgatggctcagcctctaatcccagcattttgagtggccaagatgggcagattgcttgagcccaggagttcaagaccagcctgggcaacatagcgagattccatctctacttatttaaaaaatttaaaaaataagaacaacaaataaagtttgttttgagcaggagtaaggatgctctaattcctcaactgcattagcaacctttatgacttaaagggcattaactaaagagtgcagaaacacttctattcatctccaacttcatagtacaaacaatgaccttggtttttaaatcacaaaacctttggaaacatgatgctctgacatctgtctaatcctgggactcattataggttaagagaaaaagttaagaatgacttccgtgcatatcaagttattagatgtaaaaataaaatgaaaatctgttttaaaatgttaattagatttttgacaaaaaactataccctaatagttgtgaaactgagctcaaaacaaggtaactaaccttacagcaagtatttttccttctgcaaaccaaactctcagaaagaaagggctgtatgttatacttggtttgactcaattttctaaaaacccaacaacatttccagacacttaacattcaattcttatgcaagtagcctccggagaacaaaatcaaagtgacttaaacatgtacttcatatgtcaaaacaacacattaaaaagaaaaaagctagtctacctacatagtgaatataaagaatatgaacacattaccctctgatcttcttctttagtccaaggaccctttatcaattcaggatttaaaactttctgccatcgatgctggcactgaaaatcagagcgattctgaaaaaatttagaagattttgttattaaacaactgtcttccagaaagcaagtcagcccgaatttatgtctcacatccttagaacaaagacttcaagaatagtgtattcaatagcattctttaaacatgtaacatttatgttacatatctctgccccaattatgttttttcttaattatagtagtcaacagggcttagactacaaataaaaacaatttatttaaaactaaagtgtgtatctttacactacaccttataatacagaagcagcaaagataaaacacagataactgaaataaagaaatggatttaacactgaggaataaaaagcagtggacagaaaactacacaaagctgacataagaactcaaatagtgccaggcgcagtggctcatgcctgtaatcccaacactttcggaggccgaggtgggtggatcacctgaggtctggagttcgagaccagcctgaccaacatggagaaaccccgtctctactaaaaatacaaaattagccggatgtggtggtgcatgcctgtaatcccagctactcataaggctgaggcagaagaattgcttgaacccaggaggtggaggttgcggtgagccgagattgcaccattgcattccaacctaggcaacaagagcgaaactctcatctcaaaaaaaaaaaagaaaaagaactcaaatagcctatcagtctggattcacgtagttcagcagtacctaactatacagttttaaagaaatgtaaaggcattgctatactactgcataggatcaaaaggatgttataaattatgattccaagttattaagaaaacattacatagtctacatagaagatgaatgttacatttcaattaaattggttaagtgttgacacttaaaaagaaaatgaattcactaaattggttaagtgttgacacttaaaaagaaaatgaattcaccagaataagaaatcctacgcagtatctgggtagaaacatctcaaactccaaaaataataaatgaagccttattttagtcagtccagaacctggtaactcctatacattacaaggataatgacacctaacactttattagtgattcacagtttacaaaattgttagttcataagcaagattacagaaaatctagagacatataaagggacagataaaaatgttttgtctaccaatggctcttttgcccaatgtacttaaaattatttttattcaaactcagcttcatttatggcttctgtacaccaacgctaatccattttaaggctgacactttcttcaaaataatcaggttgctcctgtatgtccttgtagcatttctgttaatgctaatgtaaataacttttctaacctagcttccatttattgaacacctgctaaatattaagaattgtgccaaacatcctatatgttatttctagttctacacaaccatactacagaaacaagtatgattatctagacattatagataaggaaggtgacaatcaaagaggctaagtaatttttccacgctcatggagctgacatttgaacataattcaaactgactccaaaatttatgctctttccattacttgatctcaatttttgggttatgttgaaagtcatatgacaatatagaaaaaacatagttaacatggtttctgaaacccaaagtagtcaatatttaaattcaaatatgtatattttccctcactactcacagtgtattaaggatacaaataagagcatatgtgaggaccaggcgcggtaactcacgcctgtaatcccagcactctgggaggccgaggcagttagatcacctgaggtcgggagtttgagaccagcctgaccaacatggagaaaccccgtctctactaaaaaaaaaatacaaaaagttagacggatgtggtggttcatgcctgtaatcccagctactcgggaggctgaggcaggagaatcgcttgaatctgggaggcggaggttgcagtgagccgagatcgtgccattgccctccagactgggcaacaagagcgaaactccgtctcaaaaaaaaaaaaaaaaaaaaaaaaaaagagtacatgtgaaaatacttcataaattataaagttatataacgaacagcaggtgaatagtagtatggtaaacaataggcataatagtttttaaaatcaacattttaaaaggtaagcctcagatgataagctttttttaatagggcttttctggattttttggttagctatcaaatatctcaatatatttctcacagaatgttttaacgtgtattagcaaatatttataaggtcccacatacatttattatcatttttgttttaagttaataatctttttaggcccctggataaacgcattactagaaaaccagactctaaaccagactctccaagccattagcaaccaactagaggcagaccaaaccaacagggatgtttttaggaaggaaacctaaaattaaaatatgtagacacatttttgaaaaatagcaaatttaacccaatgccttaaaccagccatgttagaaatataatttaatatttcacttacttgaagatgactagcaattagagtccaatcatcagttccatgttgttcaaccaacttctttaatttatcatcctattaaaacagtacaaaaattagaaagctttccccccgtccttttcctctacccctaaatatagataactctccaattctattaaggaatatctggtaaccatagaataactaaagccacccactataatacaaattcttccatttattatactgtttctctaagttccaatgtcatcagttattcatgtctctggttgaagaaaaagaacgtacagttaatttgatgcatatcttttctcatattttgtttttaaatatctttcataactatagcagcattttttttttgtttttgagatggagtctcgctctgtcacccaggctggagtgcagtggtgcaatctcggctcactgcaaccctctgcctcccaggttcaagtgatcctcctgcctcagcctcccaagtaggattaggattacagacatgcgccaccataccaggctaatttttgtattttagtagagacggggtttcatcatgttggccaggctggtcttgaactcctaacctcaagtgatccgcccatctcggcctcccaaagggctgggattacaggcgtgagccaccacacctggccgtataactatagcagtattaaccaataaatacatgtaagaaactatgaaaccttgtcagataattacctcgtcccttgtccattttactctgttccagagtttcttcagtcctttttgttgtggtacttcataatcatgatcggcatactgaaggtcatcatcctcatcctcactacaaaaaaaacacaatttgtgatatcaagaattttatttaaatttgtaaattcaaacactgaacttgtgtgtgcaggtatgactgaagaaatcatacagactacaagtcatattcacaatgaaattattcaaagtacaaaaaattaagagtcagacagcggggtggggtggagctatatatatatatatatatatatatatatatatattttttttttttttttttttttttttttctgagacggagtctcgctctgtcgcccaggctggagtgcagtggcatgatctcggctcactgcaagctccgcctcccaggttcacgccattctcctgcctcagcctctcgagtagctgggactacgggcgcccaccactacgcccagctaattttttgtatttttagtagaggcagggtttcaccgtgttaaccaggatggtctcgatctcctgaccttgtgatctgcccgactcggcctcccaatgtgctgggattacaggcgtgagccactgcacctggcctggaactatacttcttactgacaccaaacacatgaggttggatatgccactacgggaaaaatcataaccttgtacgtcatgttaaggaatttgacctttattctttatttgacctttattctaaagagttaaataattttaacacagcaaaagacaaaagacagatatcttgtgttttagaaaaatcagtgacaagagtgtggtgaaactgaaaaagaaaaaccaattagtaatcttcacaacaacccaagcaagaaattattggggcctgacaaatggtaatggtaaaatataaaccgcagccaattaaaagacacaatagaagtgatccaattaacaataccaacaataaaaaaaatttaacatacaagataaaggtacagtaagtgacaagacactgttgtgagacacagatgtcttgaacaaatggaagaacattctgacttttttttttttttccagacagggtctcagcttgctctgtcacccaggctggagtgcagtggcacaatcacagctcactgtagcctcaaactcccaggctcaggcaatcctcccacctcagtctcccgagtagctgggactacaggcatgcaccatcatgcccagctaattttttctattttttgtagagatggggttttgctatgttgctccacccgcaatgctggtcttgaactcctgagctcaagtgatcctcctgcctcagcctcccaaatcccacgcttgagattacaggcatgcatcaccatgcccagcctcctgaccatattattggataagaaaacaatattatagatatgtccattctctaatttagggagatgtccattctccctaattcataaattaaattaaatgaataaaaataccaatagactttgggaggcaactagacaagctgaatctacaattcatatgaaaaaaaaaaatcaagaagaatggcaagaaaagttttaaaaaagaataatcagagaattaccactacccaatatcaaaatacactgtagagaaataaaacagaatggtactaccacacgaacacacacatagataaatggaacagaacatttagaaaagaaaaaagacccacatggaatttggtaaattataacagtaacatttcaaatcagtggagtaaaggtagacttttcaataaatggtgttaagacactgggtagccattttttaaaattaagatgggctgggcgtggacacctgtaatcccagcactttgggaggctgagtcgagcagatcatttgaggtcaggagttcgagaccagcctgaccaacatggcaaaaccctgtctctactaaaattgcaaaaattatctgggtgtggtggtatgtgcctgtaatcccagctacttgggaggctgaagcaggagaatcgcttgtacccagtgagccaagactgcaccactgcactccagcctgggcaaccaagagaacctccatttcaaaattaaaaaaaaaaaaagatggtgtcctactttacaataaaataaactggagtgaagcaattatttacattttttacatgaaaccataatagtactataagaaaacagaaaagaagtctacttttcatatccttgagtaaaagacaggtaaatgtgacaaaaatctggaagtgataaaatagatcaaccaaggtaatgatattaggaattgaaagaaatatattaaactgagagatatttaaaaagtagaaaagaaaggattttgcaactgatagatgagggacatggaagaaggaggaattaaggatgactccaaagtttctggctttgaaaacataagtagagctatttactatggaaaatgatagaaggagaaacagaactttgggagagagaagaaaatggggagagtatgtatagtttgggactagctgttttcaaggtacttgaaaaatacacaggtggatgtctggaacagcacttcccaacagagacataatacaagccacatatgtaattttctagtagccacattttttaaaaaaagagaaataagtgaaatgtacttcaatagtcaatattccttagcttaatatatcaaaaatataatcatttcaacatgtaatcaacataaaaaagtataaatgaaatgttttacatatttttttcttactaaagtcttcaaaatctggtgtgtgttttgtagttagagttcattacaattcagactagccacagttcaagagctcaatagccacatgtggctaatggctatcctacagggcagagcaaatctagaaggcaaatgagcatgtggacctgctcaaatacaaggtctagggtagagatgcagttttggccagcatacaaagaatagctgagggcacaggatgacccaaggaaaattaataaagtgaggaaggggccaaagtcagaacctgagttttgatggagtaaaaaaagaaaaagcaattttaaagaataaagccccataaaaaagggcaagccttaatgataaactgaaatacaaggccaggcgcagtggctcccacctgtaatcccagcactttgggaggctgaggcaggcggatcacctgaagtcaggagttcaagaccagcctggccaacatggtgaaacccctactaaaaatacaaaaattagcggagcatgatggtgggtgcctgtaatgccagctactcgggaggctgaggcaggagaatcacttgaacccgggaggtagaggttacagtgagccgagattgcaccattgcactccagcccaggtgacagagcaagactccgtctcaataaataaataagtaaactgaattagaggattctgagtaggcagtggactgaataaagtcatggcatctgaaaataacacagtctaccatttatttaaaactttctaagtagtctattaaatttttctcttaaagcctcacaactggaagaggggaatattatcattattcccatttcacggaataggaaactttgactcagaaatgtaacctcttgcccacagtcactacttaaccgctatactacgacatactggaaaaatagggggaaagtgctaggaagctggaagatactaaagacaaacctcaagttcattttggaatcagaacaaggttctggttctaacttaattactcactctgtaaccttgaacatgttaacctctcaggggtttagtttacttgtttgtaaaatgataataataccacctaccttatagtgctgctttaaggataaaattaaatgagaaaacatatataacacctcatacagcacatggcacagaaaggtgcctcaatattagtattacgtgcataggctgatcacctaatagtattcaaaattatttttgccttactagattcaactctttctcaaaaattcattctgatttcacagagcaaaatttgaagatttgtttaaccttactctaatatagttaagcgcatgcaagtagtttctaatatctatgtaagttatgtaattttaatcttacaaaattgaaaaatgaaggcccagatttaatatatactgtctatagatcctttgtaggaacgtctaacttccattgacttgtcaattccattggaacaaaattcttcatatttgaccaggcaaaacaccaagattctcccattcccctatgatctgcttctacagttcaacacacttcaatagtccagtgttcgctctccctgaagccattgtctatttgtaacaataatccaccagttctccttccatacatggctgttttttttttttcttttttgagatggagtcttgctctgttgcccaggctggagtgcagtggcgcaatctcggctcactgcaacctccacctccctggttcaagcaattctccttcctcagcctcccaggtagaaggaattacaggcgtctgccatcatgcctggctaatttttgaatttttttcgtagagacggggtttcagcatgttagccaggctggtctcgaactcctgacctcaggtgatccgccaaccttggcctcccaaaatgctgggattacaggtttgagcaaccacgcctggcccatatatggttgttttattaaactgtgttaaaacaacaaaaaaaaaaaaaaaaaaaaactctacaggcttgattaaatatctgatacatgcagccattttcagctatcagaaatatcacctgataggccaatattaaattgttaagttcgacatgcttcagggtccaatgacttcataaatttctaagaaagctaccgaatcagataaaacaccacactgcagctttctgtcctatttgtatgtactaagagcacctacctttcttctttttaatgtttatcacatttgccaacctccacatccaaaaagtaagctcatgagtgcagaccatgtctaccacgttcacctctcaggactaactaagcacagtacctgccactcaaatatttgtaaaactaatgaacaatcttccctaatcttccagcttcaccaagagctctatattccaaaattatctcactcctttccaacccaaccaaaacttccaccttcttcaatacatgtgatctcaaagtggatctgagaaagaaaactttttaacaaatgaaaatacctctaggaagaggtaaaagcattcttatttgttaaagaagactttcaaaacccaaaaaaaaaaaaaaacacctccaagtggtagaattttaagaagcagaacctgctgaaacaaacattttaaatattcaatacagaaaaggttatttgaaggtatctactgtactgtttaacctttcttagaaatgccaccagcaacattaccacttcctgacaccccaaatagccctcaggcatgcttttcacagggtctctttcttttcctccctctcttcagatcctcaaagtttccataacagtatatttgagactgctttaaaatacaggttatttctaagtcaaaataatttttaccttgggaatttgcccatataaatcttgagtattcacaaatctacatcacatttaatcatacgaaacccactttaaggttcttacaaaatattttaaggatatgagtacaaaaacattattttggtcaaaaagctgagttttcaaagagtaattttcctaaaaactagttcattttaactgtaaaattttgccccttactttttacccacatactttattgtgagaaatttctatttctacatgaggtttcattctctattttgcatttcagcatggtcatcagtttcagacactgagttatatagcccattcaatgttcagtaagctgggctttttgaatgggtaagtgtgaagaagcaagtagaattcttagaattatctaccactctgactttcctagagtctacctacttcttagttatagcatcaagttatctctacatatatatgagtattgaaaagacaatgttaactttccaatacatgagaccaaaaaaaagatcctagatatctatcaacatcactagctacaaagaaagatgcctgagaatgtgtataatttgcaaagaaaacagggaaaggataaaaccccacaaatcactgcaccaatatcccactttcaccatttaacagtgaaaaagtcccatcactgaaaaatggttagatatcatcaaaatggatctgctctatttgtctacttttacataatcttttgacatttctgtattataacaatcaatgctggtaatatgtaataatttaataaaattggcttcctactatgtagttaaataaaccattcctagcctagtgtaattatctagaagacagcaaaataaagtgacattatttctctagtcacaaagcaataatagattaatttggtctttggctctccagcccaggactcggtttccagaatgattctgccagtttacctaagtcaaagaaaatatttatgtgataaatgtctaatacataaccaaactactatattcaaatggaaacagtttcatagactgtgaattaaagtgattagggtgattataaaacagtcaaaggaagcacacaaaaaaattgtagaactcattaggccaggaaaatagtttaagagtaactttacattggtgtacaagctaacaggacatgatagtcatgactttgtccgtgaaataacacgcacttgatgaaataattcacatgtgatgttaagataaaacatttagaagttcaattttagaggataacaattatatcacttaaaccagtaaatgaggtattccaaggaggaaactgaaatttttttaaattttttattctaaaagaaagagaaataccggttctataaatttgctctagtaaaatcgcatcaagttgataatatttttaatcacaaattaactcaagtccgaaatctttatcacagacaaaaaaaaaatctttattatacaatcttgaggacaagtccaatcatattcaaggtatgaaaatttaccaggttgatttaataaagtgaaattaggccacccagtggttaatatatgtactgcatacatgaatattttatttccaaatctggactgtgcaaactagcagtattatagtaagacaaactttacaaaacctttgatcattattaacagcaatattgaggagagttctacctagtaattccataaacaaaaacattgtgagaaaatttctatttcattagtatgtatatacttttaaataagattacaaaatgtcttcaaatatatacattaaagctagaaactaccttacagaccataaaatccaaactctatatattaaccagatgaaaaactgaggcagagtttacctgcttccccaaacaatattgccagttaatgacaaaaccgattaaaagatcagttctcatatttcagtataatttcactcccacccattttgctggaaacaacacagtaaaattggttcctatacacacacatatacataacactgcaaaaaacatcttctatttcaagagctggcttttatcttttcaggttagtgtagtcataggtcatctcaagtgtaaataatctgttactagtaaacaggtttctaaatgacattttttaaagcttactttaaagggtaaaactgactttcgaatctaaaattaattacgtatatataaatatgcttaaaagttaaatatatgttagtaacagatatattaattttagtattgcctgtaaattgtcatcgcaattcccagtgggatgtaaaattatttaaagtcacaatacaaatgagtcttcctttatgtaaatctagaggacagatactacggctatcttaaagatcaaaacagctaacatcctgcagttgttcacacttgaggtaacacttagttttctactcttaggtttttttgggtttttttttttcagttcacataggaaacatatattacaggatttacgcctatgctcttaggcaaaacttttatacagcaaagtatagttttcacttgaacgcttaagtggttgtatactggagatctcaaattacaacttgaagtaactgaattatttcttttccctttcaactataaattgagttcaaatatattaagatacttaggtaaaaggcaagagagatttttcccaatgacattatttttgcttcaaaacaattcacactctatcctcttttgttttttgttgaagcacaaaagcagagcatctactatcttctaagatatgtaaatcatatttacgtgggcaagaaatgtaattcagagtatgaaacacatttaagtatgaagacttaagagatacatcattcagagatgataatttctccccacatcctctatctgtatactcccagggagagtatagcttcaccccaccacatttaattactccagatttacgaccctttaaatcattctatcatgtttaaattaacttacacaactgtcaagggataaatgtcaaaagtacaatatttagatttcaagctcacagtattctcaataaaacaacttatatatgcaaactaacattaagttgtttctcctttctttgtccattattatgaaacatacacttcacacatatgaaatggacagaaaacccatggggaggggaaggttctgacatttaaacattcgtgtctagccataattttaatttaactaaatgctgatgacagaattagccaagaaactgtttcaaataagattaacatcaatactgataagtagataatatcacacattaataaacttgttattgagttaacatattcaattgtcatcttatttttaaatttttttatatttaaaaattcaaaaagcctaaaccagtacttcggcaatcataattacaagagctttaaatatctatcttttctgaagattgatgttaattgggtccttgaagttctagaagggtggttctttcctgggtgattttgtcccccaaaagatatttggcaatgtctggagacatttttactgtcatgactgagggaagtggagtgttactatctctactgggtagaagccagcgatgctgctaaacatctccccattacaaagaattatctggtccaagatgtcaatagtgcaaaggctgaaaacagttttagaggggtctgtgtacacatttatttcatctcaagagtttgtcctataacttacttcaaaactaataagcttacagagacttaaggatttctgcagaagcatcctgcacacagcagatgcttaacagaaaactaaggaaaaaacaattatgtatagttactgccaatttttagcagaactctgcaatgaatgacccccattactaaatttcaacttaggaaatacatctctagttaagattttggggctgtggatctagataaataaatatttggaaatcctgccaaacatcttttcaggtttatttgataatgctgaaaatcggaagacatcctatatttttgttatctaagcaattactccacataatttatgagtagctgctgtaatggcatgtaaacgaaaattagatgcataaattcatcctagcacattttccaggcaaaggtggaaaaaagtgccttacctctgtggaacacttaggtacggtcagagccaaacacagacactcaaaatattaagtgaatcaaacacattgttttatttcaagatcaagctactagttgttactactagttgttactatgtgacatggtcccaagagaggatattaaaatatacatatatacataaagctgagcatatgggtataggaattacagaaaacatcaaaaaagtcctctcagctattccccagaggattttccacaacgtttcaagatagccaagttggcagaggggtggccgcccaggttcaccgcggagttcctattttgactgtaccgtcattcagaaaagagtcgcccgaacaccattttcaagtcctcccggcaggacacagtcagttttctctgcgtagcggactccctaaaagcgctcgacttacctggcaagaaacctgcctcgaagaagtggcagcatgaggtcagaaatctggacgcgcattacggggagagtcaccgagaaacctgggcatctcttacgtcccgcgcctcaaacaccctggtccccaactctccacacgtcgcagctgccctccggtcatcgaggccaagcggccgcggggacgcgggaagaaaaacctctgccctcgccagggagggccttatggcgggagggggcagcgggataggaaagagaatctgagccgagacggcgccgacaggcctgggcgaaaggggtgccacccacctgcgcgacctcttcgccatccttcaagtaccgcataggagcaggctgggcggggacgcgggtcagcctcctccagcctccggcgaatgctccttctccccgatcctctagccgcttccctcgctccctctggaggcggccgagtgcggaacgcacgtcctcgacagggcaggacggagggacagcgggggcggaccgcgacccgaccccgaccccggcccgcagcgccgctcttagccccggcccggcccggccagggatacccccaacatgtcaggaggcgcgatcccgccctccgccggcttctcccgccgcttgtcagcctccctgccctggccccagcccggctccgccacaggcgcccgacccctgccctctcccccgcagctagcagttctgcagggctcgcagtctcctgcagggtttt

SEQ ID NO: 1646 - DNA, 51072 bp, Homo sapiens; identical to SEQ ID NO: 1645

SEQ ID NO: 1647 - DNA, 66589 bp, Homo sapiens
aaacacttgtagagcctgtttattgcataactagcaggcacaaattccaaaacgattttacaacacttaaagggcacaataattacaggaatagaatgtacaataaaaagtacagaataatgagtgacagggatcaaacacgttggaataaaaggcatctcagttttcctatgcagcattttcttttctaggaacacgttaccttcaaccaggacaaggaaagaaagaaaactatactattggaaagctcatgggtgccattgaggacaaaaacaggcgagttttgctcttggttctgcaactgaatcacttgagaagccgtgcacagctcccgagttgtgcgtttagaattctgattacatgaaatgctgtgtttgatctttgggcccaattcactgttctttggcaaataagaactatttgcattccaaggcagatgacgatttctgtgaaaggagcttagaggtacagctgtttccttctgttcagtcaagtgccagtttcataaagtgcacctctgccctatcagctttgggggaagggtggcatatggggaggaagggatcattgagaatacagggtgaaaaagaacgacgttactgaaggtagacattgctagtgcaaggtacggaatccatgtgcaaaaggtggctggaacaaatgttcagataaggtgcgatttgccaacaggagcagagaactctgacaccagatctcagatgaggccaaggaaatgcgcggggcacatacagagaggacgacctgcagccctccaatggccacgtcattccaccggggaacttgtttggagttttggcaccgtgggctaaccgagcactcttctgacatattcttacaactggaaatgctttgttggtccccatgttccttgactttctctagggccataaaggcaacatcttctattgcaggtcctcaaacattccaaggaaaacactgcttcacctcctgcagacagctcatttcccagaagcctctacagaagcccgtcctccctgggacagcaggggcaggggtttgcaagataaaggagggtcagctaaggacatgaagcctgcagaaaaggctatcagatggcgcctgaacttaaggtgggaggcccccttctagaaggcatcccgggagcatccaacagcaatgtggcacttagggctgtgggacaaacaagtggaagagtcttttggagacgtggacccttttcccatgctactcacagtgaagcaaaatgcgacaaaagcatccacacacggtgacttagtaaagcaagcaccgtcggggtgctactttcatgacagcatatggtcaagctataaaggtgtgcatcgatcagtcctgtgaaaatagaagcttagttattagcatgtattgaggcaacttgtactttgattcttgtgtcttcttcacatgtgtgaatgactgctatgggacagaacatatggttaaaaacaggagcgacagcaacataacacacagggttggccggctccattacgggtaagactcagaggctgctccaggtgtgtccggggaagccaggccctcacactgcacagcttacagggccctggggtgggggctgtgagctggcagcctagaggacacagctcacctgcacatggtctctgaaagtgttcaaattggttgccaacatttataaatggagagatggcaccaaaaaacatctaggtttcttgtctcttgaaaaatcaaagctgtggccaccctaggcccacttttccacatggcaacaggcgtggagctgggggctactgcccctactgtgtaggcggtgggctccccatagtctcctctgccctgctgccgtgtacctggctcccttcactcatccacatcaccggccctaggccagggtctgaaccacacacacagaatggctgcagtaagcaggaacgggaagagctttcacattcagaacaagaaggggcttttgagtaactaaaaaacaatctgagcatgttccagcacttcaaccttactctttcagagctttggggtagcaggcagccagctagagcacactctctaaggaactcttgaaagttgatgtctaatttttaagtactcatgaggtgatggaggagaaactaactcagatgactgcgatacgatacatctttccttataagaagtccttaaagatgatgaaaaatgtgaagcaactcatgtgagaaagctgtaagtggtcagagaagcaagctgacttttggatgaagggtacaacacagtgtcagggagtaggtgatttcttttccctatagttcatggtagtgatacctaaatgggtggcacaaaatgagttctggcttgttagactgatgcttctctttgctgcaggttttgaacaaactgtctggcttacaggggtgagggagagcacctgacaatgggtggtgatgtgcgtggagctcctaccctgaacatggcttcatgagatgtcctgtggtgggtcaatgctttatctcattccatggagccttcaagatgacaagaaaacatcaagagataggagcttgagataacaacattaaataacagaacatgtaacagggtaaaacactgagaagaaatgaaccaattcattgtttcctcccaagagagactgtgacactagttttaaaaagcggcaaagtcctttctctacatacatgcttggagataccccaaacttagagattatgaagtaggccaggaaattcacttattgcacgatgcttggcagggaacaaatgacgctgattttttcttttttaactgaactctctcaagaaaatgttttatgaaaaatttcatttatagtttcagccataggcagggagttttaagggatggaaaagttttcacaaactttagacaatgaaactatacttttggatgtatgtgatcaactcaacagttgttgacaacacaaccgaacatcagaaactaaaccagcaaataggcacaaaataaggcaagtgggttaaatagttgaaaattggttagaaaacatgcaaaaataatactgagttttcttttaaaaagttttaaaccgtcattaaatgtttctttttgtagaaatctgaagagttctgcgtctgaatttgaaattggactttataaagcctagaaaacagaggaggcggtgccctgcccttgtcagttgttgttctctttggtggtgatggtaaccagctgcttggcagccttggcgatgtcgtacgcacactggatgacctgctgcgtgaccagctgaacgtctgtgggtgagccggggtcccctgggagggtcttcttgcactctgactgcagtcggtaggcactggacgtcagtaaacgaagggaagtcctcaccatatcagacttgggtttctaaaaggaaaaagacagccgtttaccctgaactgcagggcagacatccaaaagcaggggacaaacattcttctaaagcaaaccaagctgctccccagagtgaaaggcggtttggtcctgccctttctcaaaggggtgcttcacacactccaagctttgcagcccacagcgtaagagatgctgaaatattctgattcaaaggtcaaagtgcatgcagggtaattttagtagtatgtggtattttgaagtagtttttgaaaaatattaatccatgtgggtaaaatattccagaaaatcctataaattttaaaatgtgccttttagcacgacttgtatatccttgtcttattaaatcaacattcatgcagaacaaaaatatttcaaagctctatacgactgcatattttattttattttacttttttttgagacttgagtttcactcttgttgcccaggctggagcgcaatggcacgatcttgactcactgcaacctccgcctcctgggttcaagcgattctcctgcttcagcctcctgagtagctgggattacaggcatgcaccaccacgcctgactaattttgtatttttagtagagacagggtctctccatgttggtcaggctggcctcgaactcccgacctcaggtgatctgcctgtctcggcctcccaaagtgctggggttacaggcgtgagccaccacacccggcctcgactgcatattttaaaactgcatgtgctacaaaaaagctaatgtaatatataggtcataaagaaatttcttgctgttcatttaaaaggatttaaaccaagtgagtaggaagtgacttactttggggaataatgctgccatttctgtaacagctacgtgtatcctctctgagcagggaatataactgcaagaatattgaagaagttattcaatgacagtaaaaatgattcggaggcaaagaggactcaagtgctagaacagattctgtttacattcccttcatgaaggggctagggctgcagtcagccgtgcatcccacaccaccagagggcacatggttataaagcaggactctcattgcttcctaaaagttcaatctgatgaaaagtctccaggtatgaaatatggcaacatacactcttggtcaggtgaggccacacaacagtacagaaacataattcacccctcctcacgtcagtcatttacttctcatgtgtttcatcgtcccaatttctagaaagagaaaggatttccatgcaaaaggccacagaagtgaaaaataaaggactgaaaaaattccttaaaattagaattggagtctctcaagtagctggaacttcaggcatgcaccgccatgcctggctgatttttaaatatttttttgtagaggagtcccactatgtcgcccagccttgtgttgaactcctggattcaagtgaatctcttgcctcagcctccaaagtgctggggttacaggtgtgagccacggtgtccagccctttccccattttttaaaccatgaagttggcttctgaatagattgtcataagcaacttatgcacttcacctttgtaacaagtctagtttcaaaactattataattaaaactgtcggccgggcgcagtggctcacgcctgtaatcccagcactttgggaggccaaagcgggcggatcacctgaggtcaggagtttgagaccagcctgaacgacatggtgaaatcccgtctctactaaaaatacaaaaaaattagctgggcattgtggcgcatgcctgtaatcccagctactcaggaggctgaagcaggagaatcgcttgaacccgggaggcagaggttgcagtgagccaagattgtgccactgcactccagcctaggggataaaagcgagattccgtctaaaaaaaaaaaaagactgcctacattttaaattaaaccattacatttcaagaaaatggtttatagtatccaaaaatgccttcattggaaatcctgacttctacctttgtgagcaattagaatcacaaaccatttaataacaaaaattccaacatatatggagttatttaacttgtaaatatgaaggggcaacaacctatctggtcacacagatttcagaaagagaaaaaagcaatgtccacagccgtcacatgtatcatgcatactaataaactgtgtgtctgttaatatcacagtgactgagaaccacactgaagttttttttttgagatggagtctcgctctgtcgctcaggctggagtgcagtggtgcaatctcggctcactgcaacctccgcctcctggcttctccgcctcccggcttcaagcaattctcctgcctcagcctctcgagtagctgggattacaggtttgcaccaccacacccggctaatttttgtatttttagtagagatggggtttcaccatgttggtcaggctggtcttgaactcctgactgatccacccgccttggcctcccaaagtgttgggattacaggcgtgagccaccgcgcccagccagtgaagagttttatattttgttgtttatggtttcatttttgagaaatacgattcaccctttcctcctgctacacagagaaggaatctttcctaaggccatctctcaaaagctcactcattatgaactatttggggaagtcctccacacgatagaaaagcgagcacacccggattaatgaggaagccctcctcctctaacaggagtccatattcacaacttcacattggtatctttcctcaaaaaggttttcgtgcataatatgtcataatccctgaattgtatgtgtgcctgtgtgagggcaggagtgaggctggaggcccaggagacaagaccagacttcaggaaggtcaggggctggggttgcttacatggatcaagaggagaaaacaagagaaaaaggcatgggtttaattcgtacaattcaagatgataaataaaagcatcttgaattttaatataggattgaacaatttatgaaatataaattctctagaccaattatggttttaaaccaaaagaatgagctaatgattaaaatctctgcatcattctctcatggtcttaaaaaaaaaaaaaaggaaatcagatcattatatgtgttgttgaatggatttgtaaattttaaacaaagaaagaaaaaaaaaagaaatttcccaaattgtaccaagcaccatattgcatctttgaagtagaaatggcctcagggcagatatttgtatttttgacaaagacagcaatataaggcaagcacattttagtttgaaatacaagcacagcacttctgaactagaggaaatgaaaagcgaagcacattgacaaatggggtcacggtgctcgggaagaaagtgttattgaatcatgattacattaaacgctgtcaaaaactttggccaagcacggtggctcacgcctgtaatctcagcactttgagaggctgaggcgggtagatcacttgagatcaggagttcgagaccagcctggccaacatggtgaaactctgtctctactaaaaatacaaaaaaattagctgggcatggtggcatgcacctgtaatcccagctacttgggaagctgaggcaggaggatcgcttgagccaaggaggcggaagttgcagtgagcaagatcgtgccactgctctccagcctgggtgacagagcaagactctgtctcaaaaaaaaaaaaaaaagctctgtactttggaaagccatgggacactttgctttctgtaatcaaatatgaagtcactcactgccaagactatggtcctgagcaaagtgagtgtgcttgtaacccgtggggtcccaaaggcatggtatgaagagaatgcctgggaaaggagggaggaggaagccaaataattagacagtttttatcgaaggaggcttaaaagttatgcatgtttctctttttctctgaggagcttccagcagtccctccagaagactaactcttatctttcaataaacatggattattcccttctttcctagtgggaaataaggacactgggagatgtgtgagccatataaaaaagggtacagaaaagggaggttggcccagtagtgccaggactacaaaagggaatacaaaggcccagatgcatgtttgtgtggaagaagaaaacagagagaagagtaaacagcacagcatcccttgaatactttttgctcgtgcaaggcgtgaagaaagttcttcactgaagtcctaaactttgctgacctaatgaaaagaatgagatttttcttgggtttgactgaactctgctggtttagctaatgttttatgagtgtctacatcctgccaaccatgggaagctaggatgttaccccaagcagttcgcaactcaccggaagttctcagagaattcactctcaaagaacaaaaggctaagttggagcaagagccagtcccttcctcagggtaagaattaaccacaggacgtgcttctagtcagagtaaacagcctcccctctcaagtgcagagatggacttgggtgatgatgagatcaactttatttattttgagacagtttcgctattgttgcccaggctggagtgcagtggcatgatcttggctcgctgcaacctccgcctccagggttccagaaattctcctgcctcagccttctgaatagctgggactacaggcacatgccaccatgctcagctaatttttgtgtttttcatagacacagggtttcaccatattggtcagactggtctcgaactcctgacctcaggtgatccacctgcttcggcctcccaaagtgccgggattacaggtgtgagccactgtgcccagcccaggataccttttgtgtcagcggccttgtccttagccaggccagggtatagccatggccagaagcgaggtgtaaggtagcccctgtccccctcctagaactagcattgtcaccaccctaactatgccgcaatcctgtttctagaggcatttattttcggagcttcgtaacaagatgaaaaaaaagaaaataccatgtaaatcaaacaagacaaagcaaaccaaaactgacattgttcttaagcctgttatgtagacttgttttcaatgaccttgaagtcagcatgctgggaatagctgccattaggaacatgggcatcatccctttctgggcgcataactcatgctctcccaaagcagggtcttcaatcctgcttacctgtcatgtttattttcttgggctgctcttaagagctcctgtatgtttttggtgatctgttcagtcttcctgatgacatcttcggtgctagggagagtggggcttggggccacatggggttctgctgtgtctggtaccaagccatcccctggccacaccatacttctttgccgtccctttcggcttgacctgtgaacattaaagatgcagttaaatacagcaggtgcttatcagctgcccctctgcttctaggagccactttgtatgcactggctaaatgcatgagcaggctggtctcgtcatttcctttatcctgtctagcaggagactcatggtaaggctctaaaatcggctatttcactctaccatagggctggaagtgttgactctcacaggaagggtgaaggaggggaaaagggagggaaatacctggagcggggagggtgtttgtttataaagccatcctcaggtgggccaactccttgggtacaaatgcagaatgtaacctaatgttgtcttcatgatgaagtggggtaatgactttaaacacactacagacagctagagacacataacatgctggtacaaagaaaaaggcctttcggcaacaatgtgagatgacaagacatgtaaactacgagcgtatgcttgaatactttaagactttatgagtctgaaaatagagaaaaggggtgtgtgtggtgaactgcttctgctggcccaggcctgccaggtctctggccctggggagcccctcccctggcacgctcgtcctgtgcatgtaccccatgccatctggctccatgtcgttgggagtgttgtcgtagtcactctcaggtgtgctgttctgcttctccagcctggatgcctacaagaaagaagagggaccctcatgagtttgtaacatgagactcttctcaggagtcttccccaggaattgttacctgttaggctactggccttcacatcccaaatctcatttgggacaggggacaactctctagtgaaaatttagtaaaagatgaatattggatccagaaatggcctctttccttctttgcaccattttcttcttagctcagtggccacttcctaatcagatccttagtacaaactaacagacatgcaaggcaacatatcctcatttagttctcaaatttataacataatgagatgcagttaaaatacaggcagggtgtggtggctcacacctgtaatccctgtattttgggaggctgaggcaggacgattgcttaaggctaggagtttgagaccagcctgggcaacatttaaaaaataaataaaataaataaataaataaataaataaataaataaataaataaataaatcagccaggcatggtagcatgaacctgtagtcccagctcctcaggaggctgagggaggactgcttgagcccaggagttcaaggttgcattgagccatggtcgcaccactgtactccagcctgggaaacagagtaagataagaccctgtctcagaaacaaacaaacaaaaaaacatgccagcacttatatgaccacagaccttcagcactggaagccaccttcagattatctcattgagccccatatgagaaaatgaagggccaaaaaagctgggtggcccaccaaaggccacaaagtctgcagaaaaacaggaccaagcaccaggtctcctgcctcctgctacctccaatatttcatgcctgggctcaaatctaccccttaaaatgtaaagatttggtgcaactgtggtgatcaaaaatgggatacagattcaaaagaggaatcctaaaaatgttttgaacaaatggcagcactgctaaacacacgatcttctagggtgacgaaatttgaaggggactttattccttcgaaggggactatgttctgagtatttcatgaacattattttccctatttatttcacccataatgcttgagaacttctctggaacagagatcagtggaggctaatttaaaacctaaaccacttaccttataaaatataagtgtgagctatttctagctttactccttgaatttcatccaagttaatcaaaacatgggactaaggagttttattgatgctgcaataaaatgtggctaaggacacagatgtaaactaagagctttgtttaaacatatggaaaccctgtagcttcatccaaaagagtggctacttttgagtaagttggtttaagaaggtctacatggccaggtgcggtggctcacacccataatcccagcatgttgggaggcagaggtgggcagatcacttgaggtcaggaatttgaggccagcctaggcaacatggtgaaacgtcatcgctactaaaagtacaaaaattagctgggtgtggtagtgcacacctgcagttcagctactcgggaggctgaggtgagatgatctcttgagcctaggaggcggaggttgcagtgagatgagatcgtactactgcactccagcctgggtgacagagctagaccctaactcaaaaaacaaaacaaaacaaaacaaaacaaaaccaaaaagaaaaaaaaaaaaaaaccccacaaaactctacataaagcctgtcactccttactgataacacctggtgggtacaggcaaggcagccggacccacgtggagaagccccccttattcacaccacactttgtttgctatccccatacactcttctgctcccagggcgcatgttctctcctctgtcggctgaggtcttccatccacacctccacgcatgctgtttagttcccagctgctcaaatacaagacacttgctgtgggctcctaaaattcactatgaactcgtgcatcctgaagccactcaaatccatctggcaaatgattaaacgttagcttggagccatatggggagtctgtaaagctaatttctgtagaatcgacaactttgatgatccctttgtttatatctcctatcaataagtagttctgcttctcttgctgccttgttttgatctggctttatgaacagtcagtgagtttggctgctagaagtttatagcaggaagatcatgggcaagcactgtggtcttccagagatgagcttagaaaatgaaaaagaaagaagaaaaacccaaaacccttcttatctttcacagggaatgcctaacttttttcttttttttttttgagattgagtttcactcttgttgcctgtggagtgcaatggcataagctaggctcactgcaacctccgcctcccaggttcaagcaattctcctgcctcggccccctgagtagctgggattacaggcatgcaccaccataccgagctaattttgtatttttagtagagatggggtttcactatgttggttaggctggtctcaaactcctgacctcaggtgattttcccgcctcagcctccaaaagtgctgagattataggtgtgagccaccgcaccctgccaattttttttcttttttttttttgagacagggtctcactctgtcgcctaggctaagtgcagtggtacaatctcggctcactgcagcctcgacctcccagactcaagcgattctcccacctcagcttcctgagcagctgggaccacaggcccgtgccaccacgcttggctaattttgtacttttttgtggagacaaggtctcactatgttgcccagcctggtcttgaactcctgagctcaagtgatcctccaactttggcctcccaaagtgctgggattataggtgttagccaccacacctggccccaactaacttttaagttttattttggtttttatatatacacccacacagaggtgtgtgtgtgtatacatatacacatatatgaatagataaaaacttgcatttacgtaattatactgaaaaatttgcccagagctgctccagtggaaaacaaactagaaacagaattaaacccagaaaattctacatttttataatgaatcttttttatttatttatctggagacagagtcttgctctgtcgcccaggctggagtgcagtggtgcaatcctggatcactgtaacttctgcctcggcctcccaggttcaagtgattctcctgcctaagcctcccaagtagctgggactacaggcacccaccgccacacctggctaattttttgtattttaatagagacagggtttcactgtgttgctcaggatggtctcaaactaccgagctcaggcaatctacctgcctcggcttcccaaagtgctaggattagaggcgtgagccaccatgtctggcctttataatgaatctttttgccttccctgatgaaaatgtgataaatcgcaaatcaaatgcattaccctcaatgatgaaaagtaccaagtttcatttaaacattttagaagagtagtgactcatatacctaataaatgcatttggtaaatgttttttcaagtatggaaaacaacatatagcagcaaccacccaggaaatcagttacttacacgttagttaagtccttccatcgttgtcaacaaaagcatatgtacagaatttcagtgtagccagcatttaattgtatcaaaaatattataagcatgcagagccaaaagctattggttaagagtgctgctctctcaaagctgttaataggaaggttaccttatagctggtgctggttcaatgtatttaataggtttgcagttttctctgaataaagacacgccataaaaatctaaactcatgatgaagctgtcaggaacaatcagggtgatcagtttaaatgatttttgtacaaaactctgtctcagcaagcagtccttgcaatgatttttaaggctaccatacaaattaaaaaacaaaaatttcacagtagacaaaagaggtttgacttacaaaatttctaatgagatatttaatcactgtctaactgtcctttagttgtatctgggctattttaatgaaacattacagttcaatttcagaactgctcaggagactttttttttttaagacaatctcactctgtcgcccaggctggagtgcagtggtgcaatctcggcttactgcaacctccacttcccaggttcaagggattcttgattctcgtgcctcagccttccaagtatctgggattacaggcatgcgccaccacccgccgctaatttttgtatttttagtagagacaggttttgccatgttggccaggctggtctcaaattcctgggctcaagtgatccacccaccttggccttccaaagtgctgggattacaggcatgagccactgcacccagccgagactttaagtacaatgtatcaagaattctttttttttttttttagtacagtaattccttttttttttttgagacagggcctcactgtgttgtccaggctggagtgcaatggcacaatcatggctcactgcagcctcgatctctcatggtgggctcaagtgatcctcccatctcagcctcccaagcacctgggactacaggtgcacatcaacacacccggataattttttatattttttatagagatgggatttcgccatgttgctgaggctggtcttgaactcctgggctcaagcaatccacccgcctaggcctcccaaagtgtgtgagtcactgcactcggctgagaattcttaatagactgaaagtgaagtgaagaattccaaaagggtcagggcatggtggcgcatgcctgtaggcccagctactcagaagcctgaagtgggaggactgcttgagcccaggagtttgaggctgcagtacgctatgaccatgcctgtaaatagctattgtactacagactgggcaacatgagactctgtctctaaaaaataaaaaataaaaaaacgaatcctgaaagggccttggtaatccatatgccactggaactaggaaagaaaggctctccataattcctaggtgtggagggaatggcaaaggcccagtgcaaaccccaccttgcctgtaaaggtggtcccttacccacagccaccttcctcctcttaccttacattacccttccattaaaaaagagatggagccagaactgggacgtggatttcaaagcctatgccctttccacggctttcccaggttgtggtcatgtaccactctttatgcatgaaagtattttttaattgacagtgcctttgggagcaggggctgtgccagctaagtccttaggaccctttcattgacttacccaaacgctgtgtatggaggaggtgcttaatacttactgcctgactactctaaaagaggcttacctgaatcatgcactgctattgagaccataaattatacaccagtaggtgaggtttaaccaacccgtacaagtgaacagctttaggttaacagctgcttgcatagctccaatgccacaaggtgttacaattctgattcaagatgcagggacttgtaaaccttggtttgtcagcacttgtggtgctgacataaaatgtgtcacaggttaaaaaaaaaaaaaaaggcatgacattttagtacttcagcgagtccacatacagcagtttcaatctgacaactgtagccctgaacaaattgaacaaatttggcctattataatatctaaccagcagccagctaattttctcgttgtttaaaaaaacagtttgctcagaataaatgctgtagggtgatttgcaaactttgttaaatatgacgtgaacatgagcagtatggggttagagaaagggaggcgccctcgatgggtgagcgtgcatgtggacgagtgtgagcctgatgcactgtgagaaaccaggaggaagtgctgcctcatgcaggacggaagggcagttagcagggacaggagggccagagcccaagcacaaagcgcccaggagcacggcccctcctccagagagcagaccattcagaatgtacttaacccttcgggcgctttcgtccctcgaccaggaaagtgtggaggggaaggaaggcagagatgaagaggaggtcacaagtgcactcctcccgatctggaatgggaaagagaaacacactcgggaaaatacaaaacaaaccaaaaacctaccaccttgccagcttcagtaaaagaatcctggaacaccacacattatgtgacgtgagtgctgcaatctcagtggccaccagtgacaggaccccagagatgcttaaacccttggtgaaacacctcctggaaattactctgaatttaataaggctgcttttccataagggaaatacctaacataatttgtcaaacttgtcaataattttttaatggatactatgaaatgcatatttgtttttcaatcaggactgatgtgaaatgagaaactataaaaatgattctaagttgctatacactatcaatctaatttttagtacaattacagtgccttcctgatatatctttatattctaattttttctaaaataagaaagtacactgaaaaataacaaagttgcttttcctaaattttgtcttcagctatacaaaaataagattcttaacttagggtgggcatggtagctcacacctgtaatcctagcactttgggaggctgaggcgggcggattgcctgagctcaggagtttgagaccagcctgggcaacatgatgaaaccccgtctctactaaaacaaaaaaattagccaggcacaggaccatgtgcctgtagtcccagctactcaggaggctgaggcaggagaactgcttgaacccaggaggtaaaggttgcagtgagctgagatcacaccactgcactccagcctgggtgacagagcgagactccatctcaaaaaaaaaagattcttaacttagttcagtggcattcccattacatcaaatgtatcaaatcaattgccttagaatgttaaacccaaatatcttaaaaagaatctgagataacagactcccaattatagtaaaacaatattgtaattttaccacactgaaaattgacaaaattaaactagggtttaattcacgaaaccatgtccttgctttgcatctaccttgagaatttttttggaaactcccataaaatttgactgaagaaataataaactttgacactcaaaaagacaaatactactctctgaaaaagcatcccatgaaaaagtttaaatgtaacatcttggcaaaacacatatttttataataaagtaatccagaagaaatatatttgaaaaccttataacacagtatgtatcccaatgcaaaataagattgtaagaaccctgctgcagaacacaatctctggaattcagcgcttctaagactgatgtagagtattacatttccttttctgagacaacaaagccacacttcccccaccacggtgggaggagcaggatgcagaagcgaacctagcaggcacactgagcacacatggagaggctgcggaagcctggagccttccagccttgcctgggtacctgggccacagactcaaggccacctgcttgaggaggagctgaaaagacgtcttggattctaagggctccagtacttaaaggggcacatccctgtctagctccaagaaggcaacacttccttctgagagtgaactttatgatttatttttgtttttggaagtagagaaggaaggaagctttaccaaaaaaagttccaacactggctggttgagaaataatcatggatgtgggggagaaaaaagcagcagttcgggcaagagccagaatccccaacttggttaggaaaccatcagcccatggccctgtgtgcttgtgggaatatcgcaagcatctgtggacatgttaatacagcaaacacaatggtaactctcttagtccaatttggcaaagcagagctgtggggacctgtaggttcagaagagggaacagagtagacaggctgcatagagtgaacagcagaagcgccagtggtgttacttacgtgcgcggggaagggctggagtctcatcctgctctcttcggggcggctcgcttctcccattgggagatatggtttctgacctgatccggtctcgtacatggacatgggcctactgccccgggcagacggacgtctctttaaggaagagtggttggaagtgtctgtgtactcagaaccagtttgcacctgatatacattggttgtggcctgtttcctgaggttcgaattttcactctggagtgtttgaagctgaaagaaatgtttggcagtgggactgtgtttttttacagcaagcagaaaaagcaaacaccaagtaaatgaatacaactaccagttttaaacaataaggacagtaacagctagccgggctgaaagtaaaaagccaatacaaacaaggaccctttcttctggattgggtgaaacacaatcaactcccttcatcacgtaagcaaattaaatagcttcatttctgaatgtggaaaagttgtggtttggacttcctcaaaacaaaatgtctaaccactttaaaatttgtcatggtggggctgggaaatgtttgcaggcaagctgtacactggattattactaaggctgtttcaagcaagagttcgagatcattaaaacatcatttaggtaacttgcttttcaaatgagccctgagcaatttgtaaaggccaaaaatgacagcagacaccatggaagcagcacaaagatgactagggttgctttgcaaagcaagaaagacagaagttcagcttgtgaaaaatcagatcgcctattgctttccaaaaagccaacaagaaaaattatgatcaacaagtttttattacataatactcttgatattccaaacaattcagcactttgtaaaaaaaaaaagaaaaaagagaaaaccggatcatggtaagtttgctatattaacatatcacgaagaaaactggaaacctattgatctatggaattgacatcttcgcatggatgctccacgcagcacgcttgcttccgtctggtgagtgatcatctttcggccagggctggaatatttggcctttctctcctttggctttgtcacccaaaaaacacgacctcagtggtgtcagctttgaacatgctaatctgcctggcaccaccccattttagagactgtcacttggaggccctgaatgctccttccattcctcacatgcaggctgctccatggtgctggatggattagagttaaggggtcagcagggaatcgtgttactctttggcatctggcattttaaacaccattcaccacgtccattctgcgcagggtccttcccttctggtgcgccttcatcttccatggacattctataagctgggtgtggtgtgagttcagctgtctactctttgacagagattgtaaaatctgaccaaattccccaccagtgccaaggtttaagtccacaagcaactgtttgcaccagaagatcattactttttcagtagcaaacccattcaatgttaggagttactttcaatttttatttagaaagcaccaatctgtgaaaaatacaccaatagtagttgctcctcttcattaattagcatcttttccaagcaactgttaaatgtgaaagatcagatacaaatcatgctactttgtcaactttatgtatattaaaaactttacccaactttgaaatataatcaatacatctttgctaaataaacaaattccatatactttatattaatcatgccaaactgctgtgaaagtgtgacttactgcctcttccacaaaaagaccactcattctgtttctctgaagagcaagccattacagaatgatagaatgcttttatatcacaaaggctggcagggtatagctcatatctgcaattccctttccagggaaagaacagctgcaaagcagctgacaaagcagccctgaacatttctacattccaggatacagacaggcatgaagtgcctgttgaaactattcattagagaacccagggcctagagtgaaatggtcaaggttcaaggactgaggtgtgtaactgacacaggtccctcaatggggcactggtgcatgtgatcacgtgtttgtctgtataaaaagcctctgtggcagttatttagttaaggccttgaaatctgaaactttatcctaacacttttcatgcctggattttgtctgaatgtgttctcatgagcacaagttcttggtttcaatttttaaaaatgttagtactctgtatttagagagatgtcttcacataaattttaatgacgtttatcttaataagaaccaggctacacttttttatttggaaggagtataagggaaaataaaaagttatagacaattcaatagtttcagaaatcaaaagcacttctaagaattgatgagataatcaataagcaaaagcaaataatttcactttgcatttctcaaagaagctcaagacatttgctttcagagataatgaggctctctctggtgatttccaaaaatactaaaagaagcattgttagattttaaaaggtgatgtgcagcagattgatttacagtggcaaaatcagcatgtttcagaaatagtcacctggtcaaaattattagtccaattaatggaacaaactataatccactaaataaaatatattccaaagaaggcaaagaaaatacaggtcctgtatgttatgacaaaggggctctcggtctgtctcgtttacagctgcacggcagccctagacagggctgggagacacagaacaagtgtctgttcgtttaaggctagctgatcttaagcattcttcattccctgctactataggcattagagccatttatttcaaaaagtctcaaaaatgctctagaagtcaacatcaaaagaatcctagaccaaaccccaggcaaaagtgcacagcaatttccttccctagtaaacagaggggcatgggcccctttttagttcttccaccttcctttaggaagcagcactgaaaagagtccaggcacacatggagtgtgccacgtcctcaggtcttgaaaatgatttgaaaaccttacttctcaaatgacagcctaaagacatagattatatatttcattttgtttctggttaagtaaagtgtccaaatctcattttagagctgaatgatgagtgatacccacaaagtcatgggcaaaatttgcaatttttcgaattcccttatttagccatctcataaggagttgcatacacaatccccctcctactaagggtattccttgctaccatcaaccacactccttttagggattaatatattcacacggttctgattctctcaaaaggtaatgaatgagaaaatgctgagcaaatgagattgttttttaccagtgtgcagctcttcctagtacaaatgaaatgttttttcttattttttgagcacctactctgtggcaggccctcctgtaggctctggggataatacaagttagtagtaaaaactggtgagcaataaggtggggatgtgggatagggctgccagggtgggagcagggtttgaatgctgataaacatgcccctgcccagggctctcattggctctgtctccatggtgtgatcatccttccctagcaatgggaagaatcacatccatggagccccatccaggtttccaggaagcacagaatagtccaagggttattctaatgggcacaaatgcttaaatagatgttaggtttctcctacctggggaacttactctggatatatttcattttaaatatccaaatacatcctgcttcaaaaagacaacttggcccaaagatttctaaggctgttacaataactgtttttctttcctcggaccacatcacagtgcctgagattcttccttgtactatgggattaaagcgtcaaccgtcctggcatttattaacatgttacctttttctgcataattctcagctcgtcactcaagttgttattcaccttcattagctgctgtatcttggcctcagaagccactagagcgtttttgacctccataaattcctgtacagtgactggtccatctgataaatctgaatctaggctctaaaaataaattgggaaaacgttcacaatctgagatgacgagaacattaaagactaacagctcaagaatttcaaattctgaccaagccagctgaattgcaaagttagtcaaaccaaatcaaggcctctgagagtaatgcaaaactaaaacataaaagtagggtcactatactatttaaaaaatttgaaagtcagtattttctaatagaacaggcagtgaggctacacatctatgctgacaatgactgtctaaggaggtctgtcctgtcttgtaagcctttctctcgttcactcttgttttgtttttattcattctttcattaattcattcattccaacattttcattgaacattaggcagtgttctaggtgcttgggatatattagaaaagagacaaagattcctgcttccatggtgtttatattccaacagcatgagagagtatatatattgcatgattgagggtgatgagtgctgtgggaaaagataagacagagcagggtagggggctgcatgttaagcggggagctggggtaagcctgtgagtgggtgagaggtgagcagagccccaggaggtgaggggatgagtcacatgaatctggaggaagaacattccagcctgcagtggagctcagctagagggagcaggtgtgtgggatggactgggcaggaggccaggcggttgacagagggcctggtcacagagggtcttggaatgacctcggctctcactgagtgaaccaggtggcttccgggaagtctgcgcaggggtgtcccctgcatctgctaatgacgccatctttctcacagtcatgtgggccgaagaactccaaacaaatcttctataaatctgtctccccacttcaaccttccgacttattgccaagacttttctattctaccttcctattcatccattctcaaatgattgccaagcccctctgtgggtgtgtcctgggggtcagcagagggtgcacagcctggggtcctgctgccctctcccccagctcacactctggtgccgaggtctctcccacccgcaccatcctagcatgggtccttaggtggcctgcatcagctccagtatggatctctccctccactctctaacccaccagaagagtcctccccagacatggcatcctgggctctgcactgcctgtgaggcccactctcttccgtcgggtgtcatacccctcctgctgcagcttcgagtcccaacctttttaggctgtccctatgcatgaccagcttccccttagatgccctggtttcactttctttctgactcctccacatgccccaatcccaagcgtcccttgaggcgcatcttaagagctgtcctatgacacagccccacctgatgctcccagccatagattctctctctgctcactccctcagcctgtgtgtgcttcgtatgacacacatcactttgtgccttctccgcagttctctctctcctaggcaatgagagcctcacaggaaagggacgaggcctcattcaggagagtaatatccagagaagtcactcagtaaacacttgttgaatgaataaaacacaccaatcactcctcacaagttttataaagtctcaactgcagcagggctgtgatgcagggacaaggatccctattttaaaaccatttaaccttgtttcacctttgcttggcctgagctagtaacaaacccaacctcactgcacagcagctttggcagggctagccctcagctgatgcgtgcttgcccttccatgggacgcatggcctctcaccttctgccggtttgttttgcttgcagtggtttccaaatctgtgtcttcgtctgatgccacgctgtcatagtcgggctgatcgttgtcttgactctcaacgctgtgctggttattgatggttttcagtatgagctccacattgtctatcaataaaagcaaacaactttacttcaggcttaaaacattgcttttcttccaaaaaactacggagaggattttttggtttagccatttaaaggacttaaagggctgaatgctgtgctcttgcctgtaatcccagcattctaggaggccaaggaggagaactgcttgaggccaggagtttgagacctacctaggcaacacaatgagactccatccctacacaataatttaaaaattatccaggcctggtgtcacaggcctgtagtcccagctactagctactcaggaggctaagacaggaggattgcttgagcccaggagattgaggctgcagtgaaccatgactgcaccactgtactccagcctgggcatcagagtgaggccctgtctctaagagcaaaaacaaagacaaaaacaaaatgaacaaggactgaaaaaaaatgacagaaatggcaacgttatattcacaccaatacagagataacagaaaaagttttcaaccaggtggacagctacataagagactccagcattcctctcatctacctgccaaatatgggcaaattaaacagatggcttaggaaggaactgctcagataaagaaggcaggttcccaagtttctagagatagagcctagctccaggtcatgaagataaggctgtaggtaatggaagataaactgtaattctatgaatacctataacatatttacaaggtaatgtcactcaaaacagaaagcaaattgttaaactggagccagaacctaggcactcaaacaatagaagcactgggccgggcgcggtggctcacgcctgtaatcccagcactttgggaggccgaggcgggcggatcacgaggtcaggagatcgaaaccatcctggttaacatggtgaaaccccgcctctactaaaaatacaaaaagttagccgggtgtggtggcgggcgcctatagccccagctactcgggaggctgaggcaggagaatggcatgaacccgcttgcagtgagccaagatcatgccactgcactccaacctgggcgacagagcaagactccgtctcaaaaaaaaaaaaaagaatagaaacattggcatttagtcaattacctgcatctcagcgagagaaagagataaaggagaatgaatcaaacaaatacacatgtgcatgttacagggagtgtctatcccatagggagcagggattattctagaggatctaatacactttgaacaaaagatttcacaaactacccaagtctctctgatttctttcaggcaactcaaactctgacttctaatattgtttcccagagatgttgaggaaacaatggatggatgatatctgggtgatgaatggtggttatttaaaaagactaggtcctagctgggcgcaggggctcacatccgtaatcccagcactttgggaggctgaggcagatggatcacttgaggtcacgagttcgagaccagcctggccaacatggcaaaaccccatccctactaaaaatacaaaaattagctgggcgtggtggtgcacatctgtaatcccagctacttgggaggctgaggcaggagaatcgcttgaacctagaaggtggaggttgcagtgagccaagactatgccactgcactccagcatggatgacagcgagactctgtctcaaaaaaaaaaaaaataataataataataaaggatagatcctattttaactgtttaaatattttaaaacacataaatataattacagaatagtcaatatattcaatttagaaactaatgaacaagtaagataatcacttatagccattgttatttgttgatctatttctaggtttttctccgagcacttatagccacacacagtcaattcttgttatgcttggtagttatgttcttttctttttttgagacagagtctcactctgttgcccaggctggagtgcagtggcgcgatcttggctcactgcaaactccgcctcccggtttcacgccattctcctgcctcagcctcctgagtagctaagactacaagcgcccgccaccacacccagctaatttttttgtatttttttagtagagacggggtttcaccgtgttagccaggaaggtctcgatcttctgacctcgtgatctgcccacctcggcctcccaaagtgctgggattacaggtgtgagccaccgcacccagcctcttggtagttatgttctaaaaagttgctgtgacttggccaatattagatcagtgcttctggggttatcaaccaatcaatatataaccttgttctacgtgtgtttctgtttaaagataccttatttaatacatagtattgattcattaacattgaactcatggccaacggcactataaatcatgcctgaatgatgcttatttaacacacatttctccgtagggcacatcacagccttcttgcacttagaaacactagacagcacttcaggactatgcttgggggccactttttttctttttttattgagacagggtctcgctatgtcacccaggctggagtgcactggcataatcatagctcactatagcttctaactcttgggctcaagtgatcctcctgcctcagcctcctgagtatgtaggactacagacacatgccaacacacctagaaaatttttaaattttttggtaaagatggggccttgctatgttgttcaggtgtgcactttttttttttttgagatggagtctcactctgtcatccaggctggagtgcagtggcacgatctcagctcactgcatcctccacctcctgggttcaagtgattctcctgcctcagcctcctgagtaactgggattacaggcacgcgtcaccatgcctggctaatttttcttgtatttttagtagagacagagtttcaccatgttggtcaggctggtctcgaactcctgacctcgtgatcagcccacctcagcctcccaaagtgctaggattacaggcgtgagccactgcgtctggccaaggagacacttttgagatagggtcacccatgctagggtgcagacgtgatcatggctcactgcagcctcaatctcctgggcactcaattgatcctgggcggtagggggccattttaaaacagtgaaatgaccaatgaaaagcacacaaatatgactaacatggcactaaatagaccacagacacttgtttatagcatgagtgcagaaacaagaagtcaaggagtctcctccctgttcaatctcagctggaaacatgtgcttttggtgactcaatttttttctctgctctgtacatttcttacaatgaccttgaaaatgctgtattaattttgaggtcacaaattttagcaagtagatgaatttgtaaatatgggatgtgcacatgaggatcaattgtgtatttatatttacatgtggtatactcacttgtacacacatatttacataaatatgttttccttacaaaactggggttatacaaaaccttttaaaaactttattatttggccaggtatggtggctcatgcctgtaatcccagcactttgggaggctgaggtgggcagatcgcttaaggctgggaattcgagaatagcctggccaacatggagaaaccccgtctctactaaaaaatacaaaaattagctgggtgtggtggtgcacacctgtaatcccagctactcaggaggctaaggcacaagaatcacttgagcctgggtggcagaggttgcagtgagccaagatcgcgccactgcactccagcctgggcgacagagtgagactcgtctcaaaaaaaaaaaaacaaaacaaaatcaaactttattactttgtctcatataattactactatagtataaatgtttcttccctccaaatctcatgttgaaatgtgatcctcagtgttggaggggaggactaaagggaggtgtttgggtcatgggggtggatcctttatgaactgatcaatgccctccctttgtagtgagttctcgctctattagttcctgctaggacctggttattgaaaagagcctggcacctccctcctcgctctcttgcttcctctctcaccgtgtgatctctgcacatgtagcaccccttcaccttccatgagtggaagcagcctgaggttctcaccagatgcccaatcctccagtcagcagaatcattagccaaataaaccttttttctttacgaactacccagtctcaggtattcttttatagccacacaaaagggactaagacaattacatattcttttaaaaaaagataagtatgtatttttttttttttttgagacggagtcttgctctgtcgcccaggctagagtgcagtggtgcgatcttggctcactgcaagctccacctcccgggttcacgccattctcctgcctcagcctcccgagtagctgggaccacaggcgtctgccaccatgcccagctaattttttatatttttagtagagacaggatttcaccgtgttagccaggatggtctcgatctcctgaactcgtgatccgcctgccttggcctcccaaagtgcagcatgtactattttaaaatgtgactaattgttcctctttattacttagttgcttctaatgtttgtgttgttctacatataacatctctgatgatttcccttcagttaatacctaagagtggaattatcaaatcaaagagcaggtattttttaagactttgttttttaagttaaaaatttttttttttttgaaaaggagtattgctctgtcactcaggctggagtgcagtggcacaatcttggctcactgcaagctctgcctcccaggttcacgccattctcctgcctcagcctcctgagtagctgggactataggtacccaccaccatgcctggctaattttttgtagttttagtagagacggggtttcaccatgttagccaagatggtctcaatctcctgacctcgtgatctgcccacctcagcctcccaaagtgctgggattacaggtgtgagccaccgtgcctggcccccaatttttttttttgagacagagtctcactctgttgctcaggttagagtgcagtggtgtgatctcggctcactacaacctctgtctcccaggttcacgcaattctcctgcctcagtctcctgagtagctgggattatacgcgcgtaccaccacgcccagctaatttttttgtatttttagtagagatgggtttcaccatgttggccaggctgatctcaaactcctgacctcaaatgatctgtccgcctcagcctctcaaagtgctgggattacaggcgtaaggcaccacgcccaggccattttaagactttaaacttatccaaagactcttgtcactgtgccttcaccaaaatttaataaaccttttcagaacttccttattcctggttgaacagataaaatcaaattcctgaacaggaaagaagaatgaatgagttgttgtcagttaatgattactgtctttggggaatgtgatactgactgaaaacttaatttttatggtacatatttcttttgcttaaatgacttacaatgaaaaacgtctaatttctataattagaaaaaaccaatatggatacagtaatagggctggagaggaaggacattcctaagcatgcagacaggacctgggctactgaactagactcaacagggcactggtgaaacagatgctcagagctctccttataattgtatatcacagtaattctcactgaagacatttaaagtttatggcaacaaattttaattatgttgaactcagttttgtaggtaagcaacagcagatattatgcagtttcaatcaggaagagtttttcttttccgtttttttttttttttgaaacagagtcttgctctgtcactcaggctggagtgcagtggtgcaatctcggctcactgcaacctccgcctcccaggttcaagtgattctcctgcctcagcctcctgggtagctgggattacaggcgcccgccaccatgccttgctaatttttgtatttttagtagagaggtggtttcaccatgttggccaggctggtctcgaactcctgacgttaggtgatccacctgcctcggcctcccaaagtgctggtattacaggtgtgagccaccacgcccggccaagaagagtttattttcttatgtcctttaacaagatctaagccagagttttgggttaatttcaggatgcaattttacagggtaggttaagtgtcccaaaacaaaacagaaatcatatataagataaatatgtgtagcagttaataactctgaaatattgttaattcaccagggctcagacaggtaaactatttatcacaatatactaccaataaaacttacagtgggtggggctgaggggagggaacctagaggacaggtcaataggtgcagcaaaccaccatggcacacgtatacctacgtaacaagcctgcacattctgcacaggtatcccggaacttaaagtaaaaaaacaaacaaaaaaccaaaaacctatagaactgtcatgttgatgactgctttaattagtttataactttaacacctgagtcaaatttagagggccaaaaaatgcaagtgtttggaggtttgagcagttaccttttgaacccgagagagaactgccctgctgtctcctcttggcgtcactgagaatgtcaatgaccagcgtggcaaactcatgggcgttgaaccgagctaacttctgtctgccctaaaggtgggaaaataattggaaatatttcccagtgtaaaaatatatacataaatagtcacataaaactagtcagactattgacagacttctgcaaatactttcttctggcatgatcaaagtacaattaatcccagccataatcaaaccaagttaatgcttgttttccatatgaacagtttaaaaccatttatataagagaatttcataacaaatgttatggcatttctcacatatgcattgttctcacaatgcaggtctattttggtaagcaaaaataaaatgggtctactgaatgcttttcttctattaatgcttcagtttggaagtagacccagtaataataaattaattttgaggggaatttttaaattttaagtttaggccgggtgcagtggctcacgcctgtaatcccagaaccttgggaggctgaggcgggaggatcacttgaggtcaggactttgtacaaaaattagccaggcatggtggcgggtgcctgtaatcctagctacttggggaggctgaggcaagagaatcgcttgggtccgggaggtggaggttgcagtgagctgagatggtgccactgcactctagcctggacaacagagcaagactccgtctcaaaagaaaaaaaaaatttaagttaaacaaaatcatagtctagatattccctatccttatatatagctgctaattataaagactaaaacaccttcataattcattcaacatttctcctcttgatggatgtgttagctgtttttaatgctctattgtatacaatggtgctttgatgaaaatcacgtgcataaatctatttttattttattagagcatattctcaaatgagaaattcccatgtaaaaggatgtacttaattttgaggcttctgaaactggtaaacaaattgcttttctaacatctacagcaatttaaagttctatctgttgcaagagaaagctcagcttaccacatccttaccagtttggagtatcctttattatatattttattaatttgactgataaaacttgcactaatgcttttaagttgctttcttagattactgacaaggttaaacatttcttcacatttgtaagccatttatatttcttctgtgaattgtttcatattctttcccagtcatttatttatagtctattgtttttcttatcaatttgggggttgtgtgtgtatatatgtataaaggatattaaattttaatcaatcaaaacatttagaatagttttcctgggaaaaatgaaacatgacatcagccattccccaactactattcctttccaaactgagccacttgcctgatttcgtgttgatgagtactcaggattgaccggaagaaaggggacgaccgttgtctcggttaccagggcgctgtggttttgcgtggcaagccagactagtcagaggaaagagccagagacaaacctcatcacgcctgtgtgccactgctcctgggaggcacagctcacgcactacgaggggaaacacactctgaagccaacacacgcaaaggcaaacgtcgacactcgcaccatcaggacagcagaaattggactagtaaaacactgagcctggcagcttttcactgcccactgataacagaagcttattagataaagccacgtcaagtcacctgcatccgtctctcgcctgtcaacttcatcgtacacatccatggcaagttcttcaaacaaatgattacttagctgaaaataaaaaatatcaggaacacaagggacaatgattaatgccaggaggacaagagggaactgcgacttagtcacccttttattgcctacgtcttatccaatgccagtgcttggtacatacccactgttaaacagacataacattttcaaaatcgtacagggcctctagaaatgtctgccaaccacagcaatttcactactttatgacacagacagagctgctgctattaaggagctaagaggcatctaaagtgcatcatctcagaagtaggttccagttctctactcttcttgtgatatcatcctgtaagcctccttttctgcacttaaaagtgcttatcagttccccaaagtataagggaacctataaccttgcaaaaacagccaggctcagtggtgcacacctataatcccagcactttgggagactgaggcaggtggattgcttaagcccaggagttcgagaccagcctgggcaacatggtgaaaccctgcctctacagaaaatacaaaaactagctgggcgtggtggtgcacacttgtagtgccaactactcaggaggctgaggcaggaggatcacttcagcccaggatatcaaggctgcagtgagccaagatcacaccactgcactccaggctgggtgacagagtgagaccctatctcaaaaaagaaaaaagaaaagcaaaagacatgctgttttgagaggataaaatgtgcccttgcacaaaaacgtgactcagacctcagctgagtttctttgctctctttctcagtagcagtcctactgcttcagtctccagaaggaagcttcctaccaaagcacagcctgactcttcagcacacaacaaccacctcacagcctgcagtgcctccctgggcacatggaggataattgaggtcttcctggcccagatgaggttaagcctcttctggggtggctccgcctctctctgcactttctgcctcatgcaacaccttgacacgtggtagttgtgactcttaaactgtctgacatctgctttgggagggcagatgctgaatctgttatattccctattgggttccttacatccacacatggtacctcacactttaaaagtggccagaaaagaggcactggctggccagaagggatttaatgcagcaatttaaaatgctggctacaggctgggtgtggtggctcatgcctataatcccaacactttgggaggcagaggcaggaagatcactcacttgagcctgggagttcaaggctgcagtgagccacgatggcaccactgcacgccagcctgggtgacggagtgagaccttgtctcgaaaaaaaaagaaaaaacaagtgctggttacagagacctcataggaacatgttaaaatgggtaccatatattactgagtgaaaaaagcaggttataaacgtctacaattatgattaagttccagttttaaaaaaagatatgcatataaaacaagaactgaaagaaatgtaccaaaatattgagcctgactccattaagagtatagcaatgaggatggtcccctttctctattttccaaatcttcccaaatgtggtcgcactataattaaaaacaaacccagagagcctgttgctagacaagatgttgaaggattgggagcttgactttgcttcataaatatctagtttcttcctccatgggactacaagctaatgttattattactagcaacaactacaatggccaacgctgattatgggcttatatcccaggcactgtgctaacagtatcatatttcacttataacacctctatgaaaacaggaactactattgtcccatttttaagacaagaaaactgaggcagagaagatagtagcttgcctaaagtcacaaagctagtgacagacctgagatccaagtttacatctttgaaaatgctaacatttactcattcaaggaatacattagcctttgttatatttctctcagttcttcatcaggagggagggaaggaaaagagaaaggaaagaaaggatgaagggaggaagagagggaggacaggaggaagatactggaggataaacactgacctggcgctgataagatggtcacctatgagaaggagaccacagggtgagggtcaacaagtaatggggcagcccactctgagcagttctggccggcagcccctgcaggatccttatctccctcttctatgagaggatgccaaggcacagggaggctaggaagcttggcagggctgagatatgtactgaccagtctgactcagagctgcagctctggagagctatactagactctgttccaggtctttacttcatgcctgccacgtgctagagatattacaagcataatctcagctttcatgcagcttccagtgaagcaaatgtaggatagtctaagaaaacgtgggtttttatctaggtttgaattatttataataaaatttacttacagattgtgagtaattaaaaggaaatcacacaatatttagtgctatctgactccaaagcttatcatcttgatcatcttagtttacaacttccttaaggcaataaaacacacagacacacaaaactgtagatacagaacacagagacaccaaacaaattgcataaaacacatttatttcataatacagttaaatactagtaaggataaattcatttaatgtaatatttaatactgagtattatatgaagttttagtaaagggtcttctgtgaaaacagaaatgaggagaaagtcataaatgagggaagctgcaatgtcagagtcaggctttgggaaagccgctacctacactggtcagatttcaggtccttgaatcagagagatggaagctgggaaaggcaaacgctgtaggcaaagcaggattcctggaagaggacttgaatgtgcagctcatggcctcagagggtgttaatctaaagacacacacacacacacacacacacacacacacacacacacacacacacacacacacggaaccagatgggaagcagggcaatctctgaaaggtgagagctgaatgatgcccttacaggttacaaaaagaagttaagaatcttggttctgatccaaagagcaatgggaacagctgaggagtatactttggtggttaaagtggagagaagtgccccggtgaggcttcatgtgagagaactagacaaagagaagtcaatcccagagaagtagatttcccagggccttgaggccttgggcccttaggcctttcctaaggctgaggtgggcagtctggaagaaagacacaggctaaagggaggttgtggcacagagccggcaaactctgagcacgcacatgggccaagaccaccagcttttaacagcagaaatttaaaaagcactgatgaatggcatgggatgggaaagaggtttacaatatggctggatccaaatggcagccagtgaatctatgggactcgccaccatttcagcatcagcatttaccagctctagaaccctacatggctaagtcaccccaagaacgcgtgccctacttactcatgacactgagaggaactagggaactctcctgaggagaacaactgcctaatgccaaaggtgccatctgcacttgttacatgatagagaaaaatgagattatctgaagcagaaccaatgaactgaatatactgaacttaatagtccttgtggtcatcactgctgtatactcaacagtctgcttctagtttaacaaataaaagtatgaaataaagtcatcagacgcaataggtaacctgcattcagagtaggtatcagcagggtgcactgattctcatactagagaaaaccagtacagagaaatactcacagattgaagtttcttcttagcagcttttgccaattcagacaaatccaggctgctaagaaaacatacaaagctaataagcaaataaataaagccagacttgtgaactctgtaaagtttaagacacccaagagataaaaatattaattacagttcatggaccatgttagaaccaagcattctacagcccagtagagtcagtgaggagctctaaacagaacaatctggtgaaagtaactccttctgaaataccacaatcatgtaagtgttaaagaggaaaaaaaaatcgtccaccaactaaacgacaaaagctattgccaggttaccttccaggcccttatgtgaggagtcacaatttttgaagtattaaaaaaaaagcatgatataagaaaatatgtcgggctcgatggctcccgcctataatcccagcacgttgggaggccgaggtgggaggatcacaaggtcagggttgtttttttttttttttttttgagatggagtctcactctgtcacccaggctggagtgcagtggcgcaatctcagctcactgcaatctctgccaccagggtttaagcaattctcctgcctcagcctccagagtagctgggattacaggcacacgccactgtgcctggctaatttttgtatttttagtagagacagggtttcaccatcttggccaggctggtctcgaactcctgacctcgtgatccacccgcctcggcctctcaaagtgctgggattacaggtgtgagccactgccctggcgaggtcaggggtttgagaccagcctggccaacatggtgaaaccccatctctactaaaattacaaaaaattagcctggtgtggtggcacacacccatagtcccagcaactcgggaggcggagacaggagaattgcttgaacctgggaggtggaggttgccctaagcctagactgcaccattgcactccagtctgggcgacagagcaagactctgtctcaaaaaaaaaaaaaaaaaaaaagaaagaaaagaaaatacaaggccagatatagttgctcatagggaggccagggcaggtggattgcttgagtcccggagtttgcaaccagcctgggtaacagagcaagaccctgtctctaccaaagcaaaaaaaaacaaaacaaaacaaaacaaaaagggaagatgtaaaagatcaggatggcaagattatatctggaatagcagttagtcatttcataaactcttgacagtttccgtgcaaaggtaacttgcaaaacaagggtttaaggatcattcctgtagcaatgaactcatctgctcttatagaccaggggtcagaaaaattatggccttctttttgttcagttgagctaggaatggtttttacgttttaaaatgtttgggggcaaaaagaaaaaacaatatttcataacgtgaaaactatttgaaattcaaatttcagtgtccagaaataaaatttcactggaatagacacacccattcatttatagagtgtccacagatgctttcatctacaacagtagagttaagctgttgcgaaagcggccatattacccacaaagtctaaaatatttattaattggcccttgagaagaaaagtctgccaacccctgtcatagataatgtaatctcctataatacagaagtattctgtaaataaataaatacaaaatactgtcacaactggctaaaacagtgacaatatcactggtttcaattttcctattagtaaaattgctacttgtgctctttgaaacttaagttttatatagtggtttacttacagccgtcttatttccaaatggtatagccataaaagagaaaaatgtatgggctttgttaaacacaaaatataatatacttaaacataatacaaccaaggaaatattagcgatagacaaaactaactggtatttcaatgagcttacctgtctgccatttgaggtattataaagtgctgtccatttttgtgatctgaaacagaaaccaagtcaaagttttgttcatagaaatgttgataagatctgtaaaggaacatcaccattatttcctcaaactaagttttgcgattagtatttgtgcataatgacgagtcatgttgctagactagctaaaaattcctgaagacccagctagtagtaaggctcatagccttgtttttttctggtacaaaggtccaggcatcatttagcagaaacctatgctcaccccaatcacgacgattagtttgccctcagtgtaactgacgatctttggccatggaaagtgtgctgagggagctgaatcagctcacagcaggtgtccatcagcccacggtgtgggacagtggatgagctctaggtcttgctcaaatgaatctattagtataaaacagctagggctgggacaggtggcctttgcagatccagacagggactccatctgcaaggaagcttactgactcagccctaatctagctcctggagaacactgatccatgtgccaatgaataacgccactatcagcactcctatgtaggtttttctttaacataagtctatctttcttctgggtaaagacccaggagtagaaatgctgggttatatggtaaatgtatgtttaacttggtaagaaactgccagaccttttcccttgagtagcgctatcactttgttttccaaacagcaatgtgagagttacagttgcttcctgtctttcccagcacctgtactttcagtttttgtttttaaaagtttaatcattctaataggtatgctgtggcatctcattgtgctaatgactaatcatgccacgcttgtcttcatgtgatttttttttttgccatcccatatcttgtctttgcccagtttttattgggttgttttcttactgttgagttttaattttaattaattaacttatttatttatttgagacagagtttcactcttgttgcccaggctggagtgcaatggcgcaatctcggctcaccgcaacctccgcctcctgggttcaagcgattcttctgcctcagcttcctgagtagctgggattacaggcatgcgccaccacgcccaactaattttgttttttcagtaaagatggggtttctccacgttggtcaggctggtcttgaactcctgacctcaggtgatctgcctgcgtcggcctcccaaagtgctgggattacaggtgtgagccactgtgcccagcttatttatttattttgagtcagggtctcactctgccccccatggctggagtgcagtggcgtggatctcggctcactggcaacctccacctcctgggttcaagcgattctcatgcctcagccacctgagtagccaggactacaggcgtgcactgctacacccggctaatttttttatatttttagtagaaacagggtttcgccacattgcctaggctggtctcaaactcctgggctcaggtaatccacctgcctaagcctcccaacgtgctgagattacaggcgtgagccaccgtgctcggcctgagtttttaaaattctttgaatattctaaatatgagtaatttgctggatatgtgatttccaaatacctgtatttttctcccagtctgttgctggtcttttcactttcttaactagttttctcagaacaaaacttttccttttttttttttttttttttttgagatggagttttgttcttgttgcccaggctagagtgcaatggtgcaatattggctcattgcaacctctgcctcccgggttcaagcaattctcctgcctcagcctcccaagtagctgggattacaggcatgcaccaccatgcctggctaactttttgtatttagtagagatgcagtttcaccatgttagtcaggttggtcttgaacttcagacctctggtgatccacctgccttggcctcccaaagtgctgggattacaggtgtgagccactgcacctggccaaaaattttcaattttgatgaagtataatttatcaatattttcttttatgcattgagttttggtgttatatttaagaggtttctttttcccccttgcagaggcaatgtcttgctctgtcacccaggctggagtacagtggcatagtcatagctcactgcagcctcgacttcctgggctcaagtgatcctcctacttcggcctcccaaagtactaggattacaggcgtgagccaccatactcagctgatagctaaaagctttcatccaagatcacaaagattttctcttatgttttctttttttttttgagacgcggtctcactctgtcgcccaggctggagtgcagtggtgtgatctcggttcgctataacctccgcttcctggattcaagcgattctcctgccttagcctcctgagtagctgggactacaggcattcaccaccatgcctggctaatttttgtatttttagtagagacggggtttcactatgttggccaggctagcctcaaactcctgacctcaggtgatccacccgccttgacctcccagagtgctggcattacaggcatgagccaccgtgcccggacctcttacattttcttctagaagttttacagtgtcaggttttacatttagatctatgatcctttctagtttcggggtaaggtgtgaggtttaggttgaagttcactttcctgcacatggatgtccggttgtcccaatgcattaaaaagaatatcctggggcgggtgcagtggctcatgcctgtaatcccagcactttgggaggccgatgcgggcagttcacgaggtcaggcgaccaacaccatcctgactaacacggtgaaaccccatctctactaaaaatacaaaaaattacctgggtgtggtagagtgcgcctgtagtcccagctgctcgggaggctgaggcagaagaatcacttgaacccgggaggccgaggttgcagtgagccaagatcccaccactgcactccagcctgggtgacagagcaagactccgtcttaaaaaaacagaaaacaacaacaacaacaaaaaactatccttcctccaccactgaactgattacctttgcacttttgacaaaaatcaattgaacatatttgtgtggatctatctctggattctctatactgtttcaatggtctatatgtctatctcttcatagatatcacagtcttgagaactgtacagcttcatagcaattctgaaaaattgggtgctgtacttccttccacattattcttctgcaaaattgtctgggctactctagttccttcacccttccatttgaatttttaaattattattattatttttggaaatgaggtctcactctgttgccaaggctagagtgcagtggcacgatcatggctcactgcagcctcaacctcctgggctcaggtgatcttcccacatcagcctcctgagtaggtgagaccacaggcatgcaccatcacacatggctaatttattatttgtagagatgaggtctcaccatgctgcccaggatagtctcaaactcctgggctcaagtagtcctcccgccgtggcctcccaaagtgctgggattacaggcgtaagccactatacctggcctccatttgaattttaaaatcagcatgtctatgtctaataaaaaatcctcaattgaagtaaatttatacatttattaacttgtggagaattgacatgttattgagtcttcatatccataagcacagtacatctctccacttattcaggtcttcattgatttctttcatcagcagtttttggcatatagatactacatgtattgtgtatttcattagatttatacctaagtatttaatttggagctttttaatttttttgagacagagtcccactctgtcgctcaggctggagtgcagtggcaagatctcaggctcactgcaacctctacctcacaggttcaagcgattctcctaactcagcctcccgaatagctgggactacaggcgcccaccaccatgcccagctaatttttgtatttttagtagagacagggcttccccatgttaaccaggctggtatcgaactcgacctcaggtgacccacccccttctgcctcccaaagtgctgggattataggtgtgagccactgtgcccagccaatttggagcttttattactggtattgcttttctagattcagtttccaattgctcactgctagtctaaagaaatgtgatggatttttggcagggtgcggtggctcacacctgtaatcccagcactttgggaggccaaggtgggtggatcacctgaggtcaggagttccagagcagcctggccaacatggcgaaaccctgtctctactgaaaatacaaaaaattagccaggcatggtggggggcacctgtaatctcagctacatgggaggctgaggcaggagaattgcttgaacccgggaggcggaggttgcagtgagccgagatcacaccactgcactccagcctgggtgacagagcaagactatctcaaaaaaaagggaaaaaaaaatatatatatatatatggatttttggctgttgaccttgtattcttgcaatcttgtttaactcaaggttctggaaacctttttgtaggttccttgtgattttctacatagaaatcatctcatttgaatggggacagtttgatttcttccttttcaatctgtatgccttttatttatttttcttgcctcttggcactggttaggatttccagtgtgatgtagaagagaaatggtaagagtggacaccctagtctttctcccaatttgaaagcaaacacagtctttcatcattaaatagatactgtttatcagatcaaggaagtctcatctattcctagtttgctaagagtttttttaaaacatgaatggatgttgaagtttgttgaatgcttcttctgcatcaactgatatgattacatagtttttcgtttttactgttaacttgatagattacattaactgatttttttttttttttgagacacagtctcgctctgtcgcccaggcaggtgagcaatggcgcaatctcagctcactgcaacctctgcttcccgggttctaagtgattctcctgcctcagcctcccaagtagctacatgcatgcaccaccatgcccagttaattttgtatttttagtagagacggggtttcaccatgttggccaggctggtctcaaactcccgacctcaggtgatccacccaccttggcctcccaaagtgttgggattacaggcgtgagccactgcacctggcctgattttcaaatattaaatcagtcttgcctatctggaaatcccacttggttatgttgcatttttctctatttttttttgagacagggtctcactctgtcacccagactagagtacagtggtgcgaacacagctcactgtagccttgacctcctgggctcaagcaatcctctcacctcagcctccagagtaactgggactacaggcacgtgccatcaggctaggctgatttttttgttgttgcagttttgtagatggggtcttgctatgttgcccaggctggtcgcaaactcttggcctcaaacaatcctcctacttcggcctttcaaagtgttgtgattaccactgtgagccactatgcctggtctgtattactattattattattgttattattagagatggagtctgactctgtcacccaggctggagtgcagttgcacaatctcagctcactgcaacctctgcctcccaggtttaagcgattttcctgcctcagcctcccaagtagctgggataacaggcgcccaccatcatgcccagctaatttttgtatttttagtagagacggagtttcaccatgttggccaggctggtctctaactccccacctcaaatgatctatctgcctcagcctcccaaagtgctgggattacaggcatgagccatcgcgcccggtctgctttgtatttttttttaattatccttccatgtctgtggggtttatagtgacaactccatctgtacactctcctttttgtcagtattgccagacatttatgagttttactaatccttctgaaaaaccagctttggtttcattgatttttcgctactgtttccttctttcagtttcattgatttttcgctactgtttccttctttcagtttcattgatttctgctctttactatttgctgccttctgtttggttcaggtttattttgctctttttttttttaaagtttcttaagggaggagcttatattaataatttgaggctaggcgcggtgtctcacgcctgtaatcccagcactttgggaggctgaggcaggcagatcatttgaggtggggagttagagaccagcctggccaacatggtaaaactccatctctactaaaaatacaaaaatgtgccaggcatggtgctgcatgcctataatcccagttcctcaggaggctgaggcaggagaatcacttgaacctgggagggggaggttgcagtgagccaagatcacatcactgcactccagcctgggtgacagagcaagacaccatctcaaaaaataatgatgagaatgatttgagacctttcttcttttctaaggtaagaatttaatactataaagtttcctctaagcattgctttggctgcatcccagaaattctgatatgctgcattttcattttcattcagtggaaaatattttttcccttaagacttcctcttagatcgatggattagttagaagtgtgttgttcagggccgggcacggtggctcacacctgtaatctcagcactgtgggaggctaaggtgggtggatcacctgaggccaggagttggagaccagcctggtcaacatggtgaaaccccatctctactaaaaatacaaaaattagctgggtgtggtagcacgtgcctgtaatcccagtactagggaggctgagacaggagaattgcttgaacccaggaggcagaggttgcagcgagccaagattgcgccactgcactccagcctgggcaacagcgcgaggctctgtttccaaaaaaaagcagcatgttgttcaacttccaagcacttgggtattctccagttttatttgtattacctatctgtagcttaatactattatggtctgaaaatatactttatagaattttaattcttttagattagctaaggtttgtcttatgacccaggatatggtctatctgggtgtatgttcaatatgtacttgaaaagaatgtgtattctaatgttgtcaggtagaagagtctataaacatcaactagatctagttgggttttggtctggtttagttctatatccttactgattttctatctactagttctatctattactaaaagatgagtgtagagtctccaacaataattgtagatttgaccttctctccttttagttctatcaaagtttgcttcatgtattttgaaggtctgttgctggatgtgtacacatttagaactattatgccttcttgatgaattgactcatttatgataatattatgtccctctctatccgtgctaatattccctcctctgaagtctactttgtctgatattaatatagccaccctagctttcttttcctgagcctttacatggtatatctttttatacttttggtttttaacttattacctatattgttatatttaaaatgggtttcttgtagacagtatatattaggccttatggttttttgtttatttcttgaggcagggtcttgctctgttgcccaggctggagagcagtggcatgatcagcactcactgcagacttgacctcctgagctcaagtgatcctcccacctcagcccctcctgagtagctgagactatgggcatgcaccaccatgcctggctgctttctataaaattttttgtagtgaaaggatcttgctctgttgcttgggctggtctcaaactcctatgcttaagcgattaggagaattgcttcaggctccctgaagtgttgggattacaggtgtgagccatagctcccagccccttttgttttttaatccattctgagaatctctgcttttcattgatgtgtttgggtcattaacatttaatgtaactattgatatgtacggacttaagtctataatgttattatttattttctatttggtccttagttttttgttctccccctcctcttttgaatattttgaatcaaaatatcttttgatgatttgagtaatttttaatactccattttcatttacctctagcatttttgatcacatatctttgtagtctttttttttttttttttttagatggagtctcactctatcacccaggctggagtgcagtggcatgatctcggctcactgcaacctctgcctcccgggttcaagcaattctcctgcctcaccctcccaagtagctaggactacaggcacgtaccaccatgcctagctaatttttgtatttttagaagagacagggtttcaccatgttggccaggatggtctcaatctcttgacctcatgatctgcccacctcagcctcccaaagtgctgggattacaggcactacaccgtgcctggcttgtagtcttctttcagtggttatggtagaaattactatacacacacacacacacaaacacacacacacacaacttttcacagtctacttagaaatcctattttacatttccagtagaaggtagaaatcttaccattatattttttaccctatccccttttatattatagttgtcaaatatattacactgatatatgctgaaaaccctactagataatttttttttttttttttttgagacggagtctcactctgtcgcccaggttggagtgcagtggtgcaatctcagctcactacaagctccgcctcccgggttcacgccatcctcctgcctcagcctcccgagtagctgggactacaggcgcccaccaccacgcccggctaattttttgtatttgtagtagagacggggtttcatcgtgttagccaggatggttttgatctcctgacctcgtgatctgcccacctcggcctcccaaagtgctgggattacgggcgtgagccaccgcgcctggcgttttcttttctttttttttttttttgagatggagtctccctgtcgcccaggcaggagtgcagtggcacgatctcggctcactgtaacctttgcctcctaggttcaagtggttctcctgcctcagcctcctgagtagctgggtttacaggcatgtaccaccatgcccggttaatttttgtagttttagtagagacagggtttcaccatgttggtcaggctggtctcaaactcctgatgtcaggtgatccgcctgcctcggcctgccaaagtgctgggattacaggcttgagctactgcacctggctgacaatgttacagctttaagatatgtatgacaatttcaactttttgtttgtttcttgagacagggtcttactctgccacatctttaacatttctgttgtttttctttcattcctaaagttccaagattccctctggcatcatttcccttccacccaaagaactttctctagcatttctgttaaagtaaagaataattcttttttttcctgttagaatgtccttattttgccttcattccaaagttattttcattggatatagagttctgggttcacagctcttttcttttagcactttaaaagtattgtttctaccatcacaaagaagatgagaaaaaataataataataaaaaaggagcagtggctcatgcctgtaatcgggaggcccaggtgggtggattacttgagctcaggaattcaagaccagcctgggcaacatggtgaaaccccatctctacaaaaaatacaaaagttatctgggcacagtggcacacacctgtagtcccagctactgtggatgctgaggtgggaggatcacttgagctcaagaggttgaggtttcagtgagtcgagatcacgccactgcactccagcctaggcgatggagtgagaccctgtctcaaaataataataataataaaagtattattctggctgggtgaggtggctcatgcctgcagtcccagccctttgggaagccgaggtgggcggatcacgaggtcgggagttcgagaccaacctggccaacatggtgaaaccccatctctactaaatatgcaaaaattagccgggcatggtggcaggcacgtgtaatcccagctactcaggaggctgaggcaagagaatcgcttgaacctgggaggcggaggtttcagtgagccaagattgcaccactgcactccagcctgggcaacagagagatactccatctcaaacaaacaaagtattatttcatttccttctcatctctatggtttctgataagaaatccacaatcattcaaatcactgtttttctatatatgttatgtgtcactttttcctggctgctttcaagatgttttcttcaactttagttttcaacagtttgattttgatgtgtctcaactgtggatttgagtttatcttctttggaattttctaagtttcttgaatctgtaagtttatgtctttcaccaaatttagaggttttttttttttttttttttttttgagacggagtttcgctctgttgcccaggttggagtgcagtggctcaatctggactcactgcaacctctacctcccaggttcaagtgattcttgtgcctcagctacctgagtagctgggattacaggtgcgcaccaacatgcccggctactttttgtatctttagtagagatggggtttcaccatgttggccaggctggtctcaaactcccaacctcaaatgatctgcccgcctcagcctcccaaagtgctgggattacaggtgtgagccattgagcctgtcccaaatttagagggtttttttggccaatatttcttcaaatacgttttctgcacacaccactctttctcatctcttattgggaatccaacgacataaatgtcagacattttagtattttcccacaggtccctgagactctgttcagtcttttcttcctactcttttttcctctctgttgcttaaaccagataatttctagtgatctgttttcaattcattgactttctttgtcatctctattcttctattaagcccatccagtaagttttaaatttttagtgtttgtatttttcagttctaatattcctatttggttctcttctgtatcttctatttctctgatgggactttctatattcctgtttgtttcaagaatgtttgcttttacttcttatagcatggtcttactagctgctttaaaatctttgtctgataacgccaacatttgtgtcatcttggggttggcatctgttggctgccttccctggcaagtacatgagaattactcagatgtcaagtcattatggatgatatcctagacactgtgaatgttttgttatgagactctgggccttctttaaactttatgcaaaaatgttcatatttttgtcttagcaggcaactgaccaggtgaggttctgcctcctgggcagatggtgagagaatagagagaaaaagacaagcaatcaggatcccccctcatccccttgctcagagatttaggaacctgtgctgccactgctgctgctgctattgcagccacaggcttgcctaggggctggatgggagagatcagaaaaaggaaggaggaggaggaaaaaaccccaggggaatccccttcctctctgtcctgtagaagtcccatttcctgctctttaaccagaaaaaggctttttttttttttttttttttgagatggagtctcattctgtcacccaggctggagtgcagtggcgcaatcttggctcactgcaacctctgcctcctgggttcaagcaattctgcctcagcctcccgagtagctgggactataggcgcctgccaccatgcccagctaatttttttgtatttttagtagagacagggtttcaccatgttggccaggatgatctggatctcctgacctcatgatccgcccacctcagcctcccaaagtgctgggattacaggcgtgagccaccgcaccccgcagaaaaaggcttttttgcactcattatgtacctccaggtttcaggctgtcattgaagtcctatcagaagtaagacaaacaggacactcaccaccagctgatgacacttttgagttccctaatctaccaaccaggatttacttttcagagtctttagctagctactccaagcatttggtccaggtctgttagttctattttgcaggagacacggtggggtgtgcttactccatctcacccagaactgaaactataccagaggctcttaactctatcatacaaccaggatggagaatcactgcatacatgtatgtgaatgttgtacatcaggggttggccaatattttctttaaagggccaaatagtaaatattttaggctttgtggccatctggcctgttgcaacgacttaacctattcaactctgctgttgttatgtgaaagcagccatacacaaggtataaataattgggcgcggctttcttgcaataaaactttattcatttattttttagagagttgggggtcttgctttgtcactgcacccaggctggagtgcagtggcacaatcatagctcactgccaccctgaattcctgggctcaagtcccagtctcccaagtacgtgggactacaggcgcacaccaccatgcctggctgattttttaaaaaacttttttgtggagacggagtctcacccctcttgcccaggctactttcgaattcctaggtgcaagcagtctttctgcctcggcctcccaaagtgctaggattacagacatgacccgttgcacccggcagaagctttatttatttatttatttatttttatttatttattttgagacagagtctgactctgtcacctaggctgaagtgcagtggcacgatacaaaactttgtttaataaaacaagtaactggctagatttgggctacaaaccatggtttgctgacccctgttccctatcacaaatagccaagttggctttggcaaagtttacttctggactttttttccattccttaagaagaatttttcaaataactacaaaggttattgctttgctcctacattcctagtcccaccatgttcaagaactgtggtacccattcaattttgctttgattattcagtctgattcttgaaatagtcatttctctagagctattaaaaatgaaaaatctaaggagttttgtccaactttatatcttttacatgtaactgacaattctgtagttatcctttcaaattaaaagccatatgtatagctttctcagtgatatgttacagcagaggaggtaataacaaatagtgtcccaacttgtttttctagaaccttcccaactggagatgtgaaacggtcattctccatccactcacctggtttcctgccacagagatagaaggctagtctgtccgttagctcatactgtatttccacgaggcgctctgccagctcatggtgccctccttgcctaccaagagaaaacaaagtaccatttatattgctcactattcactgactttaaaatggagtacaaagacgtctcctgagacacctgagcagtttatcacacaagacttttgagaatcatcaaccttcttgtggtaggtagatttctgaagtctactttgcatcccacttttataaactgttttcaccatctgaactatcgcctttcctttattaaggccaaaatagaatatttaataagaaattcaaagacttatgagagggaaggatacagaatgacttaatttaatgaggtaaaaaaatgaaattaatcaatggtttacggtagaagttctcaaaaattaactagcgcatttctagaaatataccatgtgcaggccccacccttggaaattctgaatcaatggggacaggatggggccaggggccaatatgttgaagaaggtccttcccctaggtgatgctgatgcagccagtctgactctggataagagtctagtaaccacttcaaaggcttcaaatcagtgagagacacgccaacctaacgcacagctcacgcctgcagctacttctgcctccttatcttcaatttgcacaacagaaaatattaagtttacctttcaacatccatgaaataaatacttaggctgcttagaatcctttcagcaacaaggatacaaattatattgagattattatatgcaaggtacaagtgcgaaaattccaaggtaagtgataataagtatcatttacccagggctctcgtccaagatcaagtatattttgtggtttttgtccttaaaagtaatggcaaaaactgcaattacttttgcaccaacctgatagtttcagccagcttctctccccaccattcaaggcactcacaacacccttcaacctaccacacagctttgatttgtgagaggcacatcttattttcattttttagtatctgtgaaatcaggaaatgtcctacaattgatgatacaccataatttaattggctgaactcttttcttttttagtgctctgtgaaataatgaagcaccatgcaatactgtactcctgctgttattcccagacccactctgttctttccagtcaggtctcctgctgtgctgaacacactttgtccctccctgcctcctgatcttgactcctgcctttcctcttacctggaatgcttcagctctcccttcacacattcaaatccaacccattcttcaagaccagctgaagaaatttcttaaatgatttggaccacaatgaagaaaccctatatatgctttttaagaccaattatctattttggcaatgaatcccatatggtcttgcctccttgaactctttcaggcatttatgaatcatcttttccaagagagtaaattctgggaaggcagagttttgttattcacccattttatcctctgtggaacagagtattgtgcttcacagttaataaaagtactttggaaaaagaaggaaagatgactgatctttggccatttaaatgatattcaagactaacctatagatttatttttcaaggactttattaataaagaaaaatttaaataattttacagtgagcacttttttttttttttttttttgagacagagtcttgccctgttacccagattggagtgcagtggcatggtctcggctcacagcaacctctgcctcccaggtttaagtgattctcctgcctcagcctcccgggtagcgggattacaggtgcctgccaccatgcccagccaatttttttttttgtatttttagtagagacagggtttcagcatgctggccaggctgatctcgaacttctggcctcaagtaacccacccgccttggaccctcaaagtgctgggattacaggtgtgagccaccatgcctggcctagagtgagcacttagatgtctactacccaaaccttacaattaactttttactatacttgtttaatcacatatctatgtatatatttgcttttaagttcaagaaataactaagagtattaaaaaacagaagagtacattctgtaattcttgatacttgatttggaatctgactacagctcaaacatcactgtgttataaaggatcaagtaaaagactggaagcttagcacactggttcatgattctagccttcctcaactttgccaggctgagcttatatgcatttgaaatgtcttcatctgtaaaataaaataacgtacatctttaaaggggttcaatatcaacatatacaacttagctacttaacaaggaatcacacccaacaaaaaaatcccagagagaagtagcgagaatctaggtctcttaccttgcataatcaacgggagttttcccactagaatcctgtgtgcctgggtctgctccatatactgccaataattcagcctgtaaaatctgccctgctttggaggcaacatggagtggggtgtttcctttttcctaagaatcattaataaaaagtaggcaaaagagcacattaaataaaggctacatgaacacaactcacttagtttcaatatctgaagcaattcatgttttcttacaggatgaaagaagttggcttgtgctcctaaagataacagtctcaaacaggtttcaagattccctgttctcacgctcgaatggagttgctgaaaaacgcagaaacaaaaaaggaatcgtggttagaggtgtaaagaatgatgtcctagggcagctgatagaccattttaatatatgttacatcagtaacgcataatctttatttgtctcggtaaagtgcatggaccagtctctcctttgccagtcacaactgtccctgggctgtaaggtggagtgaggccactttactgataaggaaactagggctgtgaaggctgacttgcccaaatgcatgacttatctaagaagtggcacaaccagaacctgagtgagaggcaggactgtgtgaagaggtgactatgcgtggctctgacatacgacagacctgaatttcaaactatacccacttcaagctgtgtggcctggagaaagggctttaagcaatctgaacctcactttcctcatctcaaaaatgtcaacaatggccagatgcagtggctcatgcctgtaatcccagcactttggggggctgaggttggaggatcacttgagcccaggggtttgagaccagcctgggccacatagcaagactctggctctacaaaaaatacaaaaattagttgggtgtggtggcatgcgcacctgtagtcccagctactaaggaggctgaggtgggaagatcacctgagcctgggcagtggaggctgcagtgagctgtgatcatgccactgcactccagccttggtgacagagcgagaccctgtctcaaaaaaaataaaaaataaaaaaaattttaaaaggtggcatttttctttttagaaagggtctcgcttgctctgtcatccaggctggagtgcagtggagtgatcatggctcactgcagcctcagtatcctgggctcaagcaatccttccacctcagcctcccaaacagctgggactacaggcgccggccaccatgccctgctaactttttatttttcaatacagatgaggtctcactatgttgcccaggctgatctcgaacttacgagctgaagtgatcctcccacctcggcctcccaaagtgttgggattacaggcatgagctaccgtgcctggccctattcacagggttattataaggatttagtgatataataaagtgctcaaagaatacaaatgctataataacagttattattattagttgttactgtaattagggctttaggacttcaaattctacactgtgtaagctacaggatcctgccttatacaataccctctctaccacattattcttggcctgtataatatgctttaataaagtctttcagggtaggaaaaggcccgtgatataccgaattctgtactactgcagaaaagctcttatacagtcagaagatgagctgccttccttcaaatctaacctagaattgtccaagatgcagtaacccttatcacaggaatgaagaaatctactctaacatctaagtttaattttttaaatagtttttttgttttttaaacacagggtctcgttatgttgcccaggcaggactgaactccttggctcaagcaacccttccacctcagcctcccaagtagctagtattacagggatgtgccactgtgcctaattttttaaaactctggcaaggaaaaaaaaacaaaaaacaaaaaacccaacacataccaagtcttattaatcaatggaagtagctagtatatgcatttctatgcaaaatttcaaattctgaattcttcagccagattctgctggggattaaaaaaggggggggaaaaaaggccagatgtggtggctcacgcctgtaatcccagcactttgggaggccaaggcaggcagactgcttaagcccaagaatttgagaccagtatggacaacatggtgaaaccccatctctccaaaaagtcaaaaactggccaggcgcggtggctcatgcctgtaatcccagtactttgggaggccgaggcaggcagatcacttgaggtcaggagttcaagaccagcctggccaacatggtgaaaccctgtctctactaaaaatacaaaaaaaattagccgggcatggtggtgggcacctgtaatccaagctactcaggaggctgaggcgggtgaatcgcttaaacccaggaggtggaagttgcagtgagccgagatcgtgccactgcactccagcctgggtaacagagactctatctaaaaaaaacaaaaacaaaacacacacacacacacactagccaggcttggtggcacatgcctgagatctcagccacttgagaggctgaggtgggagaatcatttgagactagggaggttgagggtgcagtcagccatgattgtgccacgacactccagcctgggcaacagagtgagactctgtcgtttaggctggagtgccgtggcatgatctcagctcactgcaaccttcgtctccccagttcaagagattcacagctgaattctaccagacatacaaagaagaacatcctactaaaattattccaaacaatcaaagaggagagactcctccttaactcattctgtgaagccaacatcagcctgataccaaaatctggcaaagacacaacaaaaaaggaaaacttcaggccaaaatccatgatgaacacagattttttaaaaaactcttaacaaaatattagcaaaccaaatccagtagcacatcaaaagttaatccaccatggctgggcgcagtggctcaggcctgtagtcccggcactttgggaagctgaaacaggcggatcatgaggttaggagttcgagaccagcctggccaacgtggtgaaaccccgtctctactaaagatacaaaaaatggccgggcgtggtggcttacgcctgtaatcccagcactttgggaggccgaggtgggcggatcacgaggtcaggaaatcgggaccatcctggttaacacagtaaaacctcgtctctactaaaaatacaaaaaaattagccgggtgtggtggcggacgcctgtagtcccagctactcaggaggctgaggcaggagaatggcatgaacccgggaggcggagcttgaagtgagccaagattgcgccactgcactccagcctgggccacagagcaagactccgtctcaaaaacaaacaaacaaacaaacaaacaaaaaaaaaccaaaagattagctgggcctggtggcacgtgcctgtaatcccagctacttgggaggctgaggcaggagaatcacttgaacctgggaggcggaggttgtagtgagccaagatcatgccattgcactacagcctggactacagagcgagactctgtctcaaaaaaataaaaaataaaaaataaaaataaaaataaaaaaattaacccatcatgatcaagtaggcttttttgctgagattcaaggctggctcaacatacacaaatcaataaatgtaatttgccacatcaatagaagtaaaagcaggccaggcgcggtggctcctgcctgtaatcccagtactttgggaggccgaggcgggaggatcacgaggtcaggagatcgagaccatcctggctaacatggtgaaaccctgtctctactaaaaatacaaaaaaaattagccgggtgtggtggtgggcacctgtagtcccagctacttgggaggctgaggcaggagaatggcatgaacctgggaggcagaacttgcagtgagctgagatcgcaccactgcactccagcttgggcgactgagcaagactctatctcaaaaataaataaaaataaataaataaataaataaataaatagaagcaaaagcaaaaaccacatgatcatctcaatagatgcagaaaatgttttctttttttgagacagggtcttgctctgttgtccaagctggagtgccatggtgtaatctcagctcactgcaacctccacctcctgggctcaagtcatcctccaacctcagcctcccaggtagctggtactacaggcacggccaccatacccggctaaaattgttatattctttgtagagacggggtttcgccatgttgcccaggctggtcttgaacttctgagcccaagtgatctgccagtctcagtctcccaaagtgctgggattacaggagtgagccatcgcacccggccaaaaagtaataaaaaaagttctgaataagtaagttctcatgctctgtgtgagtaagcatttatccaaggcagcgctttgaaaatatgcacatttcttacagcatctctcaaaaacatgcgaaggcccacataaagaaaaccacctcactcgttttacaagtatcataaaccattctgtgtactatagctttgagtcacacattgctttctgaagatcatacttactgttcaacctggaaacctgaagaagtccccttcctttagtactttttctagtccttattaaaaagaaacaattgtcctataatctttctagtcccttctagaaacaactctgagatggttcctatttcaaagttaaacaaacaaaaaacttatcaaaatataatttaaaagccatattggaaaaacacaaacagccttccagagacttacttttcctctttgccctgaacctccactatatgaatggctgccatttgaattcagattaaagacgaaaccgactgacaaaaaagctattaattaatgaatgtgcagaaatgagtttttgtttttctttctttaaaaacttttttcagcctgggcaacatagcaagaacccgtctctacaaaaaataaaaaatattagctgggtatggtaatgcgcctgtagttccagctactcgggaggctgaggtggaaggattgctagagcctggatggtcaaggctgcagtgaaccgtgattgcaccactgcactccagcctgggcaacagagcaagaccctgtctcaaaaaaaacaaacgaaaaacaaaaaaaccctggccgggtgcagtggctcacgcttgcaatcccaacactaggaggccgaggcagacggatcacctgagctcaggagttcgaaaccagcctggccaacatggtgaaaccccgtctctactaaaaatacaaaaattagctgggcatggtggcatgcgcctgtaatcccagctacctaggaggctgaggcaggagaatcgctggaacccgggaggcagaggctgcagggagccaagatcgcgccactgtactcccgcctgggtaacagagactctgtctcaaaaaaaaaaaaaaaaaaaaaaagcccacaaccagacttttttttcgttttttcaaataaaacaatatgctgtctcagcccgctcttttagggattttaaaaggtgtgacccaccttgctaagatctttggcagtcacactatcgtcatcccggcagggcaagcgatggacgaacgctaacatctgatacttggctctgatgaattccgctttattgggactggttcaaaaacaaaaaagaaaacagttcactcgttcagatacaacaatccccattctttgtactgtaaaaagaagaggaagtgacccacatcccccacttgagaataaaatgaacaatgctcaagtaagtttcagcaaggtttaagacctgcagtttgaaaacatacattagttattataatggctgggactccagagtacctgctttttatagtagccctcttctctgtgtaattgtctgaactgatttagcaactttgggagaaagcagcatttagtcccatcttataagtgaggcaacaggcagacgggtgcccagacctagatttctggtctgatcgcctcttatttgagtataagtttaaatctgattacatttacagactccaagccatggtttccaactgaggaagccacttactcctgctgggtggccatgctaaacagatggtcctgccccaccccattctgcatttctaatagcaaagaacctgatgcacaactagggtaaccccctcctctgctgcccttgcggagactgaccaaaaatagctgcactcctttcagtgggccccatttgttatgaagaaataaaagtatttataaacattccactcactgtactttatcctgtggattagctttacgtcttccactcataatagacgcagggtccagcaaagaatgctcccatatagagttagcaccgttattatacaaggtctcaaccatctaaaaccaagcaggatgacataagactttaatttcttttcacaaatattcaatggggatcagtgactgaacagagtaaacaaagtcctgttataaacactcatttgttaggaatatcattcatatcattgttttctgatttgagaatgagaaagatgatcaatctatatgcaggattcagctttgactagtaggatagttaaatacctaaagtgtgactgaactgttcttattctgtatgaaagaaaaaaaagtactctgacaccttagagcagggtttcccaaacctaattaaacactattttcaacattcttaatgacccatgtactgtctatattattcacttaatatttgtctttaaagccacttacttgtaaaaacaactacagtttgatgtgctagttatagctttcccatacacagtaaaataatgtaaccattaaaaaaaacatgtattacctacatctgtcttgaataccactggtggttccacatttggggaattgttgctttagggtcaaccctggcattctaaacaactcatctctggactttactgagactctgtactacaatctggctttgcaaacacagacagacctgagagcagtaaacagcccctttcacatgagcgtgagcggttagaaacttctaagcaaaagttagtaataaatcatatctccaaatttcatttcaaggcatgactcctaaaacagccccatctgttttttacagcagtgtagttattttcacatcagagatacaaacccacttgttttggctccttggttcacacagccaagtttaagggatatgtgcagctgtcacagattcagtgaaatgtgtaatcaagacaaatgaaggcaaaacacacacttaaccttgagttccaagagaacttgaagaatgtgtaccccaagatagaagtaaaggtgacatgacattggactccagataaaacaaagaactcatttaacagggtattctacatgcaatcaaaacatattaatttaatttggtctctctgactagtaacaagagctttaagaaaacttaaaatgtttcagaagtttctgaggaatcccagcccatgctgctatcaaagcagaaaaacatgttctaaaaatattagcaggtactcaggaataagtacattaaagaaaagattctcaggcagtagccttcagaaacattcattatcatgcatagaaaagatggactactggccgggcgcggtggctcacgcctgcaatcccagcacttcgagagaggttgaggtgtggatcacttgagttcaggagttcgagaccagcctggccaacatggtgaaaccccttctctactaaaaatacaaaaattagccgggcatgatggcgggtgcctgtaatcccagctacttgggaggctgaggcaggagaattgcttgaacccgggaggcggaggttacagtgagctgagatcacgccactgcactccagcctggatgacagagtgagagtccgtctcaaaaaaaaaaaaaaaacatttccgatgacagtctagaaagtcaacagagcaacagtaccaagatattttaatgactattcatctatctacctataattgagcttgttgaacaagatttatgtcaagtaggaagaaaagtctttactgaattcaatacagataatatttgtaaatagcattgatgggcatgccatctctattcaattatgaaacagttttgtcttatggaagaagtacaccaggagaaatttaagttattaacatgatgagccctaaaatgtaaattaccaactgtcaggagaattcttatcctttacctgaagcagtgttggaggccacggtgtgtgtttcagatgcctcacttgggagatatggcgccctagactccgatggacactgcagcactcatcacataaaaacgttcccctatttactgatgcccaggaaggatctggaaagagagtgaaatctcagtggcagggataccagcaggttgctataccgccagatggcaaaagatgactgaagtttggtttgtcagaaaaaggagacatttttgtttcagtatgctcatcaatgcatcaggctggtcatcttgttggatggtatgacctaccttggctgattaggtacaatgttaattgagactaaaaacaccagtgggagccttgggtaaacagttatcttctttctggttcagggccacagtttgtagccctaatgtggatctaccatttcagatgcatgctttttcattcaagctaagaaagcaaattgagagggtacagacgaatgattttggatccatctccataaaaatcaagataatacttttttttttttttttttttttttgagatggagtctcactctgtcacccaggctggagtacagaggcacaatcttggctcactgcaacctctatctcccagattcaagcaattctcctgcttcagcctcccgagtagctgggattacaggcatgcaccaccacgcccggctaatttttgtatttttagctgagacggggattcatcatgttggtcaggttggtctcaaactcctgacctcaggtgatccgcccacctcggcctcccaaagtgctgagattacaggcgtgagccactgtgcccggccaagataatataattttgacagtgaattatgcagatagcattttctgcagtaaatgttgtagactgctgtcctaattcactgctatgaatcaacatgtcaatatgcttagcagaaagctgcgagttacagaatcataaaatcactcagctgctatggttctgaggacagggaaacctggcctcttccattaggaaatgttctatgatgtccatgaattggtttgtttgtctgtttgtttgttttgagacagagtctcactctgtcccctaggatggagtgcagtggcgcaatctcggctcactgcaacttctgcctccagggttcaagcgattctcctgcctcagcctcccgagtagctggaattacatgtgtgtgccaccagctcggctaatttttgttatttttagtacagacgaggtttcaccatgttggccagactggtctcaaactcctgacctcaggtgatccactcacctcgacctcctaaagtgctgggattacaggcttgagccactgtgcccagccaattaattgttttacataaactaccaagtccaatcctgcaactgatctgaaaaaaaaaaaagaagttgcaataacagcagcttcacagaggcaaagatgtaaaataaaaatgaataatatttttagtgtgtgtataatacttttttccctttaaagtcatagagcttcattagctgtcctttgaaacaaggaataatttcatacttggcaagcaggatggatctgggtaagtaaactgaatacctagaaacctcaaataaagaaagagctatacttcgtcagactcacaatggggtgacaataggtgccacttaagctgcctggtcaaagggttacatttaaaaattcttcaatgtccacaaaaatctctaaaatgcatgtacaccatctttaccattttttaagagtttattcaaaccctttcaaaccatataatgaaaagttatgggctttcaatcaaagacgaatcctgggagccagtgagtatggtggttaagagggttggctctagagacaaggagttcagggtttgaaccccaactctgccacttcttgcacaatgatctcagacaagttacttgagtgttttcaccatggttcaaatgagaacaatgacaaatctcgggatagtaaggatatagagaataagtgaagtacctcacacatagtaaagtagtaatgttagttgttatatcttttctaaattattttctcagtattcagatattttctagacgtgaaattcatgatcactggacaaagtttttgatgggaaatacttaaaacattgaacatttcatgtgaccactctactactgtactgaaaatctccatggagttttcaagtaattgaactcagagtgtgatgtatttgaaatgaaccagattcattaaaaaaaaaaaagtagaatatttaagaagatgtgatcatggttaaatgtttgcataaaataaaacagaatcaaaataattcaatttagtataactctgtcgctattactgtatcatcctaaaaagcagagattggaaatgtccagatgaaggagctctacaaagatgcattaacaacactgcttcctgcagtatagtactgacactaatggcaaaaaaaaaaaaaaaaaaaaaagactgttttgaagcatagctttggttttcacttattcagaggatttgcagtattctttttttagcaagtatttaacacatattaattaagacaagtattcgactaaccactttagcatcctggatcagaatcccatggaaagaatattagaatgttaacatagtaaaataaaaatgtttgtatgaatgagattgggtaaaaccctttaagttcatctggagccagggctccagggacaccacaaatgaacttcaaaaatgtttgtgactcccccagacaaatcttaggtaaattcgttcacgtgcattttaggggagaaggccttagcattcaacagaatctcaaaggggtccctaaccctacaggtaattctctcagtagggctgtgcagaaaaggcagcacaaattcccagctgctcaatttcacagaatatttcaaggtagcctaattatattcaaaacaggaaggaagtgactcaagtctctgcagattaggcgtatgagacaacaactaaagcgatacaatggaagagaaaatgttctgaaatgcacaaaatgctgcaaaagtatatttaggatggcaatggaggaacaattttgctttgccctgtaccctatcaagaagcaaaacaatatgcattccaagaggaagttagaagctagacacatgtgaatcaaatacatcacggtaagttcaactgaaaataggcaagaaaataaggaagtggaacaaataacatttttagagaaaatgatggagtttgtataactcacactaacttggtttagaaaacacttctttttaaactcctccataccccctccctatcttcaaaggaaactggtaacacctgcactgtacgggccataaaacaaccacatgaggtttgagttatcacagttctatttacaattggtctccacttccaaatgacaagcttaagatcagaacagttgcaaagccagtggtgttcaatgatttaattaagattgtttatcggacactattgtgccaagaaagccatgttaccttcgaattaactcaaagccaatacatccaagcacctaaaacagcatgtaataatctatccagagacctgacaattcagttgcaattgctaagacacacttgatctctaaatgtgaatattatgtatgaacagttatgcatcattatgaaggaatggctttagcgtttcaatgcccctatattgctggtgattttgcgtttgtttccgttgtaatcaacgtatgatttagatagtcaaatatagctttaagggactacaagagttctactgtagacagcataatgcaaaaaagaaaagccttagatgatatgattctacgagtattcattgaatcttcctcaccactaagcgtgatactcccgattatcctcattgaaaaaaatgaggaaatcaagcaagtgaccaagtgaagtcaccagcccaaggtcagccagaagcaaaatctagtttgaacccaggccgttcagatcctcaaacttgagacaagcactgcctcctaagtgctggttgtgtttggaagaccccgatctcctggcaattctcccgggcagagtagctgtcggatgtcagcagcggggaagtcatctacggggaccctctggcgagtctcagggagtgtcatcctccccgggcaggacacccaggcggagaaagggtctagtgggaggtgacacctgcagcctctggaggctgcagccgggaggacgctcacattttacttctgtaattggctttcctgtggattgcccaagccccttcctgttgggggagcagccctggcccccgtcacctccccagttggcctaggacggagggaacgggagggaacgagagggaagggagggccgcgagggacggggagggcggcggccccctgcccgcccggctctgacaggcccgggacggttcccaccccaaggccgcccagggacctcttcgttgcgaccctagccgcgggatgcagcctgacctgagggggcggccccggggtaggggtccgggccaggaaagcagaggggagcgggcccggccggtgcgactcacccggcccgctgcagtcagcgcacacctcgctgctccggagccgtttcgacatggctcccacctcccacctgcggggaactagaggccgggggacagcaaaggcggcggtggcggcggcgcttccgctctaacgggtcccagctgcggcggcgctgacggcggcgcctctcccctcagcgccttgcagccttggcacagcacgcacgcgcggggaggt

SEQ ID NO: 1648 - DNA, 48329 bp, Homo sapiens
attatgatcaacaagtttttattacataatactcttgatattccaaacaattcagcactttgtaaaaaaaaaaagaaaaaagagaaaaccggatcatggtaagtttgctatattaacatatcacgaagaaaactggaaacctattgatctatggaattgacatcttcgcatggatgctccacgcagcacgcttgcttccgtctggtgagtgatcatctttcggccagggctggaatatttggcctttctctcctttggctttgtcacccaaaaaacacgacctcagtggtgtcagctttgaacatgctaatctgcctggcaccaccccattttagagactgtcacttggaggccctgaatgctccttccattcctcacatgcaggctgctccatggtgctggatggattagagttaaggggtcagcagggaatcgtgttactctttggcatctggcattttaaacaccattcaccacgtccattctgcgcagggtccttcccttctggtgcgccttcatcttccatggacattctataagctgggtgtggtgtgagttcagctgtctactctttgacagagattgtaaaatctgaccaaattccccaccagtgccaaggtttaagtccacaagcaactgtttgcaccagaagatcattactttttcagtagcaaacccattcaatgttaggagttactttcaatttttatttagaaagcaccaatctgtgaaaaatacaccaatagtagttgctcctcttcattaattagcatcttttccaagcaactgttaaatgtgaaagatcagatacaaatcatgctactttgtcaactttatgtatattaaaaactttacccaactttgaaatataatcaatacatctttgctaaataaacaaattccatatactttatattaatcatgccaaactgctgtgaaagtgtgacttactgcctcttccacaaaaagaccactcattctgtttctctgaagagcaagccattacagaatgatagaatgcttttatatcacaaaggctggcagggtatagctcatatctgcaattccctttccagggaaagaacagctgcaaagcagctgacaaagcagccctgaacatttctacattccaggatacagacaggcatgaagtgcctgttgaaactattcattagagaacccagggcctagagtgaaatggtcaaggttcaaggactgaggtgtgtaactgacacaggtccctcaatggggcactggtgcatgtgatcacgtgtttgtctgtataaaaagcctctgtggcagttatttagttaaggccttgaaatctgaaactttatcctaacacttttcatgcctggattttgtctgaatgtgttctcatgagcacaagttcttggtttcaatttttaaaaatgttagtactctgtatttagagagatgtcttcacataaattttaatgacgtttatcttaataagaaccaggctacacttttttatttggaaggagtataagggaaaataaaaagttatagacaattcaatagtttcagaaatcaaaagcacttctaagaattgatgagataatcaataagcaaaagcaaataatttcactttgcatttctcaaagaagctcaagacatttgctttcagagataatgaggctctctctggtgatttccaaaaatactaaaagaagcattgttagattttaaaaggtgatgtgcagcagattgatttacagtggcaaaatcagcatgtttcagaaatagtcacctggtcaaaattattagtccaattaatggaacaaactataatccactaaataaaatatattccaaagaaggcaaagaaaatacaggtcctgtatgttatgacaaaggggctctcggtctgtctcgtttacagctgcacggcagccctagacagggctgggagacacagaacaagtgtctgttcgtttaaggctagctgatcttaagcattcttcattccctgctactataggcattagagccatttatttcaaaaagtctcaaaaatgctctagaagtcaacatcaaaagaatcctagaccaaaccccaggcaaaagtgcacagcaatttccttccctagtaaacagaggggcatgggcccctttttagttcttccaccttcctttaggaagcagcactgaaaagagtccaggcacacatggagtgtgccacgtcctcaggtcttgaaaatgatttgaaaaccttacttctcaaatgacagcctaaagacatagattatatatttcattttgtttctggttaagtaaagtgtccaaatctcattttagagctgaatgatgagtgatacccacaaagtcatgggcaaaatttgcaatttttcgaattcccttatttagccatctcataaggagttgcatacacaatccccctcctactaagggtattccttgctaccatcaaccacactccttttagggattaatatattcacacggttctgattctctcaaaaggtaatgaatgagaaaatgctgagcaaatgagattgttttttaccagtgtgcagctcttcctagtacaaatgaaatgttttttcttattttttgagcacctactctgtggcaggccctcctgtaggctctggggataatacaagttagtagtaaaaactggtgagcaataaggtggggatgtgggatagggctgccagggtgggagcagggtttgaatgctgataaacatgcccctgcccagggctctcattggctctgtctccatggtgtgatcatccttccctagcaatgggaagaatcacatccatggagccccatccaggtttccaggaagcacagaatagtccaagggttattctaatgggcacaaatgcttaaatagatgttaggtttctcctacctggggaacttactctggatatatttcattttaaatatccaaatacatcctgcttcaaaaagacaacttggcccaaagatttctaaggctgttacaataactgtttttctttcctcggaccacatcacagtgcctgagattcttccttgtactatgggattaaagcgtcaaccgtcctggcatttattaacatgttacctttttctgcataattctcagctcgtcactcaagttgttattcaccttcattagctgctgtatcttggcctcagaagccactagagcgtttttgacctccataaattcctgtacagtgactggtccatctgataaatctgaatctaggctctaaaaataaattgggaaaacgttcacaatctgagatgacgagaacattaaagactaacagctcaagaatttcaaattctgaccaagccagctgaattgcaaagttagtcaaaccaaatcaaggcctctgagagtaatgcaaaactaaaacataaaagtagggtcactatactatttaaaaaatttgaaagtcagtattttctaatagaacaggcagtgaggctacacatctatgctgacaatgactgtctaaggaggtctgtcctgtcttgtaagcctttctctcgttcactcttgttttgtttttattcattctttcattaattcattcattccaacattttcattgaacattaggcagtgttctaggtgcttgggatatattagaaaagagacaaagattcctgcttccatggtgtttatattccaacagcatgagagagtatatatattgcatgattgagggtgatgagtgctgtgggaaaagataagacagagcagggtagggggctgcatgttaagcggggagctggggtaagcctgtgagtgggtgagaggtgagcagagccccaggaggtgaggggatgagtcacatgaatctggaggaagaacattccagcctgcagtggagctcagctagagggagcaggtgtgtgggatggactgggcaggaggccaggcggttgacagagggcctggtcacagagggtcttggaatgacctcggctctcactgagtgaaccaggtggcttccgggaagtctgcgcaggggtgtcccctgcatctgctaatgacgccatctttctcacagtcatgtgggccgaagaactccaaacaaatcttctataaatctgtctccccacttcaaccttccgacttattgccaagacttttctattctaccttcctattcatccattctcaaatgattgccaagcccctctgtgggtgtgtcctgggggtcagcagagggtgcacagcctggggtcctgctgccctctcccccagctcacactctggtgccgaggtctctcccacccgcaccatcctagcatgggtccttaggtggcctgcatcagctccagtatggatctctccctccactctctaacccaccagaagagtcctccccagacatggcatcctgggctctgcactgcctgtgaggcccactctcttccgtcgggtgtcatacccctcctgctgcagcttcgagtcccaacctttttaggctgtccctatgcatgaccagcttccccttagatgccctggtttcactttctttctgactcctccacatgccccaatcccaagcgtcccttgaggcgcatcttaagagctgtcctatgacacagccccacctgatgctcccagccatagattctctctctgctcactccctcagcctgtgtgtgcttcgtatgacacacatcactttgtgccttctccgcagttctctctctcctaggcaatgagagcctcacaggaaagggacgaggcctcattcaggagagtaatatccagagaagtcactcagtaaacacttgttgaatgaataaaacacaccaatcactcctcacaagttttataaagtctcaactgcagcagggctgtgatgcagggacaaggatccctattttaaaaccatttaaccttgtttcacctttgcttggcctgagctagtaacaaacccaacctcactgcacagcagctttggcagggctagccctcagctgatgcgtgcttgcccttccatgggacgcatggcctctcaccttctgccggtttgttttgcttgcagtggtttccaaatctgtgtcttcgtctgatgccacgctgtcatagtcgggctgatcgttgtcttgactctcaacgctgtgctggttattgatggttttcagtatgagctccacattgtctatcaataaaagcaaacaactttacttcaggcttaaaacattgcttttcttccaaaaaactacggagaggattttttggtttagccatttaaaggacttaaagggctgaatgctgtgctcttgcctgtaatcccagcattctaggaggccaaggaggagaactgcttgaggccaggagtttgagacctacctaggcaacacaatgagactccatccctacacaataatttaaaaattatccaggcctggtgtcacaggcctgtagtcccagctactagctactcaggaggctaagacaggaggattgcttgagcccaggagattgaggctgcagtgaaccatgactgcaccactgtactccagcctgggcatcagagtgaggccctgtctctaagagcaaaaacaaagacaaaaacaaaatgaacaaggactgaaaaaaaatgacagaaatggcaacgttatattcacaccaatacagagataacagaaaaagttttcaaccaggtggacagctacataagagactccagcattcctctcatctacctgccaaatatgggcaaattaaacagatggcttaggaaggaactgctcagataaagaaggcaggttcccaagtttctagagatagagcctagctccaggtcatgaagataaggctgtaggtaatggaagataaactgtaattctatgaatacctataacatatttacaaggtaatgtcactcaaaacagaaagcaaattgttaaactggagccagaacctaggcactcaaacaatagaagcactgggccgggcgcggtggctcacgcctgtaatcccagcactttgggaggccgaggcgggcggatcacgaggtcaggagatcgaaaccatcctggttaacatggtgaaaccccgcctctactaaaaatacaaaaagttagccgggtgtggtggcgggcgcctatagccccagctactcgggaggctgaggcaggagaatggcatgaacccgcttgcagtgagccaagatcatgccactgcactccaacctgggcgacagagcaagactccgtctcaaaaaaaaaaaaaagaatagaaacattggcatttagtcaattacctgcatctcagcgagagaaagagataaaggagaatgaatcaaacaaatacacatgtgcatgttacagggagtgtctatcccatagggagcagggattattctagaggatctaatacactttgaacaaaagatttcacaaactacccaagtctctctgatttctttcaggcaactcaaactctgacttctaatattgtttcccagagatgttgaggaaacaatggatggatgatatctgggtgatgaatggtggttatttaaaaagactaggtcctagctgggcgcaggggctcacatccgtaatcccagcactttgggaggctgaggcagatggatcacttgaggtcacgagttcgagaccagcctggccaacatggcaaaaccccatccctactaaaaatacaaaaattagctgggcgtggtggtgcacatctgtaatcccagctacttgggaggctgaggcaggagaatcgcttgaacctagaaggtggaggttgcagtgagccaagactatgccactgcactccagcatggatgacagcgagactctgtctcaaaaaaaaaaaaaataataataataataaaggatagatcctattttaactgtttaaatattttaaaacacataaatataattacagaatagtcaatatattcaatttagaaactaatgaacaagtaagataatcacttatagccattgttatttgttgatctatttctaggtttttctccgagcacttatagccacacacagtcaattcttgttatgcttggtagttatgttcttttctttttttgagacagagtctcactctgttgcccaggctggagtgcagtggcgcgatcttggctcactgcaaactccgcctcccggtttcacgccattctcctgcctcagcctcctgagtagctaagactacaagcgcccgccaccacacccagctaatttttttgtatttttttagtagagacggggtttcaccgtgttagccaggaaggtctcgatcttctgacctcgtgatctgcccacctcggcctcccaaagtgctgggattacaggtgtgagccaccgcacccagcctcttggtagttatgttctaaaaagttgctgtgacttggccaatattagatcagtgcttctggggttatcaaccaatcaatatataaccttgttctacgtgtgtttctgtttaaagataccttatttaatacatagtattgattcattaacattgaactcatggccaacggcactataaatcatgcctgaatgatgcttatttaacacacatttctccgtagggcacatcacagccttcttgcacttagaaacactagacagcacttcaggactatgcttgggggccactttttttctttttttattgagacagggtctcgctatgtcacccaggctggagtgcactggcataatcatagctcactatagcttctaactcttgggctcaagtgatcctcctgcctcagcctcctgagtatgtaggactacagacacatgccaacacacctagaaaatttttaaattttttggtaaagatggggccttgctatgttgttcaggtgtgcactttttttttttttgagatggagtctcactctgtcatccaggctggagtgcagtggcacgatctcagctcactgcatcctccacctcctgggttcaagtgattctcctgcctcagcctcctgagtaactgggattacaggcacgcgtcaccatgcctggctaatttttcttgtatttttagtagagacagagtttcaccatgttggtcaggctggtctcgaactcctgacctcgtgatcagcccacctcagcctcccaaagtgctaggattacaggcgtgagccactgcgtctggccaaggagacacttttgagatagggtcacccatgctagggtgcagacgtgatcatggctcactgcagcctcaatctcctgggcactcaattgatcctgggcggtagggggccattttaaaacagtgaaatgaccaatgaaaagcacacaaatatgactaacatggcactaaatagaccacagacacttgtttatagcatgagtgcagaaacaagaagtcaaggagtctcctccctgttcaatctcagctggaaacatgtgcttttggtgactcaatttttttctctgctctgtacatttcttacaatgaccttgaaaatgctgtattaattttgaggtcacaaattttagcaagtagatgaatttgtaaatatgggatgtgcacatgaggatcaattgtgtatttatatttacatgtggtatactcacttgtacacacatatttacataaatatgttttccttacaaaactggggttatacaaaaccttttaaaaactttattatttggccaggtatggtggctcatgcctgtaatcccagcactttgggaggctgaggtgggcagatcgcttaaggctgggaattcgagaatagcctggccaacatggagaaaccccgtctctactaaaaaatacaaaaattagctgggtgtggtggtgcacacctgtaatcccagctactcaggaggctaaggcacaagaatcacttgagcctgggtggcagaggttgcagtgagccaagatcgcgccactgcactccagcctgggcgacagagtgagactcgtctcaaaaaaaaaaaaacaaaacaaaatcaaactttattactttgtctcatataattactactatagtataaatgtttcttccctccaaatctcatgttgaaatgtgatcctcagtgttggaggggaggactaaagggaggtgtttgggtcatgggggtggatcctttatgaactgatcaatgccctccctttgtagtgagttctcgctctattagttcctgctaggacctggttattgaaaagagcctggcacctccctcctcgctctcttgcttcctctctcaccgtgtgatctctgcacatgtagcaccccttcaccttccatgagtggaagcagcctgaggttctcaccagatgcccaatcctccagtcagcagaatcattagccaaataaaccttttttctttacgaactacccagtctcaggtattcttttatagccacacaaaagggactaagacaattacatattcttttaaaaaaagataagtatgtatttttttttttttttgagacggagtcttgctctgtcgcccaggctagagtgcagtggtgcgatcttggctcactgcaagctccacctcccgggttcacgccattctcctgcctcagcctcccgagtagctgggaccacaggcgtctgccaccatgcccagctaattttttatatttttagtagagacaggatttcaccgtgttagccaggatggtctcgatctcctgaactcgtgatccgcctgccttggcctcccaaagtgcagcatgtactattttaaaatgtgactaattgttcctctttattacttagttgcttctaatgtttgtgttgttctacatataacatctctgatgatttcccttcagttaatacctaagagtggaattatcaaatcaaagagcaggtattttttaagactttgttttttaagttaaaaatttttttttttttgaaaaggagtattgctctgtcactcaggctggagtgcagtggcacaatcttggctcactgcaagctctgcctcccaggttcacgccattctcctgcctcagcctcctgagtagctgggactataggtacccaccaccatgcctggctaattttttgtagttttagtagagacggggtttcaccatgttagccaagatggtctcaatctcctgacctcgtgatctgcccacctcagcctcccaaagtgctgggattacaggtgtgagccaccgtgcctggcccccaatttttttttttgagacagagtctcactctgttgctcaggttagagtgcagtggtgtgatctcggctcactacaacctctgtctcccaggttcacgcaattctcctgcctcagtctcctgagtagctgggattatacgcgcgtaccaccacgcccagctaatttttttgtatttttagtagagatgggtttcaccatgttggccaggctgatctcaaactcctgacctcaaatgatctgtccgcctcagcctctcaaagtgctgggattacaggcgtaaggcaccacgcccaggccattttaagactttaaacttatccaaagactcttgtcactgtgccttcaccaaaatttaataaaccttttcagaacttccttattcctggttgaacagataaaatcaaattcctgaacaggaaagaagaatgaatgagttgttgtcagttaatgattactgtctttggggaatgtgatactgactgaaaacttaatttttatggtacatatttcttttgcttaaatgacttacaatgaaaaacgtctaatttctataattagaaaaaaccaatatggatacagtaatagggctggagaggaaggacattcctaagcatgcagacaggacctgggctactgaactagactcaacagggcactggtgaaacagatgctcagagctctccttataattgtatatcacagtaattctcactgaagacatttaaagtttatggcaacaaattttaattatgttgaactcagttttgtaggtaagcaacagcagatattatgcagtttcaatcaggaagagtttttcttttccgtttttttttttttttgaaacagagtcttgctctgtcactcaggctggagtgcagtggtgcaatctcggctcactgcaacctccgcctcccaggttcaagtgattctcctgcctcagcctcctgggtagctgggattacaggcgcccgccaccatgccttgctaatttttgtatttttagtagagaggtggtttcaccatgttggccaggctggtctcgaactcctgacgttaggtgatccacctgcctcggcctcccaaagtgctggtattacaggtgtgagccaccacgcccggccaagaagagtttattttcttatgtcctttaacaagatctaagccagagttttgggttaatttcaggatgcaattttacagggtaggttaagtgtcccaaaacaaaacagaaatcatatataagataaatatgtgtagcagttaataactctgaaatattgttaattcaccagggctcagacaggtaaactatttatcacaatatactaccaataaaacttacagtgggtggggctgaggggagggaacctagaggacaggtcaataggtgcagcaaaccaccatggcacacgtatacctacgtaacaagcctgcacattctgcacaggtatcccggaacttaaagtaaaaaaacaaacaaaaaaccaaaaacctatagaactgtcatgttgatgactgctttaattagtttataactttaacacctgagtcaaatttagagggccaaaaaatgcaagtgtttggaggtttgagcagttaccttttgaacccgagagagaactgccctgctgtctcctcttggcgtcactgagaatgtcaatgaccagcgtggcaaactcatgggcgttgaaccgagctaacttctgtctgccctaaaggtgggaaaataattggaaatatttcccagtgtaaaaatatatacataaatagtcacataaaactagtcagactattgacagacttctgcaaatactttcttctggcatgatcaaagtacaattaatcccagccataatcaaaccaagttaatgcttgttttccatatgaacagtttaaaaccatttatataagagaatttcataacaaatgttatggcatttctcacatatgcattgttctcacaatgcaggtctattttggtaagcaaaaataaaatgggtctactgaatgcttttcttctattaatgcttcagtttggaagtagacccagtaataataaattaattttgaggggaatttttaaattttaagtttaggccgggtgcagtggctcacgcctgtaatcccagaaccttgggaggctgaggcgggaggatcacttgaggtcaggactttgtacaaaaattagccaggcatggtggcgggtgcctgtaatcctagctacttggggaggctgaggcaagagaatcgcttgggtccgggaggtggaggttgcagtgagctgagatggtgccactgcactctagcctggacaacagagcaagactccgtctcaaaagaaaaaaaaaatttaagttaaacaaaatcatagtctagatattccctatccttatatatagctgctaattataaagactaaaacaccttcataattcattcaacatttctcctcttgatggatgtgttagctgtttttaatgctctattgtatacaatggtgctttgatgaaaatcacgtgcataaatctatttttattttattagagcatattctcaaatgagaaattcccatgtaaaaggatgtacttaattttgaggcttctgaaactggtaaacaaattgcttttctaacatctacagcaatttaaagttctatctgttgcaagagaaagctcagcttaccacatccttaccagtttggagtatcctttattatatattttattaatttgactgataaaacttgcactaatgcttttaagttgctttcttagattactgacaaggttaaacatttcttcacatttgtaagccatttatatttcttctgtgaattgtttcatattctttcccagtcatttatttatagtctattgtttttcttatcaatttgggggttgtgtgtgtatatatgtataaaggatattaaattttaatcaatcaaaacatttagaatagttttcctgggaaaaatgaaacatgacatcagccattccccaactactattcctttccaaactgagccacttgcctgatttcgtgttgatgagtactcaggattgaccggaagaaaggggacgaccgttgtctcggttaccagggcgctgtggttttgcgtggcaagccagactagtcagaggaaagagccagagacaaacctcatcacgcctgtgtgccactgctcctgggaggcacagctcacgcactacgaggggaaacacactctgaagccaacacacgcaaaggcaaacgtcgacactcgcaccatcaggacagcagaaattggactagtaaaacactgagcctggcagcttttcactgcccactgataacagaagcttattagataaagccacgtcaagtcacctgcatccgtctctcgcctgtcaacttcatcgtacacatccatggcaagttcttcaaacaaatgattacttagctgaaaataaaaaatatcaggaacacaagggacaatgattaatgccaggaggacaagagggaactgcgacttagtcacccttttattgcctacgtcttatccaatgccagtgcttggtacatacccactgttaaacagacataacattttcaaaatcgtacagggcctctagaaatgtctgccaaccacagcaatttcactactttatgacacagacagagctgctgctattaaggagctaagaggcatctaaagtgcatcatctcagaagtaggttccagttctctactcttcttgtgatatcatcctgtaagcctccttttctgcacttaaaagtgcttatcagttccccaaagtataagggaacctataaccttgcaaaaacagccaggctcagtggtgcacacctataatcccagcactttgggagactgaggcaggtggattgcttaagcccaggagttcgagaccagcctgggcaacatggtgaaaccctgcctctacagaaaatacaaaaactagctgggcgtggtggtgcacacttgtagtgccaactactcaggaggctgaggcaggaggatcacttcagcccaggatatcaaggctgcagtgagccaagatcacaccactgcactccaggctgggtgacagagtgagaccctatctcaaaaaagaaaaaagaaaagcaaaagacatgctgttttgagaggataaaatgtgcccttgcacaaaaacgtgactcagacctcagctgagtttctttgctctctttctcagtagcagtcctactgcttcagtctccagaaggaagcttcctaccaaagcacagcctgactcttcagcacacaacaaccacctcacagcctgcagtgcctccctgggcacatggaggataattgaggtcttcctggcccagatgaggttaagcctcttctggggtggctccgcctctctctgcactttctgcctcatgcaacaccttgacacgtggtagttgtgactcttaaactgtctgacatctgctttgggagggcagatgctgaatctgttatattccctattgggttccttacatccacacatggtacctcacactttaaaagtggccagaaaagaggcactggctggccagaagggatttaatgcagcaatttaaaatgctggctacaggctgggtgtggtggctcatgcctataatcccaacactttgggaggcagaggcaggaagatcactcacttgagcctgggagttcaaggctgcagtgagccacgatggcaccactgcacgccagcctgggtgacggagtgagaccttgtctcgaaaaaaaaagaaaaaacaagtgctggttacagagacctcataggaacatgttaaaatgggtaccatatattactgagtgaaaaaagcaggttataaacgtctacaattatgattaagttccagttttaaaaaaagatatgcatataaaacaagaactgaaagaaatgtaccaaaatattgagcctgactccattaagagtatagcaatgaggatggtcccctttctctattttccaaatcttcccaaatgtggtcgcactataattaaaaacaaacccagagagcctgttgctagacaagatgttgaaggattgggagcttgactttgcttcataaatatctagtttcttcctccatgggactacaagctaatgttattattactagcaacaactacaatggccaacgctgattatgggcttatatcccaggcactgtgctaacagtatcatatttcacttataacacctctatgaaaacaggaactactattgtcccatttttaagacaagaaaactgaggcagagaagatagtagcttgcctaaagtcacaaagctagtgacagacctgagatccaagtttacatctttgaaaatgctaacatttactcattcaaggaatacattagcctttgttatatttctctcagttcttcatcaggagggagggaaggaaaagagaaaggaaagaaaggatgaagggaggaagagagggaggacaggaggaagatactggaggataaacactgacctggcgctgataagatggtcacctatgagaaggagaccacagggtgagggtcaacaagtaatggggcagcccactctgagcagttctggccggcagcccctgcaggatccttatctccctcttctatgagaggatgccaaggcacagggaggctaggaagcttggcagggctgagatatgtactgaccagtctgactcagagctgcagctctggagagctatactagactctgttccaggtctttacttcatgcctgccacgtgctagagatattacaagcataatctcagctttcatgcagcttccagtgaagcaaatgtaggatagtctaagaaaacgtgggtttttatctaggtttgaattatttataataaaatttacttacagattgtgagtaattaaaaggaaatcacacaatatttagtgctatctgactccaaagcttatcatcttgatcatcttagtttacaacttccttaaggcaataaaacacacagacacacaaaactgtagatacagaacacagagacaccaaacaaattgcataaaacacatttatttcataatacagttaaatactagtaaggataaattcatttaatgtaatatttaatactgagtattatatgaagttttagtaaagggtcttctgtgaaaacagaaatgaggagaaagtcataaatgagggaagctgcaatgtcagagtcaggctttgggaaagccgctacctacactggtcagatttcaggtccttgaatcagagagatggaagctgggaaaggcaaacgctgtaggcaaagcaggattcctggaagaggacttgaatgtgcagctcatggcctcagagggtgttaatctaaagacacacacacacacacacacacacacacacacacacacacacacacacacacacacggaaccagatgggaagcagggcaatctctgaaaggtgagagctgaatgatgcccttacaggttacaaaaagaagttaagaatcttggttctgatccaaagagcaatgggaacagctgaggagtatactttggtggttaaagtggagagaagtgccccggtgaggcttcatgtgagagaactagacaaagagaagtcaatcccagagaagtagatttcccagggccttgaggccttgggcccttaggcctttcctaaggctgaggtgggcagtctggaagaaagacacaggctaaagggaggttgtggcacagagccggcaaactctgagcacgcacatgggccaagaccaccagcttttaacagcagaaatttaaaaagcactgatgaatggcatgggatgggaaagaggtttacaatatggctggatccaaatggcagccagtgaatctatgggactcgccaccatttcagcatcagcatttaccagctctagaaccctacatggctaagtcaccccaagaacgcgtgccctacttactcatgacactgagaggaactagggaactctcctgaggagaacaactgcctaatgccaaaggtgccatctgcacttgttacatgatagagaaaaatgagattatctgaagcagaaccaatgaactgaatatactgaacttaatagtccttgtggtcatcactgctgtatactcaacagtctgcttctagtttaacaaataaaagtatgaaataaagtcatcagacgcaataggtaacctgcattcagagtaggtatcagcagggtgcactgattctcatactagagaaaaccagtacagagaaatactcacagattgaagtttcttcttagcagcttttgccaattcagacaaatccaggctgctaagaaaacatacaaagctaataagcaaataaataaagccagacttgtgaactctgtaaagtttaagacacccaagagataaaaatattaattacagttcatggaccatgttagaaccaagcattctacagcccagtagagtcagtgaggagctctaaacagaacaatctggtgaaagtaactccttctgaaataccacaatcatgtaagtgttaaagaggaaaaaaaaatcgtccaccaactaaacgacaaaagctattgccaggttaccttccaggcccttatgtgaggagtcacaatttttgaagtattaaaaaaaaagcatgatataagaaaatatgtcgggctcgatggctcccgcctataatcccagcacgttgggaggccgaggtgggaggatcacaaggtcagggttgtttttttttttttttttttgagatggagtctcactctgtcacccaggctggagtgcagtggcgcaatctcagctcactgcaatctctgccaccagggtttaagcaattctcctgcctcagcctccagagtagctgggattacaggcacacgccactgtgcctggctaatttttgtatttttagtagagacagggtttcaccatcttggccaggctggtctcgaactcctgacctcgtgatccacccgcctcggcctctcaaagtgctgggattacaggtgtgagccactgccctggcgaggtcaggggtttgagaccagcctggccaacatggtgaaaccccatctctactaaaattacaaaaaattagcctggtgtggtggcacacacccatagtcccagcaactcgggaggcggagacaggagaattgcttgaacctgggaggtggaggttgccctaagcctagactgcaccattgcactccagtctgggcgacagagcaagactctgtctcaaaaaaaaaaaaaaaaaaaaagaaagaaaagaaaatacaaggccagatatagttgctcatagggaggccagggcaggtggattgcttgagtcccggagtttgcaaccagcctgggtaacagagcaagaccctgtctctaccaaagcaaaaaaaaacaaaacaaaacaaaacaaaaagggaagatgtaaaagatcaggatggcaagattatatctggaatagcagttagtcatttcataaactcttgacagtttccgtgcaaaggtaacttgcaaaacaagggtttaaggatcattcctgtagcaatgaactcatctgctcttatagaccaggggtcagaaaaattatggccttctttttgttcagttgagctaggaatggtttttacgttttaaaatgtttgggggcaaaaagaaaaaacaatatttcataacgtgaaaactatttgaaattcaaatttcagtgtccagaaataaaatttcactggaatagacacacccattcatttatagagtgtccacagatgctttcatctacaacagtagagttaagctgttgcgaaagcggccatattacccacaaagtctaaaatatttattaattggcccttgagaagaaaagtctgccaacccctgtcatagataatgtaatctcctataatacagaagtattctgtaaataaataaatacaaaatactgtcacaactggctaaaacagtgacaatatcactggtttcaattttcctattagtaaaattgctacttgtgctctttgaaacttaagttttatatagtggtttacttacagccgtcttatttccaaatggtatagccataaaagagaaaaatgtatgggctttgttaaacacaaaatataatatacttaaacataatacaaccaaggaaatattagcgatagacaaaactaactggtatttcaatgagcttacctgtctgccatttgaggtattataaagtgctgtccatttttgtgatctgaaacagaaaccaagtcaaagttttgttcatagaaatgttgataagatctgtaaaggaacatcaccattatttcctcaaactaagttttgcgattagtatttgtgcataatgacgagtcatgttgctagactagctaaaaattcctgaagacccagctagtagtaaggctcatagccttgtttttttctggtacaaaggtccaggcatcatttagcagaaacctatgctcaccccaatcacgacgattagtttgccctcagtgtaactgacgatctttggccatggaaagtgtgctgagggagctgaatcagctcacagcaggtgtccatcagcccacggtgtgggacagtggatgagctctaggtcttgctcaaatgaatctattagtataaaacagctagggctgggacaggtggcctttgcagatccagacagggactccatctgcaaggaagcttactgactcagccctaatctagctcctggagaacactgatccatgtgccaatgaataacgccactatcagcactcctatgtaggtttttctttaacataagtctatctttcttctgggtaaagacccaggagtagaaatgctgggttatatggtaaatgtatgtttaacttggtaagaaactgccagaccttttcccttgagtagcgctatcactttgttttccaaacagcaatgtgagagttacagttgcttcctgtctttcccagcacctgtactttcagtttttgtttttaaaagtttaatcattctaataggtatgctgtggcatctcattgtgctaatgactaatcatgccacgcttgtcttcatgtgatttttttttttgccatcccatatcttgtctttgcccagtttttattgggttgttttcttactgttgagttttaattttaattaattaacttatttatttatttgagacagagtttcactcttgttgcccaggctggagtgcaatggcgcaatctcggctcaccgcaacctccgcctcctgggttcaagcgattcttctgcctcagcttcctgagtagctgggattacaggcatgcgccaccacgcccaactaattttgttttttcagtaaagatggggtttctccacgttggtcaggctggtcttgaactcctgacctcaggtgatctgcctgcgtcggcctcccaaagtgctgggattacaggtgtgagccactgtgcccagcttatttatttattttgagtcagggtctcactctgccccccatggctggagtgcagtggcgtggatctcggctcactggcaacctccacctcctgggttcaagcgattctcatgcctcagccacctgagtagccaggactacaggcgtgcactgctacacccggctaatttttttatatttttagtagaaacagggtttcgccacattgcctaggctggtctcaaactcctgggctcaggtaatccacctgcctaagcctcccaacgtgctgagattacaggcgtgagccaccgtgctcggcctgagtttttaaaattctttgaatattctaaatatgagtaatttgctggatatgtgatttccaaatacctgtatttttctcccagtctgttgctggtcttttcactttcttaactagttttctcagaacaaaacttttccttttttttttttttttttttttgagatggagttttgttcttgttgcccaggctagagtgcaatggtgcaatattggctcattgcaacctctgcctcccgggttcaagcaattctcctgcctcagcctcccaagtagctgggattacaggcatgcaccaccatgcctggctaactttttgtatttagtagagatgcagtttcaccatgttagtcaggttggtcttgaacttcagacctctggtgatccacctgccttggcctcccaaagtgctgggattacaggtgtgagccactgcacctggccaaaaattttcaattttgatgaagtataatttatcaatattttcttttatgcattgagttttggtgttatatttaagaggtttctttttcccccttgcagaggcaatgtcttgctctgtcacccaggctggagtacagtggcatagtcatagctcactgcagcctcgacttcctgggctcaagtgatcctcctacttcggcctcccaaagtactaggattacaggcgtgagccaccatactcagctgatagctaaaagctttcatccaagatcacaaagattttctcttatgttttctttttttttttgagacgcggtctcactctgtcgcccaggctggagtgcagtggtgtgatctcggttcgctataacctccgcttcctggattcaagcgattctcctgccttagcctcctgagtagctgggactacaggcattcaccaccatgcctggctaatttttgtatttttagtagagacggggtttcactatgttggccaggctagcctcaaactcctgacctcaggtgatccacccgccttgacctcccagagtgctggcattacaggcatgagccaccgtgcccggacctcttacattttcttctagaagttttacagtgtcaggttttacatttagatctatgatcctttctagtttcggggtaaggtgtgaggtttaggttgaagttcactttcctgcacatggatgtccggttgtcccaatgcattaaaaagaatatcctggggcgggtgcagtggctcatgcctgtaatcccagcactttgggaggccgatgcgggcagttcacgaggtcaggcgaccaacaccatcctgactaacacggtgaaaccccatctctactaaaaatacaaaaaattacctgggtgtggtagagtgcgcctgtagtcccagctgctcgggaggctgaggcagaagaatcacttgaacccgggaggccgaggttgcagtgagccaagatcccaccactgcactccagcctgggtgacagagcaagactccgtcttaaaaaaacagaaaacaacaacaacaacaaaaaactatccttcctccaccactgaactgattacctttgcacttttgacaaaaatcaattgaacatatttgtgtggatctatctctggattctctatactgtttcaatggtctatatgtctatctcttcatagatatcacagtcttgagaactgtacagcttcatagcaattctgaaaaattgggtgctgtacttccttccacattattcttctgcaaaattgtctgggctactctagttccttcacccttccatttgaatttttaaattattattattatttttggaaatgaggtctcactctgttgccaaggctagagtgcagtggcacgatcatggctcactgcagcctcaacctcctgggctcaggtgatcttcccacatcagcctcctgagtaggtgagaccacaggcatgcaccatcacacatggctaatttattatttgtagagatgaggtctcaccatgctgcccaggatagtctcaaactcctgggctcaagtagtcctcccgccgtggcctcccaaagtgctgggattacaggcgtaagccactatacctggcctccatttgaattttaaaatcagcatgtctatgtctaataaaaaatcctcaattgaagtaaatttatacatttattaacttgtggagaattgacatgttattgagtcttcatatccataagcacagtacatctctccacttattcaggtcttcattgatttctttcatcagcagtttttggcatatagatactacatgtattgtgtatttcattagatttatacctaagtatttaatttggagctttttaatttttttgagacagagtcccactctgtcgctcaggctggagtgcagtggcaagatctcaggctcactgcaacctctacctcacaggttcaagcgattctcctaactcagcctcccgaatagctgggactacaggcgcccaccaccatgcccagctaatttttgtatttttagtagagacagggcttccccatgttaaccaggctggtatcgaactcgacctcaggtgacccacccccttctgcctcccaaagtgctgggattataggtgtgagccactgtgcccagccaatttggagcttttattactggtattgcttttctagattcagtttccaattgctcactgctagtctaaagaaatgtgatggatttttggcagggtgcggtggctcacacctgtaatcccagcactttgggaggccaaggtgggtggatcacctgaggtcaggagttccagagcagcctggccaacatggcgaaaccctgtctctactgaaaatacaaaaaattagccaggcatggtggggggcacctgtaatctcagctacatgggaggctgaggcaggagaattgcttgaacccgggaggcggaggttgcagtgagccgagatcacaccactgcactccagcctgggtgacagagcaagactatctcaaaaaaaagggaaaaaaaaatatatatatatatatggatttttggctgttgaccttgtattcttgcaatcttgtttaactcaaggttctggaaacctttttgtaggttccttgtgattttctacatagaaatcatctcatttgaatggggacagtttgatttcttccttttcaatctgtatgccttttatttatttttcttgcctcttggcactggttaggatttccagtgtgatgtagaagagaaatggtaagagtggacaccctagtctttctcccaatttgaaagcaaacacagtctttcatcattaaatagatactgtttatcagatcaaggaagtctcatctattcctagtttgctaagagtttttttaaaacatgaatggatgttgaagtttgttgaatgcttcttctgcatcaactgatatgattacatagtttttcgtttttactgttaacttgatagattacattaactgatttttttttttttttgagacacagtctcgctctgtcgcccaggcaggtgagcaatggcgcaatctcagctcactgcaacctctgcttcccgggttctaagtgattctcctgcctcagcctcccaagtagctacatgcatgcaccaccatgcccagttaattttgtatttttagtagagacggggtttcaccatgttggccaggctggtctcaaactcccgacctcaggtgatccacccaccttggcctcccaaagtgttgggattacaggcgtgagccactgcacctggcctgattttcaaatattaaatcagtcttgcctatctggaaatcccacttggttatgttgcatttttctctatttttttttgagacagggtctcactctgtcacccagactagagtacagtggtgcgaacacagctcactgtagccttgacctcctgggctcaagcaatcctctcacctcagcctccagagtaactgggactacaggcacgtgccatcaggctaggctgatttttttgttgttgcagttttgtagatggggtcttgctatgttgcccaggctggtcgcaaactcttggcctcaaacaatcctcctacttcggcctttcaaagtgttgtgattaccactgtgagccactatgcctggtctgtattactattattattattgttattattagagatggagtctgactctgtcacccaggctggagtgcagttgcacaatctcagctcactgcaacctctgcctcccaggtttaagcgattttcctgcctcagcctcccaagtagctgggataacaggcgcccaccatcatgcccagctaatttttgtatttttagtagagacggagtttcaccatgttggccaggctggtctctaactccccacctcaaatgatctatctgcctcagcctcccaaagtgctgggattacaggcatgagccatcgcgcccggtctgctttgtatttttttttaattatccttccatgtctgtggggtttatagtgacaactccatctgtacactctcctttttgtcagtattgccagacatttatgagttttactaatccttctgaaaaaccagctttggtttcattgatttttcgctactgtttccttctttcagtttcattgatttttcgctactgtttccttctttcagtttcattgatttctgctctttactatttgctgccttctgtttggttcaggtttattttgctctttttttttttaaagtttcttaagggaggagcttatattaataatttgaggctaggcgcggtgtctcacgcctgtaatcccagcactttgggaggctgaggcaggcagatcatttgaggtggggagttagagaccagcctggccaacatggtaaaactccatctctactaaaaatacaaaaatgtgccaggcatggtgctgcatgcctataatcccagttcctcaggaggctgaggcaggagaatcacttgaacctgggagggggaggttgcagtgagccaagatcacatcactgcactccagcctgggtgacagagcaagacaccatctcaaaaaataatgatgagaatgatttgagacctttcttcttttctaaggtaagaatttaatactataaagtttcctctaagcattgctttggctgcatcccagaaattctgatatgctgcattttcattttcattcagtggaaaatattttttcccttaagacttcctcttagatcgatggattagttagaagtgtgttgttcagggccgggcacggtggctcacacctgtaatctcagcactgtgggaggctaaggtgggtggatcacctgaggccaggagttggagaccagcctggtcaacatggtgaaaccccatctctactaaaaatacaaaaattagctgggtgtggtagcacgtgcctgtaatcccagtactagggaggctgagacaggagaattgcttgaacccaggaggcagaggttgcagcgagccaagattgcgccactgcactccagcctgggcaacagcgcgaggctctgtttccaaaaaaaagcagcatgttgttcaacttccaagcacttgggtattctccagttttatttgtattacctatctgtagcttaatactattatggtctgaaaatatactttatagaattttaattcttttagattagctaaggtttgtcttatgacccaggatatggtctatctgggtgtatgttcaatatgtacttgaaaagaatgtgtattctaatgttgtcaggtagaagagtctataaacatcaactagatctagttgggttttggtctggtttagttctatatccttactgattttctatctactagttctatctattactaaaagatgagtgtagagtctccaacaataattgtagatttgaccttctctccttttagttctatcaaagtttgcttcatgtattttgaaggtctgttgctggatgtgtacacatttagaactattatgccttcttgatgaattgactcatttatgataatattatgtccctctctatccgtgctaatattccctcctctgaagtctactttgtctgatattaatatagccaccctagctttcttttcctgagcctttacatggtatatctttttatacttttggtttttaacttattacctatattgttatatttaaaatgggtttcttgtagacagtatatattaggccttatggttttttgtttatttcttgaggcagggtcttgctctgttgcccaggctggagagcagtggcatgatcagcactcactgcagacttgacctcctgagctcaagtgatcctcccacctcagcccctcctgagtagctgagactatgggcatgcaccaccatgcctggctgctttctataaaattttttgtagtgaaaggatcttgctctgttgcttgggctggtctcaaactcctatgcttaagcgattaggagaattgcttcaggctccctgaagtgttgggattacaggtgtgagccatagctcccagccccttttgttttttaatccattctgagaatctctgcttttcattgatgtgtttgggtcattaacatttaatgtaactattgatatgtacggacttaagtctataatgttattatttattttctatttggtccttagttttttgttctccccctcctcttttgaatattttgaatcaaaatatcttttgatgatttgagtaatttttaatactccattttcatttacctctagcatttttgatcacatatctttgtagtctttttttttttttttttttagatggagtctcactctatcacccaggctggagtgcagtggcatgatctcggctcactgcaacctctgcctcccgggttcaagcaattctcctgcctcaccctcccaagtagctaggactacaggcacgtaccaccatgcctagctaatttttgtatttttagaagagacagggtttcaccatgttggccaggatggtctcaatctcttgacctcatgatctgcccacctcagcctcccaaagtgctgggattacaggcactacaccgtgcctggcttgtagtcttctttcagtggttatggtagaaattactatacacacacacacacacaaacacacacacacacaacttttcacagtctacttagaaatcctattttacatttccagtagaaggtagaaatcttaccattatattttttaccctatccccttttatattatagttgtcaaatatattacactgatatatgctgaaaaccctactagataatttttttttttttttttttgagacggagtctcactctgtcgcccaggttggagtgcagtggtgcaatctcagctcactacaagctccgcctcccgggttcacgccatcctcctgcctcagcctcccgagtagctgggactacaggcgcccaccaccacgcccggctaattttttgtatttgtagtagagacggggtttcatcgtgttagccaggatggttttgatctcctgacctcgtgatctgcccacctcggcctcccaaagtgctgggattacgggcgtgagccaccgcgcctggcgttttcttttctttttttttttttttgagatggagtctccctgtcgcccaggcaggagtgcagtggcacgatctcggctcactgtaacctttgcctcctaggttcaagtggttctcctgcctcagcctcctgagtagctgggtttacaggcatgtaccaccatgcccggttaatttttgtagttttagtagagacagggtttcaccatgttggtcaggctggtctcaaactcctgatgtcaggtgatccgcctgcctcggcctgccaaagtgctgggattacaggcttgagctactgcacctggctgacaatgttacagctttaagatatgtatgacaatttcaactttttgtttgtttcttgagacagggtcttactctgccacatctttaacatttctgttgtttttctttcattcctaaagttccaagattccctctggcatcatttcccttccacccaaagaactttctctagcatttctgttaaagtaaagaataattcttttttttcctgttagaatgtccttattttgccttcattccaaagttattttcattggatatagagttctgggttcacagctcttttcttttagcactttaaaagtattgtttctaccatcacaaagaagatgagaaaaaataataataataaaaaaggagcagtggctcatgcctgtaatcgggaggcccaggtgggtggattacttgagctcaggaattcaagaccagcctgggcaacatggtgaaaccccatctctacaaaaaatacaaaagttatctgggcacagtggcacacacctgtagtcccagctactgtggatgctgaggtgggaggatcacttgagctcaagaggttgaggtttcagtgagtcgagatcacgccactgcactccagcctaggcgatggagtgagaccctgtctcaaaataataataataataaaagtattattctggctgggtgaggtggctcatgcctgcagtcccagccctttgggaagccgaggtgggcggatcacgaggtcgggagttcgagaccaacctggccaacatggtgaaaccccatctctactaaatatgcaaaaattagccgggcatggtggcaggcacgtgtaatcccagctactcaggaggctgaggcaagagaatcgcttgaacctgggaggcggaggtttcagtgagccaagattgcaccactgcactccagcctgggcaacagagagatactccatctcaaacaaacaaagtattatttcatttccttctcatctctatggtttctgataagaaatccacaatcattcaaatcactgtttttctatatatgttatgtgtcactttttcctggctgctttcaagatgttttcttcaactttagttttcaacagtttgattttgatgtgtctcaactgtggatttgagtttatcttctttggaattttctaagtttcttgaatctgtaagtttatgtctttcaccaaatttagaggttttttttttttttttttttttttgagacggagtttcgctctgttgcccaggttggagtgcagtggctcaatctggactcactgcaacctctacctcccaggttcaagtgattcttgtgcctcagctacctgagtagctgggattacaggtgcgcaccaacatgcccggctactttttgtatctttagtagagatggggtttcaccatgttggccaggctggtctcaaactcccaacctcaaatgatctgcccgcctcagcctcccaaagtgctgggattacaggtgtgagccattgagcctgtcccaaatttagagggtttttttggccaatatttcttcaaatacgttttctgcacacaccactctttctcatctcttattgggaatccaacgacataaatgtcagacattttagtattttcccacaggtccctgagactctgttcagtcttttcttcctactcttttttcctctctgttgcttaaaccagataatttctagtgatctgttttcaattcattgactttctttgtcatctctattcttctattaagcccatccagtaagttttaaatttttagtgtttgtatttttcagttctaatattcctatttggttctcttctgtatcttctatttctctgatgggactttctatattcctgtttgtttcaagaatgtttgcttttacttcttatagcatggtcttactagctgctttaaaatctttgtctgataacgccaacatttgtgtcatcttggggttggcatctgttggctgccttccctggcaagtacatgagaattactcagatgtcaagtcattatggatgatatcctagacactgtgaatgttttgttatgagactctgggccttctttaaactttatgcaaaaatgttcatatttttgtcttagcaggcaactgaccaggtgaggttctgcctcctgggcagatggtgagagaatagagagaaaaagacaagcaatcaggatcccccctcatccccttgctcagagatttaggaacctgtgctgccactgctgctgctgctattgcagccacaggcttgcctaggggctggatgggagagatcagaaaaaggaaggaggaggaggaaaaaaccccaggggaatccccttcctctctgtcctgtagaagtcccatttcctgctctttaaccagaaaaaggctttttttttttttttttttttgagatggagtctcattctgtcacccaggctggagtgcagtggcgcaatcttggctcactgcaacctctgcctcctgggttcaagcaattctgcctcagcctcccgagtagctgggactataggcgcctgccaccatgcccagctaatttttttgtatttttagtagagacagggtttcaccatgttggccaggatgatctggatctcctgacctcatgatccgcccacctcagcctcccaaagtgctgggattacaggcgtgagccaccgcaccccgcagaaaaaggcttttttgcactcattatgtacctccaggtttcaggctgtcattgaagtcctatcagaagtaagacaaacaggacactcaccaccagctgatgacacttttgagttccctaatctaccaaccaggatttacttttcagagtctttagctagctactccaagcatttggtccaggtctgttagttctattttgcaggagacacggtggggtgtgcttactccatctcacccagaactgaaactataccagaggctcttaactctatcatacaaccaggatggagaatcactgcatacatgtatgtgaatgttgtacatcaggggttggccaatattttctttaaagggccaaatagtaaatattttaggctttgtggccatctggcctgttgcaacgacttaacctattcaactctgctgttgttatgtgaaagcagccatacacaaggtataaataattgggcgcggctttcttgcaataaaactttattcatttattttttagagagttgggggtcttgctttgtcactgcacccaggctggagtgcagtggcacaatcatagctcactgccaccctgaattcctgggctcaagtcccagtctcccaagtacgtgggactacaggcgcacaccaccatgcctggctgattttttaaaaaacttttttgtggagacggagtctcacccctcttgcccaggctactttcgaattcctaggtgcaagcagtctttctgcctcggcctcccaaagtgctaggattacagacatgacccgttgcacccggcagaagctttatttatttatttatttatttttatttatttattttgagacagagtctgactctgtcacctaggctgaagtgcagtggcacgatacaaaactttgtttaataaaacaagtaactggctagatttgggctacaaaccatggtttgctgacccctgttccctatcacaaatagccaagttggctttggcaaagtttacttctggactttttttccattccttaagaagaatttttcaaataactacaaaggttattgctttgctcctacattcctagtcccaccatgttcaagaactgtggtacccattcaattttgctttgattattcagtctgattcttgaaatagtcatttctctagagctattaaaaatgaaaaatctaaggagttttgtccaactttatatcttttacatgtaactgacaattctgtagttatcctttcaaattaaaagccatatgtatagctttctcagtgatatgttacagcagaggaggtaataacaaatagtgtcccaacttgtttttctagaaccttcccaactggagatgtgaaacggtcattctccatccactcacctggtttcctgccacagagatagaaggctagtctgtccgttagctcatactgtatttccacgaggcgctctgccagctcatggtgccctccttgcctaccaagagaaaacaaagtaccatttatattgctcactattcactgactttaaaatggagtacaaagacgtctcctgagacacctgagcagtttatcacacaagacttttgagaatcatcaaccttcttgtggtaggtagatttctgaagtctactttgcatcccacttttataaactgttttcaccatctgaactatcgcctttcctttattaaggccaaaatagaatatttaataagaaattcaaagacttatgagagggaaggatacagaatgacttaatttaatgaggtaaaaaaatgaaattaatcaatggtttacggtagaagttctcaaaaattaactagcgcatttctagaaatataccatgtgcaggccccacccttggaaattctgaatcaatggggacaggatggggccaggggccaatatgttgaagaaggtccttcccctaggtgatgctgatgcagccagtctgactctggataagagtctagtaaccacttcaaaggcttcaaatcagtgagagacacgccaacctaacgcacagctcacgcctgcagctacttctgcctccttatcttcaatttgcacaacagaaaatattaagtttacctttcaacatccatgaaataaatacttaggctgcttagaatcctttcagcaacaaggatacaaattatattgagattattatatgcaaggtacaagtgcgaaaattccaaggtaagtgataataagtatcatttacccagggctctcgtccaagatcaagtatattttgtggtttttgtccttaaaagtaatggcaaaaactgcaattacttttgcaccaacctgatagtttcagccagcttctctccccaccattcaaggcactcacaacacccttcaacctaccacacagctttgatttgtgagaggcacatcttattttcattttttagtatctgtgaaatcaggaaatgtcctacaattgatgatacaccataatttaattggctgaactcttttcttttttagtgctctgtgaaataatgaagcaccatgcaatactgtactcctgctgttattcccagacccactctgttctttccagtcaggtctcctgctgtgctgaacacactttgtccctccctgcctcctgatcttgactcctgcctttcctcttacctggaatgcttcagctctcccttcacacattcaaatccaacccattcttcaagaccagctgaagaaatttcttaaatgatttggaccacaatgaagaaaccctatatatgctttttaagaccaattatctattttggcaatgaatcccatatggtcttgcctccttgaactctttcaggcatttatgaatcatcttttccaagagagtaaattctgggaaggcagagttttgttattcacccattttatcctctgtggaacagagtattgtgcttcacagttaataaaagtactttggaaaaagaaggaaagatgactgatctttggccatttaaatgatattcaagactaacctatagatttatttttcaaggactttattaataaagaaaaatttaaataattttacagtgagcacttttttttttttttttttttgagacagagtcttgccctgttacccagattggagtgcagtggcatggtctcggctcacagcaacctctgcctcccaggtttaagtgattctcctgcctcagcctcccgggtagcgggattacaggtgcctgccaccatgcccagccaatttttttttttgtatttttagtagagacagggtttcagcatgctggccaggctgatctcgaacttctggcctcaagtaacccacccgccttggaccctcaaagtgctgggattacaggtgtgagccaccatgcctggcctagagtgagcacttagatgtctactacccaaaccttacaattaactttttactatacttgtttaatcacatatctatgtatatatttgcttttaagttcaagaaataactaagagtattaaaaaacagaagagtacattctgtaattcttgatacttgatttggaatctgactacagctcaaacatcactgtgttataaaggatcaagtaaaagactggaagcttagcacactggttcatgattctagccttcctcaactttgccaggctgagcttatatgcatttgaaatgtcttcatctgtaaaataaaataacgtacatctttaaaggggttcaatatcaacatatacaacttagctacttaacaaggaatcacacccaacaaaaaaatcccagagagaagtagcgagaatctaggtctcttaccttgcataatcaacgggagttttcccactagaatcctgtgtgcctgggtctgctccatatactgccaataattcagcctgtaaaatctgccctgctttggaggcaacatggagtggggtgtttcctttttcctaagaatcattaataaaaagtaggcaaaagagcacattaaataaaggctacatgaacacaactcacttagtttcaatatctgaagcaattcatgttttcttacaggatgaaagaagttggcttgtgctcctaaagataacagtctcaaacaggtttcaagattccctgttctcacgctcgaatggagttgctgaaaaacgcagaaacaaaaaaggaatcgtggttagaggtgtaaagaatgatgtcctagggcagctgatagaccattttaatatatgttacatcagtaacgcataatctttatttgtctcggtaaagtgcatggaccagtctctcctttgccagtcacaactgtccctgggctgtaaggtggagtgaggccactttactgataaggaaactagggctgtgaaggctgacttgcccaaatgcatgacttatctaagaagtggcacaaccagaacctgagtgagaggcaggactgtgtgaagaggtgactatgcgtggctctgacatacgacagacctgaatttcaaactatacccacttcaagctgtgtggcctggagaaagggctttaagcaatctgaacctcactttcctcatctcaaaaatgtcaacaatggccagatgcagtggctcatgcctgtaatcccagcactttggggggctgaggttggaggatcacttgagcccaggggtttgagaccagcctgggccacatagcaagactctggctctacaaaaaatacaaaaattagttgggtgtggtggcatgcgcacctgtagtcccagctactaaggaggctgaggtgggaagatcacctgagcctgggcagtggaggctgcagtgagctgtgatcatgccactgcactccagccttggtgacagagcgagaccctgtctcaaaaaaaataaaaaataaaaaaaattttaaaaggtggcatttttctttttagaaagggtctcgcttgctctgtcatccaggctggagtgcagtggagtgatcatggctcactgcagcctcagtatcctgggctcaagcaatccttccacctcagcctcccaaacagctgggactacaggcgccggccaccatgccctgctaactttttatttttcaatacagatgaggtctcactatgttgcccaggctgatctcgaacttacgagctgaagtgatcctcccacctcggcctcccaaagtgttgggattacaggcatgagctaccgtgcctggccctattcacagggttattataaggatttagtgatataataaagtgctcaaagaatacaaatgctataataacagttattattattagttgttactgtaattagggctttaggacttcaaattctacactgtgtaagctacaggatcctgccttatacaataccctctctaccacattattcttggcctgtataatatgctttaataaagtctttcagggtaggaaaaggcccgtgatataccgaattctgtactactgcagaaaagctcttatacagtcagaagatgagctgccttccttcaaatctaacctagaattgtccaagatgcagtaacccttatcacaggaatgaagaaatctactctaacatctaagtttaattttttaaatagtttttttgttttttaaacacagggtctcgttatgttgcccaggcaggactgaactccttggctcaagcaacccttccacctcagcctcccaagtagctagtattacagggatgtgccactgtgcctaattttttaaaactctggcaaggaaaaaaaaacaaaaaacaaaaaacccaacacataccaagtcttattaatcaatggaagtagctagtatatgcatttctatgcaaaatttcaaattctgaattcttcagccagattctgctggggattaaaaaaggggggggaaaaaaggccagatgtggtggctcacgcctgtaatcccagcactttgggaggccaaggcaggcagactgcttaagcccaagaatttgagaccagtatggacaacatggtgaaaccccatctctccaaaaagtcaaaaactggccaggcgcggtggctcatgcctgtaatcccagtactttgggaggccgaggcaggcagatcacttgaggtcaggagttcaagaccagcctggccaacatggtgaaaccctgtctctactaaaaatacaaaaaaaattagccgggcatggtggtgggcacctgtaatccaagctactcaggaggctgaggcgggtgaatcgcttaaacccaggaggtggaagttgcagtgagccgagatcgtgccactgcactccagcctgggtaacagagactctatctaaaaaaaacaaaaacaaaacacacacacacacacactagccaggcttggtggcacatgcctgagatctcagccacttgagaggctgaggtgggagaatcatttgagactagggaggttgagggtgcagtcagccatgattgtgccacgacactccagcctgggcaacagagtgagactctgtcgtttaggctggagtgccgtggcatgatctcagctcactgcaaccttcgtctccccagttcaagagattcacagctgaattctaccagacatacaaagaagaacatcctactaaaattattccaaacaatcaaagaggagagactcctccttaactcattctgtgaagccaacatcagcctgataccaaaatctggcaaagacacaacaaaaaaggaaaacttcaggccaaaatccatgatgaacacagattttttaaaaaactcttaacaaaatattagcaaaccaaatccagtagcacatcaaaagttaatccaccatggctgggcgcagtggctcaggcctgtagtcccggcactttgggaagctgaaacaggcggatcatgaggttaggagttcgagaccagcctggccaacgtggtgaaaccccgtctctactaaagatacaaaaaatggccgggcgtggtggcttacgcctgtaatcccagcactttgggaggccgaggtgggcggatcacgaggtcaggaaatcgggaccatcctggttaacacagtaaaacctcgtctctactaaaaatacaaaaaaattagccgggtgtggtggcggacgcctgtagtcccagctactcaggaggctgaggcaggagaatggcatgaacccgggaggcggagcttgaagtgagccaagattgcgccactgcactccagcctgggccacagagcaagactccgtctcaaaaacaaacaaacaaacaaacaaacaaaaaaaaaccaaaagattagctgggcctggtggcacgtgcctgtaatcccagctacttgggaggctgaggcaggagaatcacttgaacctgggaggcggaggttgtagtgagccaagatcatgccattgcactacagcctggactacagagcgagactctgtctcaaaaaaataaaaaataaaaaataaaaataaaaataaaaaaattaacccatcatgatcaagtaggcttttttgctgagattcaaggctggctcaacatacacaaatcaataaatgtaatttgccacatcaatagaagtaaaagcaggccaggcgcggtggctcctgcctgtaatcccagtactttgggaggccgaggcgggaggatcacgaggtcaggagatcgagaccatcctggctaacatggtgaaaccctgtctctactaaaaatacaaaaaaaattagccgggtgtggtggtgggcacctgtagtcccagctacttgggaggctgaggcaggagaatggcatgaacctgggaggcagaacttgcagtgagctgagatcgcaccactgcactccagcttgggcgactgagcaagactctatctcaaaaataaataaaaataaataaataaataaataaataaatagaagcaaaagcaaaaaccacatgatcatctcaatagatgcagaaaatgttttctttttttgagacagggtcttgctctgttgtccaagctggagtgccatggtgtaatctcagctcactgcaacctccacctcctgggctcaagtcatcctccaacctcagcctcccaggtagctggtactacaggcacggccaccatacccggctaaaattgttatattctttgtagagacggggtttcgccatgttgcccaggctggtcttgaacttctgagcccaagtgatctgccagtctcagtctcccaaagtgctgggattacaggagtgagccatcgcacccggccaaaaagtaataaaaaaagttctgaataagtaagttctcatgctctgtgtgagtaagcatttatccaaggcagcgctttgaaaatatgcacatttcttacagcatctctcaaaaacatgcgaaggcccacataaagaaaaccacctcactcgttttacaagtatcataaaccattctgtgtactatagctttgagtcacacattgctttctgaagatcatacttactgttcaacctggaaacctgaagaagtccccttcctttagtactttttctagtccttattaaaaagaaacaattgtcctataatctttctagtcccttctagaaacaactctgagatggttcctatttcaaagttaaacaaacaaaaaacttatcaaaatataatttaaaagccatattggaaaaacacaaacagccttccagagacttacttttcctctttgccctgaacctccactatatgaatggctgccatttgaattcagattaaagacgaaaccgactgacaaaaaagctattaattaatgaatgtgcagaaatgagtttttgtttttctttctttaaaaacttttttcagcctgggcaacatagcaagaacccgtctctacaaaaaataaaaaatattagctgggtatggtaatgcgcctgtagttccagctactcgggaggctgaggtggaaggattgctagagcctggatggtcaaggctgcagtgaaccgtgattgcaccactgcactccagcctgggcaacagagcaagaccctgtctcaaaaaaaacaaacgaaaaacaaaaaaaccctggccgggtgcagtggctcacgcttgcaatcccaacactaggaggccgaggcagacggatcacctgagctcaggagttcgaaaccagcctggccaacatggtgaaaccccgtctctactaaaaatacaaaaattagctgggcatggtggcatgcgcctgtaatcccagctacctaggaggctgaggcaggagaatcgctggaacccgggaggcagaggctgcagggagccaagatcgcgccactgtactcccgcctgggtaacagagactctgtctcaaaaaaaaaaaaaaaaaaaaaaagcccacaaccagacttttttttcgttttttcaaataaaacaatatgctgtctcagcccgctcttttagggattttaaaaggtgtgacccaccttgctaagatctttggcagtcacactatcgtcatcccggcagggcaagcgatggacgaacgctaacatctgatacttggctctgatgaattccgctttattgggactggttcaaaaacaaaaaagaaaacagttcactcgttcagatacaacaatccccattctttgtactgtaaaaagaagaggaagtgacccacatcccccacttgagaataaaatgaacaatgctcaagtaagtttcagcaaggtttaagacctgcagtttgaaaacatacattagttattataatggctgggactccagagtacctgctttttatagtagccctcttctctgtgtaattgtctgaactgatttagcaactttgggagaaagcagcatttagtcccatcttataagtgaggcaacaggcagacgggtgcccagacctagatttctggtctgatcgcctcttatttgagtataagtttaaatctgattacatttacagactccaagccatggtttccaactgaggaagccacttactcctgctgggtggccatgctaaacagatggtcctgccccaccccattctgcatttctaatagcaaagaacctgatgcacaactagggtaaccccctcctctgctgcccttgcggagactgaccaaaaatagctgcactcctttcagtgggccccatttgttatgaagaaataaaagtatttataaacattccactcactgtactttatcctgtggattagctttacgtcttccactcataatagacgcagggtccagcaaagaatgctcccatatagagttagcaccgttattatacaaggtctcaaccatctaaaaccaagcaggatgacataagactttaatttcttttcacaaatattcaatggggatcagtgactgaacagagtaaacaaagtcctgttataaacactcatttgttaggaatatcattcatatcattgttttctgatttgagaatgagaaagatgatcaatctatatgcaggattcagctttgactagtaggatagttaaatacctaaagtgtgactgaactgttcttattctgtatgaaagaaaaaaaagtactctgacaccttagagcagggtttcccaaacctaattaaacactattttcaacattcttaatgacccatgtactgtctatattattcacttaatatttgtctttaaagccacttacttgtaaaaacaactacagtttgatgtgctagttatagctttcccatacacagtaaaataatgtaaccattaaaaaaaacatgtattacctacatctgtcttgaataccactggtggttccacatttggggaattgttgctttagggtcaaccctggcattctaaacaactcatctctggactttactgagactctgtactacaatctggctttgcaaacacagacagacctgagagcagtaaacagcccctttcacatgagcgtgagcggttagaaacttctaagcaaaagttagtaataaatcatatctccaaatttcatttcaaggcatgactcctaaaacagccccatctgttttttacagcagtgtagttattttcacatcagagatacaaacccacttgttttggctccttggttcacacagccaagtttaagggatatgtgcagctgtcacagattcagtgaaatgtgtaatcaagacaaatgaaggcaaaacacacacttaaccttgagttccaagagaacttgaagaatgtgtaccccaagatagaagtaaaggtgacatgacattggactccagataaaacaaagaactcatttaacagggtattctacatgcaatcaaaacatattaatttaatttggtctctctgactagtaacaagagctttaagaaaacttaaaatgtttcagaagtttctgaggaatcccagcccatgctgctatcaaagcagaaaaacatgttctaaaaatattagcaggtactcaggaataagtacattaaagaaaagattctcaggcagtagccttcagaaacattcattatcatgcatagaaaagatggactactggccgggcgcggtggctcacgcctgcaatcccagcacttcgagagaggttgaggtgtggatcacttgagttcaggagttcgagaccagcctggccaacatggtgaaaccccttctctactaaaaatacaaaaattagccgggcatgatggcgggtgcctgtaatcccagctacttgggaggctgaggcaggagaattgcttgaacccgggaggcggaggttacagtgagctgagatcacgccactgcactccagcctggatgacagagtgagagtccgtctcaaaaaaaaaaaaaaaacatttccgatgacagtctagaaagtcaacagagcaacagtaccaagatattttaatgactattcatctatctacctataattgagcttgttgaacaagatttatgtcaagtaggaagaaaagtctttactgaattcaatacagataatatttgtaaatagcattgatgggcatgccatctctattcaattatgaaacagttttgtcttatggaagaagtacaccaggagaaatttaagttattaacatgatgagccctaaaatgtaaattaccaactgtcaggagaattcttatcctttacctgaagcagtgttggaggccacggtgtgtgtttcagatgcctcacttgggagatatggcgccctagactccgatggacactgcagcactcatcacataaaaacgttcccctatttactgatgcccaggaaggatctggaaagagagtgaaatctcagtggcagggataccagcaggttgctataccgccagatggcaaaagatgactgaagtttggtttgtcagaaaaaggagacatttttgtttcagtatgctcatcaatgcatcaggctggtcatcttgttggatggtatgacctaccttggctgattaggtacaatgttaattgagactaaaaacaccagtgggagccttgggtaaacagttatcttctttctggttcagggccacagtttgtagccctaatgtggatctaccatttcagatgcatgctttttcattcaagctaagaaagcaaattgagagggtacagacgaatgattttggatccatctccataaaaatcaagataatacttttttttttttttttttttttttgagatggagtctcactctgtcacccaggctggagtacagaggcacaatcttggctcactgcaacctctatctcccagattcaagcaattctcctgcttcagcctcccgagtagctgggattacaggcatgcaccaccacgcccggctaatttttgtatttttagctgagacggggattcatcatgttggtcaggttggtctcaaactcctgacctcaggtgatccgcccacctcggcctcccaaagtgctgagattacaggcgtgagccactgtgcccggccaagataatataattttgacagtgaattatgcagatagcattttctgcagtaaatgttgtagactgctgtcctaattcactgctatgaatcaacatgtcaatatgcttagcagaaagctgcgagttacagaatcataaaatcactcagctgctatggttctgaggacagggaaacctggcctcttccattaggaaatgttctatgatgtccatgaattggtttgtttgtctgtttgtttgttttgagacagagtctcactctgtcccctaggatggagtgcagtggcgcaatctcggctcactgcaacttctgcctccagggttcaagcgattctcctgcctcagcctcccgagtagctggaattacatgtgtgtgccaccagctcggctaatttttgttatttttagtacagacgaggtttcaccatgttggccagactggtctcaaactcctgacctcaggtgatccactcacctcgacctcctaaagtgctgggattacaggcttgagccactgtgcccagccaattaattgttttacataaactaccaagtccaatcctgcaactgatctgaaaaaaaaaaaagaagttgcaataacagcagcttcacagaggcaaagatgtaaaataaaaatgaataatatttttagtgtgtgtataatacttttttccctttaaagtcatagagcttcattagctgtcctttgaaacaaggaataatttcatacttggcaagcaggatggatctgggtaagtaaactgaatacctagaaacctcaaataaagaaagagctatacttcgtcagactcacaatggggtgacaataggtgccacttaagctgcctggtcaaagggttacatttaaaaattcttcaatgtccacaaaaatctctaaaatgcatgtacaccatctttaccattttttaagagtttattcaaaccctttcaaaccatataatgaaaagttatgggctttcaatcaaagacgaatcctgggagccagtgagtatggtggttaagagggttggctctagagacaaggagttcagggtttgaaccccaactctgccacttcttgcacaatgatctcagacaagttacttgagtgttttcaccatggttcaaatgagaacaatgacaaatctcgggatagtaaggatatagagaataagtgaagtacctcacacatagtaaagtagtaatgttagttgttatatcttttctaaattattttctcagtattcagatattttctagacgtgaaattcatgatcactggacaaagtttttgatgggaaatacttaaaacattgaacatttcatgtgaccactctactactgtactgaaaatctccatggagttttcaagtaattgaactcagagtgtgatgtatttgaaatgaaccagattcattaaaaaaaaaaaagtagaatatttaagaagatgtgatcatggttaaatgtttgcataaaataaaacagaatcaaaataattcaatttagtataactctgtcgctattactgtatcatcctaaaaagcagagattggaaatgtccagatgaaggagctctacaaagatgcattaacaacactgcttcctgcagtatagtactgacactaatggcaaaaaaaaaaaaaaaaaaaaaagactgttttgaagcatagctttggttttcacttattcagaggatttgcagtattctttttttagcaagtatttaacacatattaattaagacaagtattcgactaaccactttagcatcctggatcagaatcccatggaaagaatattagaatgttaacatagtaaaataaaaatgtttgtatgaatgagattgggtaaaaccctttaagttcatctggagccagggctccagggacaccacaaatgaacttcaaaaatgtttgtgactcccccagacaaatcttaggtaaattcgttcacgtgcattttaggggagaaggccttagcattcaacagaatctcaaaggggtccctaaccctacaggtaattctctcagtagggctgtgcagaaaaggcagcacaaattcccagctgctcaatttcacagaatatttcaaggtagcctaattatattcaaaacaggaaggaagtgactcaagtctctgcagattaggcgtatgagacaacaactaaagcgatacaatggaagagaaaatgttctgaaatgcacaaaatgctgcaaaagtatatttaggatggcaatggaggaacaattttgctttgccctgtaccctatcaagaagcaaaacaatatgcattccaagaggaagttagaagctagacacatgtgaatcaaatacatcacggtaagttcaactgaaaataggcaagaaaataaggaagtggaacaaataacatttttagagaaaatgatggagtttgtataactcacactaacttggtttagaaaacacttctttttaaactcctccataccccctccctatcttcaaaggaaactggtaacacctgcactgtacgggccataaaacaaccacatgaggtttgagttatcacagttctatttacaattggtctccacttccaaatgacaagcttaagatcagaacagttgcaaagccagtggtgttcaatgatttaattaagattgtttatcggacactattgtgccaagaaagccatgttaccttcgaattaactcaaagccaatacatccaagcacctaaaacagcatgtaataatctatccagagacctgacaattcagttgcaattgctaagacacacttgatctctaaatgtgaatattatgtatgaacagttatgcatcattatgaaggaatggctttagcgtttcaatgcccctatattgctggtgattttgcgtttgtttccgttgtaatcaacgtatgatttagatagtcaaatatagctttaagggactacaagagttctactgtagacagcataatgcaaaaaagaaaagccttagatgatatgattctacgagtattcattgaatcttcctcaccactaagcgtgatactcccgattatcctcattgaaaaaaatgaggaaatcaagcaagtgaccaagtgaagtcaccagcccaaggtcagccagaagcaaaatctagtttgaacccaggccgttcagatcctcaaacttgagacaagcactgcctcctaagtgctggttgtgtttggaagaccccgatctcctggcaattctcccgggcagagtagctgtcggatgtcagcagcggggaagtcatctacggggaccctctggcgagtctcagggagtgtcatcctccccgggcaggacacccaggcggagaaagggtctagtgggaggtgacacctgcagcctctggaggctgcagccgggaggacgctcacattttacttctgtaattggctttcctgtggattgcccaagccccttcctgttgggggagcagccctggcccccgtcacctccccagttggcctaggacggagggaacgggagggaacgagagggaagggagggccgcgagggacggggagggcggcggccccctgcccgcccggctctgacaggcccgggacggttcccaccccaaggccgcccagggacctcttcgttgcgaccctagccgcgggatgcagcctgacctgagggggcggccccggggtaggggtccgggccaggaaagcagaggggagcgggcccggccggtgcgactcacccggcccgctgcagtcagcgcacacctcgctgctccggagccgtttcgacatggctcccacctcccacctgcggggaactagaggccgggggacagcaaaggcggcggtggcggcggcgcttccgctctaacgggtcccagctgcggcggcgctgacggcggcgcctctcccctcagcgccttgcagccttggcacagcacgcacgcgcggggaggt

SEQ ID NO: 1649 - DNA, 66589 bp, Homo sapiens; identical to SEQ ID NO: 1647

SEQ ID NO: 1650 - DNA, 66589 bp, Homo sapiens; identical to SEQ ID NO: 1647

SEQ ID NO: 1651 - DNA, 66589 bp, Homo sapiens; identical to SEQ ID NO: 1647

SEQ ID NO: 1652 - DNA, 66589 bp, Homo sapiens; identical to SEQ ID NO: 1647

SEQ ID NO: 1653 - DNA, 78424 bp, Homo sapiens
ggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgccgggagggggtctataggcgccgcgacctaccccatctccctccacgcttgtgggggagtgagtggggaaggggctttgggagaggcggcgcgcgggcactgaggtgcatcgtgagcttcccggacttgacagcatcaaaggaaaatcctggcgagcagccagggccagcgagcgaccccagcagcagggacgcggccgtgcgagagctcgcggacaggcgagggggatcccaggggagcagctgctgcccacgggccacgggcgatgcacggagtggagaagtgaacgtggtctacaggatttctgtccggaaggtggagagcgctacaggggaatctcctcgattcctgtccgtctcgtaacttggcaaaagctcgcgccactgccctccggcctgggcgacagagcaagactccgtctcaaaaaaaaaaaaaaaaaatggcaaaagcctatcgctctttgtcgaactccccacgttccccagtcacctggctggggttcgttggtgtcaaaaccccagccttggtgccctcggtgccagcaggaccctcgcccactggctagcggaattaggcacctgcacgcgggctcctcattgccccggagtgtggggaggaaggggcttctgcatcagtctccagccaccctccttgggacacaagtggcagggccctggcgtggcttggcttcatttcatccctagtggctccaaaccgtggaattgactaaacaaatgttcaaattcgcaaaacggtctgacttccgccccaaacttgacaaggacatttctagtgaaattactctatctgtaagttttttggcacaaccatagtttgcaatttactatttttgttaaaatattttttctccaaacctaatttttttgggggtctcatcctgtttatcttctgttcgttaagtgacatctttctttcttttttttttttctttgagactgagtttcgctcttgtggcccaggctggagtgcaatggcgcgatctcggctcactgcaacctccgcctcctgggttcaagagattttcctgcctcagcctcccaagtagctggggctgggattacaggcatgcgccaccactcccggctaattttttgtatttttagtggagacggggtttctccatgttggtcaggctggtcttgaactcccggcctcaggtgatccgcctgcctccgcctcccaaagttctgggattacaggagtgagccactgcgcctggccataagtgacatctttcttatcacgtattagtaacgcatatgagaggcagtgttgccaaaccagtgggagtcttgagctctgtaactgggttcagatcccaacctaactgcataaacttggactagttacttatcctctctgggcgttagtttcatcatctgtgaaatgggggtaataagagcacctacctcggcagctcagcagagcacggtggctcactcctgtaatctcagcactttgggaggccgaggcaggtggatcacgtgaggtcaggagttctaggccagcctggccaacatggtgaaaccccatctctactaaaaatacaaaaaattagccgggtgtggttgctggcgcctgtaatcccagttactctgggggctgaggcaggagaattgcttgaactcaggaggcagaggttgcagtgagccgagatggagccactgcactccagcctgggcaacaagagcaaaactccgtctcaaaaaaaaaaaaagagtatctacctaatgtgctagctgacagcattcagtaaattaataacatagagctcttataacgggatggcacataccaagcaaaagctgttattactattattatattgatgctaaattggctagacttcaaactataaataagatcagtaacagaatgcatatttttgtatactataaagagtatgcataatgaaacacatgtccatcatccaaattagaaaaacagtcttttttttttttttttttttttgatgctgggtctcactctctcacccaggctggagtgcagtggcacgactgaggcccactgcacccttgaactcccagattcaaaggatcctcccacctcagcctcaggagtagctgagacttaaggtgcctgccaccgcacctggctaattttttaattttttatagagacaggatctcgctgtgttgccagggctgatgaacagccagtttaagagaatctgaaaatgtaccttaggagcttgaagtgctaacttgtctgagatcactgtaaacgttttagctgaaacaccccttatatcaaaaatacagaatgatgaaaatcaggttacttattctacctccttcgttttacagatgaggaaacattcagagaggttaagggtctgggccagagatctccagctaattaggggccaaaatagaatgaagacttctgactcattccccagggctcttacacaccacactgctgatttcctgtttactacggattaatgaactgttaacagatagaaagtataaataaggaaaaagtgtacgagcatgtgctatctctagcaccaagaaggaccaggcagtcatgtcgtggctactgttgtcccacagctttatcttggtccctcacattataagacatgaccacatgactcgcctcaggtaaggtaaggtcacagatcaagctattgtcagagccagcattagcattttaggccccacttgggtatacatttgattgcatattctattaatctcctgtagcagttttagaaatcatttttgagcttttcttgaattcttaaaatatccttccagctggctttgaaggtctttcctataagaaagccttttagaaaacgccttcaaaattacacagaaggagattttattattctagattttatggactagcgagagtaaaagagaaaagctttcttattttaatgcagtagcctgtaactggtttcattccaggcattaagtattaattcctgaaatcctgctgttcttttatttccgcatgtgggcatctaaccacattcaccttccatggacagatgcagatagtggcttaaaggtccagccctcacatccacagtttaagaattatacagcagaggccgggcgcggtggctcacgcctgtaatcccagcactttgggaggccgaggcgggtggatcacgaggtcaggacatcgagaccatcctggctaatgcggtgaaaccccgtctctactaaaaaatacaaaaaattagctgggcgtattagcgggcgtctgtagtaccagctactcgggaggctgaagcaggagaatggcatgaacctgggaggcggggcttgcagtgacccgagattgcgccactgcactccagtctgggcgacagagggagactccgtctcaaaaaaaaaaatgaattatacggcagagactttctagtgaacatctggtcttacaaagttatttatagggatggtgtgtcttccaggggaggtacttctaggaattatgcctgcatccttgaaaaaggaaaccgtggttttttccagtgtgtgaactggatactgagtatcttactcttttttttttttttttttttttgactccaagaaacctcttgcatgaataccctactcttgaatactttgcatcttgggatacttactacatgttcttagacagaaggacagggcattaagaagggagtgactttctagcatgctcccaagccagtttggcagaacttagttttgaaatcacatgtgtcaagttaggtcccaatatgattataatgtgaatcactgtccaattgggaatatttcagattggttttcagtgcaccaccaggtgactcacaatgtgagcttctattcaaacaagtacagtgtcagtcagcaactaatagggctcactctgagtcagagcttagcatttagtacaataagtgggagtcactgactacacggcaccatctgagatggtccctgaatgttactttgcgcagctagctcaagagttaaggcgacgctgcttggagtgagtcagttcatagtacaattgaatgggctcttggagaggccattcacaatcaagtttgatgtggctgagtgctcagagtaatattacatgattataaattcatggagtagattaccttgattctaatccagctgattagagtctagctatttgcatagggaatcacttgtgaaatatgagtaatatgctctgttgcccagcagtgatattttacatgagttatttcaatagttattaaagccagttgacctttttgattttgaaagctcaatttctagttacgcatttattttattctaaagtgtaaaatccttttcatgtgagcatttgggttttaggcaaaggcatctcatgcaaagttatctgatagcttggcttcctgaggtgctgggttgtacgatgtgcacctccgtccaacagtgaaggagtggagaacgccctgctatctggtttgtctacatttgtgcccctctgaagctgactgaattgtggttgttcaaggctggagcacaagtttgtactgctgctcttagactaaggacactggggactttaacccttttagggctgaatggctagaatcaacacttatacagctgttgaatttttgcaacattggaaagaattatgtaacctactccttacctcacccttataatggacttttatgtctcagggtggggtgataatgtgatttaagggactcgtagatttctttctttctttcttttcatgtcttttattaactaatacacaattacttgtcttctggtttgttgaagcaataaatcagacaacattagccacaataatgcctgtcagagtggctggccataaaaactccagcaccgcattcatctgaagggcactcccagcgaaggccactaattctgccattttcatccaccttatagtatttcaggacacccacttcaccttctttctcttatgcttattcttgggagtcgtgtaagatttcttcctagttttagcactaccatgaagtctcaacacaacataaaaagagtaaattccttttgaatgttgtagtcagagaaagttatgtccatcttccagttacttgccagcttccagtcacttgtctttgctgatcaggaggaattcgttccttatcctggatattggcctttacatttttctgttgtatccaagggttcaacctctagggtgatgatcgtccctgtaaggatttttggaaaaatctgcattttggtggaggctccacctgaggttgagggaaatgaagagatgggttagactgtggacacaagagaggtgacacaggagagggtgctggccagagagcagcccaagagcacacgcccatagatttcttaatttgtataaaagtcatgttgataattaatgacaggaagtcattatccagagaactcagattagactactgttaaaaagtacatgtggccaggcgtggtggctcacgcctgtaattcccacactttaggaggccaagacgggtggatcacttgagcccaggagttccagaccagcctgggcaacatagtgaaaccccgtctctttaaaaaatgcaaaaaattagctgggtgtggtggtgcacacctgtagtcccagctacttgggaggctgaggctggagaatcacctgagcctggggacactgaggttgcagtgggccatgatcttgcctctgccctccagcctgggcaacagagtgagaccctgacttaaaaaaaaaaaaggtatatgtatatttttctctattcatcttttgatgactccagaagaatcttacatgtatggggtcttccattatacattcattgtgtttttacaaatacttatttctagtgactacccagatataattcatatatctcctgccataaagaaaggtatagatatttctttgcatttaagggggactttacatacagagtttaattcttcctgacctactataatccccgcaaatttcagttgttaggactgtttaatgaattagagtatttctaaaactgaaacaaagtttttctgtgtttgttaggtttcagtgaggagctatttggtatttttgtgaggtttatgacagcttttaacttcatttacttgagttataacttacagtaaagtttacacatcttaagagtacagcttagtaaactttatgtaagtgtacccccacagaaccaccatttagatcagggtttctcacctcagcactgtggaaatttggggttgaacaactccttattgaggggggctgtccattgccctgtaggatgtttagcagtatccctgatctccacccactgcatgatgcagtagcgcccctccctggatgccatgaccaaaaatgtctctagacattgccaagcgtcctctggggccaaaatcactcaccacggctctagatgaagatataggatattttcagccccccgtgctctcccaaagattccgtctcgcttccttccattcaggactcactcccacaggtaaccacttttataacttttttcaccatataccaattgtgcctgcttttaaacttcatatgtaattaaacagtgtataatatttgcatctggttctttagctcagcattatgtttttgagattcatttgttgttgtacgtgttgttattttttaatgctgtgcagcgttcctttgtgtgaatacaccacagtgtattccattccactactgaagaaattttagttgtttccagtgtggagctattatgaataatgctaatatgaacattctcattcatgtcttttgatgaacttatttcctttgggtatatgcccaggataaaaattgttgggtaataagtccagtgtatgtttagctttagtagatactgcaaaactgtttcatagtccaaatcagtttacatccatccccaccagcaaagtgtgtattgcttcacatcctcaccagtacttagtattgtttgcccatttaactttagtcattctggtggctgtgtagtggtatctcattatggttttaatttgtatttccctggctactaatgatgttaagcatcttcttatatgtttttgggtcaagtcatttgtatattttctatttaaaatgcctctacaagcctttggcccatttttctttttctttctttctttctctctctctctctttttttttttttttttttttttttttttttttttttttgagacagggtctcactctgttgcccaggctggaaggcagtggcacaattagccgtgaagctgagactataggtgtccaccaccacactcaactaatttttttattttggatattgggaaggggtagagatggggtttcaccatgttgcccaggctggtcttgaacttctgtttggcccatttttctattgtgccgctgatcttttattattgttattattgatctgtcacagttctttatatattctggatacaagccatctgtcaaaattctgtgtgtgtgtgtgtgtgtgtgtgtgtgtgtgtgcacgtgctgcaaatctcttcttccagtctggcctgcctttacactctcattccattatcttttgactttcctagtttctgttggaaagttatgcttctttgaaggtagcctgttgttatcctcataaagtttttctctcatttttgacttaccacagtgaatataatgtgcctatatgtggttttcattttatttattctcctttgggttaactgagcttcttttatctgtggattgacgtctttcatcaactttggaaaattttcactcaatatctcttcaaatatggctttgtctggttttctttctttctctcctgcttctgggacccaaatcacagatatgttggcctttttccttcatgtctcttattgtctgatctgttttgttcatttcgcatatctttctgcttcaatttgaatattttctgttgacctgtgttttagttaattaagctgtcttcctctgtgcctgagtcttctgtcaaatcatctagtgagttattaatttcagaacttgttttcttctaaatgtagtatgccaatttgattcattttaatacatttaaattatctgatgaaatttcccatcttttcatcagtttagtccatctaattcttatctactaaatccaatgagatcatctgtgtgcctgtatccatttttttattcatcacatttttatctctcttcacatatctagtaatttttattatatgtagacattgtatataaagaaactgtgtaggttctggtaatttcttccaccagcaaggattgaatctcccttggagggatttcctgtctaaggatgaaggactgaagggctgatcacttcaggccagcaggtattagaatgggtcagatctggtaacagttttgggggtttttttgttttgacatggaatctccctctgtcacccctagaatggagtacattggcaccattataacctagaattcctgggctcaagcagtcctcccacttcaacctcctgagtagctgggattacaggcacttgccaattcacctgaccattttttacaaatgttttgtagagatggggtctcgctatgttacccagactggtggctgcagttttaataagatttagctaatgcccagttctttcttgttccttgggaattttctcttggattccagaatgaaagcctgatggacttctatctccttggtctcaaaagaatggaagactcagtcttgccttcagaggttttaagtttgttctttgcctccaccttccccatatggccgccacatttgataaatgtcttgtaggacccagccatgtgtttgaggaagtccttgttactgaaggggacttgttctgccacatgagaaaagagtccctttatgtccacagcttgtgctaacggtcagcaaaagccctcaggaaaaaaacagctagtgacagacagctcagcttggaagaactctcttactcagaaattttagtttatataatatttttgctttcacagttctctgatgactttagaaatgtaatttcacttatttatctgagttttttagttgttgcataagaatagtgatttgggccaggcgcagtggctcatgcctttaatcccagcactttgggaggccaaggtgggtggatcacttgaggtcaggatttcgagaccagcctggccaacatagcaaaacctcatctctactaaaaatgcaaaaaaattagccaggtgtggtggcgtgtgcctgtagtcccagctactcaggaggctgaggcaggagaatcgcttgaacccgggaggcagagattgcagtgagccaagatcatgccagtgcactctagcctgggtgacagagcaggattctgtctaaaaaaaaaagtgatctgccttgacctattgacatttttcttgaattaattttctgtgtattacattgttatctttcttttatatcatttgtttccaatgtaattcagaaaatgtgtatttaaaaatttgccatttgtgagtgtaaaatgtaatacatgttttgtcagtttgaaaacactggaaagaaaagaagtatgttataatttttgcaactttttttttttggtcagtcccttcatctaggcagcctaggcccagatttttttttaaattattattattattacactttaagttttagggtacatgtgcacaatgtgcaggttagttacatatgtatacatgtgccatgctggtgtgctgcacccattaactcgtcatttagcattaggtatatctcctaatgctatccctcccctctccccacaccccacaacagtccccggagtgtgatgttccccttcctgtgtccatgtgttctcattgttcagttcccacctatgagtgagaacatgcggtgtttggttttttgtccttgtgatagtttactgagaatgatgatttccagtttcatccatgtccctacaaaggacacgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgattacactgttggtgggactgtaaactagttcaaccattgtggaagtcagtgtggcgattcctcagggatctagaactagaaataccatttgacccagccatcccattattgggtatatacccaaaggactataaatcatgcaactctttatgcttcagattgcagttatgtaatgtaaaaagcatgagtattggaatgaaagagaactaggctcaaactttgactttgatcattagttttgtgagcctctgaatttgaatgtgtatagcagtgataagaatacttgctttaacgtaatacatgtacagcagagggttcaagagagtatcagtaagtggtacctcttgccaatattctcctaatatttatcattattttaagcccctgaccatgtataatttgattttaaacatttatattttgatatatttctatttggtacagtttctaaaattttcaccatttgaacaatgttcttttaaaaaaacttaatataaaagacctgtaccatgacttaatatccaggaaaaatattactaataagtttatgaattcatatttggcctaatctttgtcacttgtagacccccaaaaaatgacctcctgaaactgaagaatttagataaaatttagttgcagaaagaattgcattcagaatagtcactctcagtaaaatccacatttaactacttcgtgttatatcaagtagggcttataataagatattggcaataagaaaacaatattaaaaaatattaagaaaaggctaacagtattttctggaaagaatagctggttgacctttgcagaggaaagtctatgtggagactgtaattttaacattatctccatgaatgatttaaatataattaattttcatattagatttcctgttgccaagttgctcttttattttgactatggcatttgcttcttgaaaaaaaaatactatattaatatatagaaatagttagattctactctaaagctgagatgaaaatagtaaacctggaggcggagtagcaggactctcctgacctgggccaggaggacagcactgatgtgtgtgtccccaaggccttggacttatctcagtctcacctgtcatctcactcttattatctcagcctttagttccttactttgatgacagccagcttcagtgacagccggctttgctctctgacctccgtattctgaggactgctctccttaccatttgtgggcagatttaagtcaaagcataagagtgaggggatctagttatgcaacaacctgaaatttatcaaattctcactagagctaagtttttgccaaacacataagttgccttcggccccttgagtgactggttaggcagtgctgttcttttggcaaaatgaaatacttattaacaaaaacaccagaacatcataaccagaccacatagaataaatttggcttaaaggatgaaagagtactaagaagtataaaaaggataaaattatgcaaaatctagtaaagcgaaaaactcacccgagcatgttaaacaaatgtcataaactaaacaaaaggctttatttcttttctttatcttctagtgatctgtgttcaaaatcataaaggcatttatgaaaagtataaatactaacttaggtagataaaacatttgttaaaatctatcaagtctggtctgataattaggaggctacatatagcttatattttcttaattgaaacaggtcccctatgtgccattttacccaatacgttagtatggaggtttttgtcctgggtctctgtgtccaactgccttgttttgtcttactgaaaggttataaatgctatggttccctgcgaagagtccaaagcgcataaccactgaacatttcaagtctgaaatttcttcaattttagatctgtttgttcaacatatctactatttgacacttcacaccaagggggagggagatctaaaattcagtagatattttggtgcaaactgtagaaaactaaaacctcgaggagcagagattctcccatgcacatcctaggaactgcagacaaaaacattctgtcagcttagcccagagaactgtcttgggaatgctaaggccctgtgggacaacgtaatgccctggagtttctattagcccactcgaatcaacagcagaccttctgggaaaaggactccagaagacttcactgatgggcctacacaaataatccaaatccatcgaatgtggcccatgtgcagctgtggtatgaggggcacagttctgtggggtgacagatgcatccatgccttgaaccacatgatctagattcaagtctgtttggggctgactgaatgtcaggcacattaggcaacctccctgaagctgagttttccctattaataaatgggatctcaaaatctccacaaaatcatttcacatattaaatgtaagatgtgatacatttgctcatgtaaacataggggaaaattgtgcaatatttagaccctgatagagtttggattttttctagtgtcaggatttgccattgaagcccacaggaggggactaacaggatctggattctattttaaaagagttagtaaatattttaggcttgtgggtcattgcaattactcacctctgctactgtagcagaaagctgtgcggggagagggaaggaggtggatatgggacttatcgtagccatcgagacaagagatggggccgccagcctaggagaagtagcggggatgcagtgcaggcctggcgtgagtcctggagatgcagtgagcttgctaatgagtgatgcatgaggaatcaaggtgacttcttgatgtaggtggatggtggcaacatgtgtggccatggagaagacaggaggtgaaacagaggggctggaggaggagatgcaagattccatgttagaccctagagatgtccaggagagctccaactgtggtgccaggcagctggttggatctgtgtgtatggcacccagggaatggcctgggctagaggcagaaatgtggattcgttaggctctgatgatgtgcagcctgctgtactgtggtacgctaaatgatcatgaagttatggtgggaagccttgaaaataatcagtaggatcttactactttagaatctgcgcttccttttctcaattatccataaacagtctatgaagaatttctgtttatgacaggggtcagcaaacaaggcacagggccacctccagccctctgcctgcttttgtatgccctgaacactaataatagtttttctttttattccttttttttttttttgagacagggtcttgttctgttgcccaggctggagtgcagtggcgggatctcggctcactgcaacctctgcctcccaggttcaagcagttctcttgccttagcctcttgagtagctgggactacaggcacccggaaccatgcctggctaatttccttgtatttttagtagaaatagggtttcaccatgttggtcagagttgtttcaaactcctgacctcaaatgatctgcccgcctcggcctcccaaagtgctgggtttacaggcatgagccaccacgcccagccaagaatggtttttacattttttaattgttgggagaaaaagtgagaagaataaggccagacatgatggctcatgcctgtaatcccagcactttgggaggccaaagcgagagaatctcttgaggttgggagtttgaaaccagcctgggcaacaaagcaagaccctgcctctgcaaaaagtaaaaaattagccaagtgtggtggcatgagccttagtccctgctactcaggaggctgatgcaggaggatcacttgagcccaggaggttgaggctgcagtgggccatggattgcaccactgcactccaacctgtgtgacagagtgagatgctgtcccccccaaaaaaagaagaatattttgtgacacatgaaaattttacagaattcagatttcagcattcataaagatttattggagcacagccatgctcatttgtttgatgtttgagctgcctttgtgatatagaggcagaattgagtagttgcagacagaccaggaggcctgcaaagtgtgcaatatgtatgctctggtccctcactgaaaacatttgtctacctctggactatagcataaatataagtgtggggtattactaagtttttgtaggaaacaatctgtatgaaagtaaatacgaagttcaagcaatgacagttttaattcttatagaatagtctactctttaaaaaaatttcaaaagacagaccagaaaaccaattaaaggcaatctcctataggaaataaaatcaaaggacccaacttaagattcctttgggtatgcactatttcaacattcagcattttcatattaacaggaaaacttagtagcaattaacaagccccaaaaggactaatgaagaaggaccacagggaaataatatgcacaaaggttttgtggctgagagagctcagatggctttcagagatttcaaattacttacagcttgaaagctttaaatagaataggagcttgctatttcataccattatcatagaagaatcatcccaggataaaaaattctaataatggacaaaagacaaagtttgaggagccaatgctactgtccacgggggatcatagagaattttctatgggcaaaagtggaatttgtgaaaaaagaaatgtagagggaaaatttgcccagacattcctgtaagaagtagagaaagctagttagtcacttataaacacatcttttgtacatttttatccttaatttgcatgtacgttgacacattccataacccatctgctgtaattgatggagaggaacttcttcagcaaatattcatccaggcctaatgtctgttaagatttgtgcccagcacaagcagactgggctagggctgccctggcagactggaccagactagaggtggattcctgcagcactgggtaaggccctgctctcacttgtggtcaaacttggatgccctgtccataagagtttccttagttccagctaataatttaggggcaatggtaggaagcatcagtagaaatgttattcattaaagacagttcaaataaaaatgaatgttacttttaaggaacttatcttttactaagcatactttataatatccatatagtaaccacaatacatttgtcatacccaacaaaattaacagtaagcaattcacatcatctaatgtgtaaccatagtacattctttcttattagcctctttactaatcttcctcatcatccatcttctttttcatacgccaacttgaagaaattggacctgctgccccgtcgattgtcccacattgaattcatttgctgctttctcaagttgctaacttgttcctgtattccctaaatttctgcaaactagaggttagactcaaaggctcaaataaattcctgttgcatcacatcagagggacacaatgtctgcaaaattggctcgcttttagttatggaaaggacattatttctaaaagcttggtaggtcagtccaaattatacagagcggctgataggtccaaggcatgtggggcacacactgcaaaggcaacaggtgctactcttactacagctgccttctgcttgctgaaagagcttgagtgtccactccgggccatactttgggagctctgttcctcagcagggctggaatgcctccttgatggctgtggggctggatcccacccgctcgccttgcaccaccaggagctgctgctctgcctccccctggctataattccctgcctgacttgaggagtggtggtgatgatgatgatgatgatgaggttgtgtttcccttctgcactgttaatttggagaatgttccaggtgaggaaaatgcatcaccttcagaggataccagatgttacccagaccactgtcctggtattgagggtactcagagtgtacctagaagtaggtgtggccattagggagcacagaaggagtgttaccctttttcttttgggaggctgtgttccttccaccacatcagaaccaaagaagaaactggcctcctcctaatgctccattgccttcaccattacttccatataataaccttgtggcactttaacagaagtgtggatttgtggaggatttaaattcatatcaaatgtcaattcacattttttagggttatattgaagcatgcataacacatgatatcctgtgggctctagattacttagatttcaaaaccagagatagaaatgaaatatgtatgagattgaatacagtaagggcttatgtggcattaattgcacatatttattgttttctctattaaataaaagctgaactgtaattagttaagccagatgcatttctgtttttccagatgcactgtgggaacccacttttccacctggtgaatgttgaaaagactataaatacaataattctctaggccaaggagcactgcaggtgcttttaaccaaggaaagagtttgcatttctgatctttgtactgacgtatgcctatgaaagaaaacactgaaatgctatgtaacgtgactggcatgttcatttgcatttcacactgtagcatgatggtcagggaaactattttcatggcacattattgttcaaatacatattaaaatttctgctgttaggaactttatgttcccagctgtgatgtgttaacagcatttccttcagaagtcaggcagctggcccccacactaactacaatgctgtgcgatgctcctgtgtctgtcctcctggcaccacaatgcctgtgtgccatgtttgtcaccagcatgctacatgtgctatgtccactgccttttgtctctctattctctttattgggtattttttccttccttttctcaggtgtctcaggtttaagtcacagaatcatgactttatggaacagaaaggggaacgacttagccaacagcagcccagagcaggcagctgacttatgtcaggcgaacaagttagtgacagaacagaactcacaacctgcatttctgtactttttggtactcaatccactatgctgcctttaaggtaaattaaaataccagcatttaaaaactgttttatgacatccattcatagagatgtgtaaccatcactgcaattcattttagaatattttcatcactccaagaagagacccagcaccccttagccgtcaaccaccaagtcccttcctccagcagccccaggcagccactgagctactttctgtttccacagatttgcctgttccgaacattttatatagatgggttcatatgatacgtggccttttctagctggcttctctcactcagcatcctgtttgcacagttcagccatgtagtggtaggtaaccatggcatgtcagaaagagaagaaaaacttggtggtcattttgcctccagttcagaagacaaaaccaaggcctagggaggtggcttcaggctctagtcacaaagcccagcaggggaagagtgaggatccagctagacccctcaccactcaccgccctcagcagacctcctggtgcttccctgacctgcgtgcaaaggtgctctgcttggtgaactggcagatttacatgcctgccctctagtttttctgttctcagctttgcccagctatttttgtcaccgcttgcgtgtccttgaaggcattctgggttacttctagatttgtgaatggttgaggtgccagatgtctgagggtgggtaaatggggtccctgctatttcagtccctgctgaatatagacacaaaggtacaggaccaatttgtttacagtctttttttcccctaggttagaatgcagtggtgcaatcatagctcactgcagccttaaacccctgggctcaaacgatcctcccacctcagcctcctgaataggtggaactacaggtgtgtgccaccatgcctggctgatttttaaattttttttagagacggggtctcactatgttgcccaggctggtctcaaactcctggacttaagccatccacctgcctcagcctcccaaagtgctgagattacagttgtgagccactgtacccagccttgtttacaatcttaaaacacctataaggtctttctatattactcatcgtatttttacattaaatatcaatgtttatatagcaagaaatgtaaacaaaaaataaaatatcaataagtactaaatttaaagaaataaggcaccagagtagcacctagttttcagagacctttcacatacattctctcatttaatcctcttaacaaatctcaaggcagctaatgttatacacatgaggacgtggaggcttaggaaggtgaagtaatttggtccaggcctcacaagtggcaaaggtcaggatggcagggctcctctgactggacaccctatgctctcctcccgctattgcaccagactgctggacattcctggcccagttctctgttttaagcgagtgttctctagggaccagctgtgggccagaaggtcagcacagcactcagaggactcctccaagtaaacccaatattcccactcggccctctgaccccagtcacggcagggctgttcacgtcctgacctggctccatgggacactcctccacacccctcacagcatcccactgtactctctcgacctcggtctaccaacagcaacatgccctggccttcatacttgtctctttttttttttttttttttgagatggagtcttgctctatcacccaggctggagtgcagtggcgcaatcaatctcagctcactacaacctccgccttgcaagttcaagtgattctcctgcttcagcctcccgagtagctgggactacagatgcccgtcaccacgcccggctaatttttgtatttttagtagagatggggtttcaccatgttggtcaggctggtctcgagctcctgacctcaagtgatccacccgccttggcctcccaaagtgttaggattacaggcgtgaaccaccgcgcccagcctatacttgtctcttaatgtctctttctgtttcatctctcactgggatctggctagtctttgagaacattgccttccctatggccctggtagttagagacatttccccacagaaattctgccacttcagggcttagaagtaaggtaggtgtctctgctgtctattgccacttctaaaacattccttctctgaaaaaccgcacctcttaaattctgacacatgctacaaagatggttgaaccttcaggacattatgctgaaggaaataagccagacacaaaaggacagatactatatgatttcacttatatgaggtacttagagtagtcaaaattatggagacagagctggcacgcacctgtagtccgagctacttgggaggctgaggcaggagaattgctccaacccaggggtttgaggctgcagtggtatgatcatgcctccaaatagccactgcactccactgtgggcaacagagtgagaccctgtcccttaaaaaaggaaaacattatagagatagaatagaatgcagaatggcagttgccaacatcattggtgagattaatccacttattgaggtagttggagattgttcattctcatcgctgaataatatcccattatataaacacattcacttatccattctactttttatttttttttctttgagtcagggtctcgctctgtcacccaggctgaagtacagtgatgcgacctggactcaccacaacctctgcctcctggacccaaggaattctcccacctaagcctcctgagtagctgggactaggcgcatgtcaccacatccagctaatttttgcttctttttgtagagacagggttttgccatgttgcccaggccggtctcaactccacccgctgtgtcctcccaaagtgctgggattacaggcatgagccactgtgcctagccccattctactattgatgaacatttgaatagtttttgactattatgtgtagaacatcctaatgcatacttttggtgcaacgttctcagggagtatataccaaggcctggaatggctgggtcagagggtgtgtatggggtcagccaaaacacattctgtgagtgttcctaactggttacaccaatttacactcccatcagcggtgcgggagagttctggttgctctctatccttcctctctatctttctcatcacttggcatttccttcattattttagctgctcttttgtgtggggatgtgcatgccattccctgtctatgcatagttgcaatatttgcactggctcattacactgaccaataggttatggatactgctgtgaaaatgaagaaaaagataagcttttaaatgtaaaaacaaaatgattggttctttttttttttggagacggagtctccctctgtcgcccaggctagagtgcagtggcacgatctcggctcacagcaacctctgcctcccggattcaagtaattctcctgcctcagcttcccgagtagctgggattacaggccctcgccaccatgctcggttaatttctgtatttttagtagagacaggatttcgccatgatggccaggctgggctcgaacttctgacctcgggggatctgcccacctcgacctcccaaagtgctgggatcacaggtgtgagccacccgtgcccagcccaaaatgattgattcttatatttttgacagagagatcagatggatcagttcatactctggcagttaattttatttcctctaaataaaaatggacaggttaatttattaagcagctgtgttatcaatatggtacgtgtgtgtgcttgtatagatagatgtatatgtacatacataactatacatttttctggacacataatattttaggtgcctattgtatgctagacactgttctaccatcagtaaaaaagcactgccctgttttactgttgattaaaaacaaaattctgaaaatagtgaacaatgaggcttacaacatttgttacaggataagaaatctcaatttagaaaaatgttgtcaactttgactaacctggaatgctcgttacacagtcctgaaattaattttgatcctaatctggctatagctgcaccccagccagccaccttccacagcagttaggtccctgacaggagacggcacccaggaagccacaaagagcaaactggtttctgcccaggatctctgccagctctgcagccttggtgatgtcacttacacagctcagcactctccatgcttcttcccagcctgagccaagcagcatcagggaacttgttcttctgtcccttggccttgcctaccccacctttcacaatgaaaggtatttcccaagaaaagcacactcaccctaaagccaggtccctccctaccaagtctcagcactagatgctgcttcagaaggagaagcagagcagaaagaccatagagggaagaagggtatttgcggtcttcttacagctcctaccagaattttaccttttatccaaggtgagaatggaggcagagtgagtggctgggagacctccaccattatccagacctgagatgttaactagggccatatcacgtggagaagaacagggcagatgtgagaggcatgctgggagacagattgcctttgcctttgccaggagttaggattgggaggagttgaggatgatgagttttcttgaacaactggagagatagtaacactgcttaccaagagagaaaaaacaagaaggggtagctttgtctggggagataataactttgcttttttttttttttttaaccaagtctcactctgtcacccaggctggagtgtagtggtgtgatctctgctcactgcaacctccgcatcccaggttcaagtgattctcctgcctcaccctcccaagtagctgaagtagctgggattacaggtgcctgccaccacacttggctaatttttatatttttagtagagatgggatttcgccatgttggccaggctggtctcgaactcctgacctcaagtgatccttctgccttggcctcccaaagtgctaggattacaggcgtgagccaccacacctggccacaactttgatttttgacattaatttttctatgatgtaagtgatttggctgtttttttctataatttgcaataactacgcagaaattctcattagggagcctgctccttgctgggaaacagtaaatagctggccattctcatgcaaaccattaatgatggcctcatatattcctcagccatttgaagagtccctaaagcagccccacagacaaagattttcccaagtgtttaatactttcagaggtgccctgggccaagttatcactgggaatgcaccccagctgcaattttcttgagaatgccactatttcctgggataagcaaagctcttaataaagatttcaatcagtacttacaaaatggtccttcgttgttggctgacattaggaaagaacaaataaaaacatacataatttatttatttccttcatatcatactctcttctttctaatacttcccaaaaggccattgtaaaagttgagttatataggatgttcatttagtaatggcagaagagaagagaaagacactcttattatagtcttaaagccttcactggcttaaaacctcctggggcttacacatttggcaacggctatataaacaaaagtgtaaagatttccatgataagtcactgaaaaacagatggtaagatgcttaagtggttttttaaaagatgaggacatctgtaagcatccatctggaagtaattataattcaaaagtcttttgttactattaagcttccagttgacttcccctactagaaaacaatggaccagctttttcttaaaatagacaataaaacccaaatagtcagacaataaaaccaaaagacagaaatttttgaaaacccatagatttgcctggaagcaaagtttagaatttccacaaaaatccaccagctactaaactgttggctttctgtatcaaacatagtggaaatagagctttgatttgattttttggtctatttgtgctgaagtcagtgcaagtaattctagctcttcattaatatttcatgagccacagtgagatggacttttgtctggtgatgactatactgcaggataatgggccagcgtcctctcaaacttagaatcgcctcatctcagcatcctactaaacagaacatcactgttgaccagcattcagcttacgtctcggctgctaatagtaacagggcctgtttgtgacttcagcagcatctggtgacccggtgttactcttgcagtacgtgattcagagaaagccacattcccctgttgctattttcaggtaggcagctaaacccagggagagtttagcatggattcagcaggtctgtttttctaacttcattgtgtaaattcttgaatgagaatctagcgagcagccaaaaaaagacttcctgtgaactcatcttccttgaagccaaacatcttcagaaactgtttccttcaggttctggaagcctagagcccttcaaatgagatttgtccctctccccaacacactttatgcctcctgtccccagccaaatggcttttccatccttttcctcctcccgttcattcgacttccagttctgtctgaagtcagaggcatgcatggggctgagaggggcctgggtcacagggtccccctcctccacccacaagtgaacatccaactttaagaccaagtatttaagaccagaggatcctacaaaaaactcactcaggccaggcgcggtggttcatgcttgtaatcccagcattttgggaggctgaggcgggcggatcacgacctcgtccctactaaaaatacaaaaaattagccgagcatggtggcacgtgcctacagtcctagctatttgggaggctaaagcaggagaatcacttgaacccgggaggtggaggttgcagtgagccgagacagcacccctgcactccagcctgggtgacagagcaagactccatctcaaaaaaagaaaaaaaaacaactcactcaaccctctgctactttgctatcgagtggccccctaagtgtgctggcaaatgtggtatctgtgaaaaatcatcctccatccaaggcaaaatagtattagagaaagatttcccaggcaggggaaacctagaaggcaggacgacctagaggagggtaaaattaggagtaaattgaaacacgttgtgttaaatactcagaaacattactgcagagaacaaggaaatgagagtgtctcttgaggctgcagtacaggaggatattcctggaatatcgcagtgcttttcatgcacctgggaaccacagtcagtgggagctcagaaaacagtgaaattgaaatgaatgaggctcatgaggaaaggagttttgttcttaatgtggaacagcaacaaagacccaatcgtttgaacaggcttaaaaaagtactgggagagatatgtatagggcacaactgagggactaaggtaaaatcatagcatcccagtgcaatgcaaggggaaggcttacagctgagagttaggagggagactcccttgtttgtgtccatctgctatagttggtatattggggattaccaaagctgtaaaatccccagacatagctctctggcttcacgttccaccccattttaatgtcattagtcatttcttcaatgtgaaagcagaaagaaatgtcccatcaattaactctgtagcatatcgtaacaaaaatctgggagaagcaatggagctaagtggccgggtggcttggtatcagagctgccttcacactggtcccattcttccttatctcagataacaaagcatgcagattcctcctgcttgtgaaccacattttttttctgaagcatttgatgttttctatgtcttgttagccttcctgtatctattaagatttaaagaatcttggctgggcgcggtggctcacgcctgtaataccagcactttgagaggccgaggtgggcagatcacgagatcaggagttcaagaccagcctggccaacatggtgaaatctgtctctactgaaaatataaacattagcttggcatggtggcacgagcctgtaatcccagctactcaggaggctgaggcaggagaattgcttgaacccaggaggctgaggttgcagtgagccaagattgccccattgcactctagctctgggtgacagagcaagactccatctcaggaaaaaaaaaaagatttaaagaatctttccaaaatatttaaagagtaagagagacgctcttggggatgaggagtggcggggcaggtaatgattctcctgggaggccagaggccaggctaacaggctcctgcatctcatggcttcttaggatcccagaaaatgaatggcaagcttacactttgcattttagaggggtaggaaatgaggggccaaaagatttaaccaggatacagattaagtttaaaggtcattaccggctaccgtgtctaagggtgaggtttgggattcctgcctttgtgtcattgtgcagccatcagaggtaggaggtacggtcaccctgaccctgaaatactcacaatgccagcccagaaaaaatccatctagaagtgcattctgcagggtagagtctcgggttcaatgaagttgtgaggcaggtgatgaaaggtcaaagctgcctgacgcattcatgatgcttgacagagagcgctcaatctgaagatcattgacagtgaaactattgaaaacggcatatgcatatggaacaaaaagatggaaaacgttgggagatgggataatgggtgattaactcttagaaatgttctttatagaacattgaaagcaaaaaataaaggcaggcacatgcagacaaggcagctatggaaaggaagtcatgaaagttagaagcaatagttggaataaagcaatagataatggagatacagaaaagtaaaacactggacttgccgagctactaaaacttatacagactgctgctgggagcggtgattcatgcctggaatcctagcactttgggagcccaagctgagttgattacttgagcccaggagtttgagaccagcctgggccacatggtgaaaccctgcctctattcataatacaaaaattagccaggcatagtggcaggtgcctgtaatcccagctactcgggaggctgaggcaggataatctcttcaacctgggaggcagaagttgcagtgagctgagatcatgccattgcactccagcctgggcaacaagagtgaaactccatctcaaaaaaaaaaaaattagctgggtgcagtggctcacacctgtggtcccagctactcaggaggctgaggtgggaggatcacctgaggcccaggaggcggaggtagcagtgagctataattgcaccaccacactccagcctgggtgacagggtgagaccctgtctcaagataaataaataaataaacaaactatcatatcaacacagaaagttataaagcagcattcaaaatcatatatatactcttgtaatcatgtaaataatttttgtgaacaaagggaaggaaatgcaaaataaaatttaaaatattggcatgatggatttatggcatgttattctttttaaaaatatacttggtaacagttgttgagcatttaataattccaggcactatgtgaggattttacatgaattatcatatttattcctcccagcaaccccatgagccagatactattattttcctgatttgacacagagaagttggggtgacctgcctgtggtcatacaggtagtggtggtactgggtccatttgattctgagtactctattatccattatggtatgtgtgtatatatatatatatatatatatatatatatatatatatatatatactttttttttttgagacagggtcttactctgtcacccaggctggagagcagtggtgttatctcaattcactgtggcctctgccttccaggctccagcaatcctccagcctcagcctcccaaatagctgggactataggcccgcaccaccatatatggctaatttgttgttgttgttgttgagacagggtttccctatattacccaggctggtctcaaactcctaggctgaagtgatccgcccatggccttggtctcccaaagtgctgggattacagctgtgggccaccacacccagccccttatgctattttttttaaaggctgttattataatagtgtacaggtagatatttaaatgcatgcttatattaaaaatttggagatatattaatgttcctatggcagaatgatatcatagtcctggtacttgatattggaggtttcttgcttctggtagagaagtaacattatagaaagtagcaatacagtgggaaggaattgttgtgtgaataatgatgaaccatttctgagaatggattaaatgtgtatgatacacttgtctttgacaacttttgactgatgtggaaggacagaggtgatggaaactctaatgaggaaggaaaatgtctgctgggtgtgtattctctctctttccttctagagtcctttgtatctagagtgtctgagactggggaaatgaaggtgaccagtagatagttgaagagagcagggacaaatgccttcctgggctgggttcatacattttattaaattccctgttacattatcaaacagaaagggtaaagatgcattgagtcatgaggtaaaacacagagggatacattattagttctttaatcattcatcacatatgtattaaacacctttacataaaacagaatcaatcaaagcactattaggaacatgaagaaagccatgtagccagcaaaagtatagatgccctggtaccagcaagagcacaaagctggtatttgaggggctcttgcttcaggctatgggccaaaaaaaattaccaagaccctccaccaaggaagaggtacccatagcagataatacatgaaaagatgttcaacattatcagtcaagagggaaatgcaaattaaacccaccatgagctgccacttacgcctattaaaatcgccaggaaaaaaaaaatctgacaatgtcagctactgacaaggatgtggaacaattgaaactctcattcattgctggtgggaacagaaaaaagatacagctcctttgaaagacaagttggcatgttcttagaaagcgaataaacatgcacttactatgtgacccagtgagtatttacccaagaaaaatgaaaacatacacccacacaaaaatctctgcacaaatgtttatagaagctttattcataagcacccaaaacaggaaataacacaaatgtccatcagtaggtgcctggacagacagttataaccatataattgagtactactcagcagtaaacaagaatgaactactgatacacacgaccaggtgaatctcaaaagcattacgctaagtgaaagaagcccagactccaaacaatgcataccatatgatttaatttgtatgatattttggaaaaggaaaaactatcatatcaatctacaaagtaataatatacctaaacatgttaaaatcatacaggccacattttctgatcaaaatgtaaagaaacatacaaactagtcaggctagtcaagaaattaaaaataaactttaaaaaggctgtggataaaaaatctgagctgcaattagatctgaggtatttggaggtgaactattagatctgagctatttggaaataaaaatagtgctatctagcaaaactcagtggatatgatcaaagcagtaactggataaaaatttgtacttttaaacccacttattaaaaaccagcagtgactgaaagtaaatgaactaaaactttagtgtgagaggccaggagaaaagtaagccattttttaaaaagtagatgaagaataatgaaaataaaagcagaaattaatgaaatttacagttaacagaaagcaaaattgatccataaaacctaaagccaattctttggaaacagaactacagactaacctttggcaaatctgattcagataagaggatagaaaagcccaaaccatcagaaatgagttacggtgcataactggatcaagacttttttacacaaaaaccaaataacatgtacaagtttaatgccaacgtatttgaaaatcttaggtaagatagatacttttctgaaaaaatataaatttaaaatatagtcatatggtagtagaagatcctaaactacgtagaaaaaatcgaaaaggtgttatgagatttgtccctaagaaaggcatcaggccctggccaggcacggtggctcattgcctgtaatcccagcactttgggagcctgaggtgggtggatcacttgaggtcaggggttcgagatcagcctggccaacataacatggtgaaaccccatctctactaaaaatacaaaaaaattagctggtcatggtggtgtgtgccggtaatcccagctactcgggagactgaggcatgagaatcgcttgaacccgggaggtgaaagtcgcaattagccgagattgggccacttaactccagcttgggtgatggagtgagattctgtgtcaaaaaatacataaaaataaaaagatggaacatttccaactttgttttaaaaggcagaaaaataaggatatttaaactggacaaagatggccaaaaaaaggaaaattcatgaagggagatcctattcataataggaacataaatcacaagactgcaaattcctatgcataggaataaccacatagcaaacatttattgagtgctatgtgttgcaagcacatttgaagtgcttcaccagtatcgcctcatttaatcttcacctccaggatactcagtatcccagttctattgatgaaggaaccaagactcaaaaagatggaataacttctctaagctcatacagctaatcaacaatggagttgagatttaagccaatttcccccagtcctcacaatggatacagttaatcttgatttttttttttttttttgccaattttgtaggtaaaaatatcaaaaaaagatacctggttttaatttgcatctctttgttttgcatgatttcctgccacataaattttaatatttattcttgaatcacatttaacttcaattttgcatcttcagtatttatgaaatctttcattagttacattcctcaaatgaattcatcccactggattccagctactgttcatctgtctattctgatacttcattgagaataccaatatttttctaaatttacttttgataaaactgaacattttttcataggtgattttatttgtgtatatatacatatgtagtgtgcatgtgtatgtttgtatatgtgatttcttcatccatgattttttaatttattagtgagtaaaatgttttaaaagaaaaacttatccttaaactattaggttaccctgaagtataatttttataggaaaagtaggataaaaacttgattctttccccttatttatcagttttcaaaattgttccctatcactgtctaaaagtagtcagtaagtttttttagtatcattatgaattcatagttttacacatattttatgtgtttcaatgcactgcaattgatttttttttttttgaggcagagtcttgctctgttgcccaggctggagtgcagtggtgcaaactcagctcactgcaaactccgactcctgggttcaagcaattctcctgcctcggcctcccaagtagctgggattacaggcacctgccaccacgcctggctaatttttgtatttttggtagagatggggtttctccatgttagtcaggctagtatcaaactcctgacctcaggtgatccacccgcctcaggctccaaagtgctgggattacagacatgagccaccatgcccagcctaaaaataatattaataaattatcacactggttagtcaactcagctgtagattaaaatgtccagtcatctaatgcacttgacagttcgggacagaagcattaaagtggcttcacaggagatcctattcctcactccacgttggacattgttatgggttgaattgtgtccccccagaatatatgttgaagttctaaccatgatacctgtgaatatcaccttatttggaaacagggtctttgcatgcaccaccacatctggctaatcaagtgaagatgaggccaaactggatgaaggcgggcctgaaatccaacgactggtgaccttataaggagggagagcttcaaagacccaggcagtcatagagggaagaagggcaagtggcaaagaagacagagattgggtttctgttgccaccgaggctgccagaagaggcaaggaagaatcctcccctagagccttcagaggcagatgcctggccctgctgacggtttggttttgaacttttagcctccagaactgtgcaagaataaatttctgttgttttaagccatcgggtttgtggtaatttgttatggcagctctaggaaactaatccagatgttaaagtttattcttacatagaaattgaggtttctaataaaaggtgtgtggacgtggctacttcgatcacttactgagctctggcaccatgacttctggccttggctatattttccttttcctttctttttttcctcttccttcttttcttttctcttttttccaatctctctttttttttttgaaacagggtcccgctctgtcagccaagctggagtgcagtggcaccgtcatggctcactgcagcctcaaacttctgggctaaagtgatcctcctgcctcagcctactgagtaactagtactataggcatgcatcaccacatctggctaatttttaaatatttgtagagatagaggtcatgcaatgttgcctgggctggtcttgaactcctggcctcaagtgatcctcccaccttggcctcccaaggagctgggattacaggcccttcttagttctttgatgccaatccaattttaggttcttaaccttggtactttgggtccactgtggattccccattctctccttctttctcttcctatttttgatcttatcccttacagatctcccttcatgtccctgcccccaaactgtaatttgtgatatttgctgtcaccttttatccattcttgtgcactagataatcttagtttctttatgtagttcactaatttaacaagccagactgaactgagtgtaaacaggcagtgaatttcttctcctatcaccacgttcaaacagtatcggttttcccctcctctcccctcaactctatctcatgcagattctatagcttttcaagtcaatgtcagtattagaacagtctcattttcaggcgttaaaaaatttcagtgctcacttcagcagcacatatactaaaattggaacaatacagagaaattagcatggcccctgcgcgaggatgacatgcaaattcatgaagcattccataaaaagaaaaaaaaagaaaaaaaatttttttaatgtttagtccctgccaggcacggtggctcatgcctgtaatcccagcacttctgggaggccaaggcggtggatcacctgaggtcaggagtttgaggccatcctggccaacatggtgaaactctgtatctactaaaactacaaaaattagctgggtgtggtgatgcacgcctgtaatcccagttacttgagaggctgaggcaggaggatcacttgaacctgggaggcgaggttgcagtgagccgagatcgcgccactgcacttccagcctgggcaacggagtgtggctctgtctcaaaaaaaaaaaaaaagttcagtccccttgaaatcaaactttagtgccctccatttcagtttcccctcacccagctttggcctctccagaggttgcgcagaccaacagtggcaggggagaggaggatagcccttccagttcctctctgctttctctcctttccgagctctgctgccttggatgcagcactgctgaagacagaggtggtattggtcaatgggagttcagaccagtttttcttctacagggatctcccggagttcagaccagtctttcttctacagggatctccccactcctgcctgacctcttcagctttggtcccagtcatacagctctggggttctcctccccagtccaacagttttgcacaggatctttcaagaagattcaagcttggccaccttccatgtctcccatggaaaaactcacccatgcatgcagctgggtcgcttccctttttcctagacctggctgttccaaccaggccctcccattgagtctcaggcagtccggagggaagctgcagtctctgtacttctcatgctttgccaggttctccccaggagtcttctgaatcatctgaggacaaggacagggctggtgcccgagtttctttcttttttaaaaatgtgtttagaattggagtctcgctatgttgtcgaggctggtcttgaactcctggcctcaatcaagcctctcaggcaggtgtggttataggcatgaaccaccccacctgacatatttactgacatattttaccatattttatcgaattctagattcactattgtttcttgtattccatacttccccttggggtctacttttcttggtaaaatatgctttaataattttctttgcaagagtctgtgagagatcagcaaatattcatccgaggacagggtctcactctgttgcccaagctaactgcggtggtatgaccacagctcactgcagtctccacctcctgggctcaagggatcctcccacctcaacctcctaaggagctgggactacaggcatgtaccacaaagtccggctaattttttatttttcgtagagacaaggtttcactgtgttgcccagggtggtcttgaactcctgacctccagtgatctgcctgcctcagcctcccaaagtgctgggattacaggcatgagccactgagcccagcctaagacccatttttgcagacagtacttaattaaatttactgacatattttatcaaattctagatttactattgtttcttgaattccatacttccccttgggatctatttttcttggtaaaatatgctttaataatttttttgcaacggtctgtgagagataagctctctgagtcttatctcagaggaagatattatctgttttcttctgggatctgttgttgctgaagagaagtatggttgttggcctaattgtcattcttttgtaggaaacttttgtaggaagcttcttatctgtcaattcctgatgttttaaagtttaccatggtatttctagtagtggatttttgtttatttgtcctgctttgtaaagagagagactttctgagtgtctagtcaattcatgttgctataacagaattccataggccgggtggctcaaacgaccaaatttgtttctcacagttctggaggctgggaagtccaagatcaaggcactggcagataggtgtctggtgagggctgcttcctggttgccagaaaccaggaactgtcttctcaccgcaccctcacagggtagataaagagggagagagctctgtgaagcctctttcataaggacacgaatccctttcataaaggccccattctcatgacctaatcactccctagggccccacttccaaatatcatcaccttggggcttcaattaatgaattttgtggtagacataaacattcagtctgtagcactgaggatttgtgtttttttcagttctggaaattctcagaacacctactttctttttgtttggttggttttttgttttgttttgttttgtttttgagatggaatttcactcttgttgcccaggctggagtgcagtggtgcgatctcagctcattgcaacgtctgcctcccaggttcaagtgattctcctgcctcagcctcctgagtagctgggattacaggcacatgccaccacacctggctaattttttgtattttcagtagagacagggtttcaccatgttggccaggctggtctggaactcctgacctcaggtgatccgcctgcctcagcctcccaaagtgcagggattataggcatgagccaccatgcccggcctcctactttctttttaactgttattttcccatcattatctccattttccttatattaaactcctgttaaatgtacattgaaactggtaactctacactcccttactcttttacctttaaacagcattgagataaaatttacacaccataaagtttactcatttaaagagcacaggccaggcacagtgtttcatacctgttgtcccagcactttgggaagccaaggtaggaggatcacttgagcccaggagttggagactgcagtgagctactatcacaccactgcactccagtctgggcgacagagactgactctgtctcagtcaatcataatcagtagtttttagtatacttacaaagttgtgcagccatcatcataatctaattttaggacattttcatcaaaagaaaccttgtacccattagtagtcattctccgttctctctccctgctcccaaccctaggcaaccactattctactttctgtctctctagacatacctgttctgggcatttcatgtacaagtattatacaacatgtggacttcggggtcttgattccttcaattaacagaatgtttttaagacttagtcatgccatagcatgtatgagtcctgcattccttttataaaattgtcatataaatcatacaccgtaaggctcaccattttacaatatacagttcagtagttcttagcacagtcacaaagttgtgcaacaatcaccactaattcctgaatattttcataattctgaaaagaaatcccacacccactagcagtcactcattccccttaccccatcccctggcaaccactaatttacttccagtctctatggatttgcctagtctgaaaatttcttataaatggaatcatacattatgtagccttttgtgtctgccttcgttcacttcacttcacatattttctttttttttctttcttcctttttttgagacggagctttgctcttgttgcccgggccgaagtacaatggtgcaatctcagcttgctgcaacctctgcctcccgggttcaagcagttctcttgcctcagcctctgagtagctgggactacaggtgcccaccaccacacccagctaattttttgtatttttagtagagatgggtttcactatgttggtcaggctggtctcgaactcctgacctcaaatgatccacctgcctcagcttcccaaagtgctaggattacaggcatgagccaccgtgcccagccttcacttaacatattttcaaggctcatccatgttgtagcaggatccagtacttcattccttttcatagctaaataaatattgcctcgtatggacatatcatattttgtttatccatcagttgatagatatttgtgtttttccactttgtgaccattatgtataatgtttacaacaataaacaaacagcatttgtttacaagtttttgtgtggacatgtgttttcagttttctgggcatatataggactagaattgctgggtcatttggaaacttcatgtttaacattttgaggacctgtcaaactgttttccaaagtggccaacccattttacattctcacatgtagcatatgaggattctaatttcttcacatcctaacactaattgtctacttttattttacccatcctagtaggaataaaatagtatttcattgtggtagagattttatttccctaatgactgattatgttaatcatcttttcatgtgtatattggccatttgaaatatctagtcaaatcctttctccatttttaaattgggttttctctcctttttcttaagttgcaagagttctttatacatcctggatacaagtctcttacctaatatgtgacttccatatattttttcccactctgtgggttgtcttttcactttttttttttttttgagacagtcttgctctgtcaccccgtctggagtgcaatggcacaatctcggctcactgcaacctccgcctcccaggttcaagagattctcctgcctcagcctcctgagtagctgggattacaggcacgtgccactaggctctgcttatttttgtatattttttttgtagagacagggtttcaccatgttgatcatgctggtctggtgtcgtttgaagcataacattttttcttttttttttttttttgagacagtcttgccctgttgcccaggctggaatgcagtggtgcgatcttggcttactgcagcctcaacttctgggcaggaggatcacctgagcccaggtgttatgttgtccagcctgggcaacatagcaagaccctatctctaaaaagaaaacaaaacaggcatctgggattttgatagggattgcattgaatctgtacattaacttgaggaatgttgccatcctaacagcattgtcttatattttataaatatgggatatctttccacttacttagattttttgtttgtttgtttgtttgtttttgcccaggctggagcacagtggtgtgatcttggctcactgcagcctcaacttctgggctatgtgatcctcccacttcagcttcctgagtagctgggactacaggcgcacaccaccatgcctagctaattttttgtacttttagtagagaaggtgtttcaccctgttgcctaggctgatcttaaactcctgggctcaagtgatccacccacctcagcctcccaaagtgctggaattatagatgtgagccatcatgcccagacctatttagatattctttactttcaacaatcgttttgtggtttccagtgtataaatcttataattcttttattaaatttatttctaattattttattcttttgatactatattggaattattttcttatatcacttccagaatgttcactgctagtgtacagaaatacaattgatttttctttgttaatattgtatcctgcaactttgctgaactcatttattagttctaattgttttttttgtttgtttttagtggaattcttaggatttttaaataagcaagatcatgtcatttgcaaatagagatatagagatagttttacttccttttcaatttgaatgccttttatttatttttcttgccttactgccgaggctggagttccaatgtagtatgaatagaagtggtaaaagtagattttttttcttatttctgatcttagagagaaagccatcagtctttcagtgtttaatatgatcttagatataggtgtgttataggtgactttggtcaggtttaggaagcttccttatatgccaattttgctgaatattatttatcatgaaatgcattagattttgtcaaataattttttttttgagacgggcagtctcactctgttgcccgggctggagtgcagtggtgcaatttcagctcactgcaacctccagttcctgggctcaagcgattctcctgcctcagcctcctgagtagctgggattacaggcacatgccatcacgcctggctaatttttgtattttttagtagagatagggtttcaccatgttggccagactggtcttgaactcctgacctcaggtgatccacccacctcggcctcccaaagtgctgggataacaggtgtgagccactgtgcctgacaaaataatcttgctctgtctattatgatttttgtccattattttattggtatggctattatgtttattttttatgttaaactaaccttgcattcttacattaaattctacttagtcatggcatataatcctttttttacatgttgctagattccgtttgctagtattttaagatttttgcaactgtattcataaaagatgattatggtgtctttatttggttttggtatcagagtaatactggtctcagagaataagttgggaagtattcactccccttccattttttggaacagtttttgaagaactggtagtccttctttactaaatgtttggtagaattcaccggtgaaaccaacttgatctgagctgagctgagcttttctttttttttttttttttaaatacaccagcctgaacagatctgggctttcctttgtaggattttttaaaataactaaccaatctctttacttgttaaagttccatttagattttttcttctttagttaattttgttagtttatgactttccaggattttttccatttcatctaagttttctaattagttggcatacagttgttcacagtattccattatcgttctttttatttctgtaagatcagtagtaatttcccatctttcattcctgattttggtaatttgagtcttcatttttcttcatcaactagctaaggtttgtcaattttgttgatcttttcaaataactaacttttggtttcatgaattttctcttttgtatttttctatttctattttctattccattgtgtttggaaaacatactttgtattataataatgattttaaatctgttgaggctgttttacggcctattatatggtctattctggagaattttcatgtgtatttgagaagaatatgtattccactgatgcaggtggagtgctctatagatgtctgttaggtgtagttagtttatagtgtcctgatgtcctctattcatatgcttgttgatcttctatctagttgttctgtccattattgaaagcaaggtattgaactttattactgttatcattgaattgtcggtttttcccttcaattctgttagtttttgctgtatgtatttttgtggttctgttattgggtgtatatatatttataattgttgtatcttcctgagacgttagctcttttatcattataaaatgtccctattaatctctagtaacattttgtgtttaatagtattttatttgctattattagagccattccagctctctatggttgctgttgccagatatatatttttccatccttttactttctatctatttgcatttttgaatctaaagtatgtctcttgtagacagcatatagttggattatgtttgtaatcattctggcaatctctatcttttgattggattgtttaatctgcacacttttcacattgtcattgatccatttagatttacctttgtgtttttcttttcactttctatatatttcatgactactctgttctcttttcctcccttattaacttcctttgttttatgttgatattttctagtgtaccattttactttagttattttttcactgtatgtgtatattttttaatttttaatctttctttgagacagggtgtcactttgtcacacaggctggagtgcagtggtgcaatcatagctcgaactcctgggctcaacagtcctcctgcctcagcctcccaagtagctaggactacatgtgtgcaccctcatgccagctaattttttaaattttttgtagagatggggtttcactatgttgtccaggctggtcttgaactcctggtctcaagtgagcctccttccttgacctcccaaagtgctgggattacaggcatgagaaaatgtgcctggccctgaggtaatttcttcatggcctctataatgcttataataccttaatgtatcagaatcaactttagatgtatactaccttaattctagtaagatatagaaacttttctcttatatgtagctcctttctctccctactgttttgtggctactactgctgtacatattaaggtgtatatgtattacaaatccaataacatattgttataattactgctttatataatcctcccaaagtgctgggattacaggcgtgagccaccgaacctggccaatcctatgtcttttaaagaagctaagaaaagaaacaagagcagaaatatacgtatagagtttcttctttaaaaaatattaggcctggcctggtggctcacatttgttatcctagcactttgggaggccaaggaaggcaggctgcttgaactcaagagtttgagaccagcctgggcaacatactgagaccccgtctttacaaaaaatatataaattagcctggcatggtggtgtgtgccagtagtcccagctacttggggagctgaggcaggaggatcacttgagcccgggaggcaaaggttgcagtgagccaaaatcacgccactgaactccagcctgggcgacagagtgagactctgtctcaaaaaaaaaaaaatttccagagactttaaatgattgttttttaataactcactagttatatgattatattttgctggagagagggtctacgtccctcacgtagccattcgggaaccaaactgcagatgatgcgctgcgtctttttatctcttagtctttctgaacattctaaattagtccttcagtactattttctaatatccttgcaactttctacttgattctttttcgtgactacctgttcttattttatttctatttgttttagtttcctattttttgacattttaaatgtaaatgatttcttcattattatttgagcatcgcaacttttatttttcattttcttctgcaacattaaattcatatttcagtgggtgattttaatgactgcctttcttcatatgttttggaattttagtttgcaaatactttttttttttgagagtgtcttgctgtgttgcccaggccggagtgcaatggaatgattatagttcactgcagccttgacctcctgggctcaagcattcctccaacctctgcctcctgagtagctaggactacagacgtgtgccatcagacccagctaatttttttattttttatttttttttgagacagagtcttgctctgtcacccaggctgaagtgcagtggtgtatgttggctcacagcaacctccgcctcccgggttcaagagattctcctgcctcagcctcccagatagctgggattacaggtgcaccaccacgcccggctaatttttgtatttttagtacagacggggtttcaccatgttggccaggctggtcttgaactcctgacctcaagtgatctaccccccttggcctcccaaagtgctaggattacaggcgtgagccaccgtgcctggactagttttttaatttttttgtagagatggggcttactatgttgctcaggctggtcttaaactcctggcctcaagcaatcctcctacctctgcctcccaaagcactgggataacaggcatgagccaccatgcccagctgcaagttcattttaaagcaattgtttcattcttttttgttgttgatcttttttctgtcctccttagtttttacttatctccatctagaaacattaagatttccttcactgatcatctgggcaacctactaagagccagatgttatgatgacaattcagaatttctgcccaagtgatattgtgaatatggcagatttcagaaccagcagttccagctcattccagaccatagagatgtctatatgctcccatattccacatctagcctcagcagaggtcagctacagttggtgttttttataagcttccatcataaggaagaggagattcttctcaacttttaaagcactgactgtagctccaactccacatttaacctggagcaattttagtcccttttagcttctggactgatgttgcctctgcccattacttggacctacagccaagcaggcccactgcttgcactctgcccattgatttacactgccattgcgtttctggttggaggtatatttatcttggttttgaactcaactacatgtttttagacttttcttatctgtcattgcttttgcttggaacagaatcagtgatcaaagtgagatcattgccccagcttgcctagagtcccaatcccatcctgaatttgcagtcagccatttcaggctgtagtctttagcttctctgtaacattcacaatagctttttggatggaagtgatgggtggaatggatcagcaagacacagaaaccaggagtaaaaaaaaaatatgaaccagagtttgggtagggtaatggtgaggcctgtggcagggttcccagcagggcaagattctgtgcaggaaaacaaagttagaagttaaaactaggtggctggatgtggtggctcatgcctgtaatcccagcattttgggaggccaaggtgggcggatcacctcaggtcaggagtaaaaatacaaaattagctgggcatggtggcacatgcctgtaatcccagctactcaggaggctgaggcaggagaatcacttgaatccgggaggtggaggtgccggtgagctgagatcgtgccattgcactttagcctgggcaacaagagcgaaactcagtctcaaaaaaaaaagaagttaaaacgaagtaagatattcaaggtcagtgtctaaagcagggaacagctagtactaaggaataatctagtagcactgtgttctgacaaagatgttactaacggaggccctgtgggagccatgatctacccagccatactgcccaaagaaaaaatacttcaagagccaaggtttattaaagcaaaagtaggccgggctcagtggctcacacttgtaatctcagcacttcggaaggctgaggcaggagcatcacttgagcccaggagtttgagacatagtgagatcccacctctatgaaaaaaaattgttaattagctgggtatggtggcacacacctgtggttcctgctacttgggagacttggacaggaggattgcttgaactcaggaggttgaagctgcagtgagccgtgttcacaccactgtactgcagcctgggcaacagagtgagatcctgtctcaaaaaacaaaaaagaaaatggatttgggatttgagtctcctccaggagaatgtgtcctctcaaattttcttatattattgtctaactctttcaaggccctaaactatcccctgatggtaggatcctgcttcttagggtctttgaagaaggctttgaatttatgtatttttggattcttggttctccttcatcagaagcttatctatgattctatatctttctggaacaggaacttgagtcttaggccttaagagataagagattttttttaaacacaatacttggtgtttcatcgtattctcaatatgtaattcaataatcgctatcttcaggatttgggaactacagtgaaaataaataactattaaaggaatctggctaccaagtgtgtttaccagaaaataagaaagaacttctctgggttggacatggtggctcacacatctaatcccagcactttgggaggctgaaacaggcggatcacttgaggtcaggaattcgacaccagcctggccaatatggtgaaaccccatctctactaaaaatacaaaaattagccaggtgtggtggtgggcgcctgtaatcccagctgctctgggaggctgaggcaggagaatcgcttgaacccaagaggcggaggttacagtgagccgagatcacaccactgcactccagcctgggtgacagagcaagactccatctcaaaaaaagaaagaaagaaagaacctctctgagataattagttaggttaaaacttttttaaaaactagttactggtttcaattccaaaatactaaaagattgtgatcaaaattaagagtttgccttggcttttagttgaattttgaaaggcctcttagatgttgagttcctaggaatttggaaaagccttgtttgaggattgtctcttgactgagatctgaaatgtttaataagctatcaacctgtattattcccatttcctcaggatgctctttttgttttttggggcgtttttttttttttttttgagacaaggtctcactcagtcacccaggctagaggcagtggcagaatcacagctcactgcagcctcaacctcctgggctcaaacgatcttctcaccttagccccccaaccaagtaactgggactacaggcgcgcgccaccatacccagctaattttcatatttttgtgtagagatggggtttctccatgttgcccaggctggtctcaaactcctgagctcaagcgatccacccgcctcatcctcctaaagtgctgggattacaggcatgaggcaccatgtccagccctcaggctgcttttgaaatcccacacatgttagcatatgaggatgctaacaatgatttcacattcttctaagttctgagccctaggaccatcaggtgaaggcagccagtacctgggggatgatgtgtgtgacttacatggtcatcccaaaggacagtaaaatgatgcccagcattctctgccaaacagactaaaaaaggagagaagagcactgtcaaaaggcattgattccatgttatttagaaaggacaaatggaaatgatatgtgcatagagttctcccacagatatgatgaaggcaaaggagaagatgtatgaagctggtttggctaattagatcctataccgatgtctgaaaagactagtggaattaacatatacattgatggcatatttttacaatcttgtaaataggtagcatttatatcagtggtataataaaagaataattatcttttagacctgagaagagtttgcttagtaaggtaagggtgactcaacatcaagaaatgcattaattcacttcattaactattcaaaggaggaaattgatatgctcacctaaatagattttttttaatctaaaagaattcaacattttaaaaactttattaaggaaatttccaaccacacaaatatgtagagaggatagtataacaaaccctgtgtgttagtcaacttcaataattatcaaatcaacattggcttctttttaatattcatgttttattaacacttttagttcccctcaggctcttgcatttctccacagacatttatggtataaatgatcactcccaccaccaaacactccaacatttagcaaggaagtgaaagccattcccattaatttagaatttttttgtacatagagatgagagattgttagtaaacttttccaggaatagcatgtatttctgtacacttacttatcgaatctttaaatgatttaaaatgtcaaaattatagttcagtaaacatgaatacagtcttaataacagtctcttctaatttagtctgataaaagactttcatgctcaccagggcgcggtggcttacatgtggaatcccaacactttgggaggctgaggcaggaagatcacctgaggtcaggagttcgagaccagcctgaccaaaatggagaaaccccatctctactgaaaatacaaaattagccgggcgtggtggtgcatgcctgtaatcctagctactcgggaggctgaggcaggagaattgcttgaacctgggaggcagaggttgcggtaagctgagatcacaccattgcactccagcctgggcaacaagagtaaaactccgtctcaaaaaaaaaaaaagattttcatgttcgaaagaagacaatgtcttatatatctaaacttttcagcaaccatcaaaaaggtctaagtccatcaacaggtgaatggataaacaaatagtagtacatccatacagtggaatcctgctcaggaataacaaggaatgacttattgatatatgcaacaatctcaaaacaatcatgctacgcaaaggaaaccagaccacaataaaagatgttgtatggttccctttatataaaaatcaagaaatgcaaattaatggatatagagagaaagcagatcagtcagcacccaaggcagaggcataagagggaaggaacaaaagagaaattctcaagaagcagggttttgagaaaacttttgagggtgaggatgtgttcaccatcttgattgtgatgatggcttcccaggtatacatatgaaaacttatcaaattatataccttaaacatgtgcagtttattggatgtctgttagacctcaataaagctgtttttaaaaatgtatacaattccagagctctccagtctcaaaaatttttttaaaaatgtataagaacaggccaggcgcagtggctgatgcctgtaatcccagcactttgggaggctgaggcgggtggataacctaaggtcaggagttcaaaatcagcctgactcccatctctactaaaaatacaaaaattagctggacatggtggcggacgcctgtaattccagctactcgggaggctgaagcaagagaattgcttgaacccaaaaggtggaggttgcagtgagccaagatcgcaccattgcactccagcctgggtgacaagagcaaaactacatatcaaaaaaaatgtttaataacagactttgatagaagttacctttgacttctaatggctatatttggtcctaagaaaccttatgatgttctctaagagttagctcactcagtcattaaaattcttccagacatttacaaacagataggtgtgtataaacaaatcaaatatgttagcttatgacatagggctagagagttaaaattaaaattttttttaatgttaataagttagcacagcttattttataccatgtaaatagtgaaagaaagcctgcttaacttgaaatgttatcttccagaaacctccaacacatagcatacatgtcagcaaaacactgtctgctcattaaagaaagtcttgaggaagacaaaggtgcctagtactattgctacttctcaatatttactcaacttcctggccaatgaaataagaccagggtaagaacagataccttaaaaaggtacaggaagcaaagagactagtgtgatcatgtagagacagtatgatcatctaattaaagaatgaacagaaaaattactggaactgtaagagaattcaatatagtattcttagccttcctatatgctaaaatatctacttagaaaacacagttgggtactaggggaagatatcatttatgacagcagcaaaaatcagcctacaaaatattcaggagtaaacctatcaaaaatgtgcaagacctgtttgaagagacccttaccccacatgtaagagaggatttaagtgaatagatatttcatggactgattgggaagacccagtgtggccaagatgttggaacaggactcccctgagaccttgggacagcaccatgtcacagtccttcctacttctggaaattaattaggatatggttttgttttttgttttttgttttttgacagagtctcactgttgccgaggctggagtgcagtggcacgatctcagttcactgcaacctctgcctccggggttcaagtgattctcctgcctcagcctcccaagtagctgagattacaagtgtgtgccaccacactcagctaattttttttgtagttttggcagagacagggttttaccatgttggccgggctggtctcgaactcctgacctcaagtgatctgcctgcctcggcctcccaaggaatatgtttttttaatgaggcaagttgcatcaacatctcataggaaataatagttacctggagcatcttttgttcaaaacatcttggtttggagattgtgctggcttgtcctgaggcctcagtgcccgaattgagtgaatgaagtgaaaccatggttaggctatctcctccacaggtgaggtgaagacgtgatccctggagtcacttgagcctagagtttctgccttcgaagctgtctccctgtggtacccataaagcatgactgtggctgaccgtgtgtctctgcctccaccttttggctaagtgagccacaccaactcagtaaccccagcagagcactgtgggtggtctctgggtatgttgggagcattgttttcacagtggatgaaagaagaaaaaaacagtaaagccctttgatgggtctttcttgtggtcctgaaacttacatgcaagactaattaaggccaggtgcagtggctcacgcctgtaatcccagcactttgagaggccaaggtgggcagatcatgaggtcaggagtttgcgaccagcttggccaacatggtgaaaccccatctctactaaaaatacaaaaattagctgggcgtggtggtgggcacctgtaatcccagctactcaggaggctgaggcaggaaaattgtttgaaactgagaggcagaggttgcagtgagccaagataatgccattgcagtccagcctgggcaacaagagcaaaactccaaaacaacaacaacaacaacaacaacaacaacaacaacaacaaacaacctgtggctggcaaactggctgaataggaacagctccggtctgtagctcccaatgagatcaatgcagaaggtgggtgacttctgcatttccaactgaggtatctggctaatctcattgggactggttagacagttgggtgcagcccacggagggtgagcagaagcagtgtggggtgtcgcctcacccaggaagtgcaaggtgtcagggaactccctcccctagccaagggaagccatgagaaactgtgccataagggacagagcactccgacccagacagtactcttttcccacagtctttgcaacctacagaccaaaagatttcctctgatgcctacaccactagggccctggtggtgacaaaatctctcagcacttgcctgtctgtaaaggatttcatttcttctttgcttatgaagcatagtttggctggatataaaattctgggtggaaaattcttttctttaagaatgttgaatatcggaccccactctcttctggcttgtagggtttctgcagagagatgtgctgttagtctgatgggcttccctttgtgggtaacccgacctttctctctggctgcccttaacacaaaactgggtggccatttgggcagacaccgagctagctgcagaagtgtttttcataccccagtttcacctggaatgccagcgagacagaaccgttcacacccctgaaaagggggctgaagccagggagccatggtctagctcagtggatcccacccccacggaacccagcaagctaagatccaatggcttgaaatccttgctgccagcacagaagtctaaagttgacctgggatgcttaagcttgatagggggaggggcgtccaccattaatgaggcttgagtaggcggttttcccctcacacagtgtaaacaaagccaccaggaagttcgaactaggaggagcacactgcagcttagcaaagtcgctgtagccagactgtatctctagattccttctctctggatagggcatctctgaaagaaaggcagcagccccagtcaggggcttatagataaaactctcatctccctgggacaaagcacctgggggaaggggcagctatgggagcagctccagcagacttactgcctggcggctgtgaagagagcagcagatctcccagcacagtgcttgagctctgctaagggacagactgcctcctcaggtgggtccctgacccctgtgcctcctgactgggagacacctcccagcaggggtcgacagacacctcatacaggagcgctccaactggcctctggtgggtgcccctctgggatgaagcttccagaggaaggaacaggcagctgttctgcagcctttgctagtgataccctggcaaacagggtctggcatggacctccagcaaactccagcagacctgcagcagaggggcctgttagaaggaaagctaacaaacgaaaggaatagcatcaacatcaacaaaaaggacgtccacacagaaaccccatccaaagatcaccaacatcaaaaaccaaaggtagataaatccatgaagatgaggaaaaaccagtgcaaaaaggctgaaaattgcaaaaaccagaatgtctcttctactccaaaggatcacaactcgttgccagcaagggaacaaaactggacagagaatgagtttgacgcattgacagaaggaggcttcagaaggtaggtaataaactcctctgagctaaaggagcatgttctaacccaatgaaaggaagctaagaaccttgaaaaaagattagaggaattgctatctagaataaccattttagagaagaatataaatgacctgatgtagctgaaaaacacagcacaagaacttcctgaagcatacacaagtatcaatagccgaattgatcaagtggaagaaaggatatcagagattgaagatcaacttaatgaaataaagtgtgaagacaagattagagaaaaatgaatgaaaaggaatgaacaaagcctccaagaaatatgggactatgagaaagaccaaatctacatttgattggtgtacctgaaagtgacggggagaatggaaccaagttggaaaacactcttcaggatattatctgggagaacttccccaacctagcaagagaggccaacgttcaaactcaggaaatacagagaacaccacgaagatattcctcgtagagagcaacccaagactcataatcatcagattcaccaaggttgaaatgaaggaaaaaatgttaagggcagccagagagaaaggtcgggttacccacaaagggaagcccatcagactaacagcacatctctctgcagaaaccctacaagccagaagagagtggggtccaatattcaacattcttaaagaaaagaattttcaacccagaattttatatccagccaaactatgcttcataagcaaaggagaaatgaaatcctttacagacaagcaaatgctgagagattttgtcaccaccaggcctgccctacaagagctcctgaaggacgtactacacacggaaaggaaaaaccggcatcagccactacaaaaatgtaccaaattgtaaagaccatcaacactatgaagaaactgcatcaactaatgggcaaaataaccagctagcatcataatgacaggatcaaattcacacataacaatattaagcttaaatgtaaacaggctaaatgccccaattaaaagatgcagactggcagattggctaaaggtcaagacccaacagtgtgctgtatttaggagacccatctcacgtgcagagacacacatagactcaaaataaaggcatggaggaatatttacaagcaaatggaaagcaaaaagaagcaagcgttgcaatcctagtctctgataaaacagactttaaaccaacaatgatcaaaaaagacaaagaagggcatcattacataatggtaaagggatcaacacaacaagaagagataactatcctaaacatatatgcacccaataaaggagcatccatattcataaagcaagttcttagagacctacaaagagacgtagactcccacacaataatagttggagacttttacaccccactgtcaatattagacagattaacgagacagaaaattaacaaggatattcaggacttgaactcagctctggaccaagcagacctaatagacatctacagaactctcaaccccataccaacagaatatacagtcttctcagcaccacatcacatttattctaaaattgaccacataattgaaagtaaaacactcctcggcaaacgcaaaagaacagaaatcacaacaaacagtctctcaggccacagtgcaatcaaattagaactcaggaataagaaactcactcaaaaccgcacaactgcatggaaactgaacaacctgctcttgaatgactactgagtaaataatgaaattaaggcaaaaataaataagttttttgaaaccaatgagaacaaagacacaacctaccagtatctctgggacacagctaaagcagcgtttagagggaaatttatagcactaaatgcccaaaggagaaagcaggaaaaatctagaattgacaccctaacatcacaattaaagaactagagaagtgagagcaaacaaattcaaaagccagcagaagacaacagataactaagatcagagcagaactgaaggaggacaccaaaaaatccttcaaaaaatcaatgaatcaaggagctggtttttgaaaagatcaacaaaatagctagaccactagccagactaataaagaagaaaagacaggagaatcaaatagacacaataaaaaattataaagcagatatcaccactgatcccacagaaatacaaactaccatcagagaatattataaacacctctacacaaataaactagaaaatctagaagaaacagataaattcctggacacatacaccctcccaagactaaatcaggaagaagtcaaatccctgaatagaacaataacaagttctaaaattgaggcagtaattaatagcctaccaaccaaaaaaaggcccaggaccagacagattcacagcctaattctaccagaggtacaaagaggagctggtaccattccaaacaatagaaacaatagaaaaagagggactcctccctaactcattttgagtccagcattatcctgataccaaaacctgccagagacacaacaaaaaaagaaaatttcaggccaatatccctgatgaacatcaatgcgaacatcctcaataaaatactggcaaaccgaatccagcagcacatcaaaaagcttatccaccaccatcaagtcggcttcatccctgggatgcaaggctggttcaacatatgcaaatcaataaacataatccatcacataaacagaaccaatgacgaaaaccacatgattatctcaatagatgcagaaaaggccttcaataaaattcaacaccctttcatgctaaaaactctcaataaactaggtattgatggaatgtatctcaaaataacaagacctatttatgacacacccacaaccaatatcatgttgaatggacaaaagctggaagcattccctttgaaaactggcacaagacaagaatgccgtctcttaccactcctattcaacatagtattggaagttctggccagggcaatcaggcaagagaaagaaataaatggtatccaaataggaagagagagagtcaaattatctctgtttgcagatgacatgattgtatatttagaaaacctcatcatctcagcccaaaatctccttaagctgataagcaacttcagcaaagtctcaggatacaaaatcaatgtgcaaaaatcacaagcattcctatacaccaagaacagacaaaaagagagccaaatcatgagtgaactccgattcacaattgcttcaaagagaataaaatacctagaaatacaacttacaagggatgtgaaggacctcttcaaggagaactacaaaccactgctcaaggaaataagggaggacacaaacaaatggaaaaacattccatgctcatggataggaagaatcaatatcctgaaaatggccatactgcccaaagtaattgatagattcaatgccgtccccatcaagctaccactgactttcttcacaggaaaaaactactttaaatttcatatggaaccaaaaaagagtttgtatagccaagacaatcccaagcaaaaagaacaaagctggaggcatcacgctacctgactttaaactatactacaatgttgtagtaaccaaaacagcatggtactggtaccaaaacagatatatagaccaatggaacagaacagaggcctcagaaataacaccacacatctacaaccatctgatctttgacaaacctgacaaaaacaagccatggggaaaggattccctatttaataaatggtgttgggaaaactggctagccatatgcagaaaactgaaattgggttctcactcataggtgggaattgaacaatgaaaacacttggacacagggtggggaacatcacacaccagggcctgtcgtggagttggggggagaggggaaggatagcattaggagatatacctaatgtaaatgatgagttaacgggtgaagcataccaacatggcacatgtatacatatgtaacaaacctgcacgttgtgcacatgtaccctagaacttaaagtataataataaataaataaataaataaacataaaaataaaataaaaaaagaaaactgaaattggaccccttccttacaccttatacaaaagttaaatcaagatggattaaagacttagacataagacctaaaaccataaaaaccctagaagaaaacccaggcaataccattcaggacataggcatgagcaaagacttcatgactaaaacaccaaaagcaatggtaataaaagcaaaaattgacaaatgggatctaattaaactaaagaacttctgcacagcaaaagaaactatcatcagagtgaacaggcaacctacagaatgggagaaaatttttgcaacctactcatctgacaaagggctaatatccagaatctacaaggaagttaaacaaatttacaagaaaaaaacaaacaaccccatcaaaaagtgggcaaaggatacaaatagacacttctcaaaagaaaacatttatgcagccaaaagacacatgaaaaaaagctcatcatcactggtcgttagagaaatgcaaatcaaaaccacaatgagataccgtctcatgccagttagaatggcaatgattaaaaagttaggtaacaacagatgctggagaggatgtggagaaataggaatgcttttacactgttagtgggagtgtaaattagttcaatcattgtgggagacagtgtgatgattcctcaaggatctagaaccagaaataccatttggcccagcaatcccattactgggtatatacccaaaggattagaaatcattctactataaagacacatgtacacatatgtttattgaggcactgttcacagtagcaaagacttgaaccaacccaaatgcccatcaatgatagactggataaagaaaatgtggcacatatacaccatggaattctatgcagccattaaacaggatgagttcatgtcctttgcagggacatggatgaagccggaaaccgtcattctcagcaaactaacacaagaacagaaaaccaaaaactgaatgttctcgctcataagtgggaattaaacaatgaaaacacatggacacagggagaggaacatcacacactggggcctgtcagtggatgggggactaagggagggatagcattaggagaaatacttaatgtagatgacggattgatgggtgcagcaaaccactatggcacgtgtatacctatgtacctatgtaacaaaccttcaggttttgcacatgtgtcccagaacttaaagtataatttaaaaaataaaaataaataaaataattagaacaaagtccagcagtatagagaattaggtaataatcaataggaacagacaaatctaatgttgaaatagaataatagatccagaaattaattctaaagtcttatttatggttctttaatgtgtccttgatattagcttgcaattagctccatcaagtgatagtatccaacgtaaaatgggcttagcaatttcttgcttctcatgctgcttttatatctctcttctttcacattcttggagtccccaacaacagggcagaggctgaagggcacagatcttttgtgtcgtatggcttggcctccattgaagtaggtgagggtgaccatccctggtacggaaagacaggtccgggcaggccacagtctggctctcctgcctggcttcctgggaataattgagcaattgctctgtaccaggcggggttctgaatgcttccacgtcccaatttcaatcacttctgcaaggtgacgcagctaggaaagatgtgactcaggccactctggcatccaggactcacctcctcttctgacctctcgtcagcctgctgtattagctgggccgcccttcccatgttgacctcctcccatatctgagcgttggcctcacaggcagcgtcatgaagctgccaccatccctgtccccctttggttcaggccacagggatgcctggagctgggaacggccctgcgtagcactgactgcagagtcttcagtgcgtgtgtctctgtctcctttactgaactgtgagcgcctaaggaggggccttccatctgctagtttatccctggaatgtatctcaatgcttggcagaggataagcgttacatgttggatacattaattgatcctaagattctaagcactaaattttacgagaagtagcaaaaatgacctgaatgtagtcgcactgtatcttttcaatgatccaaacagctgactccctgggcttacgccttcataacgctggaaccccctcccgcccgctttgttcctctccctcttgcagcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtggtaaggtttggggctttttaatgaatgtgctcctgactgggaagtgtaatgtgctcctgactgggacgtggcacccctgaaagtggtggcagcttatggttaattcaataagtgttttttaagcaactactatatgcctgacacacagggacacccaagaaataacaacaggctgcatctgtctagctctcaaggggtttatgctcagatccctcaaatcaggccaacgtgtgttaaacaactaaagaacaacctcaggcggttcacgattgactatcaacatttgggcagaaatggttagaaagaattggactcgaggcactcctgtggtaatgaaggcttaggatctaagataggtcttaaaggttagggcgatgaagtagagggagcctggattttaccttctgctgcttccatttcataaattttgttttgtaataaagagaaatgtcaaaatatgtgttttaaagagagagaaatattaaaatatatgctaacttactgggtagaggaagacacacagacagtcattgctttaaaaaggaaagaaacgacttgaatgtaaaacatctgtgaccctttgagtagctgttaaaggtctggagaaaaggagataatttacacctaaaaatcatgggaactttaggttacatctttggaatcttggatatgaaaagtgcttagtgccagccaagtttgtgaaccactttcagcaatcaaatcatcctaaatttatgtaggcttggcagtaagttagaccaagacctcactgtctgctggaagagaagaaaaactgataatggactgatcacgaaccgtgaaatggaactaacagaactgatccctggggaggagagtggagttgaaaatgaaatgcccggggaagtttggtggctcctgcccaactcaggctagtattcatttccaagaagttccaatctggtggaagggacacagcaatagaacatccaccaaggggatcccgataccgatggtctcttcattcccacagcaagaggaaacgtggccatggggctgacaagagctaggcagtgtcaaggtgagacttcagcccctggtaggaatctggacagctctgcaggaagccagaggagaggcgctggtggtgggcagaggaaacacgtgggtgtccagggcctgccctaaaggaggaagacaccagtgatggccagactgcatttaggggcctatattctcactctgccagtaggtctcagtggggaaatgagaccatcctcctagagatgtgcaggatgtccaggtgcaggtgagactccagctgacgttcaaaccttccgctccctcctttctctgctgcctcacgcagggtgtgggaggcggctgacatgctgacctgaacaacgtattgtcccgggatagtgtaaggctagagggcgggtcaggtcccagagcaggctcctcctacaggtaacaagtaggacgaataaaataagtatctgtacctaagacactatcatcaccatcatagccaacacttctgtagtacttaggtgtgtgtagaagagacaatagagcaatatcttcaaagtgctggagaaaagtaactgaaaactccgtcaaaccataattcaagagtgtgggtaaaataagacattctcagacatacgaaggccaaccgagtttactgcctgcaaacctaaaagaaccgaagaaagggcctacttcagaggaaaaaaagggaacccagaggaaagactcaggaaacaagtaacaatcatagatacaacggggtcaaatattgatataaaatgtggcaatgaattttgtgttaaaaagtgtgaaaccaaagctgtaaacaatctcatgtcaatgacatacaatcaaataattcagactttcttagaaaaaattattaaaagaaaattttctttcaaaagtaatgttattcataattagtccaaaaatacaccctatagttttaacatcagtgaaagacaataaatctagaaaaccttaccaacacgtgataaaagtgacatcagcaaaggagaaaatgaactattcagtaaatagcaggatacttggtatttgggtaccaactcatccccactgataggactttctcagttttagcactgaaaggtcccatagcccagaaaacctgaaaaccctaggcaaaccaggaaaattggtcatcctgcttggtatccaaatatataaaaatgtatttatattcctacatagcaccatatacaaaaatcaattcccaccttaaaaaaaagatcagctgggtgcggtggctcacgcctgtaatcccagcactttgggaggccgaggccggcagatcacatgaggtcgggagttcgagaccagccctaccaacatggagaaaactcgtttctactaaaaatacaaaattagtcaggcatgggggcacatgcccataatcccagctactcaggaggctgaggcaggagaatcgcttgaacctgggaggcagaggtttcggtgagccgagattgcaccattgcacttcagcctgggcaacaagagcaaaactccatctcaaaaaaataaataaataaaaaataaaacacaaaaattagccaggcatggtggcgcacacctgtagtcccagctactcaggaggctgaggtgggaggatcgcttgagcccagggaggttgaggctgcagtgaatgatgattgtgccattgcactccagtgtgtgtaacagagtgagactctgtctgaaaaacaaaaacaaaaaaaaaagaaaagaaaaacctataccctggaaaaacttctcacacccctgcaaaaaaaggagacatgtatgagaagattcactacagcattcatctgagtgagaaaaatttaaaatggttctaaagggtatagacaggagaatggatgaatatattgtggtatagttatacaatccactaccatacagcacttaaattcatatactagaaaaacaaaactaaacaaataaataagttaggcgtggtggcttatgcctgtaatcccagcactttgggaggccaaggcagaaggattgtttgagcccaggagttcgagaccagctggggcaacacagcgagaccatgtctccactaaaaaaaaaaaaaaaaaaagttagcccggcatggtggcatgtgcctgtagtcccagctactctagaagctgaggtggaaggatcacttgaacccaggagttcaaggctgcagtgagctatgatcatgctactgcactccagcctgggcaacagagtgagaccttgtctcagaaataaataaattcatatgctagagggaaaaaaaattataaagcaatacatgttacataattacatttatactatgtttaaaaatatgtttatgaatataatatagtagcataattatgaattggaatggtaaacagtaagttaaaaatggtggctctctctagggtaaagagaggaagaaatgagatggggaaaagtacacagcaaacttcaactgttttaatagtgaatttccttgttttttttcaccacacttttgagatttatccatattaatatacatagtcaagtcaattttcaagaaaagtaaatggcaatttcttttctaagtacttgtgaatctttctcaacattttgctgtaaggccttctggtatttagtgttataagggaaggcatgctgattcttgttcagttgaatataaagtttttttcctttctagtaagttttctctttatcactcaaaattttaccaaaatatatctggccatgggtcttcttttactgaaacttcctaaaacacagcgagcaactatcttggctactatagacatcttctaggtctgctgtaacaataacagtggaccgaggtaaagaaaacttcacaaaaaaaaattcttctctttttcaaaaccacattgtctctttaaaacattcttacttgaaatgagggaaaaagtatatcaaagctgaaataagtttgcattatttagtttgcagtacagcttctggttctctgaggaactcctgtcaaattcatctcttttttcctctgctttttcatacccactgagcagtaatgtgttttgcttacaaaagaagcctcggaagtcatgcagagagcgtaccactcagatgcctctcaagttttttttggttggatttttttttaaagaagccattatttactgaaactatttagccctgacatcatgaaagaaagaagtcaaaagggttcctgcatttctaatgattttgcctttaaagaaaaatagagctacacacacacacacacacacacacacactgaaaatttataaaacagttgtgctaaaaacaggctgaaaaacttttataaaatagtgttaagaaaagatataataaagaatatagaaaatacagtagcaacaagataaagaaaacccaaattgtcagtgataaaatccattttcatgttgatgggatgctgaaagcattcctgcaaaaatcatgaataaggcaaaatgtccacaatctctactactatttaacaatgtatttggccaggcgcgatggctcacgcctgtaatcccaacactttgggaggccgaggcgggcagatcacaaggtcagcaattcaagaccagcaggaccaacatagtgaaaccccgtctctactaaaaatacaaaaattagctgggtgtggtggtgcgcgcctgtagtcccagctactcaggaggctgagggaggagaatcacttaaacccgggaggcggaggttgtagggagctgagatcacgccattgcactccagcctgggagacagagcaagaccccgtctcaaaaaaaaaaaaaaagtattttaggtgttagctaattagacaagaaaattagaggcctgagaattggaaataggtaaaattcttcctatttgcagatgaaacccgaagagaattatagctataactgatacaaatacagaagaattcagaaataagaaggatataaaattatcattaaaataatactctgtaggcttcaggtcttaaaatgaagaacacttccatttcaataataaaatgcaaataaatcaatttagaaatggtcaaaacatctgaacacacatctctccaaagatgtacaaatagctagtaaatgcatgaaaagatgttccacatcagtagtcattagcaagatgcaaatcaaaaccacaatgaaataccacttctcacccacttatgaagctagaataaaaaagacaacagtaactgttggcaaggacatggagaaattggatccctcaaatattaccatgtgaaatggtgcaattgccttgtaaaacagtttgggagttcctcaaaatgttaaaactcaagttaccatatgactcagcagttctactccgaggtttctacttgagagaaacacaaatatatgttcgcacgtacttgcacaggaatgtgcatagcagcatgattcatgcagccaaaatgtggaaacaacccgaatgtctatctgctgatgaatggacaaacgaaatgtgatgtgtctatccaaacaatgagatattattcaactggaaaaagaaatgaagtgccgatacatgctacggcatgggctaagtgcaaaaacattacgccaagtgaaaggagacagccagcaaagatcacatacggtatgctccacaacaggcaaatctatagagacaggaagcggattcgtgcttgcctagggccggtagagtggggagatacaggtgataagcagtgactgcttactggtggggtttcttttgggggtgatgacaatgttctggaattagatagtagggatggttgcacaactttgtgagtatactaaaaaccactgaattgtacactttaaacagataaacttgacggcatatgaatgatagctcaataaagtgattaagaaagtggccgggcacggtggctcatgcctgtaatcccagcactttgggaggtccaggtgggtggatcacttgaggttaggagtttgaaaccagcctggccaacatggtgaaaccaaatacaaaaagtagccgggcgtgttggcacatgcctgtagtcccagctactcaggagactgaggcacaagaatcgcttggttgcagtgagctgagattgcgccacagcactgcagcctgggcagcagagcaagacttggtctccaaaaaaaaaaaaatagcattcatattacaacaataaccagttacaagatgagataaaagtacaaattccatttacgataacaacaaaaatacttggaataagtttacagacaaatgtacagaatgtgtataagaaaacaaactctttagagaaatacaatagattttgattatgcactttatttttctctactacttttgtatatttgcctataaatatatgaagcctccattttgactggaaacaaagcctagaggatgtatactttttaagatgcagaaaatgaaatgaaaccccaatacattcctgacagtcttacttttttactattttcatttttttaatttttgtattaaatagagacagggtctcgctatgatgcccaggctggtcttaaactcctggcctcaagtgatcctcctgccttggcctcccaaagtgctggggttacaggcatgagccaccgcgccgaacccttttttactattttctaatgaatgtttttatttaaaaaatcattattctaagtataattgaacacaataatttctaactctttctcaatagtagaaaccacaacgtttatttatatttctagtaccttattgtcacacttttggtttgcttgggaaaactaactggggtcatttttttttccaagtagaggaagaaattctattaatacttggggatctgaagttctctttaaagtatttgtaaaaaatcttttcttggcagggactgagctgtcaacatgtgaatgtcttttttttgcagtctcactgttagaaaccaggaagatcagaggcccacaatagcttcccacgaactcagagcagatcttccaacctgggaagaaaggtgaaatcacacgttttttttacctcactaaactaacagaaatactaacctctttcttttctttgccttgtatgtttcaacagaacacatactttctctaactgtaatttagtaatatccaatcattatgtggcctcgcattcctcccctgcagaattccatttaattcatcgtgtgacagggagagaaatcagttccattattagtctaatccctttgctaattgcaaatacaaatagattcttcctaacaaaacatattatgttattttatttttatataatatacttttaaaaataaaagtatatcatataattttatataagatatagcatatatatttatatatactatatataaaatacagcatatatacttatatatgctatatatatgatatagtatatatatttatacactctatataagatatagcatatttatacacgctatataagatatagcatatttatttatacatgctatataagatatagcatatttatttatacatgctatataagatatagcatatatatttatacatgctatataagatatagtatatatattatatatgctatatataagatagtatatatattatatatgctatatataagatatagtatatttatatatgctatatataagatatagtacatttatatatgctatatatgatatagtatatacatttatatatgctatatataagatatagtatatacatttatatatgctatataggatatagtatatacatttatatatgctatataggatatagtatatacatttatatatgctatataggatatagtatatacatttatatatgctatatataggatatagtacatacatttatatatgctatatataggatatagtacatacatttatatatgctatatataggatatagtacatacatttatatatgctatatataggatatagtacatacatttatatatgctatatataggatatagtacatacatttatatatgctatatataggatatagtatatacatttatatatgctatatataggatatagtatatacatttatatatgctatatataggatatagtatatacatttatatatgctatatataagatgtagtatatatatgctatatatatgatatagtatatatatttacatatgctatatatataagatatagtatatatatttacatatgctatatataagatagtatatatatttatatatgctatatatatgatagtatatatactatatataagtatatatgctatatgtaggatatagtatatatatttatatatgctatatataagatgtagtatatatatgctatatataagatgtagtatatatatgctatatatatgatatagtatatatatttatatatgctatatatatgatatagtatatatatttacatatgctatatataagatagtatatatatttatatatgctatatatatgatagtatatatactatatgtaagttatagtatatatatttatatatacgatatatgatacagtatatatacatatgctatatataagacagtatatatttatatatgctatatataagacacagtatatatttatatatgctatatataagatacagtatatatttacatatgctatatataagatacagtatatatttacatatgctatatatgatacagtatatatttacatatgctatatatgatacagtatatatttacatatgctatatatgatacagtatatatttacatatgctatatatgatacagtacatatttacatatgctatatatgatacagtacatatttacatatgctatatatgatacagtacatatttacatatgctatatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtatatatttatatatgctatataagatacagtatatatttatatatgctatataagatacagtatatatttatatatgctatataagatacagtatatatttatatatgctatataagatacagtatatatttatatatgctatataagatacagtatatatttatatatgctatataagatacagtatatatttatatatgctatataagatacagtatatatttatatatactatatataagatacagtatatatttatatatactatatataagatacagtatatatttatatatactatatataagatacagtatatatatttattggtcatttacaaaaacttggatttaaacatttgaaaatatatatccttctcaagcaaacatgaaacagttatattttaaaaataaaagtatattatataatatacggtgggtgggcacggtggctcacacctgtaatcccagcactttggaaggtcaaagcatgcggatcacctgaggtcaggagtttgagaccagcctggctgacatggtgaaaccccttttctattaaaatacaaaaattagcggggcgtggtggcaaacgcctgtaatcccagctgtttggaaggttgaggcagggagaattgcttgaacactggaggcagaggttgcagtgagccaagattgcaccactgcaccccagcctaggagacagagcaagactctgcctcaatcaatcaatcaatcaataaagggagagggagaaagaaaaagctatagatgcttgccaaaaatttaatggtatataagtaaagaaagtggtctaacctctaagagagtaaacactgttaacacatttcttttttttttttgagatggagtctagctctgtcacccaggctggagtacagtggtgcaatcttgactcactgcaacctctgcctcctgggttcaagcgattctcatgccttagcctcccaagtaactgggattacaggcgcccaccaccatgcccagctaatttttgtatttttagtagagatggggtttccccatattggccaggctggtctcgaactcctgacctcaggtgattcgcccacctcgttctcccaaagtgctaggattacaagcgtgagccactacgcccagcgtgttaacacatttctttaagaaatgacctggaagatttgaaaagaaataaaatagaagttttaaaaatcaaatattattgttcaaattttaaaaaaattgatgattgaaatagaagattagatacaactaaataaataattagtgaacctgaaggtatccaaaaagacccacgtaacaaggagattgaaatacagtttgagtttcccttatccaaaatgcttggaactagaaatgtctcagatttcagattttttcagatttcggaatatttgcattatacttaccagttgaacatcccaagtccaaaacttcaaattattccaatgagcatttcctttgagtgtcatgtcaatgctcaaaaagtttcagattttggagcaatatggattttagatttttgaattttggatgttcaacctatataaaaataagttaaaataaatggaggatagaatgataagaattgacattaatgttttgtttttttttttttagacagggtctcattctgtcacccaggctggcatgcggtggcacgatcttggctcactgcaacctctgcctcctgtgttcaagtgattctcctgcctcagcctcccgagtacctgggactacaggcatgggccaccacacttggctaatttttgtatttttagtagagacggggtttcaccatgttgcccaggttggtctcaaactcctgagctcaagtgatctgtccacctcagcctcccaaagtgctgggattacaggccagagtctgtttttatccactaatctatacttcttccccatactagcagtaaacaaaatagactttaaaaaattttaaagcactttagagacagagcaagtcactactagaacgttaaatgatttagcttactaggaaagtgtaacaacttgtatgtacctaataaaataatctcaaacatcaaaagcaaaaattgctagagcaagacatttacaaatctgctaacgatagagggagattgccacattcctttcttagttactgatatttctaacagatagaaattttagacaaattatagaaatttgggccaggcacagtggctcctgcctgtagtcccagcactttgggagaccaaggatgggggaaagcttgagtccaggagtttgagaccagcctgagcaacatgacaaaatctcatctctacaaaaaaatacaaaaaaatttagctggctgtgatggtgcgtgcctgcagtcccagctgctctagaggctgaggtgggagagtcaattgagcccaggaggttgaggctgcagtgagccatgatcacaccactacactccagcctgggcaacacagtgataccctgtatcagaaaaaaagaaaaagaaaaaaagaaacagggagaaattaattaataagctatatttattggtcatttacaaaaacttggatttaaacatttgaaaatatatatccttctcaagcaaacatgaacagttatgataactgaccaagcattaccttataaagtatctcaataaatttcaaggaacataattaatcaaactgtactgacaccaatataattcaaatagaagttagaaattaaaaaataaagccgagcactgcggcacacgcctgtgatcccagcactttgggaggccgaggcaggcggatcacctgaggtagggagtttgaggccagcctggccaacatggtgaaactccgtctctactaaaaatacaaaaatcagctgggggtggtggcacccacctgtaatcccagctagtcgggaggctgaggcaggagaatcgcttgaacccgggaggcagaggttgcagtgagccgagatcgcgccactgcactccagcctgggcaacagagtaagactaaaaaaacagaaattaaaaagtgaactaaaaatcctcatatgtttgacatttattttattttattttacatcattattatttttttgagacagagtcttactctgtcacccaggctggagtgcagtggtgcaatctcggctcactgcaacatctgcctcccgggttcaagtgattctcctggctcagcctcccgagtagctgggattacaggcacatgccaccatgcccagctaatttttttttttttttttttttgagacagagtattgcagaggttgtggtgagccgagatcacaccactgcactccagcctgggcaacagagcaatactctgtctcaaaaaagaaaaaagaaacttaatgttgggtggaaaaagcaagttgcagaagacaacatatagtcaaccattttgataaacttaaaaaaaaaaactggctgggcacagtggctcacacctataatcccagcacttcgggaggccaaggtgggtggatcacctgaggtcaggagttccagacagcctggccaacatggtgaaacgccatctctactaaaaatacaaaaaattacccgggtgtggtggtaagcacctgtaatcccaactacttgggaggctgaggcaggagaatcacttgaacccggaaggcggaggttgcagtgagccgagatcgtgccattgtactccagcctgggcaacaaagagagactctgtctcaagaaaataaaataaagaaataaaaactaaagactacatttttcaggattacatacatacatttgaaactatggaaacaagataaaagagatattaaggatcattattaagctatgttttctgatctcaatataattatgacagaagtaagaattaactcaaaggggtaagcccaaaatcaagtatagcagttccctagaggacaaagccaagagacagtagcaagtagaagtagcacgaaaataaatgcaacattatcagtgctgttctggttcttaaggaaaatggcgcattcataagtgttcatttacactagagactcggaaaggtggatgggagggtgggagataggtaagggatgacaaattacctaatgagtacaatgtacactatcccattgatggctacactaaaaacacaggcttcaccactgtgcaatatatccatgtaacaaaagtgcacttgcaccccctaattatagtttttaaatgtttataagttttttataaagtgagccagacgcagtggctcacacttgtaatcccagcactctgggaggccaaggtgggcagatcgcttgagcccaagagtttgagagcagcctaggcaacatagtaagacctgactctacaaagaatacaaaaagttagctgggcgtggtggcacgtgcctgcagggtctgctacttgggaggccaaggagagagaatcatatgagcctagtaagtcgaggcttcagtaagctgtgatcacaccactgcactctagcctcagcaacaaagtgagactctgtctcaaaaaaaaaaaagtgttcattttgttgtcacctttggacagtacagcggtggcatttataacttgcacttatactacatatattctctttctcaaatattatataattttaaaatatattaaacagacacttgctctattgttccagaggtttaatgttgtcaaatctgacttagttctgtcgtagtacagaactcatcacagatgattaggaagttttgggtcagatggttgcaggatttttctttacatttacagtttttaaaatatttcaagatgtgcccatttgtaaacaagcatgttcttagcatttattctagcaacttggtttgcaagccttttggtatgcaatccagcaaaaaatttgaaagtatcatattcatgtgtttttcccaaaggtttgaggaaatgcgaacagttctttcccttcctaaaagggcctaaatgcatatatttttcattcttggaggaggaaaagatatgttcctaatgatgaattccaattaactaccactaacagttcccttttgccccctctcttttggtctccacgaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtatgtgaccacgagatgccttttcccaaggctgttggtaaaattaacttggtgcaaaagtaattgccataggccgggcacagtggctcacgtctgtaatcccagcactttgggaggctgaggcgggcggatcacctgaggtgaggagttggagaccagcctgaccaacatggtgaaaccccgtctctactaaaaatacaaaaattagcctggtgtggtcatgggcgcctgtaatcccagctacttgggaggctgaggcaggagaatcgcttgaacctaggaggcagaggatgcagtgagccgagattgtgccattgcactccagcctgggtgacaacagcaaaactccatctcaaaaaactaaacaaaagtaattgccttttttttttttttttgagatggagtctcactctgtcgcccaggctggagtgcaatggtgcaatcttggctcactgcaacttctgcctcccgggttcaagcaattctcctgcctcagcctccagagtagctgggattataggtgcgcaccaccaggcctggctaatttttgtatttttagtagagacagggtttcaccatgttggccaggatggtcttgatctcttgacctcgtgatccacctgccttagcctcccaaagtgctgggattacaggcgtgagccaccgtgcccggcctcgccattacttttaactttttccagaaaaatgcacaaaatttttcaccaatttcagaggacatttggagccgctctgcaggtccacagtcaaagggatctgaataccgtgaatgcgggtgcagctgttttctacattttgcagttgatgttctgggtcaagctgaacatgaccaaacagctgcacccacattcacggttttcagatcactttgactgtggacttgcagagggctccaagtgtcctctgaaatctgtgaaaaattttgtgcatttttctggaaaaagtatcccctggagtctccatttgacactgaacactgtttacaaatattataccctaagacgttcctttaaataaaattatcttgttattctgagaaaaatcttgtatttaggtatcttgatgttatagagcagcagcatcacagatgtgatactgatgctgaaaaggttttccccaggctggctttttcattcaagaaattatcagatgaatgagattgggcaagtttccacctgtcagtgtttcagtttcttcaaatctaaaatgtaggaggccagccctggcacagtggccaacttctgtaatcgcagcattttggcaggccgaggcaggtggatcacctgaggtcaggagttcgagaccagcctggccaacatggtgaaaccccatctctactaaaaatacaaaaaattagccaggtgtggtagcattcatctgtaatcccagctactcaggagactgaggcaggagaatcacttcaacccgggaggcggaggttgcagtgagtagagattgcgtcattgcactccagcctgggcaacaagagcaaaactccatttcaaaaaaataataataataaaataaaatttaggaggtcagattgttctcaaattgggtgccttgtagctctaattataaaactattagttatttcctactatgtgccgacaggaatgtcaagttgaagaagcagggcctctcctgtcatggagctcctggagatgtgggcggacagaccaggacccctggccacactctcagcactcactggggctcgggggtgagccatccacaaaggggtgggcgagaatgagaaaaatactcaaggaggctacagatggaccaaggatagtgaaaaggaaatttccacaaacacagcaggatggggacatcccaggagacaggaccaggcgagcccaggggaagagcatgaagttgtgtgatcactgcaagtatacacagattgtgccagaaagggagggtgcttaccaaactattagggctgggggcaggcagcaggaggagacttagagaaggggtagtcggagagcatggagaggtttgggcatcatggcgaagtgtctggatttttatcttgggaagcccttggattttagcctgtttatatcatcaaattttgatttttgaaagaccagtagggctgcagagtgaatttggagaagaccaggggcagaagacgttagaaaactaattcaggagtccaaagggacatggtgagggcctagctaggccagctgaagacgctagagaggaagagtcggatttgaggcaaaccccaccgtctcaaatgactcccatatgtctggtgtaggcagaccaggtggtggggtcgttggcttacttaattttgcgtcgttacgttttgctttcttaagtttgcgttgttaaattggtaatattcagttgacatgtttgaatactgagtccaaaaagttattttcattttgaattaataaggagcaagataatttttgtcctttaatttatggcttccacatatttttattttgtcatgattttttttaaggcaaggtttttcatcaatcttttaaagtattatacaaccaaaaacaggccgggcacagtggctcacgcctgtaatcccagcactatgggaggccgaagcaggcagatcaccttgtctaggaagagccaaacatcagagcaatcaacatctcctatgggcttagtgaaatccaagcactttgtcattaaatcacaaaaaacctaagacattaccatcatcatcatccccacttcaggggaagagctcactaggacacagagtttaccttgcctgaggccccacagctatacagtgacagggatggattttgttttgttttgtttttgagatggagtctcgctctgttgcccaggctggagtgcagtggcatggtctcggctcactgcaacctctgcttcccaggttcaagcgattctcctgcctcggcctcccgagtagctgggattacaggcacctgccaccatgcccagctagtattttttatttttagtagagatggggttttgccatgttggccaggctggtttcgaactccacagcgctgggattacaggcgtgagccaccatacccaggcagggctggaatttaaacacaggcattgtctgccctcaggccctgtgattggaaccttccagggttttgagtcaacttccacttcacccctgtgcccaaccctccgggcaggccagcactcatccccagagccctgccactgtgggccagcaggggaagcctgggcctccaggtgtcagcccccacgttacaaggaaatgagcaaggggcagtctgtgctgcctgttttcttcaaagcagcagtgtgagccctgccagcatcacttagaacttgtgggaaataacaagcatcaggggcccctacacctactgagtctggggtggggcccaggaaccgctctcacaagccctctggagcctgctgatgccactgacatttgagaactgcgttgattatgcttttggtttctctttggcagtttggattttttggatgatcttgtttggtttgggatatttaaaaaacaacaaggccgggcacagtggctcatgcctgtaatcccagcagctagagaggccgaggcgggcggataacctgaggtcaggagttcgaaaccaaccaacacggagaaaccccgtctctactaaaaaagttagccgggtgtggtggtgggtgcctgtaatcccagctactcgggaggctgaggtaggagaattgcttgaacccaggaggcggaggttgcactgagctgagatcgcgccactgcactccagcctgggtgacagagtaagactctgtctcaaaacaaaacaaacaacaaaaaaaccaaaaacaaaaaacaaaaacaacaacaaaaatccccacaagctctaggagtttgggatagagatacaactgaagtctctaatacagctcctactcgtttctgtcgacaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaat

SEQ ID NO: 1654 - DNA, 107498 bp, Homo sapiens
gcattaaccaaacaaagagaagcagagtggatcctgtgctaatattgggaaaaccaggcaacaggactcatttggggcctttattgtgaaaacatgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaaggtaaggtgatttccacaatccatgatcctttcccgtcaagggaaagtgtttacccagaaagaatataaaactatactcaagctttagtgccattgctcacttatcttaatgttttatcaaaaatgttttcaaaccatccccaagggaaatctagaacctagatgataattacctgatctatctagttttctccaatctaaacagattccctttaccaaaataaattattatgtattgcttttttgtttgtttgcttgtttcaggtgataacattcaacaaatctagacagattttgtggctattagtgttagccctaggatatctttctccgatataaatattacatcccatataataatgaaagaaaaattatagaccgctttctacaaaaaattccttgggaaaaaattgataaactaagaacataagaacattaaggagctgaggggtgttttttccaaattcaaagtttccaaaggtgaatttcctaagcatgagtttctatcagtaggtaataacattatttctccaaaaagtgacaattttcctgctggatgttgtgtgtatatttgaaaaaaatacagtttgagtctgtaaatcctcttagctattaatagaaccatctcataaaaggttacttggcatagaatatggacatgtgttaatgtctaacaagcaatgagcacactcaaaattaaatgctgcaaaactataaaactgttcaaatactttaacaccagaaaattcacctgttcttttgccgcggctcatatcctgatatcattatttatttgcaaattctttacaaaattctctaggtctgccctttctcctaatgttattttaaccatttggcacaagtggaggggaaaaaaaaaataaaaagggtcaacacaaagctttttctgtaaaaatatacggacctgttcttttgagctttcagacatatgtgaacaaataacacatgaattcccacaccgcctattatcatctaagcactaagagtttagcaagctgcaatgaaatgggatgtagtgtccaagagtcctgaattaatggacatcttaatgtaggcgacacatgcaaaagatatttctaaaaggcagaatgtggaggctactttgaggaaacagagagcaacaacaacaaatatacccattgtatggtgcatatgtatgctgttgtatatgtgtgtatgtatatgcacccacacacacatatatataatttcaaagttctaactatcttgagaaggtatgctctaagtggaatcaaagacaaataaaatgcaaaaatatttaagaatcagtattacaccttcccatggcatcctggaatcgaccacacatgctggtgctgggcagcctaacttctatcctaacctcactaacctgttaacaggttccagtctgtacagcagcaggtgagggtagaaggaagcaatccagttgggatgctactggctccttcactcagtttttgccttttgaaaaaatctttttatattgcatttgaatacagaaagaggagacatgtgcctcatctagcaaatgtaaggatggaaacactcaactcattttgagtctgcagataccattgaatccttactaactgcaaaaccttgggctaggagccatagggaataaagagaaagagcaagatatgctccctcctttctagagacttactgtgtattgagaaagacaaacatatagcatattatcagcatgactcatgtcaataacataagatacctacataattattgtatattctttcaatcagtaagatattaggggaggaatatgatcactatggggtaagacaattgaagaagcccagtgttagagtgaaagcagtgaaatctaaggtagacgtgaaataatgtctaagaacatatatagaggcagaaagagggaacgtgagctaaaatgtatctagacgtcaaggggtcagtcagaaattctccaaaaatcctcaacctaagctttgcagttcatgcaaaaattacccccaaatataacatgggcttaaatttacaactacacggagaactatagaacttttaggaaaaaaatgggagaaaatctttatgaggtagggctaggtgaagaatacacagacaccaaaaaatcatgatccgttcaagaaaaaaaatcaataaataagacttcattagaatctaaaaaacttttgtcctgccaaagactctattgagagggtaaaagacagcatacagatggcaggaaaatactttcacccccatgtctgccaaacaccttgaacctagaataattctcaaaactcaaaagtaaaagacaaacaatccaacaagaatatgggcaaaagacatgaacagccattttactgaagagaatatgcagatggcaaataaatacatgaaaagatagtcaacattgttagccactaggagatgcaaattaaagtcacagtgaaatatcactacacaccgagaagaatagctaaaatggaaaaaaatagtgactataaaaatggctagaattgctaaaatggctaaaattgtgacaacaccaactgctggaaaggatgcagagaaactgaatcattaatacattgctgataggaatgtaaaatagtacagccaatctggaaaacaatttggcagtttctcataaacctgaagatacaactgccatatggtctagcaatttcaccattaggcatttatcccagagaaatgaaaacctacatttgcaccaaccctgtatgccaatgtccacagctgctttatttgtaatagtcaaaaaccagaaacaacccaaaagcccttcaagggatgaatgattaaacaaactgtggtacatccatactatggaatcctatgaagccactaaaaggaatgaactactaatacacgaaacaacttgataaactttagggaatggtgctgagtgggggagaaaaagccaattccaaaaagtcacacactatatatatgtgtatgattctatataagccactctttttttttctttgagacggagtcttgctctgtcgcccaggctggagtgcagtggggcaatctcggctcactgcaacctctgcctcctgggttcaggcgattctctcacctctgcctcccaagaagctaggactacaggcacgtgccaccacacccagctaatttttgtatttttagtagagacagggtttcaccatgttggtcaggctgatcttgaactcctgaccacaagtgatccgcccacctcggcctctcaaagtgctgggattactgacataagtcaccatgcccagcctatataagccactcttgaaataaaattatagacgtagagaacatattcatggttgccaaagattagggattaggtagggtggtggatatagctacaaaggggtcatactttaaagggagcctggtggtgatgaaccagttctgtgtcttgactgcagtggcagttacacacattacatgtgtaatgtgctaaaattgcatgaaactatacacgtgcacacacagaaatgagtgaactctgaagaagctctgtgaatggtaccaatgtcatttcctggttttgatattgttcttcagttatgcagtctctattgagggaaactgggtgatcagtacacgggaccactctgtacattctgtgcacgtgatttcctatgactatagcattatttcaaaataaacaattttaaaaagcaaacctctaaaggcaggttaaactgacaatatgacacacaaatcacctacatttattgttgtggttattccagttgttcttttcatttggctccttgggttaatagcattgatgtggtctgacctgttttagagatgagaaaacaagtttagatatactattggttgcatatgtgaagtcagctgagaggtgatttgaatctggattttctgacactgatttcaataagtatttgatagcttctgacagtgatttaaaaagtggactgtagtttcctgggcttgaagtcagtcttcttcatagtactttctgtatgatttctgcccaaaatactccaacatgggccactaatttactacaaaataaactacaaaatcccacgcacctgcacatacactcacacacttgtcttcatcagattatttatttatttttcaatttttttttttttttttgagactcagtcttgctctgttgcccaggctggagtgcagtggcgtgatctcagctgactgcaacctccacctcccaggttcaagtgattctcctgcctcagcctcccaactagctgggactaaaaacgtccacaattacccccagctacttttttttgtatttttagtacagacagggtttcaccatgttgactgggctggtcacagactcctgatctcatgtgatccacctgccttggcctcccaaagtgctgagattacaggcgtgagccaccgtgcccggctgatcagatttcttttttcttccatcaggatttttgtttcctttcagggcaagaatgcaagtgggagggcgggtgaactctagccagcagtttttctagacaatcgacatgaggaagagaaagcattacagctgctctagtgataagtcaactctgtcaatatagatatatatgtttatgtgtgtgcattctttcttaattataaacatggtcagagcttagacaagagagctgtttccacaaggttatttttcagcccattccaaagtcaatgcccttctgaaagtgtgggcttctgagtgctctgctgttccagacatgtgatcccttgagcagctgatcaaagcacttattttgagaccttatacacagaaatgagaaaataaatctcaaggcaccaaagggcagctacaaagacaatggagccttgtgtgatgaaaatgatagaggaaagaagaaaggaaaaacagcttagtaagagagcaagtacgcctgttggccaaacaccttaccataagtgtattcagaagacagaattattctgtcctgcctccatttgtgaaagagtaagttcactgagaagaataaagttgtttcttattttcctgaaggcgctccaaaaataattccatagtaagtagtttaacacttgagatgttcacaaacctattgaggaaagggctcatttggaagtcagccatacttctctctgccgtggctagcatgcacatgttcagtggctgtctcctctggcacctgctgcagggtcttcccaagtgaggccaaggggatgtggctccacaggccttgtggctcaggtccttgggttctcagtgagcagtacttacttggtcttcctttgatggagaccataaggaagaccttgggtatgctctttgggaaagtgaaaaaaggtcttcaattattcagcctctaagctcacagaacccaggacaatccatgtgatattaagaacaaaaaaagaggggggatggagaaagggaagatgttggtcaaagggcacaaagtatcagtgagatgagagaaataaattttagtgatctattctacagtatggtgactgtagttaacacagcttgagcatccctaatctgaaagtccaaaatgcaaaatgctccaaaatctgaaactttttaagtgcagatatgacattcaaaaggaatgctcattggagcatttcagatttggatttttagattcgggatgccaagccagtaaatataatgcaaatattccaaaagctgaaaaaaatctgaaatccaaaacacttctggttccaaacattttgtttaaggaatacttagcttgtaatcatgtatatttcaaagttgcaaaaagcaaatttttaactgtctcatcacaaaaaaaaaatagatgagatgatggatatgttagctttatttaaggtttctaccatgtatacaaatattaaaacatcacattgtaccccataaatatatgcaattattatgtgtgaattagaaataaaaataaaaaaataaaataaaatagtgtttcatcttgtcataaaaggtacttattatcatcccagagactattcttatatagctaacttggacaatcccttacattaattaagcacctaagataccagctaatgcctttcaaagtaaaaaatgaaatggtgatcaacttaaaagtaaatggcggctagatgtggtggctcacgtctgtagtcccagcgtttgggattacactggcagccttcaccacaccatccactgggctctaatctgagcacctgtacactccacttacaattctgattaagaatctgaacaggaaaaattgaaaaccattctatcaatgaaacaggctagtatctcactgcagtaaggcccgcaggagaggtcataattagaaaactctggtgactataaataaaaaataaagcattctttatatcagaaatggatgcatatatatatacatatatatatatacacacacacacacatccttttaaaaacctctatgtacacatacccgaaagaaagcataatgtgtatttgtgcttttcagatatacattggcttgaaaaaagtcaatgtaatattgcaaagagccagaggtggcattgctgaagaaagagaggcagggaagagtgaaaagggcgatggcacatgatactgattcaccctggaggttttagaaacaattgagacgcccccaagcaaggaaggtggagaagggtctccggtgatcagctggggcaagctcaaaagattatttgctgcagttaatgtggccccattttttttaacctgtaggccatgtccaatgcctccttgactgtctgaaaaatatccagcaatggaactggggttatgtttaaaaaaaaaaaaaaaaaaaaccgcggggggtggggcagaggaagtgggaagtactgaaagggttttcagaagagagatgtggtctttgatttgccttaaaataatccaggggaggaggaaagtaggagtgtaagagataatgcagacttgacaatgtgttcttaattattgaaactgggtgatggacatgagggttcatgaagatagtcactcagattttttgtattttgaaaattaacataatacatttgtttttaagaatcccaaagactagagcttacgatgtacctttaaatttaaataacaaacgaacaaacttttcatattctatttatacaccacaatggaagctgttgtgtatgctgtctagcaaacattcagtaactgcacaaatcatcttgaccttttggggaatattttaaatggcaaaaaatatcccatatgaaaatcaaagaagcatactgcaaaaatcctggctagctttagtatactggtttgtttgtcttttcattgattttacaactctcagattttaaatggttttaatggttacagaaaaatatatctagtatcattaccattgttcaaaagtctcataaaatcatgttggcttccctgctgaaatcaagccagtcttcacaaagccacagaatcactgcaaatgttttagaaaatttacattaaagttttaccctcttgcaagataaagatgtgaataaactatattgggaaactcagggagtgtattagtccattttcatactgctgtgaagaaatacccgagactggttgatatataaagaaaaagaggtttaatggactcacagttccacatggctgaggagccctcacaatcatggtggaaggcaaaggaggagcaaaggcatgtcttacatggtggcaggcaagaaagcgtgtgcagggggactgccctttataaagccgtcggatctcatgagacttattcactatcatgagaacagcatgggaaaaacccacccccactattcagttacctcccaccgggtccctcccatgacatatggggattatgggagctacaattcaagatgagattttggtggggacacagccaaaccatatcggggagtaaacttgtttttctaggttctctagaaaccatttatttccattctatgagaaaaggtgatccaaatcaagcttgtgtcacttaagagtttattttagaaacatctatagaatggttttacagctcctgcatttcaaatgactgaaaaatgaaattttaagatgaagcaaatatgttgaaaggataatagtttaaaccatatagtgacaactggaatatattcaaatattcaagaaagaaacccaaatcacagactacaaaagtaatttgatttgacatcaactatgtaaccaaatatgttttcccataagactatatttggcttatatgatttcgaattctcaacactaaaaattgtaaggatttatattcaagtgatagatcattctaagaacttttattcaaaataagactggaaatgaactaaaatatgcaagacattgtctcaacacgtttttgtaactgtctgttcaaattgcatatgactagaagacaaaaggaaatagcaaggaggcaggaggctagcagcccaggaacctcagaccaggaatctgtggaagatagtttaacaccagcaaactgcctctaatagctgtggctccatgttctcattccaaattcccaggagagaggatctggcccagtatagatgtggtctctgtctcaagatccatcagccctgctgagcgcagtgggtcacacctctaatcccagcactctgggaggccaagacaggtggatcacttgacgtcaggagttcgagcccagcctggccaacatggtgaaaccccatctctactaaaaaatacaaaaattagctgggtgtggtggcacatgcctgtaatcccagctactcaggaggctgaggcaggagaattgcctgaacccaggaggcagaggctacagtgagccaagatcacaccactgcactctagcctgggcaacagagtgagaccctgtctccaaaaaaaaaaaaagatcaatcagccctagctgttctttaggttgtaagacaatcttaaggggttgtccagcacatattttgagtgattgcaactttaaaccaacttatgggattccaaaatcaacgatgacacctgaagtagacagccctgatttagatatttgaggcctggcatttttatatctatcacccacaagctttgtaatcacgcctcagagataattctacacatcttctctgtttatctcctattcccaccaccagacattctgcaaagtatctgtggataagccccacaaaactagagtcagcagaccctcagcccctaggggacacaagctgtgaagttcttgtgtgaccctctgtcctctcttgagtcagcgtgacccagtgtgggtcatcggataaacacccacactaataaatgaatatttttacctgtaagttatcaacaaaatatatagattgtgtgaagttacataaaaatagttgagcaaaatatgaccaaatgaaatgaataaaacattacttgaaagaaatgatcaaagcagttgatactaccaatgtcacactgcatttccgaattctgtaataaatctgctgtctctgcttctgtgagttgtatttaaggctttcatctgtgaccatttgcccagaggatcatgttctgaaggatatatttttgaagttttcatttgaagagaaagtattattaccatcaacatcgtatcaggaggacatgcaattaattttacagacagttttgttgaagaacaagtttgctggattaaaaagtaagcttatgatcagcaaataaaatccaggtactattgcttccttttttctgtttttgccttgtcttaaaaatacctgcacctgattatttttaccaacttattagcatcattaagatctctaagcttcccctttcccagagctgcagttttggagaagccacacatctcccatcatttgttggcccgtggggagtccaagctttgggggggccaaccattgccccacatggattctttgctaccctgaagataagcagagtgaaggtgaggagggtgtgaggaacaggaggcaaaggagggtccctcaggcccctggtcgttagcctggaccaaactagaagttaagagaagtttgcctcccctctctctcacccacccctcaccttggactcttcgccaacatccacagacataccctaggaacctcattctctcattctggcctagtttctccctttaaaaaaagaaacaaaagttcaaattcaaatgcacttagatgtaaatgaattcatacatcactcctgctcatgaaatctacagggaacactcatattagatccacaagaatgaacctgagtagtgtaatttggaccatataaaatctgagcaggtgggagacttggggttcagggctacttccagcccctcctcagaaaccacactccagcgtgatgcaaatcctgctggcttctacttctgatcacagagaaggtgcagcgttccttggttctgtcttcacttcaaaacctcctgctttataaaaaattagctggagggctaggcatggtggctcatccctgtaatgccagcactttaggaggccagtagtttggggccagcctggacaacaaagagagatccagtctccacaagaaaatttaaaaattagctgggtgagtggcacatgcccctaagtcctagctactcaggaggctgaggcatgaggattgcttgagcccaggagttagagactgcagtgagctatgatcatgccactacactccagcctgagtgatggagtgagaccctatctctaaaaagaaaagaaaatctcctccttttctaagttgttttggccaaaagccaggttatagttctgcttggtttatccatcagaaatgggctgggtttttagatacacgaaatcacaaggggagggggaaataatgcctttgggttttaggaaatcgggaaccagagagctcatgacattttcttttcttttcttttcttttgtttttgagatggagtttcgctcttgtttctcaggctggagtacaatggcacgatctcggctcaccgcaacctctgcctcccagttcaagggattctcctgcctcagcctcccgagtagctgggattacaggcatgtgccaccatgcccggctaattttgtatttttagtagagacggggtctctccatgttggtcaggctggtctcaaactccggacctcaggtgatccgcccgcctcggcctcccaaagtgttgggattacaggtgcgagccacagcgcccggccatgacattttcaaattccttctccctgagtcaagattcagagctcattgctcccttcttggaatacagccctccacctcactcccagatgcaataagcattctcaggggcccaagagcagatgggctcttctttgctaatgctttttaaaggcagggagtagaacaatggcaaatggtgacatctggtggaaatccaagcactgcagcacttcgaaccagtgcgacttgaggctcagttgtaactaactgaagtctgagtacttgaagatgtccttttttaccaagtgaaaagctcagtgatatcacccttttggctgacacaggtacaccctgccaccaagcaagatgatgacataaagggcaatgtctttgaaatgccaagaattggtttttgaattcaggtctaagttgtatttcattctctgagtctttgttttatctttttttttttttttttttggcagagtctcactttgccacccaggctggagtgcaatggcgccaactcggctcactgcaacctctgcttccccggttcaagcaattctcctgtctcagcctcccaagtacctgggactacaggctcatgccaccacacccagctaatttgtatgtatttttagtagagacagggtttcaccatgttagccaggatggtctcaatctcctgacctcgtgatctgccttcctcggcctcccaaagtggtgggattacaggcatgacattttatcttctataaaatcaagacaataatacttttcacattcaatttgaatggttgctttgaaaaaatcaaatgagacaaggcatgtaaaaatgctggtaaactataaagacatgggcttttttaaaaaactcagatcatggtggctcacacctgtaatcccagcactttgggaggccaaggcaggtggatcacttgaggtcgatcaggagttcaagaccagcctggccaacatggtgaaaccccgtctctacaaaaatacaaaaaaaaaatcagctgggcatgatggcgggtgcctgtaatcccagctactcgggaggctgaggcaggagaatagcttgaacccaggagttggaggttgcagtgagctgagattgtgccattgcactccagcctggcgatagagcaagactccatgaaaaaaaaaaaaaaaaaaaaactcagatactttgagtttttcttttaaaagcctgcatcggtgagtccagctttccattagccctgtgctgcctcccgggaaccccttggaatcctatgggctgggtttgtagccagtttctcccataatagttgttaatctagttatctccatctgcagatggacctcgtacatagtgggcacagagtaagagcccagttaatattgattggccagttgattagtagatatagaaatgcattatttccctaatttttttccaccatgtggatgaaacaagatttcatctgattaaggtcagagatcatatggtatttcttgatgtcttcaaactgaaattgttaaaatctttcttcagacaaatgtttcatatgccctgaaagaaattaatgacagttaagaattctgaatggcccctaaaatgtttcatatcaaggcagtgccaacctccaacttccccaagaaaacatcccctttaaaatgccaagcaaagcagtctaattcagtcgcgtccaactcaaagaaatcaatgcccgctaacaagttctcccagcagccaggccagaggagggagaaagccttagaacgacagggccccgcatggcctgaacgaggctcacacaaagcctggtttattaggaaccactggaaaagctataaagcccaggcagccttcctgggcctgtcacaaattgtccactttggagagaacaatgtcttccctgttcttgccgtcttgtttgttgattttcaggctccatcagtgtgaaattgagagatccggcccaggtccgtggggacaaatggagtggccctcttgtgtcaggccttctctgaacatccattttaacaaacctcataccttcagggtctactcatgcaattgctgcagcctctatcccacagtttctcgcctctgtaattgagaaagagatgagatgcattgtttagaaatgtaaaaccacatctatcaaaaaacatttttattacaaaagtgttagacataatagcataataaaaccgtatgtgcccattacccagcttcaacaattatcaactccagatcatgacatttcaaagttcattcatttaacagatattcattaagtacatgttatatcccagtactgcttaggtttttttgtgggggttttttgtttgtttgtttgtttttgagacagagtttgccctctcgcccaggctggcatgcagcggtgtgatctcagctcactgcaacctctgcctcctgggctcaagctgttctcatgcctcagcctcctgagtagctgagatgacaggtgtgcaccaccatgcccagctaattttatccatttttagtggagatggggcttctctgttttggccaggctggtcttgaactcctggcctcaagtgatctacctgcctcaatgttccaaagtactggattacaggcatgaaccattgtgcctggccaactgcttagggttttgagacacaggtctgaatattgcaaagtcctgaggctcacagagctcagagcctgatgggaaaacagactatcacaatacagagcatgcaggcaaccccaacgtgagagagcttcctgagggaaatggcatctaagctgagacttgaaggataaataggagaggagattgccctgggagagaagaagaggtaactggagaggggagtgattcaggcagaagcagcagctgacacaaagtcccaggaatgagaatgaacaaggaaattttaggaacggaaggaacatgaatgtatggtgctttgagtaccaaggaataggtgacagaaagatgggtagacagagtacacatcagcaaatcgcagaaggtcttctatgccatgtgaagtcacttgaacttcatcctgcagagaaatgatgagcccctgtgaggctaaaaggaagggaagagaaggacacatttacctctttttttttttttgagtcttgctctgtcacccaggctagagtgcagtggcacaatctcggctcactgcaacctccgcctcccaggttcaagcaattctcctgcctcagcctcccaagtagctgggattacaggaggcacccaccatcacacgcctggctaatttttgtatttttagtagagacggggtttcaccattttggccagactggtcttgaactcctgaccttaggtgatccacctgcctcggcctctcaaagttctgggattacaggcttgagctacttagcccagcctcacatttaccttttagaaagatccctcatctgtaacgtggggaatggagtggggtgggcagaggcgccgtgtaggtgcaaaggctggaactgttaaggaggccactataatttaattaagagagctgggaagtaactgtggggatgttgagaagtgcatgcttggggaggcaggttggctctcgctggggattatgctctgcttcctctgtaaggtggaaggtttggggtttggacgtgtgtgtgtcctaagagagggcattggagactgattacgtatcagagaatgggccccatgctgaacccaaacgtaggctcggctagaagccctagagaccatcttcggcacagatgaggaaactgaggcccaggcgagtacagagatggatccaaagtcacaaaggaaacttgtggtcatgtctccctctcctgacccttcctccatcgctctgtgctttagccaactgtctcccttcatttcaccagtgcctcaggagagcggcagagcctgggaaaacgtgacaactcaaatggtggcagtgtgaaatttatctcttatgccactcaaaaaagagaagttgttttttaaaaaaaatattctgagcaactccatcccctacgtttctcatgctacatttttcatgcctgcatttgcttccaccagctcttgggatttggatgagagggtttttcatttctcatggctactaacatccatcttcaaaaaaccttaggatgaaatatgacagtatgaaccttgttgacttgttttacagactaacaatattctgtactccatggatttaatttatcaaaggtgtctggcattacttgacgcagatcctgctaatatcttcattttggtgtgcactctttactgtgtaaaatgtcaggggcgtctgtcatttctaatgccctgttggtatctaaaacactgtttccaaatcttaggtaaatccaaccattacggaagtagtcttccttccttccttccttccttccttccttccttccttccttcctttctttgtttctttccttctttctttctttccttctttcttttccccaagacagggtctccgatcaccagtgcagtggtgtgatcccagctaactgcagcctaaacctcctaggctcaggtgattctcctatctcagtctcccgggtagctgggactacaggcacacgccaccacacctgtctaatttttttgtattttttgtagagccggggttttgccacattgcccaggctggtctcaaatgcctctgctcaaaagatctgcccacctcagcctcccaaagtgctgagattataggccttgccaaagctgggtcattctttttattatttttgtattattcagagaactaatcaatttactaagtaaagtggagaattagcagccatgtgactaactgagctagtacctacagagttcaagtcagtaattcaacctcctgtgtaggcttggaaatatgggattagtaattagtcattgaattcctatttgctgagggtgagaggatgacaaatttaaattttggtctaagatgatgaatgtggtcaaaagtacttaattactcctagaaactatcataaataggcattgggagaatatgaaccaagaatatcactctcatagattacagtcatcagcatcagttaacaatgactatgtctcctggatatggtgtcaaggagcgtgacagccaggaggtgggtctggggagccagttctactacttactcacgctaacagaaatcatccggcctcactggtctgcagtttactcatcgaatagctgggggcaggagggagtagttattgatataacgtttataggaacattttataaatgtgtatacctcagggtaaaaaaaagtcaatattcttataataaagataagtatacaaaatgtgtttttatagggttctactattctctaggaatagcttcactggtaaatatatatatatatatgtatgtctatattagatatagatatactcactgaatttttaaaattgtaaacctccatgataagaaaatatagcagtttggacaaatgcatttttttttttgagacagagtctccctctgttacccatgttgaagtgcagtggggcgatctcaactcactgcaacttccacctcccaggttcaagcaattattctgcctcagtctcccaagtagctgggattacaggtacgcaccaccacgcctggctaatttctgtatttttagtagagaaggggtttcaccatgttggccaggctggtcttgaactcctgacctcaggtgatctgcccacctcagcctcccaaagtgctgagattataggcatgagccaccgcgcctggaaacaaatacaatttttatagagctggggatcccagaaaaacattctaaaacttcaaaagtgagttttaaatgtttcttttcaattttctgatatcaaatgtaacaattcctgtcctactctttggggatatagaatgctacaagaaaagaagcaggagctttagtttatttcatgtttgtttttctttttagttagctagcaaatataaaaagtggggagaaagcacaggtagatcttggaatcttaggactttggcacatggactctttatattcctgtcatttaaaatgttgtttagttaattcacatttatttattagaacattcaaaattaaaataggggctgggtgcgatggcttacgtctgtaatcccagcattttgataggctgaggtgagcagatcacttgaggtcaggagttcgagaccagcctggccaacatggtgaaaccctgtctctactaaaaacacaaaaattagccgggcatgctggcaggtgcctgtagtcccagctactcgggaggctgaggcaggagaatcgcttgaacctgggatttggaggttgcggcgagccaagatcacgccactacactccagcctaggtgatagcacaagagagactcagtctcaaaacaaacaaacaaaaaaccaaaacaacacaaaattaaaatagcacagctttacagttgtcaggaccggtaggctacacacaccaagagaacatggaaaggtttattgatcacatattgaggccctctgagcagaacagggcaggaccacaagcaggcccaaaattggccaagagagcagagaaaggagcgtggcttggggttcatagtgggactgagtggagggttctcctttgcaatggccaggacttgtgtggtttgaacttcctgcaggtgctgcccaaggagggagcacctgtgcttttgtgtcagcttacccagatgttgggcagatgggggagtaggagtgatggtaactagaagctgccaatggccaaacatttaaaaaaaatggattctgtgtcacagactctttattacaacaatataaagaataaaatatatacagtatagtcagtctccatcccaccttttccaaccaccattctctcacccaaggcaccaaaccactcttcacttttttcagctcctaagctctatgcatccttacagagatagtctatgtatacacagatatgtgtgtacacacacacacacacacacatctcattccctttacaaggaacaaagagttagacaccagctagactagagtttgtttataattcttcaaacctgctctgctattttctagatacgattcattgggcaagttttttcacctttatgagtttctgaagtctttacagtcttctgtaaagtgcatatgagactaatgcctgcatgcatcattatcgtatggaataaataatgcatctttggaacagtattaggaacattatagatggtgtcccttttatcttgtttttcttcaacttcttgagctgcacttcatcagcctcatttgaaatttccccttcctttgttgactttgaaataccaggaattttctaggctttcctccttggtctttttctcatttcacttgactcattctccctggctaagcttggctgtgtcggtggctttgagacagcctgtggactgatgattccactcagctttgtctcctgaggtccacacagaagctgcaaatatatgctaagtgtcgagatataaatgtctagcagcacttcaaaattagcaatataggccaggtgcggtgactcacacctgtaatcccagcactttgggaggctgaggtaggtggttcacgagctcaggagttcaagaccagcctggccaagatggagaaactgtgtctctactaaaactacaaaaattagccaggtgtggcggcaggagcctgtaaccccagctactcaggaggctgagacaggagaattgcttgaagccgggtggcagaggttgcagtgagccaagatcgtgccactgtattccagcctgggtgacagagtgagactccatctcacaaaaaaaaaaaaaaaaaaaaaaaaaaaaagattagcaatatgttttcccctttccccagactcttcttttcctgagttttctatccagcaaatggttccctttcaacctagaaacttggaggtataattcttgaccttgcttttgtcctcatttgaacctccagtcaatcctcaaattttgaccacactactcagaattatcccttgatctgttcatttagttccaacccatttaaaactttcctggatcaagtcacaatcacttctcaaaacattattgcaggccaggcacggtgggttacacctgtaatcccagcactttggtgaaaccctgtctctactaaaaacacaaaaattagctgggcttggtggctggtgtctgtaatcccacctacttaggaagctgaggcaggagaatcgcttgaccctgagaggcagaggttgcagtgagttgagatcatgccactgcactccagcttgggtgacagagtgagagtccatctcaaaaaaaaaataataataataataattacaacagcttgtccctggtctcctttccagtgatgcctgcttctaaataacactagaggacagagagatctttcaaaaacacacacatgattgtgttgacttcctgactaaatgttgtcaagggatacccttttccacctagatatggttcaaactccttaaattgattcagtcttctatctctctgactctccctctgtttcctggtctctagggatcctatccaattccagtagctttaaatacctttgtatgctagtgcttccaaattcacatctcctagactcccacccagacctccctaccctaagctcaagcctcttttacatcaacctgtctgacatctccatttgaatgactcataggcatctcaaaaatctgtctttagcaggattcttgattttcctccctagtcctctcctttcagtaagccattcaactgctcaagtaaaaaaacactaggaattatctttgattccttttttctcagcctgcacttacaatccatctgaagtcctgttaattcaatctttaaaacttctgccaaacctgtccatttatttatgtttttatttacatgacctgtccaagtcatcatcttctttcttattcctacccttgccccctccccaattcactccaatactcagcagccaaagcagtctttaaagatataaactagatgtctctcttgctgaaaaacctctcaatgatttcccattgcttttacaataaaatccaaaatccttaccatgatttggttgcccttattcaggctatatggacccttaataccctcccattcaccacaccatgagagcaggtcatgctctttctcattcatggaatcccaagcatctaggacagtacctcatacacaggagacacacaataaatgtttgttgaaagaatgagtaagtgagtggcttacaagacccttcctcgtctggtttctgtttccgctgttctctttctactcccccatgtcacaatatatgttccatcaaatgctaggagcagaatgagactaggcaatgtctctcttacaagcactttgagtggcagcagcagaaatcaagtgagagaaccccaagagatagctgcaaactcaatgagagaataaagagtaattaactctgccgtccttcctccctgaatggacttcttgggcgcctctcagctcacatcttgagggtttttttttaatttagtaaaatataaacaacataaaattcaccattttaggcatacaattcaatggcactatctatttccagaactcttttatcttcctgatgtagttcagatgttgtctcctctaaatctcatgtggaattgtaatccccagtgttggaggcatgacctggtaggaggcgattgagtcacgagggcaaatccctcgtggctgggtgctgtcctcatgatagtaagtgagttatcaggagatctggttgtttaaaaacatgtagtacttccctcctctactctatttattgctccccctcttgccatgtgacaggcctgctcccacttcgtcatctaccatgaataaaacctcccttagacctctccaaaagctggacaaatgccagtgccatgcttcctgtacagcctgcagaaccatgaaccaattaaattgcttttcttgataaatgacccagtctcaggtatttctttatagcaatgcaagaatggcctgatacacgtctcaaacagaaattatgtatccaccaaacaatcactccccattctcccctcttctcagcctctagtaacctctattctattttctgtctctttgaatttgtctattcttggcacctcatataaatggaatcatacaatatttgtccttttgtgtctgtcatctttcacttaacatcatgtttttaaggttcatctatgtcatagcatatatcagaattccactcctttttatggctgaatgatatttgagtttgtttttaattcatctatccaacaaatattaattgagtagtttatccacccaagcacttttctagattctatggagggagcaataagtgaaagagacaaaattattgcttagttcttacaaataaacaagtgaatatatactatgtcagatggtgacaagtgctatagaaaaaaaactgtattgcagagaggaactgtagaggaagaagagatctcaaaggcagagtggaatcattcacgtagttccttgagaactagagtaaggattttggattttactctgaaatgagaagtcaatagaaagtctggagccgggatgggtgcagtggctcacacctgtaatcccagccctttaggaggccgaggagagtggatcacttgagaacaggagttcaagaccagcctggccaacatgatgaaaccctgtctctactaaaaatacaaaaaattagttgggcgtcatggcacacacctgtaatcccagctactagggaggctgaggcataagaattgcttgaagccaggcggtagaggctgcagtgagcccggtgatccaacaaagcaagactccgtctcagaaaaaagaaaaaagaaagaaagtctgcacctgtagagtgacattttcaaggataactgttttgaaggataactttggcttcggtgttgagatgagactatgacaggaaatatggcaaacggaaggagaaagatcagtgaaaggtgtgcattagtcaaggttccccagagaatcagaagcaataaggggtgtgtgtgtgtgtgtgtgtgtgtgtgtgtgtgtgcgcgcgcgtgtgcttgcgtgcatctgtgtgttacatggggagagatatactttaaggaattggctcatgtaattgtggagggtgtcaagtctgaaatctgtagggcaagccagcaggctggaaattcaagtaagagctgatgttgcagtcttcattctgaagtccacaggacaggacagaacagttggaaactcagtcagcgtttccatgttgcaatcttgaggccaaattccttttgaggtagaatctactccatgcctcttcttagcctctggtggtttgctgtcaatctctggcatttcttgggcagtggatgcatcaacccaatttctgccttacatggcattctctctgtgtgtatatctgtgtcgaaatttcccctttgtataaggacaccagtcatactggaatagggtgtccttcatcttactaattacatctgctgcaatgctatttccaagtaaggtcatattccaaggtactagggactagaattttaatatgtaaattttgggaggtgcaagtcaacctataacacagggtaacagctgtgaatatgaagtagttggatttggccagagaattttaaaaagagagtctgggatactccaatgatgtttttcgcctgaacaaaaatagttaaacttcccatttgctgagctggtgaagactgcaagaggagaaagctcggagaagaataacaagggttcagttttttatgtaataagttttcaaagcaccatctccagcagggcatggtggctcacacctataatcccaccactttgtgaggccaaggtgggaggattacatgaggtcagaagtttgagatcagcctggccaacatggtgaaaccccatctctactaaaaatacaaaaattagctgggcatggtggcacatgcctgtagtcccagctactaaggaggctgaggcaggagaatcgcttgaacccaggaggtggaggttgcagtgagccgagatcacaccactgtactccagcctgggcagcagaataagactctgtcaaaaaaaaaaaaaaaaaaaaaccaaaaaaaccaaaaaaactaaaaaacaccatctcctaccctaagtcccttacttggctagtaatacctatggcgagaacagaggacccagttatctctgcagaagcaaggcagacagagcctttgagtgtttcccttctctagacatacaagtcatctaagtagctctcatttctggcccactccacttccctttccagcccctcctccctcgttatcattgcctccattacacaacatttccttatgacatctccatgtaagccttaggcataaatacattttaaaagttattaaaagaatggaacaagtcagaactgattatgagctgcagaaatattctttttaagagttgtatgttcacaaggaacattaagattctgaaggaaccttaataatagaaacatattatgaagagttgggttcacctcaagttaatattaacctgtgactctaatagccaggatctgttagcttatttatattgccacctttcaatctgcataatttatggtcaatgcagggaaagatttgcctttatagttttcactgtcagctagattcttccatccaagtggaagaattacatttccaaataacagaaagttaaaatgtataatgtgactaaactacagcaaagtggaacttaaaaataaagttcaggagaaaataggtcatttcataaaactaacttcaaattctatttgaactgtgactttaattctaaagagtctcagaaatttttggtacaggagtcatttattctgctatggatatttcctttatgaaatgctgctatttaagcatgaatgaaaaccttccatttgaaatgggcaagacattgttcatacggatttaggctgtggcgattttcgtctgcataaaggcactctggttgctgttcagtagccaacatgattgattagggaagtggtggttcaatcagaataaagtattccccaagtattctggatccctaaggaccagtgcttccaggaatacggtactgatgattccattttgtggctattttttgacagtcctcagactgtcaaatagaatctggcctaaaaggaggacaaggctctctgaagtgcagcccttcgggcagctgaaggtctttctgcagataacttttctcagatcgaattttttggctacattgatactcttcggctctgtccttgccagaagttcggaaggattccagcgccccacaccttgcttgattcaccctcatcccctcccctaactggagaagccgctgggtcccgcgccaggctcgcggtggcttcagagtagcaggggagcaggcggctgatccggaggccagtgtggggccggcaagcggtgactgtctccagaggagcaaaggagccgagtcttgtttttcttggatcaggtttgggacttttattctgtctgaccatttccaccacttgcctcacaagagtctctgtctcgaagcacaggaccgaagcaaaatgcctaatgaagcgtgcctgaggaaggggcaggggcttgcaagtgacttgggaagaaggactggggcgaagggagaaaggaggttacgagttcgcacgttctcacaaaaccatttgaaaacatgagctggagacgccaaattctgggacccacgaaaggctttggagctcgctcgggctcctcgaagttgggcgtgcgtcgcagaacagtgctgggcgctctctttcagcattttcggcttttttcaagcccttgcgtagggtcgggaaggccgtgggtgggctcagtcaggctttaggtcgccaggaacccggctggtcctctctcgacttcttagcgtggggtcccgccggccctgccgcccgtggccgccgaagttcccgccctcgccgagggccctcgctccggagtggggcgcagacgcggccgccggcccgcagtcccccgcaggtgccgcccaggactagctgcccggcggaggccgagcacgcttggcggcagctgagcctccaccccaagccccagccggaggggcgcgtcccctgtcctcctcccgagcgagacgaacgctcagcagctcgttccctgggcgccaagaccgatttccaagtcgcccactttccccctcgagggagctgttggcgcttctccagaagcctcctcggctcccagctccagcccctaaaataaaagcaccttgccagagagcgggggaggggagcagctgaacgaggagaatgaaaatactgggagaacgaccccattctccaggaaaaggtaatgaggggaagtgaaacagtgtgaacttactcggaaatgcaaaccgagttcaactcacccaggagcaaacaaacgacagcaagacaaatcagccaccgcactcgcggcttcccagaaagggcctcatgaatgagaatgggttgctaggtttccttccctctctcctgacaatcgcttcccacaagacttccaccgccgaaagaatacaggccgggcctggtgactgcggagtgagggaaccgcgccaggcccacgaggccgctcgcgaccgctcccgccttcaggaccctggagagcggccgccgcgcccctgggacccacgcccaacccagaacacccgcgctcgcctcccgcgcctcaccaccccagcactttattcgctgcttcccgcctccaccttcattttttttggcaaccaccgctcttgtttttcacagacagattaaattgttttttgtttggcatgagggggtgtttggattggccgagctacattccggtttgtaactacactaaacgttagtgtaccaagaaactaagagcgtctcaaagatgacagtctgaacgtggcaggtgaccttaaaaagccactgagttcaacccctttataaatgaactcaaaaaataaagagacattcccaaggttagccattaagttagtggcaaggttgagtgtagaaccgtgggtttctgacttctaaactagtgcttccctccactttccaaaagaaaaaaaatatctcattgcttaggtctcctaagcaacaagtggaaggtggaaaggccggtgttcccgggaataagaaggacacatggagtttggaaaggaggtctgcagagggttcacttgtagtagcagccctaacatggaatcccggtgtccccagctccacgcaacatacctacagccgcactggccagtccctttttccaaccagcctgtggagggtctgaggcccttcagccaccttcagccactatctggaccttccatagacaacaatcccaatagaatctagtagccaaggccaactctgtgcctctggcaggcagagccctgggcacttagggagatgggaaagggcagggggaacaagggaagaccagagaagggaggggaagagcaacagttacaaaagtgaactaagattttcatccaaattctgaagaaccaggcgatgtgaacacagacccttctgcataccgcatgtcacattcagcgcgcatggtagtcccctgggaatgttaccatgcagattccgatgcattggctgggtggggctcaagagtctttatttctaacaagctcctaggtgttggcgaagctgctggcctacggaccacacttcaagtagcacggagttaggaaatacaggagtgggaggggaaagaatctaactataggcctttccttctgctttcaccgaccttctcttgcacccccaaagtaacgcttcaaaattctgtagtaaagagccccatctaagcggccggacaccacagtaaccgtatgctggttttgtttctctctccccaccccagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccggtgagtaccgtggtctccactacgccccacacccagcctccccaggacaccagcctctcccgattcttcctaaccccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctccagggaactaaccccgcggccccaccgggtcccactcccgaagggacgctgcgggctacggggacacgcggtgctgcgagtccggagagctgggcggctgggttccccctcccgctgccccctggtctactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattcacgaggtccgagcacgcagtccagcacactctagtctcgctcggccccgcgcgccgaggggaggcgatgacacagagggcttcgcggacgccctctacgcgcgcctggcttcgcatccacactcttgggacttgctaatgcggggctggagcagtggggctgcggccggggtggaggtcgcgccccgcgtggggcctcgggggtacccctagcacccgcggcggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgccgggagggggtctataggcgccgcgacctaccccatctccctccacgcttgtgggggagtgagtggggaaggggctttgggagaggcggcgcgcgggcactgaggtgcatcgtgagcttcccggacttgacagcatcaaaggaaaatcctggcgagcagccagggccagcgagcgaccccagcagcagggacgcggccgtgcgagagctcgcggacaggcgagggggatcccaggggagcagctgctgcccacgggccacgggcgatgcacggagtggagaagtgaacgtggtctacaggatttctgtccggaaggtggagagcgctacaggggaatctcctcgattcctgtccgtctcgtaacttggcaaaagctcgcgccactgccctccggcctgggcgacagagcaagactccgtctcaaaaaaaaaaaaaaaaaatggcaaaagcctatcgctctttgtcgaactccccacgttccccagtcacctggctggggttcgttggtgtcaaaaccccagccttggtgccctcggtgccagcaggaccctcgcccactggctagcggaattaggcacctgcacgcgggctcctcattgccccggagtgtggggaggaaggggcttctgcatcagtctccagccaccctccttgggacacaagtggcagggccctggcgtggcttggcttcatttcatccctagtggctccaaaccgtggaattgactaaacaaatgttcaaattcgcaaaacggtctgacttccgccccaaacttgacaaggacatttctagtgaaattactctatctgtaagttttttggcacaaccatagtttgcaatttactatttttgttaaaatattttttctccaaacctaatttttttgggggtctcatcctgtttatcttctgttcgttaagtgacatctttctttcttttttttttttctttgagactgagtttcgctcttgtggcccaggctggagtgcaatggcgcgatctcggctcactgcaacctccgcctcctgggttcaagagattttcctgcctcagcctcccaagtagctggggctgggattacaggcatgcgccaccactcccggctaattttttgtatttttagtggagacggggtttctccatgttggtcaggctggtcttgaactcccggcctcaggtgatccgcctgcctccgcctcccaaagttctgggattacaggagtgagccactgcgcctggccataagtgacatctttcttatcacgtattagtaacgcatatgagaggcagtgttgccaaaccagtgggagtcttgagctctgtaactgggttcagatcccaacctaactgcataaacttggactagttacttatcctctctgggcgttagtttcatcatctgtgaaatgggggtaataagagcacctacctcggcagctcagcagagcacggtggctcactcctgtaatctcagcactttgggaggccgaggcaggtggatcacgtgaggtcaggagttctaggccagcctggccaacatggtgaaaccccatctctactaaaaatacaaaaaattagccgggtgtggttgctggcgcctgtaatcccagttactctgggggctgaggcaggagaattgcttgaactcaggaggcagaggttgcagtgagccgagatggagccactgcactccagcctgggcaacaagagcaaaactccgtctcaaaaaaaaaaaaagagtatctacctaatgtgctagctgacagcattcagtaaattaataacatagagctcttataacgggatggcacataccaagcaaaagctgttattactattattatattgatgctaaattggctagacttcaaactataaataagatcagtaacagaatgcatatttttgtatactataaagagtatgcataatgaaacacatgtccatcatccaaattagaaaaacagtcttttttttttttttttttttttgatgctgggtctcactctctcacccaggctggagtgcagtggcacgactgaggcccactgcacccttgaactcccagattcaaaggatcctcccacctcagcctcaggagtagctgagacttaaggtgcctgccaccgcacctggctaattttttaattttttatagagacaggatctcgctgtgttgccagggctgatgaacagccagtttaagagaatctgaaaatgtaccttaggagcttgaagtgctaacttgtctgagatcactgtaaacgttttagctgaaacaccccttatatcaaaaatacagaatgatgaaaatcaggttacttattctacctccttcgttttacagatgaggaaacattcagagaggttaagggtctgggccagagatctccagctaattaggggccaaaatagaatgaagacttctgactcattccccagggctcttacacaccacactgctgatttcctgtttactacggattaatgaactgttaacagatagaaagtataaataaggaaaaagtgtacgagcatgtgctatctctagcaccaagaaggaccaggcagtcatgtcgtggctactgttgtcccacagctttatcttggtccctcacattataagacatgaccacatgactcgcctcaggtaaggtaaggtcacagatcaagctattgtcagagccagcattagcattttaggccccacttgggtatacatttgattgcatattctattaatctcctgtagcagttttagaaatcatttttgagcttttcttgaattcttaaaatatccttccagctggctttgaaggtctttcctataagaaagccttttagaaaacgccttcaaaattacacagaaggagattttattattctagattttatggactagcgagagtaaaagagaaaagctttcttattttaatgcagtagcctgtaactggtttcattccaggcattaagtattaattcctgaaatcctgctgttcttttatttccgcatgtgggcatctaaccacattcaccttccatggacagatgcagatagtggcttaaaggtccagccctcacatccacagtttaagaattatacagcagaggccgggcgcggtggctcacgcctgtaatcccagcactttgggaggccgaggcgggtggatcacgaggtcaggacatcgagaccatcctggctaatgcggtgaaaccccgtctctactaaaaaatacaaaaaattagctgggcgtattagcgggcgtctgtagtaccagctactcgggaggctgaagcaggagaatggcatgaacctgggaggcggggcttgcagtgacccgagattgcgccactgcactccagtctgggcgacagagggagactccgtctcaaaaaaaaaaatgaattatacggcagagactttctagtgaacatctggtcttacaaagttatttatagggatggtgtgtcttccaggggaggtacttctaggaattatgcctgcatccttgaaaaaggaaaccgtggttttttccagtgtgtgaactggatactgagtatcttactcttttttttttttttttttttttgactccaagaaacctcttgcatgaataccctactcttgaatactttgcatcttgggatacttactacatgttcttagacagaaggacagggcattaagaagggagtgactttctagcatgctcccaagccagtttggcagaacttagttttgaaatcacatgtgtcaagttaggtcccaatatgattataatgtgaatcactgtccaattgggaatatttcagattggttttcagtgcaccaccaggtgactcacaatgtgagcttctattcaaacaagtacagtgtcagtcagcaactaatagggctcactctgagtcagagcttagcatttagtacaataagtgggagtcactgactacacggcaccatctgagatggtccctgaatgttactttgcgcagctagctcaagagttaaggcgacgctgcttggagtgagtcagttcatagtacaattgaatgggctcttggagaggccattcacaatcaagtttgatgtggctgagtgctcagagtaatattacatgattataaattcatggagtagattaccttgattctaatccagctgattagagtctagctatttgcatagggaatcacttgtgaaatatgagtaatatgctctgttgcccagcagtgatattttacatgagttatttcaatagttattaaagccagttgacctttttgattttgaaagctcaatttctagttacgcatttattttattctaaagtgtaaaatccttttcatgtgagcatttgggttttaggcaaaggcatctcatgcaaagttatctgatagcttggcttcctgaggtgctgggttgtacgatgtgcacctccgtccaacagtgaaggagtggagaacgccctgctatctggtttgtctacatttgtgcccctctgaagctgactgaattgtggttgttcaaggctggagcacaagtttgtactgctgctcttagactaaggacactggggactttaacccttttagggctgaatggctagaatcaacacttatacagctgttgaatttttgcaacattggaaagaattatgtaacctactccttacctcacccttataatggacttttatgtctcagggtggggtgataatgtgatttaagggactcgtagatttctttctttctttcttttcatgtcttttattaactaatacacaattacttgtcttctggtttgttgaagcaataaatcagacaacattagccacaataatgcctgtcagagtggctggccataaaaactccagcaccgcattcatctgaagggcactcccagcgaaggccactaattctgccattttcatccaccttatagtatttcaggacacccacttcaccttctttctcttatgcttattcttgggagtcgtgtaagatttcttcctagttttagcactaccatgaagtctcaacacaacataaaaagagtaaattccttttgaatgttgtagtcagagaaagttatgtccatcttccagttacttgccagcttccagtcacttgtctttgctgatcaggaggaattcgttccttatcctggatattggcctttacatttttctgttgtatccaagggttcaacctctagggtgatgatcgtccctgtaaggatttttggaaaaatctgcattttggtggaggctccacctgaggttgagggaaatgaagagatgggttagactgtggacacaagagaggtgacacaggagagggtgctggccagagagcagcccaagagcacacgcccatagatttcttaatttgtataaaagtcatgttgataattaatgacaggaagtcattatccagagaactcagattagactactgttaaaaagtacatgtggccaggcgtggtggctcacgcctgtaattcccacactttaggaggccaagacgggtggatcacttgagcccaggagttccagaccagcctgggcaacatagtgaaaccccgtctctttaaaaaatgcaaaaaattagctgggtgtggtggtgcacacctgtagtcccagctacttgggaggctgaggctggagaatcacctgagcctggggacactgaggttgcagtgggccatgatcttgcctctgccctccagcctgggcaacagagtgagaccctgacttaaaaaaaaaaaaggtatatgtatatttttctctattcatcttttgatgactccagaagaatcttacatgtatggggtcttccattatacattcattgtgtttttacaaatacttatttctagtgactacccagatataattcatatatctcctgccataaagaaaggtatagatatttctttgcatttaagggggactttacatacagagtttaattcttcctgacctactataatccccgcaaatttcagttgttaggactgtttaatgaattagagtatttctaaaactgaaacaaagtttttctgtgtttgttaggtttcagtgaggagctatttggtatttttgtgaggtttatgacagcttttaacttcatttacttgagttataacttacagtaaagtttacacatcttaagagtacagcttagtaaactttatgtaagtgtacccccacagaaccaccatttagatcagggtttctcacctcagcactgtggaaatttggggttgaacaactccttattgaggggggctgtccattgccctgtaggatgtttagcagtatccctgatctccacccactgcatgatgcagtagcgcccctccctggatgccatgaccaaaaatgtctctagacattgccaagcgtcctctggggccaaaatcactcaccacggctctagatgaagatataggatattttcagccccccgtgctctcccaaagattccgtctcgcttccttccattcaggactcactcccacaggtaaccacttttataacttttttcaccatataccaattgtgcctgcttttaaacttcatatgtaattaaacagtgtataatatttgcatctggttctttagctcagcattatgtttttgagattcatttgttgttgtacgtgttgttattttttaatgctgtgcagcgttcctttgtgtgaatacaccacagtgtattccattccactactgaagaaattttagttgtttccagtgtggagctattatgaataatgctaatatgaacattctcattcatgtcttttgatgaacttatttcctttgggtatatgcccaggataaaaattgttgggtaataagtccagtgtatgtttagctttagtagatactgcaaaactgtttcatagtccaaatcagtttacatccatccccaccagcaaagtgtgtattgcttcacatcctcaccagtacttagtattgtttgcccatttaactttagtcattctggtggctgtgtagtggtatctcattatggttttaatttgtatttccctggctactaatgatgttaagcatcttcttatatgtttttgggtcaagtcatttgtatattttctatttaaaatgcctctacaagcctttggcccatttttctttttctttctttctttctctctctctctctttttttttttttttttttttttttttttttttttttttgagacagggtctcactctgttgcccaggctggaaggcagtggcacaattagccgtgaagctgagactataggtgtccaccaccacactcaactaatttttttattttggatattgggaaggggtagagatggggtttcaccatgttgcccaggctggtcttgaacttctgtttggcccatttttctattgtgccgctgatcttttattattgttattattgatctgtcacagttctttatatattctggatacaagccatctgtcaaaattctgtgtgtgtgtgtgtgtgtgtgtgtgtgtgtgtgcacgtgctgcaaatctcttcttccagtctggcctgcctttacactctcattccattatcttttgactttcctagtttctgttggaaagttatgcttctttgaaggtagcctgttgttatcctcataaagtttttctctcatttttgacttaccacagtgaatataatgtgcctatatgtggttttcattttatttattctcctttgggttaactgagcttcttttatctgtggattgacgtctttcatcaactttggaaaattttcactcaatatctcttcaaatatggctttgtctggttttctttctttctctcctgcttctgggacccaaatcacagatatgttggcctttttccttcatgtctcttattgtctgatctgttttgttcatttcgcatatctttctgcttcaatttgaatattttctgttgacctgtgttttagttaattaagctgtcttcctctgtgcctgagtcttctgtcaaatcatctagtgagttattaatttcagaacttgttttcttctaaatgtagtatgccaatttgattcattttaatacatttaaattatctgatgaaatttcccatcttttcatcagtttagtccatctaattcttatctactaaatccaatgagatcatctgtgtgcctgtatccatttttttattcatcacatttttatctctcttcacatatctagtaatttttattatatgtagacattgtatataaagaaactgtgtaggttctggtaatttcttccaccagcaaggattgaatctcccttggagggatttcctgtctaaggatgaaggactgaagggctgatcacttcaggccagcaggtattagaatgggtcagatctggtaacagttttgggggtttttttgttttgacatggaatctccctctgtcacccctagaatggagtacattggcaccattataacctagaattcctgggctcaagcagtcctcccacttcaacctcctgagtagctgggattacaggcacttgccaattcacctgaccattttttacaaatgttttgtagagatggggtctcgctatgttacccagactggtggctgcagttttaataagatttagctaatgcccagttctttcttgttccttgggaattttctcttggattccagaatgaaagcctgatggacttctatctccttggtctcaaaagaatggaagactcagtcttgccttcagaggttttaagtttgttctttgcctccaccttccccatatggccgccacatttgataaatgtcttgtaggacccagccatgtgtttgaggaagtccttgttactgaaggggacttgttctgccacatgagaaaagagtccctttatgtccacagcttgtgctaacggtcagcaaaagccctcaggaaaaaaacagctagtgacagacagctcagcttggaagaactctcttactcagaaattttagtttatataatatttttgctttcacagttctctgatgactttagaaatgtaatttcacttatttatctgagttttttagttgttgcataagaatagtgatttgggccaggcgcagtggctcatgcctttaatcccagcactttgggaggccaaggtgggtggatcacttgaggtcaggatttcgagaccagcctggccaacatagcaaaacctcatctctactaaaaatgcaaaaaaattagccaggtgtggtggcgtgtgcctgtagtcccagctactcaggaggctgaggcaggagaatcgcttgaacccgggaggcagagattgcagtgagccaagatcatgccagtgcactctagcctgggtgacagagcaggattctgtctaaaaaaaaaagtgatctgccttgacctattgacatttttcttgaattaattttctgtgtattacattgttatctttcttttatatcatttgtttccaatgtaattcagaaaatgtgtatttaaaaatttgccatttgtgagtgtaaaatgtaatacatgttttgtcagtttgaaaacactggaaagaaaagaagtatgttataatttttgcaactttttttttttggtcagtcccttcatctaggcagcctaggcccagatttttttttaaattattattattattacactttaagttttagggtacatgtgcacaatgtgcaggttagttacatatgtatacatgtgccatgctggtgtgctgcacccattaactcgtcatttagcattaggtatatctcctaatgctatccctcccctctccccacaccccacaacagtccccggagtgtgatgttccccttcctgtgtccatgtgttctcattgttcagttcccacctatgagtgagaacatgcggtgtttggttttttgtccttgtgatagtttactgagaatgatgatttccagtttcatccatgtccctacaaaggacacgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgattacactgttggtgggactgtaaactagttcaaccattgtggaagtcagtgtggcgattcctcagggatctagaactagaaataccatttgacccagccatcccattattgggtatatacccaaaggactataaatcatgcaactctttatgcttcagattgcagttatgtaatgtaaaaagcatgagtattggaatgaaagagaactaggctcaaactttgactttgatcattagttttgtgagcctctgaatttgaatgtgtatagcagtgataagaatacttgctttaacgtaatacatgtacagcagagggttcaagagagtatcagtaagtggtacctcttgccaatattctcctaatatttatcattattttaagcccctgaccatgtataatttgattttaaacatttatattttgatatatttctatttggtacagtttctaaaattttcaccatttgaacaatgttcttttaaaaaaacttaatataaaagacctgtaccatgacttaatatccaggaaaaatattactaataagtttatgaattcatatttggcctaatctttgtcacttgtagacccccaaaaaatgacctcctgaaactgaagaatttagataaaatttagttgcagaaagaattgcattcagaatagtcactctcagtaaaatccacatttaactacttcgtgttatatcaagtagggcttataataagatattggcaataagaaaacaatattaaaaaatattaagaaaaggctaacagtattttctggaaagaatagctggttgacctttgcagaggaaagtctatgtggagactgtaattttaacattatctccatgaatgatttaaatataattaattttcatattagatttcctgttgccaagttgctcttttattttgactatggcatttgcttcttgaaaaaaaaatactatattaatatatagaaatagttagattctactctaaagctgagatgaaaatagtaaacctggaggcggagtagcaggactctcctgacctgggccaggaggacagcactgatgtgtgtgtccccaaggccttggacttatctcagtctcacctgtcatctcactcttattatctcagcctttagttccttactttgatgacagccagcttcagtgacagccggctttgctctctgacctccgtattctgaggactgctctccttaccatttgtgggcagatttaagtcaaagcataagagtgaggggatctagttatgcaacaacctgaaatttatcaaattctcactagagctaagtttttgccaaacacataagttgccttcggccccttgagtgactggttaggcagtgctgttcttttggcaaaatgaaatacttattaacaaaaacaccagaacatcataaccagaccacatagaataaatttggcttaaaggatgaaagagtactaagaagtataaaaaggataaaattatgcaaaatctagtaaagcgaaaaactcacccgagcatgttaaacaaatgtcataaactaaacaaaaggctttatttcttttctttatcttctagtgatctgtgttcaaaatcataaaggcatttatgaaaagtataaatactaacttaggtagataaaacatttgttaaaatctatcaagtctggtctgataattaggaggctacatatagcttatattttcttaattgaaacaggtcccctatgtgccattttacccaatacgttagtatggaggtttttgtcctgggtctctgtgtccaactgccttgttttgtcttactgaaaggttataaatgctatggttccctgcgaagagtccaaagcgcataaccactgaacatttcaagtctgaaatttcttcaattttagatctgtttgttcaacatatctactatttgacacttcacaccaagggggagggagatctaaaattcagtagatattttggtgcaaactgtagaaaactaaaacctcgaggagcagagattctcccatgcacatcctaggaactgcagacaaaaacattctgtcagcttagcccagagaactgtcttgggaatgctaaggccctgtgggacaacgtaatgccctggagtttctattagcccactcgaatcaacagcagaccttctgggaaaaggactccagaagacttcactgatgggcctacacaaataatccaaatccatcgaatgtggcccatgtgcagctgtggtatgaggggcacagttctgtggggtgacagatgcatccatgccttgaaccacatgatctagattcaagtctgtttggggctgactgaatgtcaggcacattaggcaacctccctgaagctgagttttccctattaataaatgggatctcaaaatctccacaaaatcatttcacatattaaatgtaagatgtgatacatttgctcatgtaaacataggggaaaattgtgcaatatttagaccctgatagagtttggattttttctagtgtcaggatttgccattgaagcccacaggaggggactaacaggatctggattctattttaaaagagttagtaaatattttaggcttgtgggtcattgcaattactcacctctgctactgtagcagaaagctgtgcggggagagggaaggaggtggatatgggacttatcgtagccatcgagacaagagatggggccgccagcctaggagaagtagcggggatgcagtgcaggcctggcgtgagtcctggagatgcagtgagcttgctaatgagtgatgcatgaggaatcaaggtgacttcttgatgtaggtggatggtggcaacatgtgtggccatggagaagacaggaggtgaaacagaggggctggaggaggagatgcaagattccatgttagaccctagagatgtccaggagagctccaactgtggtgccaggcagctggttggatctgtgtgtatggcacccagggaatggcctgggctagaggcagaaatgtggattcgttaggctctgatgatgtgcagcctgctgtactgtggtacgctaaatgatcatgaagttatggtgggaagccttgaaaataatcagtaggatcttactactttagaatctgcgcttccttttctcaattatccataaacagtctatgaagaatttctgtttatgacaggggtcagcaaacaaggcacagggccacctccagccctctgcctgcttttgtatgccctgaacactaataatagtttttctttttattccttttttttttttttgagacagggtcttgttctgttgcccaggctggagtgcagtggcgggatctcggctcactgcaacctctgcctcccaggttcaagcagttctcttgccttagcctcttgagtagctgggactacaggcacccggaaccatgcctggctaatttccttgtatttttagtagaaatagggtttcaccatgttggtcagagttgtttcaaactcctgacctcaaatgatctgcccgcctcggcctcccaaagtgctgggtttacaggcatgagccaccacgcccagccaagaatggtttttacattttttaattgttgggagaaaaagtgagaagaataaggccagacatgatggctcatgcctgtaatcccagcactttgggaggccaaagcgagagaatctcttgaggttgggagtttgaaaccagcctgggcaacaaagcaagaccctgcctctgcaaaaagtaaaaaattagccaagtgtggtggcatgagccttagtccctgctactcaggaggctgatgcaggaggatcacttgagcccaggaggttgaggctgcagtgggccatggattgcaccactgcactccaacctgtgtgacagagtgagatgctgtcccccccaaaaaaagaagaatattttgtgacacatgaaaattttacagaattcagatttcagcattcataaagatttattggagcacagccatgctcatttgtttgatgtttgagctgcctttgtgatatagaggcagaattgagtagttgcagacagaccaggaggcctgcaaagtgtgcaatatgtatgctctggtccctcactgaaaacatttgtctacctctggactatagcataaatataagtgtggggtattactaagtttttgtaggaaacaatctgtatgaaagtaaatacgaagttcaagcaatgacagttttaattcttatagaatagtctactctttaaaaaaatttcaaaagacagaccagaaaaccaattaaaggcaatctcctataggaaataaaatcaaaggacccaacttaagattcctttgggtatgcactatttcaacattcagcattttcatattaacaggaaaacttagtagcaattaacaagccccaaaaggactaatgaagaaggaccacagggaaataatatgcacaaaggttttgtggctgagagagctcagatggctttcagagatttcaaattacttacagcttgaaagctttaaatagaataggagcttgctatttcataccattatcatagaagaatcatcccaggataaaaaattctaataatggacaaaagacaaagtttgaggagccaatgctactgtccacgggggatcatagagaattttctatgggcaaaagtggaatttgtgaaaaaagaaatgtagagggaaaatttgcccagacattcctgtaagaagtagagaaagctagttagtcacttataaacacatcttttgtacatttttatccttaatttgcatgtacgttgacacattccataacccatctgctgtaattgatggagaggaacttcttcagcaaatattcatccaggcctaatgtctgttaagatttgtgcccagcacaagcagactgggctagggctgccctggcagactggaccagactagaggtggattcctgcagcactgggtaaggccctgctctcacttgtggtcaaacttggatgccctgtccataagagtttccttagttccagctaataatttaggggcaatggtaggaagcatcagtagaaatgttattcattaaagacagttcaaataaaaatgaatgttacttttaaggaacttatcttttactaagcatactttataatatccatatagtaaccacaatacatttgtcatacccaacaaaattaacagtaagcaattcacatcatctaatgtgtaaccatagtacattctttcttattagcctctttactaatcttcctcatcatccatcttctttttcatacgccaacttgaagaaattggacctgctgccccgtcgattgtcccacattgaattcatttgctgctttctcaagttgctaacttgttcctgtattccctaaatttctgcaaactagaggttagactcaaaggctcaaataaattcctgttgcatcacatcagagggacacaatgtctgcaaaattggctcgcttttagttatggaaaggacattatttctaaaagcttggtaggtcagtccaaattatacagagcggctgataggtccaaggcatgtggggcacacactgcaaaggcaacaggtgctactcttactacagctgccttctgcttgctgaaagagcttgagtgtccactccgggccatactttgggagctctgttcctcagcagggctggaatgcctccttgatggctgtggggctggatcccacccgctcgccttgcaccaccaggagctgctgctctgcctccccctggctataattccctgcctgacttgaggagtggtggtgatgatgatgatgatgatgaggttgtgtttcccttctgcactgttaatttggagaatgttccaggtgaggaaaatgcatcaccttcagaggataccagatgttacccagaccactgtcctggtattgagggtactcagagtgtacctagaagtaggtgtggccattagggagcacagaaggagtgttaccctttttcttttgggaggctgtgttccttccaccacatcagaaccaaagaagaaactggcctcctcctaatgctccattgccttcaccattacttccatataataaccttgtggcactttaacagaagtgtggatttgtggaggatttaaattcatatcaaatgtcaattcacattttttagggttatattgaagcatgcataacacatgatatcctgtgggctctagattacttagatttcaaaaccagagatagaaatgaaatatgtatgagattgaatacagtaagggcttatgtggcattaattgcacatatttattgttttctctattaaataaaagctgaactgtaattagttaagccagatgcatttctgtttttccagatgcactgtgggaacccacttttccacctggtgaatgttgaaaagactataaatacaataattctctaggccaaggagcactgcaggtgcttttaaccaaggaaagagtttgcatttctgatctttgtactgacgtatgcctatgaaagaaaacactgaaatgctatgtaacgtgactggcatgttcatttgcatttcacactgtagcatgatggtcagggaaactattttcatggcacattattgttcaaatacatattaaaatttctgctgttaggaactttatgttcccagctgtgatgtgttaacagcatttccttcagaagtcaggcagctggcccccacactaactacaatgctgtgcgatgctcctgtgtctgtcctcctggcaccacaatgcctgtgtgccatgtttgtcaccagcatgctacatgtgctatgtccactgccttttgtctctctattctctttattgggtattttttccttccttttctcaggtgtctcaggtttaagtcacagaatcatgactttatggaacagaaaggggaacgacttagccaacagcagcccagagcaggcagctgacttatgtcaggcgaacaagttagtgacagaacagaactcacaacctgcatttctgtactttttggtactcaatccactatgctgcctttaaggtaaattaaaataccagcatttaaaaactgttttatgacatccattcatagagatgtgtaaccatcactgcaattcattttagaatattttcatcactccaagaagagacccagcaccccttagccgtcaaccaccaagtcccttcctccagcagccccaggcagccactgagctactttctgtttccacagatttgcctgttccgaacattttatatagatgggttcatatgatacgtggccttttctagctggcttctctcactcagcatcctgtttgcacagttcagccatgtagtggtaggtaaccatggcatgtcagaaagagaagaaaaacttggtggtcattttgcctccagttcagaagacaaaaccaaggcctagggaggtggcttcaggctctagtcacaaagcccagcaggggaagagtgaggatccagctagacccctcaccactcaccgccctcagcagacctcctggtgcttccctgacctgcgtgcaaaggtgctctgcttggtgaactggcagatttacatgcctgccctctagtttttctgttctcagctttgcccagctatttttgtcaccgcttgcgtgtccttgaaggcattctgggttacttctagatttgtgaatggttgaggtgccagatgtctgagggtgggtaaatggggtccctgctatttcagtccctgctgaatatagacacaaaggtacaggaccaatttgtttacagtctttttttcccctaggttagaatgcagtggtgcaatcatagctcactgcagccttaaacccctgggctcaaacgatcctcccacctcagcctcctgaataggtggaactacaggtgtgtgccaccatgcctggctgatttttaaattttttttagagacggggtctcactatgttgcccaggctggtctcaaactcctggacttaagccatccacctgcctcagcctcccaaagtgctgagattacagttgtgagccactgtacccagccttgtttacaatcttaaaacacctataaggtctttctatattactcatcgtatttttacattaaatatcaatgtttatatagcaagaaatgtaaacaaaaaataaaatatcaataagtactaaatttaaagaaataaggcaccagagtagcacctagttttcagagacctttcacatacattctctcatttaatcctcttaacaaatctcaaggcagctaatgttatacacatgaggacgtggaggcttaggaaggtgaagtaatttggtccaggcctcacaagtggcaaaggtcaggatggcagggctcctctgactggacaccctatgctctcctcccgctattgcaccagactgctggacattcctggcccagttctctgttttaagcgagtgttctctagggaccagctgtgggccagaaggtcagcacagcactcagaggactcctccaagtaaacccaatattcccactcggccctctgaccccagtcacggcagggctgttcacgtcctgacctggctccatgggacactcctccacacccctcacagcatcccactgtactctctcgacctcggtctaccaacagcaacatgccctggccttcatacttgtctctttttttttttttttttttgagatggagtcttgctctatcacccaggctggagtgcagtggcgcaatcaatctcagctcactacaacctccgccttgcaagttcaagtgattctcctgcttcagcctcccgagtagctgggactacagatgcccgtcaccacgcccggctaatttttgtatttttagtagagatggggtttcaccatgttggtcaggctggtctcgagctcctgacctcaagtgatccacccgccttggcctcccaaagtgttaggattacaggcgtgaaccaccgcgcccagcctatacttgtctcttaatgtctctttctgtttcatctctcactgggatctggctagtctttgagaacattgccttccctatggccctggtagttagagacatttccccacagaaattctgccacttcagggcttagaagtaaggtaggtgtctctgctgtctattgccacttctaaaacattccttctctgaaaaaccgcacctcttaaattctgacacatgctacaaagatggttgaaccttcaggacattatgctgaaggaaataagccagacacaaaaggacagatactatatgatttcacttatatgaggtacttagagtagtcaaaattatggagacagagctggcacgcacctgtagtccgagctacttgggaggctgaggcaggagaattgctccaacccaggggtttgaggctgcagtggtatgatcatgcctccaaatagccactgcactccactgtgggcaacagagtgagaccctgtcccttaaaaaaggaaaacattatagagatagaatagaatgcagaatggcagttgccaacatcattggtgagattaatccacttattgaggtagttggagattgttcattctcatcgctgaataatatcccattatataaacacattcacttatccattctactttttatttttttttctttgagtcagggtctcgctctgtcacccaggctgaagtacagtgatgcgacctggactcaccacaacctctgcctcctggacccaaggaattctcccacctaagcctcctgagtagctgggactaggcgcatgtcaccacatccagctaatttttgcttctttttgtagagacagggttttgccatgttgcccaggccggtctcaactccacccgctgtgtcctcccaaagtgctgggattacaggcatgagccactgtgcctagccccattctactattgatgaacatttgaatagtttttgactattatgtgtagaacatcctaatgcatacttttggtgcaacgttctcagggagtatataccaaggcctggaatggctgggtcagagggtgtgtatggggtcagccaaaacacattctgtgagtgttcctaactggttacaccaatttacactcccatcagcggtgcgggagagttctggttgctctctatccttcctctctatctttctcatcacttggcatttccttcattattttagctgctcttttgtgtggggatgtgcatgccattccctgtctatgcatagttgcaatatttgcactggctcattacactgaccaataggttatggatactgctgtgaaaatgaagaaaaagataagcttttaaatgtaaaaacaaaatgattggttctttttttttttggagacggagtctccctctgtcgcccaggctagagtgcagtggcacgatctcggctcacagcaacctctgcctcccggattcaagtaattctcctgcctcagcttcccgagtagctgggattacaggccctcgccaccatgctcggttaatttctgtatttttagtagagacaggatttcgccatgatggccaggctgggctcgaacttctgacctcgggggatctgcccacctcgacctcccaaagtgctgggatcacaggtgtgagccacccgtgcccagcccaaaatgattgattcttatatttttgacagagagatcagatggatcagttcatactctggcagttaattttatttcctctaaataaaaatggacaggttaatttattaagcagctgtgttatcaatatggtacgtgtgtgtgcttgtatagatagatgtatatgtacatacataactatacatttttctggacacataatattttaggtgcctattgtatgctagacactgttctaccatcagtaaaaaagcactgccctgttttactgttgattaaaaacaaaattctgaaaatagtgaacaatgaggcttacaacatttgttacaggataagaaatctcaatttagaaaaatgttgtcaactttgactaacctggaatgctcgttacacagtcctgaaattaattttgatcctaatctggctatagctgcaccccagccagccaccttccacagcagttaggtccctgacaggagacggcacccaggaagccacaaagagcaaactggtttctgcccaggatctctgccagctctgcagccttggtgatgtcacttacacagctcagcactctccatgcttcttcccagcctgagccaagcagcatcagggaacttgttcttctgtcccttggccttgcctaccccacctttcacaatgaaaggtatttcccaagaaaagcacactcaccctaaagccaggtccctccctaccaagtctcagcactagatgctgcttcagaaggagaagcagagcagaaagaccatagagggaagaagggtatttgcggtcttcttacagctcctaccagaattttaccttttatccaaggtgagaatggaggcagagtgagtggctgggagacctccaccattatccagacctgagatgttaactagggccatatcacgtggagaagaacagggcagatgtgagaggcatgctgggagacagattgcctttgcctttgccaggagttaggattgggaggagttgaggatgatgagttttcttgaacaactggagagatagtaacactgcttaccaagagagaaaaaacaagaaggggtagctttgtctggggagataataactttgcttttttttttttttttaaccaagtctcactctgtcacccaggctggagtgtagtggtgtgatctctgctcactgcaacctccgcatcccaggttcaagtgattctcctgcctcaccctcccaagtagctgaagtagctgggattacaggtgcctgccaccacacttggctaatttttatatttttagtagagatgggatttcgccatgttggccaggctggtctcgaactcctgacctcaagtgatccttctgccttggcctcccaaagtgctaggattacaggcgtgagccaccacacctggccacaactttgatttttgacattaatttttctatgatgtaagtgatttggctgtttttttctataatttgcaataactacgcagaaattctcattagggagcctgctccttgctgggaaacagtaaatagctggccattctcatgcaaaccattaatgatggcctcatatattcctcagccatttgaagagtccctaaagcagccccacagacaaagattttcccaagtgtttaatactttcagaggtgccctgggccaagttatcactgggaatgcaccccagctgcaattttcttgagaatgccactatttcctgggataagcaaagctcttaataaagatttcaatcagtacttacaaaatggtccttcgttgttggctgacattaggaaagaacaaataaaaacatacataatttatttatttccttcatatcatactctcttctttctaatacttcccaaaaggccattgtaaaagttgagttatataggatgttcatttagtaatggcagaagagaagagaaagacactcttattatagtcttaaagccttcactggcttaaaacctcctggggcttacacatttggcaacggctatataaacaaaagtgtaaagatttccatgataagtcactgaaaaacagatggtaagatgcttaagtggttttttaaaagatgaggacatctgtaagcatccatctggaagtaattataattcaaaagtcttttgttactattaagcttccagttgacttcccctactagaaaacaatggaccagctttttcttaaaatagacaataaaacccaaatagtcagacaataaaaccaaaagacagaaatttttgaaaacccatagatttgcctggaagcaaagtttagaatttccacaaaaatccaccagctactaaactgttggctttctgtatcaaacatagtggaaatagagctttgatttgattttttggtctatttgtgctgaagtcagtgcaagtaattctagctcttcattaatatttcatgagccacagtgagatggacttttgtctggtgatgactatactgcaggataatgggccagcgtcctctcaaacttagaatcgcctcatctcagcatcctactaaacagaacatcactgttgaccagcattcagcttacgtctcggctgctaatagtaacagggcctgtttgtgacttcagcagcatctggtgacccggtgttactcttgcagtacgtgattcagagaaagccacattcccctgttgctattttcaggtaggcagctaaacccagggagagtttagcatggattcagcaggtctgtttttctaacttcattgtgtaaattcttgaatgagaatctagcgagcagccaaaaaaagacttcctgtgaactcatcttccttgaagccaaacatcttcagaaactgtttccttcaggttctggaagcctagagcccttcaaatgagatttgtccctctccccaacacactttatgcctcctgtccccagccaaatggcttttccatccttttcctcctcccgttcattcgacttccagttctgtctgaagtcagaggcatgcatggggctgagaggggcctgggtcacagggtccccctcctccacccacaagtgaacatccaactttaagaccaagtatttaagaccagaggatcctacaaaaaactcactcaggccaggcgcggtggttcatgcttgtaatcccagcattttgggaggctgaggcgggcggatcacgacctcgtccctactaaaaatacaaaaaattagccgagcatggtggcacgtgcctacagtcctagctatttgggaggctaaagcaggagaatcacttgaacccgggaggtggaggttgcagtgagccgagacagcacccctgcactccagcctgggtgacagagcaagactccatctcaaaaaaagaaaaaaaaacaactcactcaaccctctgctactttgctatcgagtggccccctaagtgtgctggcaaatgtggtatctgtgaaaaatcatcctccatccaaggcaaaatagtattagagaaagatttcccaggcaggggaaacctagaaggcaggacgacctagaggagggtaaaattaggagtaaattgaaacacgttgtgttaaatactcagaaacattactgcagagaacaaggaaatgagagtgtctcttgaggctgcagtacaggaggatattcctggaatatcgcagtgcttttcatgcacctgggaaccacagtcagtgggagctcagaaaacagtgaaattgaaatgaatgaggctcatgaggaaaggagttttgttcttaatgtggaacagcaacaaagacccaatcgtttgaacaggcttaaaaaagtactgggagagatatgtatagggcacaactgagggactaaggtaaaatcatagcatcccagtgcaatgcaaggggaaggcttacagctgagagttaggagggagactcccttgtttgtgtccatctgctatagttggtatattggggattaccaaagctgtaaaatccccagacatagctctctggcttcacgttccaccccattttaatgtcattagtcatttcttcaatgtgaaagcagaaagaaatgtcccatcaattaactctgtagcatatcgtaacaaaaatctgggagaagcaatggagctaagtggccgggtggcttggtatcagagctgccttcacactggtcccattcttccttatctcagataacaaagcatgcagattcctcctgcttgtgaaccacattttttttctgaagcatttgatgttttctatgtcttgttagccttcctgtatctattaagatttaaagaatcttggctgggcgcggtggctcacgcctgtaataccagcactttgagaggccgaggtgggcagatcacgagatcaggagttcaagaccagcctggccaacatggtgaaatctgtctctactgaaaatataaacattagcttggcatggtggcacgagcctgtaatcccagctactcaggaggctgaggcaggagaattgcttgaacccaggaggctgaggttgcagtgagccaagattgccccattgcactctagctctgggtgacagagcaagactccatctcaggaaaaaaaaaaagatttaaagaatctttccaaaatatttaaagagtaagagagacgctcttggggatgaggagtggcggggcaggtaatgattctcctgggaggccagaggccaggctaacaggctcctgcatctcatggcttcttaggatcccagaaaatgaatggcaagcttacactttgcattttagaggggtaggaaatgaggggccaaaagatttaaccaggatacagattaagtttaaaggtcattaccggctaccgtgtctaagggtgaggtttgggattcctgcctttgtgtcattgtgcagccatcagaggtaggaggtacggtcaccctgaccctgaaatactcacaatgccagcccagaaaaaatccatctagaagtgcattctgcagggtagagtctcgggttcaatgaagttgtgaggcaggtgatgaaaggtcaaagctgcctgacgcattcatgatgcttgacagagagcgctcaatctgaagatcattgacagtgaaactattgaaaacggcatatgcatatggaacaaaaagatggaaaacgttgggagatgggataatgggtgattaactcttagaaatgttctttatagaacattgaaagcaaaaaataaaggcaggcacatgcagacaaggcagctatggaaaggaagtcatgaaagttagaagcaatagttggaataaagcaatagataatggagatacagaaaagtaaaacactggacttgccgagctactaaaacttatacagactgctgctgggagcggtgattcatgcctggaatcctagcactttgggagcccaagctgagttgattacttgagcccaggagtttgagaccagcctgggccacatggtgaaaccctgcctctattcataatacaaaaattagccaggcatagtggcaggtgcctgtaatcccagctactcgggaggctgaggcaggataatctcttcaacctgggaggcagaagttgcagtgagctgagatcatgccattgcactccagcctgggcaacaagagtgaaactccatctcaaaaaaaaaaaaattagctgggtgcagtggctcacacctgtggtcccagctactcaggaggctgaggtgggaggatcacctgaggcccaggaggcggaggtagcagtgagctataattgcaccaccacactccagcctgggtgacagggtgagaccctgtctcaagataaataaataaataaacaaactatcatatcaacacagaaagttataaagcagcattcaaaatcatatatatactcttgtaatcatgtaaataatttttgtgaacaaagggaaggaaatgcaaaataaaatttaaaatattggcatgatggatttatggcatgttattctttttaaaaatatacttggtaacagttgttgagcatttaataattccaggcactatgtgaggattttacatgaattatcatatttattcctcccagcaaccccatgagccagatactattattttcctgatttgacacagagaagttggggtgacctgcctgtggtcatacaggtagtggtggtactgggtccatttgattctgagtactctattatccattatggtatgtgtgtatatatatatatatatatatatatatatatatatatatatatatactttttttttttgagacagggtcttactctgtcacccaggctggagagcagtggtgttatctcaattcactgtggcctctgccttccaggctccagcaatcctccagcctcagcctcccaaatagctgggactataggcccgcaccaccatatatggctaatttgttgttgttgttgttgagacagggtttccctatattacccaggctggtctcaaactcctaggctgaagtgatccgcccatggccttggtctcccaaagtgctgggattacagctgtgggccaccacacccagccccttatgctattttttttaaaggctgttattataatagtgtacaggtagatatttaaatgcatgcttatattaaaaatttggagatatattaatgttcctatggcagaatgatatcatagtcctggtacttgatattggaggtttcttgcttctggtagagaagtaacattatagaaagtagcaatacagtgggaaggaattgttgtgtgaataatgatgaaccatttctgagaatggattaaatgtgtatgatacacttgtctttgacaacttttgactgatgtggaaggacagaggtgatggaaactctaatgaggaaggaaaatgtctgctgggtgtgtattctctctctttccttctagagtcctttgtatctagagtgtctgagactggggaaatgaaggtgaccagtagatagttgaagagagcagggacaaatgccttcctgggctgggttcatacattttattaaattccctgttacattatcaaacagaaagggtaaagatgcattgagtcatgaggtaaaacacagagggatacattattagttctttaatcattcatcacatatgtattaaacacctttacataaaacagaatcaatcaaagcactattaggaacatgaagaaagccatgtagccagcaaaagtatagatgccctggtaccagcaagagcacaaagctggtatttgaggggctcttgcttcaggctatgggccaaaaaaaattaccaagaccctccaccaaggaagaggtacccatagcagataatacatgaaaagatgttcaacattatcagtcaagagggaaatgcaaattaaacccaccatgagctgccacttacgcctattaaaatcgccaggaaaaaaaaaatctgacaatgtcagctactgacaaggatgtggaacaattgaaactctcattcattgctggtgggaacagaaaaaagatacagctcctttgaaagacaagttggcatgttcttagaaagcgaataaacatgcacttactatgtgacccagtgagtatttacccaagaaaaatgaaaacatacacccacacaaaaatctctgcacaaatgtttatagaagctttattcataagcacccaaaacaggaaataacacaaatgtccatcagtaggtgcctggacagacagttataaccatataattgagtactactcagcagtaaacaagaatgaactactgatacacacgaccaggtgaatctcaaaagcattacgctaagtgaaagaagcccagactccaaacaatgcataccatatgatttaatttgtatgatattttggaaaaggaaaaactatcatatcaatctacaaagtaataatatacctaaacatgttaaaatcatacaggccacattttctgatcaaaatgtaaagaaacatacaaactagtcaggctagtcaagaaattaaaaataaactttaaaaaggctgtggataaaaaatctgagctgcaattagatctgaggtatttggaggtgaactattagatctgagctatttggaaataaaaatagtgctatctagcaaaactcagtggatatgatcaaagcagtaactggataaaaatttgtacttttaaacccacttattaaaaaccagcagtgactgaaagtaaatgaactaaaactttagtgtgagaggccaggagaaaagtaagccattttttaaaaagtagatgaagaataatgaaaataaaagcagaaattaatgaaatttacagttaacagaaagcaaaattgatccataaaacctaaagccaattctttggaaacagaactacagactaacctttggcaaatctgattcagataagaggatagaaaagcccaaaccatcagaaatgagttacggtgcataactggatcaagacttttttacacaaaaaccaaataacatgtacaagtttaatgccaacgtatttgaaaatcttaggtaagatagatacttttctgaaaaaatataaatttaaaatatagtcatatggtagtagaagatcctaaactacgtagaaaaaatcgaaaaggtgttatgagatttgtccctaagaaaggcatcaggccctggccaggcacggtggctcattgcctgtaatcccagcactttgggagcctgaggtgggtggatcacttgaggtcaggggttcgagatcagcctggccaacataacatggtgaaaccccatctctactaaaaatacaaaaaaattagctggtcatggtggtgtgtgccggtaatcccagctactcgggagactgaggcatgagaatcgcttgaacccgggaggtgaaagtcgcaattagccgagattgggccacttaactccagcttgggtgatggagtgagattctgtgtcaaaaaatacataaaaataaaaagatggaacatttccaactttgttttaaaaggcagaaaaataaggatatttaaactggacaaagatggccaaaaaaaggaaaattcatgaagggagatcctattcataataggaacataaatcacaagactgcaaattcctatgcataggaataaccacatagcaaacatttattgagtgctatgtgttgcaagcacatttgaagtgcttcaccagtatcgcctcatttaatcttcacctccaggatactcagtatcccagttctattgatgaaggaaccaagactcaaaaagatggaataacttctctaagctcatacagctaatcaacaatggagttgagatttaagccaatttcccccagtcctcacaatggatacagttaatcttgatttttttttttttttttgccaattttgtaggtaaaaatatcaaaaaaagatacctggttttaatttgcatctctttgttttgcatgatttcctgccacataaattttaatatttattcttgaatcacatttaacttcaattttgcatcttcagtatttatgaaatctttcattagttacattcctcaaatgaattcatcccactggattccagctactgttcatctgtctattctgatacttcattgagaataccaatatttttctaaatttacttttgataaaactgaacattttttcataggtgattttatttgtgtatatatacatatgtagtgtgcatgtgtatgtttgtatatgtgatttcttcatccatgattttttaatttattagtgagtaaaatgttttaaaagaaaaacttatccttaaactattaggttaccctgaagtataatttttataggaaaagtaggataaaaacttgattctttccccttatttatcagttttcaaaattgttccctatcactgtctaaaagtagtcagtaagtttttttagtatcattatgaattcatagttttacacatattttatgtgtttcaatgcactgcaattgatttttttttttttgaggcagagtcttgctctgttgcccaggctggagtgcagtggtgcaaactcagctcactgcaaactccgactcctgggttcaagcaattctcctgcctcggcctcccaagtagctgggattacaggcacctgccaccacgcctggctaatttttgtatttttggtagagatggggtttctccatgttagtcaggctagtatcaaactcctgacctcaggtgatccacccgcctcaggctccaaagtgctgggattacagacatgagccaccatgcccagcctaaaaataatattaataaattatcacactggttagtcaactcagctgtagattaaaatgtccagtcatctaatgcacttgacagttcgggacagaagcattaaagtggcttcacaggagatcctattcctcactccacgttggacattgttatgggttgaattgtgtccccccagaatatatgttgaagttctaaccatgatacctgtgaatatcaccttatttggaaacagggtctttgcatgcaccaccacatctggctaatcaagtgaagatgaggccaaactggatgaaggcgggcctgaaatccaacgactggtgaccttataaggagggagagcttcaaagacccaggcagtcatagagggaagaagggcaagtggcaaagaagacagagattgggtttctgttgccaccgaggctgccagaagaggcaaggaagaatcctcccctagagccttcagaggcagatgcctggccctgctgacggtttggttttgaacttttagcctccagaactgtgcaagaataaatttctgttgttttaagccatcgggtttgtggtaatttgttatggcagctctaggaaactaatccagatgttaaagtttattcttacatagaaattgaggtttctaataaaaggtgtgtggacgtggctacttcgatcacttactgagctctggcaccatgacttctggccttggctatattttccttttcctttctttttttcctcttccttcttttcttttctcttttttccaatctctctttttttttttgaaacagggtcccgctctgtcagccaagctggagtgcagtggcaccgtcatggctcactgcagcctcaaacttctgggctaaagtgatcctcctgcctcagcctactgagtaactagtactataggcatgcatcaccacatctggctaatttttaaatatttgtagagatagaggtcatgcaatgttgcctgggctggtcttgaactcctggcctcaagtgatcctcccaccttggcctcccaaggagctgggattacaggcccttcttagttctttgatgccaatccaattttaggttcttaaccttggtactttgggtccactgtggattccccattctctccttctttctcttcctatttttgatcttatcccttacagatctcccttcatgtccctgcccccaaactgtaatttgtgatatttgctgtcaccttttatccattcttgtgcactagataatcttagtttctttatgtagttcactaatttaacaagccagactgaactgagtgtaaacaggcagtgaatttcttctcctatcaccacgttcaaacagtatcggttttcccctcctctcccctcaactctatctcatgcagattctatagcttttcaagtcaatgtcagtattagaacagtctcattttcaggcgttaaaaaatttcagtgctcacttcagcagcacatatactaaaattggaacaatacagagaaattagcatggcccctgcgcgaggatgacatgcaaattcatgaagcattccataaaaagaaaaaaaaagaaaaaaaatttttttaatgtttagtccctgccaggcacggtggctcatgcctgtaatcccagcacttctgggaggccaaggcggtggatcacctgaggtcaggagtttgaggccatcctggccaacatggtgaaactctgtatctactaaaactacaaaaattagctgggtgtggtgatgcacgcctgtaatcccagttacttgagaggctgaggcaggaggatcacttgaacctgggaggcgaggttgcagtgagccgagatcgcgccactgcacttccagcctgggcaacggagtgtggctctgtctcaaaaaaaaaaaaaaagttcagtccccttgaaatcaaactttagtgccctccatttcagtttcccctcacccagctttggcctctccagaggttgcgcagaccaacagtggcaggggagaggaggatagcccttccagttcctctctgctttctctcctttccgagctctgctgccttggatgcagcactgctgaagacagaggtggtattggtcaatgggagttcagaccagtttttcttctacagggatctcccggagttcagaccagtctttcttctacagggatctccccactcctgcctgacctcttcagctttggtcccagtcatacagctctggggttctcctccccagtccaacagttttgcacaggatctttcaagaagattcaagcttggccaccttccatgtctcccatggaaaaactcacccatgcatgcagctgggtcgcttccctttttcctagacctggctgttccaaccaggccctcccattgagtctcaggcagtccggagggaagctgcagtctctgtacttctcatgctttgccaggttctccccaggagtcttctgaatcatctgaggacaaggacagggctggtgcccgagtttctttcttttttaaaaatgtgtttagaattggagtctcgctatgttgtcgaggctggtcttgaactcctggcctcaatcaagcctctcaggcaggtgtggttataggcatgaaccaccccacctgacatatttactgacatattttaccatattttatcgaattctagattcactattgtttcttgtattccatacttccccttggggtctacttttcttggtaaaatatgctttaataattttctttgcaagagtctgtgagagatcagcaaatattcatccgaggacagggtctcactctgttgcccaagctaactgcggtggtatgaccacagctcactgcagtctccacctcctgggctcaagggatcctcccacctcaacctcctaaggagctgggactacaggcatgtaccacaaagtccggctaattttttatttttcgtagagacaaggtttcactgtgttgcccagggtggtcttgaactcctgacctccagtgatctgcctgcctcagcctcccaaagtgctgggattacaggcatgagccactgagcccagcctaagacccatttttgcagacagtacttaattaaatttactgacatattttatcaaattctagatttactattgtttcttgaattccatacttccccttgggatctatttttcttggtaaaatatgctttaataatttttttgcaacggtctgtgagagataagctctctgagtcttatctcagaggaagatattatctgttttcttctgggatctgttgttgctgaagagaagtatggttgttggcctaattgtcattcttttgtaggaaacttttgtaggaagcttcttatctgtcaattcctgatgttttaaagtttaccatggtatttctagtagtggatttttgtttatttgtcctgctttgtaaagagagagactttctgagtgtctagtcaattcatgttgctataacagaattccataggccgggtggctcaaacgaccaaatttgtttctcacagttctggaggctgggaagtccaagatcaaggcactggcagataggtgtctggtgagggctgcttcctggttgccagaaaccaggaactgtcttctcaccgcaccctcacagggtagataaagagggagagagctctgtgaagcctctttcataaggacacgaatccctttcataaaggccccattctcatgacctaatcactccctagggccccacttccaaatatcatcaccttggggcttcaattaatgaattttgtggtagacataaacattcagtctgtagcactgaggatttgtgtttttttcagttctggaaattctcagaacacctactttctttttgtttggttggttttttgttttgttttgttttgtttttgagatggaatttcactcttgttgcccaggctggagtgcagtggtgcgatctcagctcattgcaacgtctgcctcccaggttcaagtgattctcctgcctcagcctcctgagtagctgggattacaggcacatgccaccacacctggctaattttttgtattttcagtagagacagggtttcaccatgttggccaggctggtctggaactcctgacctcaggtgatccgcctgcctcagcctcccaaagtgcagggattataggcatgagccaccatgcccggcctcctactttctttttaactgttattttcccatcattatctccattttccttatattaaactcctgttaaatgtacattgaaactggtaactctacactcccttactcttttacctttaaacagcattgagataaaatttacacaccataaagtttactcatttaaagagcacaggccaggcacagtgtttcatacctgttgtcccagcactttgggaagccaaggtaggaggatcacttgagcccaggagttggagactgcagtgagctactatcacaccactgcactccagtctgggcgacagagactgactctgtctcagtcaatcataatcagtagtttttagtatacttacaaagttgtgcagccatcatcataatctaattttaggacattttcatcaaaagaaaccttgtacccattagtagtcattctccgttctctctccctgctcccaaccctaggcaaccactattctactttctgtctctctagacatacctgttctgggcatttcatgtacaagtattatacaacatgtggacttcggggtcttgattccttcaattaacagaatgtttttaagacttagtcatgccatagcatgtatgagtcctgcattccttttataaaattgtcatataaatcatacaccgtaaggctcaccattttacaatatacagttcagtagttcttagcacagtcacaaagttgtgcaacaatcaccactaattcctgaatattttcataattctgaaaagaaatcccacacccactagcagtcactcattccccttaccccatcccctggcaaccactaatttacttccagtctctatggatttgcctagtctgaaaatttcttataaatggaatcatacattatgtagccttttgtgtctgccttcgttcacttcacttcacatattttctttttttttctttcttcctttttttgagacggagctttgctcttgttgcccgggccgaagtacaatggtgcaatctcagcttgctgcaacctctgcctcccgggttcaagcagttctcttgcctcagcctctgagtagctgggactacaggtgcccaccaccacacccagctaattttttgtatttttagtagagatgggtttcactatgttggtcaggctggtctcgaactcctgacctcaaatgatccacctgcctcagcttcccaaagtgctaggattacaggcatgagccaccgtgcccagccttcacttaacatattttcaaggctcatccatgttgtagcaggatccagtacttcattccttttcatagctaaataaatattgcctcgtatggacatatcatattttgtttatccatcagttgatagatatttgtgtttttccactttgtgaccattatgtataatgtttacaacaataaacaaacagcatttgtttacaagtttttgtgtggacatgtgttttcagttttctgggcatatataggactagaattgctgggtcatttggaaacttcatgtttaacattttgaggacctgtcaaactgttttccaaagtggccaacccattttacattctcacatgtagcatatgaggattctaatttcttcacatcctaacactaattgtctacttttattttacccatcctagtaggaataaaatagtatttcattgtggtagagattttatttccctaatgactgattatgttaatcatcttttcatgtgtatattggccatttgaaatatctagtcaaatcctttctccatttttaaattgggttttctctcctttttcttaagttgcaagagttctttatacatcctggatacaagtctcttacctaatatgtgacttccatatattttttcccactctgtgggttgtcttttcactttttttttttttttgagacagtcttgctctgtcaccccgtctggagtgcaatggcacaatctcggctcactgcaacctccgcctcccaggttcaagagattctcctgcctcagcctcctgagtagctgggattacaggcacgtgccactaggctctgcttatttttgtatattttttttgtagagacagggtttcaccatgttgatcatgctggtctggtgtcgtttgaagcataacattttttcttttttttttttttttgagacagtcttgccctgttgcccaggctggaatgcagtggtgcgatcttggcttactgcagcctcaacttctgggcaggaggatcacctgagcccaggtgttatgttgtccagcctgggcaacatagcaagaccctatctctaaaaagaaaacaaaacaggcatctgggattttgatagggattgcattgaatctgtacattaacttgaggaatgttgccatcctaacagcattgtcttatattttataaatatgggatatctttccacttacttagattttttgtttgtttgtttgtttgtttttgcccaggctggagcacagtggtgtgatcttggctcactgcagcctcaacttctgggctatgtgatcctcccacttcagcttcctgagtagctgggactacaggcgcacaccaccatgcctagctaattttttgtacttttagtagagaaggtgtttcaccctgttgcctaggctgatcttaaactcctgggctcaagtgatccacccacctcagcctcccaaagtgctggaattatagatgtgagccatcatgcccagacctatttagatattctttactttcaacaatcgttttgtggtttccagtgtataaatcttataattcttttattaaatttatttctaattattttattcttttgatactatattggaattattttcttatatcacttccagaatgttcactgctagtgtacagaaatacaattgatttttctttgttaatattgtatcctgcaactttgctgaactcatttattagttctaattgttttttttgtttgtttttagtggaattcttaggatttttaaataagcaagatcatgtcatttgcaaatagagatatagagatagttttacttccttttcaatttgaatgccttttatttatttttcttgccttactgccgaggctggagttccaatgtagtatgaatagaagtggtaaaagtagattttttttcttatttctgatcttagagagaaagccatcagtctttcagtgtttaatatgatcttagatataggtgtgttataggtgactttggtcaggtttaggaagcttccttatatgccaattttgctgaatattatttatcatgaaatgcattagattttgtcaaataattttttttttgagacgggcagtctcactctgttgcccgggctggagtgcagtggtgcaatttcagctcactgcaacctccagttcctgggctcaagcgattctcctgcctcagcctcctgagtagctgggattacaggcacatgccatcacgcctggctaatttttgtattttttagtagagatagggtttcaccatgttggccagactggtcttgaactcctgacctcaggtgatccacccacctcggcctcccaaagtgctgggataacaggtgtgagccactgtgcctgacaaaataatcttgctctgtctattatgatttttgtccattattttattggtatggctattatgtttattttttatgttaaactaaccttgcattcttacattaaattctacttagtcatggcatataatcctttttttacatgttgctagattccgtttgctagtattttaagatttttgcaactgtattcataaaagatgattatggtgtctttatttggttttggtatcagagtaatactggtctcagagaataagttgggaagtattcactccccttccattttttggaacagtttttgaagaactggtagtccttctttactaaatgtttggtagaattcaccggtgaaaccaacttgatctgagctgagctgagcttttctttttttttttttttttaaatacaccagcctgaacagatctgggctttcctttgtaggattttttaaaataactaaccaatctctttacttgttaaagttccatttagattttttcttctttagttaattttgttagtttatgactttccaggattttttccatttcatctaagttttctaattagttggcatacagttgttcacagtattccattatcgttctttttatttctgtaagatcagtagtaatttcccatctttcattcctgattttggtaatttgagtcttcatttttcttcatcaactagctaaggtttgtcaattttgttgatcttttcaaataactaacttttggtttcatgaattttctcttttgtatttttctatttctattttctattccattgtgtttggaaaacatactttgtattataataatgattttaaatctgttgaggctgttttacggcctattatatggtctattctggagaattttcatgtgtatttgagaagaatatgtattccactgatgcaggtggagtgctctatagatgtctgttaggtgtagttagtttatagtgtcctgatgtcctctattcatatgcttgttgatcttctatctagttgttctgtccattattgaaagcaaggtattgaactttattactgttatcattgaattgtcggtttttcccttcaattctgttagtttttgctgtatgtatttttgtggttctgttattgggtgtatatatatttataattgttgtatcttcctgagacgttagctcttttatcattataaaatgtccctattaatctctagtaacattttgtgtttaatagtattttatttgctattattagagccattccagctctctatggttgctgttgccagatatatatttttccatccttttactttctatctatttgcatttttgaatctaaagtatgtctcttgtagacagcatatagttggattatgtttgtaatcattctggcaatctctatcttttgattggattgtttaatctgcacacttttcacattgtcattgatccatttagatttacctttgtgtttttcttttcactttctatatatttcatgactactctgttctcttttcctcccttattaacttcctttgttttatgttgatattttctagtgtaccattttactttagttattttttcactgtatgtgtatattttttaatttttaatctttctttgagacagggtgtcactttgtcacacaggctggagtgcagtggtgcaatcatagctcgaactcctgggctcaacagtcctcctgcctcagcctcccaagtagctaggactacatgtgtgcaccctcatgccagctaattttttaaattttttgtagagatggggtttcactatgttgtccaggctggtcttgaactcctggtctcaagtgagcctccttccttgacctcccaaagtgctgggattacaggcatgagaaaatgtgcctggccctgaggtaatttcttcatggcctctataatgcttataataccttaatgtatcagaatcaactttagatgtatactaccttaattctagtaagatatagaaacttttctcttatatgtagctcctttctctccctactgttttgtggctactactgctgtacatattaaggtgtatatgtattacaaatccaataacatattgttataattactgctttatataatcctcccaaagtgctgggattacaggcgtgagccaccgaacctggccaatcctatgtcttttaaagaagctaagaaaagaaacaagagcagaaatatacgtatagagtttcttctttaaaaaatattaggcctggcctggtggctcacatttgttatcctagcactttgggaggccaaggaaggcaggctgcttgaactcaagagtttgagaccagcctgggcaacatactgagaccccgtctttacaaaaaatatataaattagcctggcatggtggtgtgtgccagtagtcccagctacttggggagctgaggcaggaggatcacttgagcccgggaggcaaaggttgcagtgagccaaaatcacgccactgaactccagcctgggcgacagagtgagactctgtctcaaaaaaaaaaaaatttccagagactttaaatgattgttttttaataactcactagttatatgattatattttgctggagagagggtctacgtccctcacgtagccattcgggaaccaaactgcagatgatgcgctgcgtctttttatctcttagtctttctgaacattctaaattagtccttcagtactattttctaatatccttgcaactttctacttgattctttttcgtgactacctgttcttattttatttctatttgttttagtttcctattttttgacattttaaatgtaaatgatttcttcattattatttgagcatcgcaacttttatttttcattttcttctgcaacattaaattcatatttcagtgggtgattttaatgactgcctttcttcatatgttttggaattttagtttgcaaatactttttttttttgagagtgtcttgctgtgttgcccaggccggagtgcaatggaatgattatagttcactgcagccttgacctcctgggctcaagcattcctccaacctctgcctcctgagtagctaggactacagacgtgtgccatcagacccagctaatttttttattttttatttttttttgagacagagtcttgctctgtcacccaggctgaagtgcagtggtgtatgttggctcacagcaacctccgcctcccgggttcaagagattctcctgcctcagcctcccagatagctgggattacaggtgcaccaccacgcccggctaatttttgtatttttagtacagacggggtttcaccatgttggccaggctggtcttgaactcctgacctcaagtgatctaccccccttggcctcccaaagtgctaggattacaggcgtgagccaccgtgcctggactagttttttaatttttttgtagagatggggcttactatgttgctcaggctggtcttaaactcctggcctcaagcaatcctcctacctctgcctcccaaagcactgggataacaggcatgagccaccatgcccagctgcaagttcattttaaagcaattgtttcattcttttttgttgttgatcttttttctgtcctccttagtttttacttatctccatctagaaacattaagatttccttcactgatcatctgggcaacctactaagagccagatgttatgatgacaattcagaatttctgcccaagtgatattgtgaatatggcagatttcagaaccagcagttccagctcattccagaccatagagatgtctatatgctcccatattccacatctagcctcagcagaggtcagctacagttggtgttttttataagcttccatcataaggaagaggagattcttctcaacttttaaagcactgactgtagctccaactccacatttaacctggagcaattttagtcccttttagcttctggactgatgttgcctctgcccattacttggacctacagccaagcaggcccactgcttgcactctgcccattgatttacactgccattgcgtttctggttggaggtatatttatcttggttttgaactcaactacatgtttttagacttttcttatctgtcattgcttttgcttggaacagaatcagtgatcaaagtgagatcattgccccagcttgcctagagtcccaatcccatcctgaatttgcagtcagccatttcaggctgtagtctttagcttctctgtaacattcacaatagctttttggatggaagtgatgggtggaatggatcagcaagacacagaaaccaggagtaaaaaaaaaatatgaaccagagtttgggtagggtaatggtgaggcctgtggcagggttcccagcagggcaagattctgtgcaggaaaacaaagttagaagttaaaactaggtggctggatgtggtggctcatgcctgtaatcccagcattttgggaggccaaggtgggcggatcacctcaggtcaggagtaaaaatacaaaattagctgggcatggtggcacatgcctgtaatcccagctactcaggaggctgaggcaggagaatcacttgaatccgggaggtggaggtgccggtgagctgagatcgtgccattgcactttagcctgggcaacaagagcgaaactcagtctcaaaaaaaaaagaagttaaaacgaagtaagatattcaaggtcagtgtctaaagcagggaacagctagtactaaggaataatctagtagcactgtgttctgacaaagatgttactaacggaggccctgtgggagccatgatctacccagccatactgcccaaagaaaaaatacttcaagagccaaggtttattaaagcaaaagtaggccgggctcagtggctcacacttgtaatctcagcacttcggaaggctgaggcaggagcatcacttgagcccaggagtttgagacatagtgagatcccacctctatgaaaaaaaattgttaattagctgggtatggtggcacacacctgtggttcctgctacttgggagacttggacaggaggattgcttgaactcaggaggttgaagctgcagtgagccgtgttcacaccactgtactgcagcctgggcaacagagtgagatcctgtctcaaaaaacaaaaaagaaaatggatttgggatttgagtctcctccaggagaatgtgtcctctcaaattttcttatattattgtctaactctttcaaggccctaaactatcccctgatggtaggatcctgcttcttagggtctttgaagaaggctttgaatttatgtatttttggattcttggttctccttcatcagaagcttatctatgattctatatctttctggaacaggaacttgagtcttaggccttaagagataagagattttttttaaacacaatacttggtgtttcatcgtattctcaatatgtaattcaataatcgctatcttcaggatttgggaactacagtgaaaataaataactattaaaggaatctggctaccaagtgtgtttaccagaaaataagaaagaacttctctgggttggacatggtggctcacacatctaatcccagcactttgggaggctgaaacaggcggatcacttgaggtcaggaattcgacaccagcctggccaatatggtgaaaccccatctctactaaaaatacaaaaattagccaggtgtggtggtgggcgcctgtaatcccagctgctctgggaggctgaggcaggagaatcgcttgaacccaagaggcggaggttacagtgagccgagatcacaccactgcactccagcctgggtgacagagcaagactccatctcaaaaaaagaaagaaagaaagaacctctctgagataattagttaggttaaaacttttttaaaaactagttactggtttcaattccaaaatactaaaagattgtgatcaaaattaagagtttgccttggcttttagttgaattttgaaaggcctcttagatgttgagttcctaggaatttggaaaagccttgtttgaggattgtctcttgactgagatctgaaatgtttaataagctatcaacctgtattattcccatttcctcaggatgctctttttgttttttggggcgtttttttttttttttttgagacaaggtctcactcagtcacccaggctagaggcagtggcagaatcacagctcactgcagcctcaacctcctgggctcaaacgatcttctcaccttagccccccaaccaagtaactgggactacaggcgcgcgccaccatacccagctaattttcatatttttgtgtagagatggggtttctccatgttgcccaggctggtctcaaactcctgagctcaagcgatccacccgcctcatcctcctaaagtgctgggattacaggcatgaggcaccatgtccagccctcaggctgcttttgaaatcccacacatgttagcatatgaggatgctaacaatgatttcacattcttctaagttctgagccctaggaccatcaggtgaaggcagccagtacctgggggatgatgtgtgtgacttacatggtcatcccaaaggacagtaaaatgatgcccagcattctctgccaaacagactaaaaaaggagagaagagcactgtcaaaaggcattgattccatgttatttagaaaggacaaatggaaatgatatgtgcatagagttctcccacagatatgatgaaggcaaaggagaagatgtatgaagctggtttggctaattagatcctataccgatgtctgaaaagactagtggaattaacatatacattgatggcatatttttacaatcttgtaaataggtagcatttatatcagtggtataataaaagaataattatcttttagacctgagaagagtttgcttagtaaggtaagggtgactcaacatcaagaaatgcattaattcacttcattaactattcaaaggaggaaattgatatgctcacctaaatagattttttttaatctaaaagaattcaacattttaaaaactttattaaggaaatttccaaccacacaaatatgtagagaggatagtataacaaaccctgtgtgttagtcaacttcaataattatcaaatcaacattggcttctttttaatattcatgttttattaacacttttagttcccctcaggctcttgcatttctccacagacatttatggtataaatgatcactcccaccaccaaacactccaacatttagcaaggaagtgaaagccattcccattaatttagaatttttttgtacatagagatgagagattgttagtaaacttttccaggaatagcatgtatttctgtacacttacttatcgaatctttaaatgatttaaaatgtcaaaattatagttcagtaaacatgaatacagtcttaataacagtctcttctaatttagtctgataaaagactttcatgctcaccagggcgcggtggcttacatgtggaatcccaacactttgggaggctgaggcaggaagatcacctgaggtcaggagttcgagaccagcctgaccaaaatggagaaaccccatctctactgaaaatacaaaattagccgggcgtggtggtgcatgcctgtaatcctagctactcgggaggctgaggcaggagaattgcttgaacctgggaggcagaggttgcggtaagctgagatcacaccattgcactccagcctgggcaacaagagtaaaactccgtctcaaaaaaaaaaaaagattttcatgttcgaaagaagacaatgtcttatatatctaaacttttcagcaaccatcaaaaaggtctaagtccatcaacaggtgaatggataaacaaatagtagtacatccatacagtggaatcctgctcaggaataacaaggaatgacttattgatatatgcaacaatctcaaaacaatcatgctacgcaaaggaaaccagaccacaataaaagatgttgtatggttccctttatataaaaatcaagaaatgcaaattaatggatatagagagaaagcagatcagtcagcacccaaggcagaggcataagagggaaggaacaaaagagaaattctcaagaagcagggttttgagaaaacttttgagggtgaggatgtgttcaccatcttgattgtgatgatggcttcccaggtatacatatgaaaacttatcaaattatataccttaaacatgtgcagtttattggatgtctgttagacctcaataaagctgtttttaaaaatgtatacaattccagagctctccagtctcaaaaatttttttaaaaatgtataagaacaggccaggcgcagtggctgatgcctgtaatcccagcactttgggaggctgaggcgggtggataacctaaggtcaggagttcaaaatcagcctgactcccatctctactaaaaatacaaaaattagctggacatggtggcggacgcctgtaattccagctactcgggaggctgaagcaagagaattgcttgaacccaaaaggtggaggttgcagtgagccaagatcgcaccattgcactccagcctgggtgacaagagcaaaactacatatcaaaaaaaatgtttaataacagactttgatagaagttacctttgacttctaatggctatatttggtcctaagaaaccttatgatgttctctaagagttagctcactcagtcattaaaattcttccagacatttacaaacagataggtgtgtataaacaaatcaaatatgttagcttatgacatagggctagagagttaaaattaaaattttttttaatgttaataagttagcacagcttattttataccatgtaaatagtgaaagaaagcctgcttaacttgaaatgttatcttccagaaacctccaacacatagcatacatgtcagcaaaacactgtctgctcattaaagaaagtcttgaggaagacaaaggtgcctagtactattgctacttctcaatatttactcaacttcctggccaatgaaataagaccagggtaagaacagataccttaaaaaggtacaggaagcaaagagactagtgtgatcatgtagagacagtatgatcatctaattaaagaatgaacagaaaaattactggaactgtaagagaattcaatatagtattcttagccttcctatatgctaaaatatctacttagaaaacacagttgggtactaggggaagatatcatttatgacagcagcaaaaatcagcctacaaaatattcaggagtaaacctatcaaaaatgtgcaagacctgtttgaagagacccttaccccacatgtaagagaggatttaagtgaatagatatttcatggactgattgggaagacccagtgtggccaagatgttggaacaggactcccctgagaccttgggacagcaccatgtcacagtccttcctacttctggaaattaattaggatatggttttgttttttgttttttgttttttgacagagtctcactgttgccgaggctggagtgcagtggcacgatctcagttcactgcaacctctgcctccggggttcaagtgattctcctgcctcagcctcccaagtagctgagattacaagtgtgtgccaccacactcagctaattttttttgtagttttggcagagacagggttttaccatgttggccgggctggtctcgaactcctgacctcaagtgatctgcctgcctcggcctcccaaggaatatgtttttttaatgaggcaagttgcatcaacatctcataggaaataatagttacctggagcatcttttgttcaaaacatcttggtttggagattgtgctggcttgtcctgaggcctcagtgcccgaattgagtgaatgaagtgaaaccatggttaggctatctcctccacaggtgaggtgaagacgtgatccctggagtcacttgagcctagagtttctgccttcgaagctgtctccctgtggtacccataaagcatgactgtggctgaccgtgtgtctctgcctccaccttttggctaagtgagccacaccaactcagtaaccccagcagagcactgtgggtggtctctgggtatgttgggagcattgttttcacagtggatgaaagaagaaaaaaacagtaaagccctttgatgggtctttcttgtggtcctgaaacttacatgcaagactaattaaggccaggtgcagtggctcacgcctgtaatcccagcactttgagaggccaaggtgggcagatcatgaggtcaggagtttgcgaccagcttggccaacatggtgaaaccccatctctactaaaaatacaaaaattagctgggcgtggtggtgggcacctgtaatcccagctactcaggaggctgaggcaggaaaattgtttgaaactgagaggcagaggttgcagtgagccaagataatgccattgcagtccagcctgggcaacaagagcaaaactccaaaacaacaacaacaacaacaacaacaacaacaacaacaacaaacaacctgtggctggcaaactggctgaataggaacagctccggtctgtagctcccaatgagatcaatgcagaaggtgggtgacttctgcatttccaactgaggtatctggctaatctcattgggactggttagacagttgggtgcagcccacggagggtgagcagaagcagtgtggggtgtcgcctcacccaggaagtgcaaggtgtcagggaactccctcccctagccaagggaagccatgagaaactgtgccataagggacagagcactccgacccagacagtactcttttcccacagtctttgcaacctacagaccaaaagatttcctctgatgcctacaccactagggccctggtggtgacaaaatctctcagcacttgcctgtctgtaaaggatttcatttcttctttgcttatgaagcatagtttggctggatataaaattctgggtggaaaattcttttctttaagaatgttgaatatcggaccccactctcttctggcttgtagggtttctgcagagagatgtgctgttagtctgatgggcttccctttgtgggtaacccgacctttctctctggctgcccttaacacaaaactgggtggccatttgggcagacaccgagctagctgcagaagtgtttttcataccccagtttcacctggaatgccagcgagacagaaccgttcacacccctgaaaagggggctgaagccagggagccatggtctagctcagtggatcccacccccacggaacccagcaagctaagatccaatggcttgaaatccttgctgccagcacagaagtctaaagttgacctgggatgcttaagcttgatagggggaggggcgtccaccattaatgaggcttgagtaggcggttttcccctcacacagtgtaaacaaagccaccaggaagttcgaactaggaggagcacactgcagcttagcaaagtcgctgtagccagactgtatctctagattccttctctctggatagggcatctctgaaagaaaggcagcagccccagtcaggggcttatagataaaactctcatctccctgggacaaagcacctgggggaaggggcagctatgggagcagctccagcagacttactgcctggcggctgtgaagagagcagcagatctcccagcacagtgcttgagctctgctaagggacagactgcctcctcaggtgggtccctgacccctgtgcctcctgactgggagacacctcccagcaggggtcgacagacacctcatacaggagcgctccaactggcctctggtgggtgcccctctgggatgaagcttccagaggaaggaacaggcagctgttctgcagcctttgctagtgataccctggcaaacagggtctggcatggacctccagcaaactccagcagacctgcagcagaggggcctgttagaaggaaagctaacaaacgaaaggaatagcatcaacatcaacaaaaaggacgtccacacagaaaccccatccaaagatcaccaacatcaaaaaccaaaggtagataaatccatgaagatgaggaaaaaccagtgcaaaaaggctgaaaattgcaaaaaccagaatgtctcttctactccaaaggatcacaactcgttgccagcaagggaacaaaactggacagagaatgagtttgacgcattgacagaaggaggcttcagaaggtaggtaataaactcctctgagctaaaggagcatgttctaacccaatgaaaggaagctaagaaccttgaaaaaagattagaggaattgctatctagaataaccattttagagaagaatataaatgacctgatgtagctgaaaaacacagcacaagaacttcctgaagcatacacaagtatcaatagccgaattgatcaagtggaagaaaggatatcagagattgaagatcaacttaatgaaataaagtgtgaagacaagattagagaaaaatgaatgaaaaggaatgaacaaagcctccaagaaatatgggactatgagaaagaccaaatctacatttgattggtgtacctgaaagtgacggggagaatggaaccaagttggaaaacactcttcaggatattatctgggagaacttccccaacctagcaagagaggccaacgttcaaactcaggaaatacagagaacaccacgaagatattcctcgtagagagcaacccaagactcataatcatcagattcaccaaggttgaaatgaaggaaaaaatgttaagggcagccagagagaaaggtcgggttacccacaaagggaagcccatcagactaacagcacatctctctgcagaaaccctacaagccagaagagagtggggtccaatattcaacattcttaaagaaaagaattttcaacccagaattttatatccagccaaactatgcttcataagcaaaggagaaatgaaatcctttacagacaagcaaatgctgagagattttgtcaccaccaggcctgccctacaagagctcctgaaggacgtactacacacggaaaggaaaaaccggcatcagccactacaaaaatgtaccaaattgtaaagaccatcaacactatgaagaaactgcatcaactaatgggcaaaataaccagctagcatcataatgacaggatcaaattcacacataacaatattaagcttaaatgtaaacaggctaaatgccccaattaaaagatgcagactggcagattggctaaaggtcaagacccaacagtgtgctgtatttaggagacccatctcacgtgcagagacacacatagactcaaaataaaggcatggaggaatatttacaagcaaatggaaagcaaaaagaagcaagcgttgcaatcctagtctctgataaaacagactttaaaccaacaatgatcaaaaaagacaaagaagggcatcattacataatggtaaagggatcaacacaacaagaagagataactatcctaaacatatatgcacccaataaaggagcatccatattcataaagcaagttcttagagacctacaaagagacgtagactcccacacaataatagttggagacttttacaccccactgtcaatattagacagattaacgagacagaaaattaacaaggatattcaggacttgaactcagctctggaccaagcagacctaatagacatctacagaactctcaaccccataccaacagaatatacagtcttctcagcaccacatcacatttattctaaaattgaccacataattgaaagtaaaacactcctcggcaaacgcaaaagaacagaaatcacaacaaacagtctctcaggccacagtgcaatcaaattagaactcaggaataagaaactcactcaaaaccgcacaactgcatggaaactgaacaacctgctcttgaatgactactgagtaaataatgaaattaaggcaaaaataaataagttttttgaaaccaatgagaacaaagacacaacctaccagtatctctgggacacagctaaagcagcgtttagagggaaatttatagcactaaatgcccaaaggagaaagcaggaaaaatctagaattgacaccctaacatcacaattaaagaactagagaagtgagagcaaacaaattcaaaagccagcagaagacaacagataactaagatcagagcagaactgaaggaggacaccaaaaaatccttcaaaaaatcaatgaatcaaggagctggtttttgaaaagatcaacaaaatagctagaccactagccagactaataaagaagaaaagacaggagaatcaaatagacacaataaaaaattataaagcagatatcaccactgatcccacagaaatacaaactaccatcagagaatattataaacacctctacacaaataaactagaaaatctagaagaaacagataaattcctggacacatacaccctcccaagactaaatcaggaagaagtcaaatccctgaatagaacaataacaagttctaaaattgaggcagtaattaatagcctaccaaccaaaaaaaggcccaggaccagacagattcacagcctaattctaccagaggtacaaagaggagctggtaccattccaaacaatagaaacaatagaaaaagagggactcctccctaactcattttgagtccagcattatcctgataccaaaacctgccagagacacaacaaaaaaagaaaatttcaggccaatatccctgatgaacatcaatgcgaacatcctcaataaaatactggcaaaccgaatccagcagcacatcaaaaagcttatccaccaccatcaagtcggcttcatccctgggatgcaaggctggttcaacatatgcaaatcaataaacataatccatcacataaacagaaccaatgacgaaaaccacatgattatctcaatagatgcagaaaaggccttcaataaaattcaacaccctttcatgctaaaaactctcaataaactaggtattgatggaatgtatctcaaaataacaagacctatttatgacacacccacaaccaatatcatgttgaatggacaaaagctggaagcattccctttgaaaactggcacaagacaagaatgccgtctcttaccactcctattcaacatagtattggaagttctggccagggcaatcaggcaagagaaagaaataaatggtatccaaataggaagagagagagtcaaattatctctgtttgcagatgacatgattgtatatttagaaaacctcatcatctcagcccaaaatctccttaagctgataagcaacttcagcaaagtctcaggatacaaaatcaatgtgcaaaaatcacaagcattcctatacaccaagaacagacaaaaagagagccaaatcatgagtgaactccgattcacaattgcttcaaagagaataaaatacctagaaatacaacttacaagggatgtgaaggacctcttcaaggagaactacaaaccactgctcaaggaaataagggaggacacaaacaaatggaaaaacattccatgctcatggataggaagaatcaatatcctgaaaatggccatactgcccaaagtaattgatagattcaatgccgtccccatcaagctaccactgactttcttcacaggaaaaaactactttaaatttcatatggaaccaaaaaagagtttgtatagccaagacaatcccaagcaaaaagaacaaagctggaggcatcacgctacctgactttaaactatactacaatgttgtagtaaccaaaacagcatggtactggtaccaaaacagatatatagaccaatggaacagaacagaggcctcagaaataacaccacacatctacaaccatctgatctttgacaaacctgacaaaaacaagccatggggaaaggattccctatttaataaatggtgttgggaaaactggctagccatatgcagaaaactgaaattgggttctcactcataggtgggaattgaacaatgaaaacacttggacacagggtggggaacatcacacaccagggcctgtcgtggagttggggggagaggggaaggatagcattaggagatatacctaatgtaaatgatgagttaacgggtgaagcataccaacatggcacatgtatacatatgtaacaaacctgcacgttgtgcacatgtaccctagaacttaaagtataataataaataaataaataaataaacataaaaataaaataaaaaaagaaaactgaaattggaccccttccttacaccttatacaaaagttaaatcaagatggattaaagacttagacataagacctaaaaccataaaaaccctagaagaaaacccaggcaataccattcaggacataggcatgagcaaagacttcatgactaaaacaccaaaagcaatggtaataaaagcaaaaattgacaaatgggatctaattaaactaaagaacttctgcacagcaaaagaaactatcatcagagtgaacaggcaacctacagaatgggagaaaatttttgcaacctactcatctgacaaagggctaatatccagaatctacaaggaagttaaacaaatttacaagaaaaaaacaaacaaccccatcaaaaagtgggcaaaggatacaaatagacacttctcaaaagaaaacatttatgcagccaaaagacacatgaaaaaaagctcatcatcactggtcgttagagaaatgcaaatcaaaaccacaatgagataccgtctcatgccagttagaatggcaatgattaaaaagttaggtaacaacagatgctggagaggatgtggagaaataggaatgcttttacactgttagtgggagtgtaaattagttcaatcattgtgggagacagtgtgatgattcctcaaggatctagaaccagaaataccatttggcccagcaatcccattactgggtatatacccaaaggattagaaatcattctactataaagacacatgtacacatatgtttattgaggcactgttcacagtagcaaagacttgaaccaacccaaatgcccatcaatgatagactggataaagaaaatgtggcacatatacaccatggaattctatgcagccattaaacaggatgagttcatgtcctttgcagggacatggatgaagccggaaaccgtcattctcagcaaactaacacaagaacagaaaaccaaaaactgaatgttctcgctcataagtgggaattaaacaatgaaaacacatggacacagggagaggaacatcacacactggggcctgtcagtggatgggggactaagggagggatagcattaggagaaatacttaatgtagatgacggattgatgggtgcagcaaaccactatggcacgtgtatacctatgtacctatgtaacaaaccttcaggttttgcacatgtgtcccagaacttaaagtataatttaaaaaataaaaataaataaaataattagaacaaagtccagcagtatagagaattaggtaataatcaataggaacagacaaatctaatgttgaaatagaataatagatccagaaattaattctaaagtcttatttatggttctttaatgtgtccttgatattagcttgcaattagctccatcaagtgatagtatccaacgtaaaatgggcttagcaatttcttgcttctcatgctgcttttatatctctcttctttcacattcttggagtccccaacaacagggcagaggctgaagggcacagatcttttgtgtcgtatggcttggcctccattgaagtaggtgagggtgaccatccctggtacggaaagacaggtccgggcaggccacagtctggctctcctgcctggcttcctgggaataattgagcaattgctctgtaccaggcggggttctgaatgcttccacgtcccaatttcaatcacttctgcaaggtgacgcagctaggaaagatgtgactcaggccactctggcatccaggactcacctcctcttctgacctctcgtcagcctgctgtattagctgggccgcccttcccatgttgacctcctcccatatctgagcgttggcctcacaggcagcgtcatgaagctgccaccatccctgtccccctttggttcaggccacagggatgcctggagctgggaacggccctgcgtagcactgactgcagagtcttcagtgcgtgtgtctctgtctcctttactgaactgtgagcgcctaaggaggggccttccatctgctagtttatccctggaatgtatctcaatgcttggcagaggataagcgttacatgttggatacattaattgatcctaagattctaagcactaaattttacgagaagtagcaaaaatgacctgaatgtagtcgcactgtatcttttcaatgatccaaacagctgactccctgggcttacgccttcataacgctggaaccccctcccgcccgctttgttcctctccctcttgcagcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtggtaaggtttggggctttttaatgaatgtgctcctgactgggaagtgtaatgtgctcctgactgggacgtggcacccctgaaagtggtggcagcttatggttaattcaataagtgttttttaagcaactactatatgcctgacacacagggacacccaagaaataacaacaggctgcatctgtctagctctcaaggggtttatgctcagatccctcaaatcaggccaacgtgtgttaaacaactaaagaacaacctcaggcggttcacgattgactatcaacatttgggcagaaatggttagaaagaattggactcgaggcactcctgtggtaatgaaggcttaggatctaagataggtcttaaaggttagggcgatgaagtagagggagcctggattttaccttctgctgcttccatttcataaattttgttttgtaataaagagaaatgtcaaaatatgtgttttaaagagagagaaatattaaaatatatgctaacttactgggtagaggaagacacacagacagtcattgctttaaaaaggaaagaaacgacttgaatgtaaaacatctgtgaccctttgagtagctgttaaaggtctggagaaaaggagataatttacacctaaaaatcatgggaactttaggttacatctttggaatcttggatatgaaaagtgcttagtgccagccaagtttgtgaaccactttcagcaatcaaatcatcctaaatttatgtaggcttggcagtaagttagaccaagacctcactgtctgctggaagagaagaaaaactgataatggactgatcacgaaccgtgaaatggaactaacagaactgatccctggggaggagagtggagttgaaaatgaaatgcccggggaagtttggtggctcctgcccaactcaggctagtattcatttccaagaagttccaatctggtggaagggacacagcaatagaacatccaccaaggggatcccgataccgatggtctcttcattcccacagcaagaggaaacgtggccatggggctgacaagagctaggcagtgtcaaggtgagacttcagcccctggtaggaatctggacagctctgcaggaagccagaggagaggcgctggtggtgggcagaggaaacacgtgggtgtccagggcctgccctaaaggaggaagacaccagtgatggccagactgcatttaggggcctatattctcactctgccagtaggtctcagtggggaaatgagaccatcctcctagagatgtgcaggatgtccaggtgcaggtgagactccagctgacgttcaaaccttccgctccctcctttctctgctgcctcacgcagggtgtgggaggcggctgacatgctgacctgaacaacgtattgtcccgggatagtgtaaggctagagggcgggtcaggtcccagagcaggctcctcctacaggtaacaagtaggacgaataaaataagtatctgtacctaagacactatcatcaccatcatagccaacacttctgtagtacttaggtgtgtgtagaagagacaatagagcaatatcttcaaagtgctggagaaaagtaactgaaaactccgtcaaaccataattcaagagtgtgggtaaaataagacattctcagacatacgaaggccaaccgagtttactgcctgcaaacctaaaagaaccgaagaaagggcctacttcagaggaaaaaaagggaacccagaggaaagactcaggaaacaagtaacaatcatagatacaacggggtcaaatattgatataaaatgtggcaatgaattttgtgttaaaaagtgtgaaaccaaagctgtaaacaatctcatgtcaatgacatacaatcaaataattcagactttcttagaaaaaattattaaaagaaaattttctttcaaaagtaatgttattcataattagtccaaaaatacaccctatagttttaacatcagtgaaagacaataaatctagaaaaccttaccaacacgtgataaaagtgacatcagcaaaggagaaaatgaactattcagtaaatagcaggatacttggtatttgggtaccaactcatccccactgataggactttctcagttttagcactgaaaggtcccatagcccagaaaacctgaaaaccctaggcaaaccaggaaaattggtcatcctgcttggtatccaaatatataaaaatgtatttatattcctacatagcaccatatacaaaaatcaattcccaccttaaaaaaaagatcagctgggtgcggtggctcacgcctgtaatcccagcactttgggaggccgaggccggcagatcacatgaggtcgggagttcgagaccagccctaccaacatggagaaaactcgtttctactaaaaatacaaaattagtcaggcatgggggcacatgcccataatcccagctactcaggaggctgaggcaggagaatcgcttgaacctgggaggcagaggtttcggtgagccgagattgcaccattgcacttcagcctgggcaacaagagcaaaactccatctcaaaaaaataaataaataaaaaataaaacacaaaaattagccaggcatggtggcgcacacctgtagtcccagctactcaggaggctgaggtgggaggatcgcttgagcccagggaggttgaggctgcagtgaatgatgattgtgccattgcactccagtgtgtgtaacagagtgagactctgtctgaaaaacaaaaacaaaaaaaaaagaaaagaaaaacctataccctggaaaaacttctcacacccctgcaaaaaaaggagacatgtatgagaagattcactacagcattcatctgagtgagaaaaatttaaaatggttctaaagggtatagacaggagaatggatgaatatattgtggtatagttatacaatccactaccatacagcacttaaattcatatactagaaaaacaaaactaaacaaataaataagttaggcgtggtggcttatgcctgtaatcccagcactttgggaggccaaggcagaaggattgtttgagcccaggagttcgagaccagctggggcaacacagcgagaccatgtctccactaaaaaaaaaaaaaaaaaaagttagcccggcatggtggcatgtgcctgtagtcccagctactctagaagctgaggtggaaggatcacttgaacccaggagttcaaggctgcagtgagctatgatcatgctactgcactccagcctgggcaacagagtgagaccttgtctcagaaataaataaattcatatgctagagggaaaaaaaattataaagcaatacatgttacataattacatttatactatgtttaaaaatatgtttatgaatataatatagtagcataattatgaattggaatggtaaacagtaagttaaaaatggtggctctctctagggtaaagagaggaagaaatgagatggggaaaagtacacagcaaacttcaactgttttaatagtgaatttccttgttttttttcaccacacttttgagatttatccatattaatatacatagtcaagtcaattttcaagaaaagtaaatggcaatttcttttctaagtacttgtgaatctttctcaacattttgctgtaaggccttctggtatttagtgttataagggaaggcatgctgattcttgttcagttgaatataaagtttttttcctttctagtaagttttctctttatcactcaaaattttaccaaaatatatctggccatgggtcttcttttactgaaacttcctaaaacacagcgagcaactatcttggctactatagacatcttctaggtctgctgtaacaataacagtggaccgaggtaaagaaaacttcacaaaaaaaaattcttctctttttcaaaaccacattgtctctttaaaacattcttacttgaaatgagggaaaaagtatatcaaagctgaaataagtttgcattatttagtttgcagtacagcttctggttctctgaggaactcctgtcaaattcatctcttttttcctctgctttttcatacccactgagcagtaatgtgttttgcttacaaaagaagcctcggaagtcatgcagagagcgtaccactcagatgcctctcaagttttttttggttggatttttttttaaagaagccattatttactgaaactatttagccctgacatcatgaaagaaagaagtcaaaagggttcctgcatttctaatgattttgcctttaaagaaaaatagagctacacacacacacacacacacacacacactgaaaatttataaaacagttgtgctaaaaacaggctgaaaaacttttataaaatagtgttaagaaaagatataataaagaatatagaaaatacagtagcaacaagataaagaaaacccaaattgtcagtgataaaatccattttcatgttgatgggatgctgaaagcattcctgcaaaaatcatgaataaggcaaaatgtccacaatctctactactatttaacaatgtatttggccaggcgcgatggctcacgcctgtaatcccaacactttgggaggccgaggcgggcagatcacaaggtcagcaattcaagaccagcaggaccaacatagtgaaaccccgtctctactaaaaatacaaaaattagctgggtgtggtggtgcgcgcctgtagtcccagctactcaggaggctgagggaggagaatcacttaaacccgggaggcggaggttgtagggagctgagatcacgccattgcactccagcctgggagacagagcaagaccccgtctcaaaaaaaaaaaaaaagtattttaggtgttagctaattagacaagaaaattagaggcctgagaattggaaataggtaaaattcttcctatttgcagatgaaacccgaagagaattatagctataactgatacaaatacagaagaattcagaaataagaaggatataaaattatcattaaaataatactctgtaggcttcaggtcttaaaatgaagaacacttccatttcaataataaaatgcaaataaatcaatttagaaatggtcaaaacatctgaacacacatctctccaaagatgtacaaatagctagtaaatgcatgaaaagatgttccacatcagtagtcattagcaagatgcaaatcaaaaccacaatgaaataccacttctcacccacttatgaagctagaataaaaaagacaacagtaactgttggcaaggacatggagaaattggatccctcaaatattaccatgtgaaatggtgcaattgccttgtaaaacagtttgggagttcctcaaaatgttaaaactcaagttaccatatgactcagcagttctactccgaggtttctacttgagagaaacacaaatatatgttcgcacgtacttgcacaggaatgtgcatagcagcatgattcatgcagccaaaatgtggaaacaacccgaatgtctatctgctgatgaatggacaaacgaaatgtgatgtgtctatccaaacaatgagatattattcaactggaaaaagaaatgaagtgccgatacatgctacggcatgggctaagtgcaaaaacattacgccaagtgaaaggagacagccagcaaagatcacatacggtatgctccacaacaggcaaatctatagagacaggaagcggattcgtgcttgcctagggccggtagagtggggagatacaggtgataagcagtgactgcttactggtggggtttcttttgggggtgatgacaatgttctggaattagatagtagggatggttgcacaactttgtgagtatactaaaaaccactgaattgtacactttaaacagataaacttgacggcatatgaatgatagctcaataaagtgattaagaaagtggccgggcacggtggctcatgcctgtaatcccagcactttgggaggtccaggtgggtggatcacttgaggttaggagtttgaaaccagcctggccaacatggtgaaaccaaatacaaaaagtagccgggcgtgttggcacatgcctgtagtcccagctactcaggagactgaggcacaagaatcgcttggttgcagtgagctgagattgcgccacagcactgcagcctgggcagcagagcaagacttggtctccaaaaaaaaaaaaatagcattcatattacaacaataaccagttacaagatgagataaaagtacaaattccatttacgataacaacaaaaatacttggaataagtttacagacaaatgtacagaatgtgtataagaaaacaaactctttagagaaatacaatagattttgattatgcactttatttttctctactacttttgtatatttgcctataaatatatgaagcctccattttgactggaaacaaagcctagaggatgtatactttttaagatgcagaaaatgaaatgaaaccccaatacattcctgacagtcttacttttttactattttcatttttttaatttttgtattaaatagagacagggtctcgctatgatgcccaggctggtcttaaactcctggcctcaagtgatcctcctgccttggcctcccaaagtgctggggttacaggcatgagccaccgcgccgaacccttttttactattttctaatgaatgtttttatttaaaaaatcattattctaagtataattgaacacaataatttctaactctttctcaatagtagaaaccacaacgtttatttatatttctagtaccttattgtcacacttttggtttgcttgggaaaactaactggggtcatttttttttccaagtagaggaagaaattctattaatacttggggatctgaagttctctttaaagtatttgtaaaaaatcttttcttggcagggactgagctgtcaacatgtgaatgtcttttttttgcagtctcactgttagaaaccaggaagatcagaggcccacaatagcttcccacgaactcagagcagatcttccaacctgggaagaaaggtgaaatcacacgttttttttacctcactaaactaacagaaatactaacctctttcttttctttgccttgtatgtttcaacagaacacatactttctctaactgtaatttagtaatatccaatcattatgtggcctcgcattcctcccctgcagaattccatttaattcatcgtgtgacagggagagaaatcagttccattattagtctaatccctttgctaattgcaaatacaaatagattcttcctaacaaaacatattatgttattttatttttatataatatacttttaaaaataaaagtatatcatataattttatataagatatagcatatatatttatatatactatatataaaatacagcatatatacttatatatgctatatatatgatatagtatatatatttatacactctatataagatatagcatatttatacacgctatataagatatagcatatttatttatacatgctatataagatatagcatatttatttatacatgctatataagatatagcatatatatttatacatgctatataagatatagtatatatattatatatgctatatataagatagtatatatattatatatgctatatataagatatagtatatttatatatgctatatataagatatagtacatttatatatgctatatatgatatagtatatacatttatatatgctatatataagatatagtatatacatttatatatgctatataggatatagtatatacatttatatatgctatataggatatagtatatacatttatatatgctatataggatatagtatatacatttatatatgctatatataggatatagtacatacatttatatatgctatatataggatatagtacatacatttatatatgctatatataggatatagtacatacatttatatatgctatatataggatatagtacatacatttatatatgctatatataggatatagtacatacatttatatatgctatatataggatatagtatatacatttatatatgctatatataggatatagtatatacatttatatatgctatatataggatatagtatatacatttatatatgctatatataagatgtagtatatatatgctatatatatgatatagtatatatatttacatatgctatatatataagatatagtatatatatttacatatgctatatataagatagtatatatatttatatatgctatatatatgatagtatatatactatatataagtatatatgctatatgtaggatatagtatatatatttatatatgctatatataagatgtagtatatatatgctatatataagatgtagtatatatatgctatatatatgatatagtatatatatttatatatgctatatatatgatatagtatatatatttacatatgctatatataagatagtatatatatttatatatgctatatatatgatagtatatatactatatgtaagttatagtatatatatttatatatacgatatatgatacagtatatatacatatgctatatataagacagtatatatttatatatgctatatataagacacagtatatatttatatatgctatatataagatacagtatatatttacatatgctatatataagatacagtatatatttacatatgctatatatgatacagtatatatttacatatgctatatatgatacagtatatatttacatatgctatatatgatacagtatatatttacatatgctatatatgatacagtacatatttacatatgctatatatgatacagtacatatttacatatgctatatatgatacagtacatatttacatatgctatatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtacatatttacatatgctatataagatacagtatatatttatatatgctatataagatacagtatatatttatatatgctatataagatacagtatatatttatatatgctatataagatacagtatatatttatatatgctatataagatacagtatatatttatatatgctatataagatacagtatatatttatatatgctatataagatacagtatatatttatatatgctatataagatacagtatatatttatatatactatatataagatacagtatatatttatatatactatatataagatacagtatatatttatatatactatatataagatacagtatatatatttattggtcatttacaaaaacttggatttaaacatttgaaaatatatatccttctcaagcaaacatgaaacagttatattttaaaaataaaagtatattatataatatacggtgggtgggcacggtggctcacacctgtaatcccagcactttggaaggtcaaagcatgcggatcacctgaggtcaggagtttgagaccagcctggctgacatggtgaaaccccttttctattaaaatacaaaaattagcggggcgtggtggcaaacgcctgtaatcccagctgtttggaaggttgaggcagggagaattgcttgaacactggaggcagaggttgcagtgagccaagattgcaccactgcaccccagcctaggagacagagcaagactctgcctcaatcaatcaatcaatcaataaagggagagggagaaagaaaaagctatagatgcttgccaaaaatttaatggtatataagtaaagaaagtggtctaacctctaagagagtaaacactgttaacacatttcttttttttttttgagatggagtctagctctgtcacccaggctggagtacagtggtgcaatcttgactcactgcaacctctgcctcctgggttcaagcgattctcatgccttagcctcccaagtaactgggattacaggcgcccaccaccatgcccagctaatttttgtatttttagtagagatggggtttccccatattggccaggctggtctcgaactcctgacctcaggtgattcgcccacctcgttctcccaaagtgctaggattacaagcgtgagccactacgcccagcgtgttaacacatttctttaagaaatgacctggaagatttgaaaagaaataaaatagaagttttaaaaatcaaatattattgttcaaattttaaaaaaattgatgattgaaatagaagattagatacaactaaataaataattagtgaacctgaaggtatccaaaaagacccacgtaacaaggagattgaaatacagtttgagtttcccttatccaaaatgcttggaactagaaatgtctcagatttcagattttttcagatttcggaatatttgcattatacttaccagttgaacatcccaagtccaaaacttcaaattattccaatgagcatttcctttgagtgtcatgtcaatgctcaaaaagtttcagattttggagcaatatggattttagatttttgaattttggatgttcaacctatataaaaataagttaaaataaatggaggatagaatgataagaattgacattaatgttttgtttttttttttttagacagggtctcattctgtcacccaggctggcatgcggtggcacgatcttggctcactgcaacctctgcctcctgtgttcaagtgattctcctgcctcagcctcccgagtacctgggactacaggcatgggccaccacacttggctaatttttgtatttttagtagagacggggtttcaccatgttgcccaggttggtctcaaactcctgagctcaagtgatctgtccacctcagcctcccaaagtgctgggattacaggccagagtctgtttttatccactaatctatacttcttccccatactagcagtaaacaaaatagactttaaaaaattttaaagcactttagagacagagcaagtcactactagaacgttaaatgatttagcttactaggaaagtgtaacaacttgtatgtacctaataaaataatctcaaacatcaaaagcaaaaattgctagagcaagacatttacaaatctgctaacgatagagggagattgccacattcctttcttagttactgatatttctaacagatagaaattttagacaaattatagaaatttgggccaggcacagtggctcctgcctgtagtcccagcactttgggagaccaaggatgggggaaagcttgagtccaggagtttgagaccagcctgagcaacatgacaaaatctcatctctacaaaaaaatacaaaaaaatttagctggctgtgatggtgcgtgcctgcagtcccagctgctctagaggctgaggtgggagagtcaattgagcccaggaggttgaggctgcagtgagccatgatcacaccactacactccagcctgggcaacacagtgataccctgtatcagaaaaaaagaaaaagaaaaaaagaaacagggagaaattaattaataagctatatttattggtcatttacaaaaacttggatttaaacatttgaaaatatatatccttctcaagcaaacatgaacagttatgataactgaccaagcattaccttataaagtatctcaataaatttcaaggaacataattaatcaaactgtactgacaccaatataattcaaatagaagttagaaattaaaaaataaagccgagcactgcggcacacgcctgtgatcccagcactttgggaggccgaggcaggcggatcacctgaggtagggagtttgaggccagcctggccaacatggtgaaactccgtctctactaaaaatacaaaaatcagctgggggtggtggcacccacctgtaatcccagctagtcgggaggctgaggcaggagaatcgcttgaacccgggaggcagaggttgcagtgagccgagatcgcgccactgcactccagcctgggcaacagagtaagactaaaaaaacagaaattaaaaagtgaactaaaaatcctcatatgtttgacatttattttattttattttacatcattattatttttttgagacagagtcttactctgtcacccaggctggagtgcagtggtgcaatctcggctcactgcaacatctgcctcccgggttcaagtgattctcctggctcagcctcccgagtagctgggattacaggcacatgccaccatgcccagctaatttttttttttttttttttttgagacagagtattgcagaggttgtggtgagccgagatcacaccactgcactccagcctgggcaacagagcaatactctgtctcaaaaaagaaaaaagaaacttaatgttgggtggaaaaagcaagttgcagaagacaacatatagtcaaccattttgataaacttaaaaaaaaaaactggctgggcacagtggctcacacctataatcccagcacttcgggaggccaaggtgggtggatcacctgaggtcaggagttccagacagcctggccaacatggtgaaacgccatctctactaaaaatacaaaaaattacccgggtgtggtggtaagcacctgtaatcccaactacttgggaggctgaggcaggagaatcacttgaacccggaaggcggaggttgcagtgagccgagatcgtgccattgtactccagcctgggcaacaaagagagactctgtctcaagaaaataaaataaagaaataaaaactaaagactacatttttcaggattacatacatacatttgaaactatggaaacaagataaaagagatattaaggatcattattaagctatgttttctgatctcaatataattatgacagaagtaagaattaactcaaaggggtaagcccaaaatcaagtatagcagttccctagaggacaaagccaagagacagtagcaagtagaagtagcacgaaaataaatgcaacattatcagtgctgttctggttcttaaggaaaatggcgcattcataagtgttcatttacactagagactcggaaaggtggatgggagggtgggagataggtaagggatgacaaattacctaatgagtacaatgtacactatcccattgatggctacactaaaaacacaggcttcaccactgtgcaatatatccatgtaacaaaagtgcacttgcaccccctaattatagtttttaaatgtttataagttttttataaagtgagccagacgcagtggctcacacttgtaatcccagcactctgggaggccaaggtgggcagatcgcttgagcccaagagtttgagagcagcctaggcaacatagtaagacctgactctacaaagaatacaaaaagttagctgggcgtggtggcacgtgcctgcagggtctgctacttgggaggccaaggagagagaatcatatgagcctagtaagtcgaggcttcagtaagctgtgatcacaccactgcactctagcctcagcaacaaagtgagactctgtctcaaaaaaaaaaaagtgttcattttgttgtcacctttggacagtacagcggtggcatttataacttgcacttatactacatatattctctttctcaaatattatataattttaaaatatattaaacagacacttgctctattgttccagaggtttaatgttgtcaaatctgacttagttctgtcgtagtacagaactcatcacagatgattaggaagttttgggtcagatggttgcaggatttttctttacatttacagtttttaaaatatttcaagatgtgcccatttgtaaacaagcatgttcttagcatttattctagcaacttggtttgcaagccttttggtatgcaatccagcaaaaaatttgaaagtatcatattcatgtgtttttcccaaaggtttgaggaaatgcgaacagttctttcccttcctaaaagggcctaaatgcatatatttttcattcttggaggaggaaaagatatgttcctaatgatgaattccaattaactaccactaacagttcccttttgccccctctcttttggtctccacgaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtatgtgaccacgagatgccttttcccaaggctgttggtaaaattaacttggtgcaaaagtaattgccataggccgggcacagtggctcacgtctgtaatcccagcactttgggaggctgaggcgggcggatcacctgaggtgaggagttggagaccagcctgaccaacatggtgaaaccccgtctctactaaaaatacaaaaattagcctggtgtggtcatgggcgcctgtaatcccagctacttgggaggctgaggcaggagaatcgcttgaacctaggaggcagaggatgcagtgagccgagattgtgccattgcactccagcctgggtgacaacagcaaaactccatctcaaaaaactaaacaaaagtaattgccttttttttttttttttgagatggagtctcactctgtcgcccaggctggagtgcaatggtgcaatcttggctcactgcaacttctgcctcccgggttcaagcaattctcctgcctcagcctccagagtagctgggattataggtgcgcaccaccaggcctggctaatttttgtatttttagtagagacagggtttcaccatgttggccaggatggtcttgatctcttgacctcgtgatccacctgccttagcctcccaaagtgctgggattacaggcgtgagccaccgtgcccggcctcgccattacttttaactttttccagaaaaatgcacaaaatttttcaccaatttcagaggacatttggagccgctctgcaggtccacagtcaaagggatctgaataccgtgaatgcgggtgcagctgttttctacattttgcagttgatgttctgggtcaagctgaacatgaccaaacagctgcacccacattcacggttttcagatcactttgactgtggacttgcagagggctccaagtgtcctctgaaatctgtgaaaaattttgtgcatttttctggaaaaagtatcccctggagtctccatttgacactgaacactgtttacaaatattataccctaagacgttcctttaaataaaattatcttgttattctgagaaaaatcttgtatttaggtatcttgatgttatagagcagcagcatcacagatgtgatactgatgctgaaaaggttttccccaggctggctttttcattcaagaaattatcagatgaatgagattgggcaagtttccacctgtcagtgtttcagtttcttcaaatctaaaatgtaggaggccagccctggcacagtggccaacttctgtaatcgcagcattttggcaggccgaggcaggtggatcacctgaggtcaggagttcgagaccagcctggccaacatggtgaaaccccatctctactaaaaatacaaaaaattagccaggtgtggtagcattcatctgtaatcccagctactcaggagactgaggcaggagaatcacttcaacccgggaggcggaggttgcagtgagtagagattgcgtcattgcactccagcctgggcaacaagagcaaaactccatttcaaaaaaataataataataaaataaaatttaggaggtcagattgttctcaaattgggtgccttgtagctctaattataaaactattagttatttcctactatgtgccgacaggaatgtcaagttgaagaagcagggcctctcctgtcatggagctcctggagatgtgggcggacagaccaggacccctggccacactctcagcactcactggggctcgggggtgagccatccacaaaggggtgggcgagaatgagaaaaatactcaaggaggctacagatggaccaaggatagtgaaaaggaaatttccacaaacacagcaggatggggacatcccaggagacaggaccaggcgagcccaggggaagagcatgaagttgtgtgatcactgcaagtatacacagattgtgccagaaagggagggtgcttaccaaactattagggctgggggcaggcagcaggaggagacttagagaaggggtagtcggagagcatggagaggtttgggcatcatggcgaagtgtctggatttttatcttgggaagcccttggattttagcctgtttatatcatcaaattttgatttttgaaagaccagtagggctgcagagtgaatttggagaagaccaggggcagaagacgttagaaaactaattcaggagtccaaagggacatggtgagggcctagctaggccagctgaagacgctagagaggaagagtcggatttgaggcaaaccccaccgtctcaaatgactcccatatgtctggtgtaggcagaccaggtggtggggtcgttggcttacttaattttgcgtcgttacgttttgctttcttaagtttgcgttgttaaattggtaatattcagttgacatgtttgaatactgagtccaaaaagttattttcattttgaattaataaggagcaagataatttttgtcctttaatttatggcttccacatatttttattttgtcatgattttttttaaggcaaggtttttcatcaatcttttaaagtattatacaaccaaaaacaggccgggcacagtggctcacgcctgtaatcccagcactatgggaggccgaagcaggcagatcaccttgtctaggaagagccaaacatcagagcaatcaacatctcctatgggcttagtgaaatccaagcactttgtcattaaatcacaaaaaacctaagacattaccatcatcatcatccccacttcaggggaagagctcactaggacacagagtttaccttgcctgaggccccacagctatacagtgacagggatggattttgttttgttttgtttttgagatggagtctcgctctgttgcccaggctggagtgcagtggcatggtctcggctcactgcaacctctgcttcccaggttcaagcgattctcctgcctcggcctcccgagtagctgggattacaggcacctgccaccatgcccagctagtattttttatttttagtagagatggggttttgccatgttggccaggctggtttcgaactccacagcgctgggattacaggcgtgagccaccatacccaggcagggctggaatttaaacacaggcattgtctgccctcaggccctgtgattggaaccttccagggttttgagtcaacttccacttcacccctgtgcccaaccctccgggcaggccagcactcatccccagagccctgccactgtgggccagcaggggaagcctgggcctccaggtgtcagcccccacgttacaaggaaatgagcaaggggcagtctgtgctgcctgttttcttcaaagcagcagtgtgagccctgccagcatcacttagaacttgtgggaaataacaagcatcaggggcccctacacctactgagtctggggtggggcccaggaaccgctctcacaagccctctggagcctgctgatgccactgacatttgagaactgcgttgattatgcttttggtttctctttggcagtttggattttttggatgatcttgtttggtttgggatatttaaaaaacaacaaggccgggcacagtggctcatgcctgtaatcccagcagctagagaggccgaggcgggcggataacctgaggtcaggagttcgaaaccaaccaacacggagaaaccccgtctctactaaaaaagttagccgggtgtggtggtgggtgcctgtaatcccagctactcgggaggctgaggtaggagaattgcttgaacccaggaggcggaggttgcactgagctgagatcgcgccactgcactccagcctgggtgacagagtaagactctgtctcaaaacaaaacaaacaacaaaaaaaccaaaaacaaaaaacaaaaacaacaacaaaaatccccacaagctctaggagtttgggatagagatacaactgaagtctctaatacagctcctactcgtttctgtcgacaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaat

SEQ ID NO: 1655 - DNA, 8416 bp, Homo sapiens
gctctgtccagatgctcttttttatttattttatttttatttttatttttatttttgaggcagggtttcattttgtcacccaggattgagtgcagaggtgcgatctccgctcactgcaacctcgaccctccaggctcagggatcttcccacctcagcctcccgagtagctgggaccacaggcacacaccaacacacccagctaattattttattttgtatttgtagagacagggtctcactatgttgcccaggctggtcttgaactctcagtttccagcagccttcctgcctcagcctcccaaagtgagccactgtgcccagccagaggctccagttccactggtgttgggtgaggcctagtgagagggtgggcagagggccttgttgaatctgaactgcagcaagggctcgcagatctcaaaggaggcagggaagtgtgctggggtcccgtcagcatcgcatgaactcagggatggctgcatttgaggccagggtcaggctgtcctcacttatcaggggacaagagctggctgatgccgattggaaaggatagaatcctagtgagctgccccagtcccggtaagcatgagtgcctgcatatcctcgctcttcctcagttccacccccttcctgggggtgtcacaggctcctggcagaaccagagcccatgccctgcatttgggctggcacatttagtggaaccagccagagaaatgctgtccctccttcctggggaagtggtggcaaacagaggcgccaaggctctctctgcccactgcccacatcatctctgggactctgcgggtgccctctgccccaaggctactgccagggactcaggtgtggctgggctttccagagcctccctcaaccctcccctcacaggctgaagtcagtacttcgtttgggggagccacacccagagccaggagcctgacttgctcagggcctagggaatgggaccaagagtgatccagcttcttctccagagctgcaccctgcacaaatccaccctctccctacgctttgccctggacactttcagaacacatcacactgcctgtcatcatgcatctccggctagggcagagggagaccgtgcacgtcacccggcacaatgtgacggaagataaactgtgtggggaagagaaactgaggcccaacaggaataaagctgccccaagacccagctcctgcctctcttggtcccacactagaaccactgtttaaataaagtcctcccctcccaaaggtactcctgctccccaactacagcagggtcctgggtcctgggtctgagggtttattggtcagggcccaggcagatgtcatgtgcccctgttgtccccacgcaggcccacagacatcacaggagaatgatttacaagccacttggggcctgctggcagtgagggtttacccaccccccgccccagcttgctccagtgccgccgtttacgtcatgggtacgtggcctgcagttcacggatctccaggcccatcctgttgactgcatacccagtgaggcttcgagcctgccagaggtcaatacagcccagcagactaaagtcagttttccaaaaggactctggaattcagcaaaatgaatggaaggtcctttacagcgtactcactccaccattgtacagatggcagcactgaggcccggagaggctctggaacttgggagaaaggctcaggctaagagaagccagggactcctcacccccagcctgtgagctgctgcagattaaggggtcattgaagatgggctagtggccaagggaaaaccaccacatccagggccacacccgtcacccctcaccctcatcccagtcagggcagcagcagcatcttcctgtgcaaaacaaaatgctcatctcctccaagagctgcttctgagggcctgtcctgccccttgccttgggtaatgagggacaggctggcagtgccctgctcagctcttcagtctgtccaggaaaggccaggctaccagagctccctggagtgccagtggccaggtaagcggtgcagcctcatgtcttctttctggatgtgctcgtaacaggactggagggagagaggcaaggctgaggccagttgacctgcctgatcccaaccacatgcacaggatctagggctcaatagctgtgtgcacccacctcccaacccagaggaggcgtgtctccaactcagccctcagccacagtctgcgaggaaaatggggcccttcctctcccactgtgcttgggaatgcagcatggagcaatcatggccccagggtccccagggctgggatgcactgtgggacccctccctggctcctttaataagagcaggatcagggacactgtgaggacccttcccagagtcacacatgagctgtgaatttgagctccctcccactatggtgttatgatgtctgggaagggaaaagggtctgccccaggggccagggcatttccacctcggtccacagcccctgtcccttacctccagggctgtgagcaggaagtcatacaggcctcctgtgtggttggggtccatcatgtcacggatcaggtggatctcggctcccaggtgctgaattctggagaacaccgccccaccaagagagcgagggagacaaggagaagaggcctgtcgcggacaggcagctggggaaggagcgctggcctggatggctggacacctggggtgtggtcctcactctacctctagcaccccagcaccctggctgggaccctcccttttctgggccttggcttccccatctgtacagagagaagctgcatccataaaccctggggttcagaggtatcagaagatatcgtggttgggggtgggaccctgcccctgccctgcacccccagctcctgactgcctcaccgggcgcgcgacaccacgtagatgagaagtggcagcaggtcgtccatgggcagcttgtactcccggcccaataccctcgacaccgtgccctcaatttccccgtatgtcctctccagcacctccagcttctcccgtgggtccaccgtggtcctgcagcagggtagctggctccaggtcaaggcccttggttcagtcccaaccaggagcaccccacactctgcctccggacccccaacccactacggctcacactcacatgatcttctgcaggcactcggtggctgacaggaaacacttgtccctgaccagggagtacctctgcatggtggagggagtgggctggatgaggccatggccccccagctctgacatcccctccttcccagggccgggcctgagtcccccgccacccttcccttcactgccagctttagtgcagccccaccctgagggctgagtgacccagggcaagtcacagctccactgtgggcctcagtttgtgcaaccataaaacggggtgaatagtctccatgaggttgggaggatccaaacggataagaagataataatcataacaggcactggccactgggtgccgcccagttctgagtgcctatgtcgatggttctcaaacccaagggcttagtgaaacacaggttcccgggcccactccctgcatttctgactcggtaggtctgaggtggttccaagaatctgctttcctaacaggttcccagatgatcctgatgcttccagcctggcaggcacattttgagaacagctgcctcatgtgcccacttcaccctcacaacaattttgaggtggttctggccaagcgcagtggctcacgcctgtaatcccaccactttaggaggcgaaggcaagcagatcacctgaggtcaggagtttgagaccagcctggccaacatggtgaaatcctgtctctaccaaaaatacaaaaattagctgggcatggtagtgagcacttggcaggcgcctgtaatcccagctactcgggaggctgaggcaggttagtcacttgaacccgggaggcggaggttgcagtgagctgagatcgcaccactgcactctaacccgggcgataaagtgagactttttctcgaaaagtaaataaataaataaataaaataagaattttgaggttgttctagtgttggctcccttttactgatgaggcagctgaggcacggtgcacgagcctcttgcacacggtcacacagccaggtaagaacctgtgtttgagcctggtggttacaggccaacagcttacctccaccacactgggaggtcagaatgacagtgtctcctcccaacccaccctgcccctccccagctcctctgcagcctccgcccagcaatcatgaggcaaagggctcctcaaagcctgcaggacctctgggggcccctggcttggggctctggcctccctctcacctgattgctcgtcagcgtgaggtccttgaggggccacaagtgcctgaaattgaaaaagtgagacaggaggctctgcctcgacaaggggcagagtctgaggtcagagggcaaattccctatgccactgtttcccccggcagatctgggtcctgaaaaggggaaggagatcagcctaggtcatggggaggatggaaggattcctggagaaggcagagctccagaagctccagggaggtaagggcggcccaggggcttgtatgagccaggtcgtggtgaccagtagagagggaggggtgaggagactgcactccatccaggaggctctgctgagccagcacagggctgtgagcagggggatgcagccctcatgcagcagaggtggaggctggtgtggggaagcgacactgaggtggtgagggaggcggggcatgcttgggaagcactggcagccaggtctttaggctggtggctggtcagatgcaggacacagtcaccaagatagaggaagaaacagggatttgcagggtgggtgggaagcaccatccctgtgtaacaaaggagacctggatgtgggagcagagacagtgcccgtgccctctactgtggacagtggggtcacttgtggcatcaatggatagatgggacactgaagagaaaggacattttggagactgagggtggaagggaggccctggggtgtggtaaacacctcccgacatgcacccagagcagtcctcagtctcccctgagggacctcctctcccctactctcagcccaagtgctcagagcaggtgatcttgccccagcctcagcagtggatattcaggcaggcctggtcaatcacggctggcactcaggggtgggctcaagacccaagccccaagccgagccagtgagggacttcaggggctctgagggagctgttggaaggcaatgccagctcctgtggggactctgggagaggagctgggagggtatgaaccttgagcggttggtgcttatggtgtttgtcaccacaagggggaggctgagaaagaccaacagaaatggaaggtgcttccctctgtcattcagttgaacacctagatccagccacacctgaatgcataagcttagaacttggtgggtacatgaacctatcaaccccagccccaccttttggctgaagacagtctgagtcgagtttgagtcctggctaacacggcacgggggaagggaaggcttacttctgcacatccaggaactcgagcagttgggtatcaggaaagaggctcaagttggcaatgccctggctgtagaagctgtcctcccgctcatgaagcagcaggtagagcgtgaagagctctgagtagaagctgggcagcatgaggggcagcaccaatccatgcacctggaggtccctgatggggagaccggaacaggttgggatgagcaaggtggggtctgggattactacttggagtctcgtctcaaagagctcctagttccacaacaaacagtgtcctggcctccagcctcctcctccccagaaaaccttttccaagcctgttctcagtcatcatttgcccaattcaattcataacttcattccctcctttgactttgacaaccaagatggcaggtggggcaggagttggatccccatttgactgaaagcaaaaccagggccccagatggaccagcaacttgcagctgagctctcagcagccattccaggctgattcagttccacctcctggtttgctgtgctaggactccgggcggggaatcctccctaatgtctaaccccatttcccttgcctcctgcaaggcagtgacaggaaggcctctctgatcaggaacactttcaggtctagaatctaaaggcaaattgtaaggtttgctccagggactgggggaaacaaatttcatgcccacctaactcctgtataacctcaggctcatccctaccagccctcggtttccccatctgtgtgcagggagaggagggtgcctcggggagctactcaccttctgcatgcgaaagatgagattgggatcatacatttagaacaaagatgcattcaatgcattgtagcagtgccccctccctggttcctcacagaacagaggtcatgggtcattctaatccacaaacgatcaatgcacaatgtttggtcaatagagtgaatgcccagcacttccccagaagcacctctttccccaagggaggtcctaggagcagacgcatgaggcctccctggacacggcaggccccaaggagacctgcgccagtcaccttgtctctgtgtcttcatcctcctccagggcctggcccttgcgctctaaggcaactcgcagcagacccctgtgagtcaatgagagagaaatggtgtggctgccccttgccacagaactggagttctaccaccagtcaacaaaggcaaaagcaggtggcctctcagaactgtggacatggcctgcagggttcatcctctcaaaccacagaagttagaaggttggagctccaggatgttagcctgagaatccagcagcagaaggaactatagcatctaaggcttctatttgcagtgtttcatggggtcacagcccagcctgggactgcaggtgtgttccgagtccagggccaagctcagcctacagtggggtgagagtgcacctgcggtcagagtcagcccagcgcctggttgggtcttggactctagctgagggctgcagctgggcctttgctctcacctccccaccctctaacccttttgctcagcagctgcacactgaccaagcctctggttcattgttgaatcagacacttggcattcctcccaaatgcaaggcagaactgatgcctggaaagggcacactagtgtcacagggcagtagctgtcccgtttgccaccgagcccacctgtaggcagcccagagttcctgggcatgctgcttcacctcctcctgggccagctcctgcaggtgcttgttggccccgacacctgcgtaggtagcctggaaggtcagcatcagtgtccggagcagctttcccagggggtgcagtgagttgctcagagcctgggccagtgcataggcaacagagagagactaagcactggggtctggagcacagcatgcccacaccagcctcccaacacttctcccatctcatacacgagaacactgaggtcctctgaggacaagggatccacaggcctgtccccttcagtcagcaccctgctatgaaaaatgggagcccttccccaccagggacagtgacaatgtcacccccttggccaccccagcagggctctcaccttcctgaggtacagctgcagggccttgggctcccggtgctgcagcagctcctccaggatgtcttccatactgcccacactgtcctcagggtgggtcctgggcaccacacacagcatccctcacccacacctcggcccagccccctccccccaggaagccctccccagcccaccctaacctgtgcatgctcacacagccggcctcacctctcgcaggacaggtaatcctgagacctacgcagctccctggagctctgcacgtcgaagcccagcagggcctcctgcaggtccctggggcagccagcacacacaaagtcccggaaggggctgtagactccctgccagcggctttccacggggaaggcacccacgcccagctgcctgcgatggggatggagggtgggtgatggggcagagagagatggagctgaggtaggcaggactctgcccaggcccttggaggggtgggggtatgagcctggcccaggatcaagccccaagaagggtggatggattgaaccatgcagagggggctgacctccacggctccaggaggaagagcagcagagaaagggacagagaatctaccctgcgacgagaagacagacagaagcatatggaatcctggaaagacggagacagaaaggtgggcagatctggaggccaagccagagagggggtcttggtccaagagagaccagtgtccaaagtctgggattcccctccaagacatccccctctgccctcccttacagctggttccttcct

SEQ ID NO: 1656 - DNA, 24711 bp, Homo sapiens
gctctgtccagatgctcttttttatttattttatttttatttttatttttatttttgaggcagggtttcattttgtcacccaggattgagtgcagaggtgcgatctccgctcactgcaacctcgaccctccaggctcagggatcttcccacctcagcctcccgagtagctgggaccacaggcacacaccaacacacccagctaattattttattttgtatttgtagagacagggtctcactatgttgcccaggctggtcttgaactctcagtttccagcagccttcctgcctcagcctcccaaagtgagccactgtgcccagccagaggctccagttccactggtgttgggtgaggcctagtgagagggtgggcagagggccttgttgaatctgaactgcagcaagggctcgcagatctcaaaggaggcagggaagtgtgctggggtcccgtcagcatcgcatgaactcagggatggctgcatttgaggccagggtcaggctgtcctcacttatcaggggacaagagctggctgatgccgattggaaaggatagaatcctagtgagctgccccagtcccggtaagcatgagtgcctgcatatcctcgctcttcctcagttccacccccttcctgggggtgtcacaggctcctggcagaaccagagcccatgccctgcatttgggctggcacatttagtggaaccagccagagaaatgctgtccctccttcctggggaagtggtggcaaacagaggcgccaaggctctctctgcccactgcccacatcatctctgggactctgcgggtgccctctgccccaaggctactgccagggactcaggtgtggctgggctttccagagcctccctcaaccctcccctcacaggctgaagtcagtacttcgtttgggggagccacacccagagccaggagcctgacttgctcagggcctagggaatgggaccaagagtgatccagcttcttctccagagctgcaccctgcacaaatccaccctctccctacgctttgccctggacactttcagaacacatcacactgcctgtcatcatgcatctccggctagggcagagggagaccgtgcacgtcacccggcacaatgtgacggaagataaactgtgtggggaagagaaactgaggcccaacaggaataaagctgccccaagacccagctcctgcctctcttggtcccacactagaaccactgtttaaataaagtcctcccctcccaaaggtactcctgctccccaactacagcagggtcctgggtcctgggtctgagggtttattggtcagggcccaggcagatgtcatgtgcccctgttgtccccacgcaggcccacagacatcacaggagaatgatttacaagccacttggggcctgctggcagtgagggtttacccaccccccgccccagcttgctccagtgccgccgtttacgtcatgggtacgtggcctgcagttcacggatctccaggcccatcctgttgactgcatacccagtgaggcttcgagcctgccagaggtcaatacagcccagcagactaaagtcagttttccaaaaggactctggaattcagcaaaatgaatggaaggtcctttacagcgtactcactccaccattgtacagatggcagcactgaggcccggagaggctctggaacttgggagaaaggctcaggctaagagaagccagggactcctcacccccagcctgtgagctgctgcagattaaggggtcattgaagatgggctagtggccaagggaaaaccaccacatccagggccacacccgtcacccctcaccctcatcccagtcagggcagcagcagcatcttcctgtgcaaaacaaaatgctcatctcctccaagagctgcttctgagggcctgtcctgccccttgccttgggtaatgagggacaggctggcagtgccctgctcagctcttcagtctgtccaggaaaggccaggctaccagagctccctggagtgccagtggccaggtaagcggtgcagcctcatgtcttctttctggatgtgctcgtaacaggactggagggagagaggcaaggctgaggccagttgacctgcctgatcccaaccacatgcacaggatctagggctcaatagctgtgtgcacccacctcccaacccagaggaggcgtgtctccaactcagccctcagccacagtctgcgaggaaaatggggcccttcctctcccactgtgcttgggaatgcagcatggagcaatcatggccccagggtccccagggctgggatgcactgtgggacccctccctggctcctttaataagagcaggatcagggacactgtgaggacccttcccagagtcacacatgagctgtgaatttgagctccctcccactatggtgttatgatgtctgggaagggaaaagggtctgccccaggggccagggcatttccacctcggtccacagcccctgtcccttacctccagggctgtgagcaggaagtcatacaggcctcctgtgtggttggggtccatcatgtcacggatcaggtggatctcggctcccaggtgctgaattctggagaacaccgccccaccaagagagcgagggagacaaggagaagaggcctgtcgcggacaggcagctggggaaggagcgctggcctggatggctggacacctggggtgtggtcctcactctacctctagcaccccagcaccctggctgggaccctcccttttctgggccttggcttccccatctgtacagagagaagctgcatccataaaccctggggttcagaggtatcagaagatatcgtggttgggggtgggaccctgcccctgccctgcacccccagctcctgactgcctcaccgggcgcgcgacaccacgtagatgagaagtggcagcaggtcgtccatgggcagcttgtactcccggcccaataccctcgacaccgtgccctcaatttccccgtatgtcctctccagcacctccagcttctcccgtgggtccaccgtggtcctgcagcagggtagctggctccaggtcaaggcccttggttcagtcccaaccaggagcaccccacactctgcctccggacccccaacccactacggctcacactcacatgatcttctgcaggcactcggtggctgacaggaaacacttgtccctgaccagggagtacctctgcatggtggagggagtgggctggatgaggccatggccccccagctctgacatcccctccttcccagggccgggcctgagtcccccgccacccttcccttcactgccagctttagtgcagccccaccctgagggctgagtgacccagggcaagtcacagctccactgtgggcctcagtttgtgcaaccataaaacggggtgaatagtctccatgaggttgggaggatccaaacggataagaagataataatcataacaggcactggccactgggtgccgcccagttctgagtgcctatgtcgatggttctcaaacccaagggcttagtgaaacacaggttcccgggcccactccctgcatttctgactcggtaggtctgaggtggttccaagaatctgctttcctaacaggttcccagatgatcctgatgcttccagcctggcaggcacattttgagaacagctgcctcatgtgcccacttcaccctcacaacaattttgaggtggttctggccaagcgcagtggctcacgcctgtaatcccaccactttaggaggcgaaggcaagcagatcacctgaggtcaggagtttgagaccagcctggccaacatggtgaaatcctgtctctaccaaaaatacaaaaattagctgggcatggtagtgagcacttggcaggcgcctgtaatcccagctactcgggaggctgaggcaggttagtcacttgaacccgggaggcggaggttgcagtgagctgagatcgcaccactgcactctaacccgggcgataaagtgagactttttctcgaaaagtaaataaataaataaataaaataagaattttgaggttgttctagtgttggctcccttttactgatgaggcagctgaggcacggtgcacgagcctcttgcacacggtcacacagccaggtaagaacctgtgtttgagcctggtggttacaggccaacagcttacctccaccacactgggaggtcagaatgacagtgtctcctcccaacccaccctgcccctccccagctcctctgcagcctccgcccagcaatcatgaggcaaagggctcctcaaagcctgcaggacctctgggggcccctggcttggggctctggcctccctctcacctgattgctcgtcagcgtgaggtccttgaggggccacaagtgcctgaaattgaaaaagtgagacaggaggctctgcctcgacaaggggcagagtctgaggtcagagggcaaattccctatgccactgtttcccccggcagatctgggtcctgaaaaggggaaggagatcagcctaggtcatggggaggatggaaggattcctggagaaggcagagctccagaagctccagggaggtaagggcggcccaggggcttgtatgagccaggtcgtggtgaccagtagagagggaggggtgaggagactgcactccatccaggaggctctgctgagccagcacagggctgtgagcagggggatgcagccctcatgcagcagaggtggaggctggtgtggggaagcgacactgaggtggtgagggaggcggggcatgcttgggaagcactggcagccaggtctttaggctggtggctggtcagatgcaggacacagtcaccaagatagaggaagaaacagggatttgcagggtgggtgggaagcaccatccctgtgtaacaaaggagacctggatgtgggagcagagacagtgcccgtgccctctactgtggacagtggggtcacttgtggcatcaatggatagatgggacactgaagagaaaggacattttggagactgagggtggaagggaggccctggggtgtggtaaacacctcccgacatgcacccagagcagtcctcagtctcccctgagggacctcctctcccctactctcagcccaagtgctcagagcaggtgatcttgccccagcctcagcagtggatattcaggcaggcctggtcaatcacggctggcactcaggggtgggctcaagacccaagccccaagccgagccagtgagggacttcaggggctctgagggagctgttggaaggcaatgccagctcctgtggggactctgggagaggagctgggagggtatgaaccttgagcggttggtgcttatggtgtttgtcaccacaagggggaggctgagaaagaccaacagaaatggaaggtgcttccctctgtcattcagttgaacacctagatccagccacacctgaatgcataagcttagaacttggtgggtacatgaacctatcaaccccagccccaccttttggctgaagacagtctgagtcgagtttgagtcctggctaacacggcacgggggaagggaaggcttacttctgcacatccaggaactcgagcagttgggtatcaggaaagaggctcaagttggcaatgccctggctgtagaagctgtcctcccgctcatgaagcagcaggtagagcgtgaagagctctgagtagaagctgggcagcatgaggggcagcaccaatccatgcacctggaggtccctgatggggagaccggaacaggttgggatgagcaaggtggggtctgggattactacttggagtctcgtctcaaagagctcctagttccacaacaaacagtgtcctggcctccagcctcctcctccccagaaaaccttttccaagcctgttctcagtcatcatttgcccaattcaattcataacttcattccctcctttgactttgacaaccaagatggcaggtggggcaggagttggatccccatttgactgaaagcaaaaccagggccccagatggaccagcaacttgcagctgagctctcagcagccattccaggctgattcagttccacctcctggtttgctgtgctaggactccgggcggggaatcctccctaatgtctaaccccatttcccttgcctcctgcaaggcagtgacaggaaggcctctctgatcaggaacactttcaggtctagaatctaaaggcaaattgtaaggtttgctccagggactgggggaaacaaatttcatgcccacctaactcctgtataacctcaggctcatccctaccagccctcggtttccccatctgtgtgcagggagaggagggtgcctcggggagctactcaccttctgcatgcgaaagatgagattgggatcatacatttagaacaaagatgcattcaatgcattgtagcagtgccccctccctggttcctcacagaacagaggtcatgggtcattctaatccacaaacgatcaatgcacaatgtttggtcaatagagtgaatgcccagcacttccccagaagcacctctttccccaagggaggtcctaggagcagacgcatgaggcctccctggacacggcaggccccaaggagacctgcgccagtcaccttgtctctgtgtcttcatcctcctccagggcctggcccttgcgctctaaggcaactcgcagcagacccctgtgagtcaatgagagagaaatggtgtggctgccccttgccacagaactggagttctaccaccagtcaacaaaggcaaaagcaggtggcctctcagaactgtggacatggcctgcagggttcatcctctcaaaccacagaagttagaaggttggagctccaggatgttagcctgagaatccagcagcagaaggaactatagcatctaaggcttctatttgcagtgtttcatggggtcacagcccagcctgggactgcaggtgtgttccgagtccagggccaagctcagcctacagtggggtgagagtgcacctgcggtcagagtcagcccagcgcctggttgggtcttggactctagctgagggctgcagctgggcctttgctctcacctccccaccctctaacccttttgctcagcagctgcacactgaccaagcctctggttcattgttgaatcagacacttggcattcctcccaaatgcaaggcagaactgatgcctggaaagggcacactagtgtcacagggcagtagctgtcccgtttgccaccgagcccacctgtaggcagcccagagttcctgggcatgctgcttcacctcctcctgggccagctcctgcaggtgcttgttggccccgacacctgcgtaggtagcctggaaggtcagcatcagtgtccggagcagctttcccagggggtgcagtgagttgctcagagcctgggccagtgcataggcaacagagagagactaagcactggggtctggagcacagcatgcccacaccagcctcccaacacttctcccatctcatacacgagaacactgaggtcctctgaggacaagggatccacaggcctgtccccttcagtcagcaccctgctatgaaaaatgggagcccttccccaccagggacagtgacaatgtcacccccttggccaccccagcagggctctcaccttcctgaggtacagctgcagggccttgggctcccggtgctgcagcagctcctccaggatgtcttccatactgcccacactgtcctcagggtgggtcctgggcaccacacacagcatccctcacccacacctcggcccagccccctccccccaggaagccctccccagcccaccctaacctgtgcatgctcacacagccggcctcacctctcgcaggacaggtaatcctgagacctacgcagctccctggagctctgcacgtcgaagcccagcagggcctcctgcaggtccctggggcagccagcacacacaaagtcccggaaggggctgtagactccctgccagcggctttccacggggaaggcacccacgcccagctgcctgcgatggggatggagggtgggtgatggggcagagagagatggagctgaggtaggcaggactctgcccaggcccttggaggggtgggggtatgagcctggcccaggatcaagccccaagaagggtggatggattgaaccatgcagagggggctgacctccacggctccaggaggaagagcagcagagaaagggacagagaatctaccctgcgacgagaagacagacagaagcatatggaatcctggaaagacggagacagaaaggtgggcagatctggaggccaagccagagagggggtcttggtccaagagagaccagtgtccaaagtctgggattcccctccaagacatccccctctgccctcccttacagctggttccttcctgtggttgatcccgccctggccaacaggctggggcctggctgcgcatgtctaatggagccctgcactccagtgtcatgctcgtaggctacacgcagcccacactcacacccaggctggggcctgcccctagggattgctgtccactcccagctcctgctgtcagggagaagcagcatgcagggacagcgggccaagtagtcaactgtactccctccctacatctgaaatgctgcctgggaccacttcccattagaactgccacccacacagattccttcctctgtgcaatactgagtcttcctcaacagacgcaacaagagcaactgttttccaaggaggaactctgttcctacaggaaaagaagtctatccttctctggaatactccttgataatgactgtgattccacttagcaagtttccttctttaccttggctgccaggaaactcagagccaggctcaatgatcagttgtaaatgccgtaggacatgtctacatatccctttcttttaaggttaacatatgctcttattttctattttttttttcctgtatgtttggtttgtaaaccgtattgtatcctttcgagacaaaaaaaaaaaaaaagcaggacctaagcaaagcctacaaataatatttctctccagttttgtggtgtaccgcattatatccacacagcccctgatcccaagagtctctgactggagttgtacaccctgggctctcggaactctctagagggctaagaggtgggtgcaaaaaggcccctctgaggagacctgagtctttgggatggaaacacagacacatccccagataggcccagagccagaggggccaggcactcacctcttgcaggtactgctcgggtctggtgggagggcagccgtgtccagcacaccctgtgtgtgcagtcctctccctgccccactgccgaacgagccctccagggtgaagccattggggaaggtgaccttgccctgggagccaggagaaggagcagggatgtctgtctgcccagttacccttccagccaatcatgacaggccacaagcctgtccatcagtgtcagagaggctaaggactaatgaatgggcttcccgccatccattcaagctgctccatgctgaggggttcataatcctctatgcctgccagagccccccaccaacagctgtgcccacgtctcaggggctcgctcacctctgaggtaggaagaggagagagatgcagaagggactcacaggcaagagtggggagaccaccactgaggggctggggtgggggtaagcccagggacaggcaacgcctgaggagggcggtgtcttgccacatgaggctgtcccattcatagcaacctgatctccacccctttgctccagtcattatgaaaccaaaacagcccctacatttccaaaggctccagcggggacacattgccttttcctgggttagctcagggaggcacacactgaaggccagtgcctccagggacagctgctcgaggcactggtactggtggagggcgtgtattctgaactaggagggtatggagggacacagccaggagaccaccggtaccctctggatagcaggcaaggccactggtcccctctcacctcactccagaatcaatcgcaactctgtggcagggtggagttgctgtgcccactccttggctccaagggaggtgggacaggccctcccctacctgcccccagccctgagtctaagtggggagattacagacaccaaccaaggccttggcagggtgtggaggggggcctcagtggtcctcaccttccccatgagggtcaggtccctggtgaaggtgccctcatacagggagtcgtcttcagagaggaggatgcccgggcccttggggagaggaagccagggagggtagaaagggtgggtgaggaagggccaggaaactcagggtggagagagatggccaaagaagggagatgtgccctgacacatggcgagaggggccctgagcctcatcacgccccacaggactgtacctaattgggactctagcctttggcctgctaagcaccagccccgaggaccccatccctggatttccccaaatgacaccctccgccctggctcctcaccccagcggcttcttcaggaagcccttgggagctcaagaaatgtggggctttctctgaaacatccctgcttccctgcttgtcactggccctgggaacggcagagctgaccaggctcccttgccccatgggctgccgggaagctcagagccgaaagggttacaattagtgttcggcttatttccaaatctattttgtgtacttattcttccccttgtcttcctctttccttgaaggcctccttcaatcctttcgagaatgaagtagagcataaacaaaccaacagaccataataacaggaacagccatcaggccagagccccacattccccaggcacctggaagggtatgggtgaggcaaacatgggagtcccaggctcggcggccaggctcagcagaccagggtgtgagtgtcagctctgccactcagtgaaggtgacatggagcaggtcctctgatccctctgaacctctcatttgtcattcactagggacacactagggataataatgacatcaacctgcagggctcttgggaagatcccacaagatcagggtgggagcttagcccagagccaggtgtcaagttaggactctgtgaatgtcagctaatgcatcatcatgagcaagtgctccattcttgttagttcattgagtctatggtaagtattcttaacctgagttgctgatggggaaaccaaggtcaggcagagcagggattggccagggccaggggaggtgggtggtagagctggcttcctgcccaggttctggctccctccagcacccaggaacacagccccctttcccatccctccctgaaaggcctcagctcagcctcagtgcccccagcgggagtggggtgcaaagagagggatagcccaggatacactccactcaccaccgtcttgtccgcctggaaggtgccctggtagcagacacctgcctgggtgaccatgacccctgggccgtggcgctgaccagcctgccacatgccaatgtagcgctcacctctggaaggagaggaatgtggccagagttggatcagactcattcccatgtacctcctgggcactctgctggcacggggcggcagggagtgcagataaggggcagtgacatcacctgaatccactcaacagacacagtgccagagaggtcaggacccccaagaggaatagagaatggaggagggagggaggcagcctgggaagggcatctgggaggcttctccgtggaggtggcaggaaggacagggggaataggagtgtgtgcaaagccatggaggtaggagcatgtgatggatacgtggggacttcagtggtccagaaaggctggaggggtgcccaggagacgcagctggggtgaggtcagagaagcaggcgaggctgtgattgccaggccaaggatccagggctttatcacacagcccagagagccagcaagggctgcagtttttagacgtgacagagcagggggtcagaaatgcctctccaacaccatgaggaggggtgaggggcgggggcgaccctgcagtcagcgtgaccaagattcgctcagcctgagcctccgcagcaaccgagggactggaggggaagtgaggggcttaagagagacacagtgggggacaaacaggagcctgtgtcctgcaacaatctggtctgtgagggcccggtccacccctccgtcctgggagtggtggctgcagggcgctcacctgtcaccatcctcctcaatgccatagccgctcctctggcccctctcccagtggcccgtgtacctgaagggctggggggcctgcggaccactctcaaggaccccaaatccgtgccgcaggccctcctggaagtagcccttgtacacctcgtcggtgctgtacctggggagggccatcaacaacgagctctgcctcatggagctcagcccagaggatgggcccagcccatgaaccccccagccagggtcacttactcacagatgccgtagccacacatgctgccttctcgccagtgacacttgtaacagtcgaacttgtcctcagaggcctggggcagcaggcggatgccgaagctgacagcatggttgtgggggtggggatcagccctgacctgagacgcccattacacctactccatgccacccaggagtatccctgcccccaaggagccttccagacaacagggagactctcagaggccctcagccttcctatccttcaaagggcccctctcaggacccctccctccagcctggtcccgagcaccttggagcaccttttggcctgtaccactccctctgtgacctcgagctgagacgggccccctattcaggcccccggttcccctttggtacagtgggcgggggctggaccggattgtctctaagttcctgcttgaggtttgggaattcaggatggggccgggctggtgaccacagcaggggaggaaagcacccttcagcccactgcacgcctcccagcagtagccccagccagccttacccatgctccaggccctggcagaaattccccacgtgattccgcccatccggccatttcagggttcccctggaacacagtggaggttcacgagcctcaggcctacccacccctcagcaacctcagccacctactttctcagacgccctcccttcctcttcccttggactgggctccctgcacccacccagccctcttgtctgagctccgaacattccttgcagaaagcccctttagcccttttctactcctggcccaactgtaccagcagcctcatggggcacactcaccacatcccataaggaaagccctggagacatctaggttcccttttttcccttgaccaacaggaagctcagagctaagaatcaagctcaagtttaatgctggtctgtggggtttctaccaccctcctccccacttctgtgttttttctgtccttttgttcataagtcttctcgagccctttctgaaaggaggcagggtatcagaaactagcggaggtgcttgagagtgtagccttgtgagtcccttctgctctctgggtctgttttcccagctgtggcatggggtggggccacatggtctataaaggcttgcctgtctgtggggtcacacagacctgtgattgaggccggctcaccctatcacttgccctgagaccttgggcaggttatgcccatcactaggcctcagtgtttgtacctatgaaatgggtaaaagcactccatacagagcgtcttcatgaggaccgatggagatagaatgtgtgcaagccatttcaacactgccagacaatgaggtacagatgtgagaattattctcccaccctcctaagaatggaatggcacctgcaggctgtaaggccagcgcgtggttgctgccccttgtcctctagcgtcaccatcaagactttatttggcacagactgtctctgggccaggcccagtccaagaggacttaagagggactctgagaattgactgtccacagagagtaaccgctcctggaacatgtcctgagacaattaggcttgtgtgctgctctctgccccgcagacccccagggagtcccaccttgccacccagagctccagccactcacttgccgtggggccggcccctgcaccactcgccctcgtaggtggcctggcagagccggccctctgcctggaaggtatattctgcgcagcggcagtcgggaggctgggagggctccaggccagcccccagcacggggaagtccttcttcccatgcagggcctggtgaacagcccaggtcaccttccactgccagactgcctggtgggagggggaacatggggaaggggatcactgctgctggaggctttccctccaggaagccttctggggtagctccaggtaccaccccctccaccctccacctcctactccattttgtcaccttggggacccttcaactgcttcttgctactctctgggccctccacccaacctgagatcctcctctgcagtttcagggcctgcccagaggggccaaacaagacctcagggcagggatcaacacaggacccaattctgtctttagaaagaaaaataccctgttctttttgacattctaattcttgaccccgatttactctgaccaggtccccagaagcctgccagacactcgccggcactcctgtggggccctgcagggttgcatacttctgccctcttcctaccctgtcctctgaccccgctcccgcagttcacagctcacccacactcacctggccctgggagtccttggcacaaaaggagaactcttcttcgggcgtgaggaggtgaaacgtgcacctagacagacggaggtgatgagtaggccccagctttgtccaggagggtggaggggcccaagccagagtcccagggtgtgggcaggtgtcatgggggtaaagggaagaaggcctggggtgtcagccgagggggttgctcacccgtcctgcccaggatccacccacaccagcttcagatcaaaggtgtggacattgtggccctggaagaggatggacacaggagtcatccagagcccaggccagatgctcacctaccctctggccaaggcttgccccaagctcaaccttgtgtggccaccaaggctattctgcccagcatgtccaggactgagtccctctcccctctggcttgctccccacctcagggacagctcctccatgtcctttctaccccagagcttggccaggaactcagaaccagcctctagccccctgtggctaccagagtggtctacaaatgaagctgggacctggtcaacccctgctggaaacctctctatggctcctactgcctgggggttgagacactgctgagcctaacatttaagacctcacagaccactacgccatcagggccactccacaatcacaccttcatgagcttgccccaacctctcctcactgtgaacttttgctcatactgttccttctacctggaatgccatcctgctctgacagccagaaaaaaagccccttcctatgggaagattttgtgtagcaacttcctacccggcccagtcaggccaatcactgctccataccagaatggggaggacgtgggaggcccaggcctgaggggtgaggaggagcttgccagccgcaggccagggacaagagatggcccaccagacacaacagcatgtgcaaaggtccagcgtcaggagagggctagcacagggaagggacagtagctcatcagtgtacctggagtggagtgtgaagttgggagtggaggggaattcaaactaaatcagaaccaatcccaaaatcaggcttcaggggacacaggtctaggctgggcagcagcttcctgccaggccccggccacctgtctgcaagggggttccaggccaaccttctaaggggtagagaagactgtgctgtggacctcaccaggacaacatgatttcaggatggatgaaccacagttggtgactggccatgtaacaattcccagcctcaggcctggctcccttctgacttccacaatgctgaaagcccaggcactgctcctgtagggtacttttctctagaagccttctcatccagccctccttagtcacccctcagtcacccatgactttctgtctggggttcctctctcatttgagtacaatgggaactaagagttgtctggtgtctactgtagaacaaactcactcacaatgacccccacattcccgatgggaaaacgaaggtgaagacatgtaaccaaggacaccagctgggaagggctgaagccgggacaaaccctggacagcctttcccctcagcccatgctcctctggggacagctccagtggaccgcccctccccaacacaacgcctttctatccctgaccatccctcccagcccactttctcagtcccagcagcatgcccctttactgctccttttccagccagaccccagaaccctactgtggcctcaagaccttgggtcagccccaccccaacctgcagcaggacgagggcatcatcaaagagcagcacacgctcagcccgcaacggtgcgaccgtcacgggtacgtcctggctgtcctgaaggagtctgtgagcaggggtgcagagcacatcctggtggggcaaagaggacagtacaaggcttaggcacctctgtcctgcaagctgcctgccactctgccacctcccaatgtaccccagacacctcccagaggccccctccagtagacctggagcggaccctgggtcagagataggcagaaatgcactgattatacattcctggctctcttgaagcttcagtgtcccctcccacacctctgtgccacggccccagccatgcccctatcagtcctctcccagtactcggccacccctgcctcccttccacaattctcgttcctctacctagtctcctaattctccacaccaggtccaaacctcagggcacaggggactctcctccctgcaggggcagtccatgccatggtgggcagtgacgcaagggtgtgatcggtgatatccccaggggagaggactggttctgctgattgcctcttccctaggccgggtcagggcctggcccaggacgtgctcagcagacagataagaatggctggacagagggaccttacagccacctgcttcagccatcactcccccttccatatagggaaactgaggcccagagaatacagcaagcagctcaagccccccaacatctccatgcccaatgtggaaccccctccctaactgcccctcaggcccccaactcaccctcagccggcctctcagggtgtgccagagagcctgtgtggccacagcctggtccaactcctgcttcatgaaggactgcaggttcccaaagagggtgactgcgttcaccaccagctcccgggttgggtgatgctgaagggggacagggcagccagtgagaggagagcttactggaatcttccctagcccagtcctggtcccggctggtggggaggcctgaatctaggccagaccttgcccttctctccctgacagctcctcttctgctggtggggcagggggtggaatatgaaggtgcttccccagcttggccctgggcccacgtgtcctcattcccaggacgtgattctacccctgctctctgggtctctgctggctctaccagggcagggccacgtgcctcagacaccgcagggaagggcagtgctttcacccactaagattccctaggacagaaccatgtcttcggaccccctcctcagggctgggccacgtcccccatgtcccctgaaaaccacaggacaggcctgtgacttcctcaaccctctcccacctgccggcatggctgagtccttcttgtactagggttcctgagtataggctgagccccctgagtctgggccctatccctcccttccctcggcttccccacatgctgctgcccctggtacccacctccccaatggtgtccccgaggctcagcaggaggagcacgtactgttgcacgtgatgggcgagtggctggtggagggcctggcccagcgatgcgcccaccgagccctctgagctcacacctgaaagcagctgccgcagcgccttccgctggccccgccagtactcgctgcgtgtagagagggccacgcaccaccttcaccccttcctccattcctgcacccacaccgccacctccctgccccagctaatcccctcagatcccagggccagccccaggcccaaaacctctaccctatcagatcaacacagtacctgagttgccctcacaggtttaagagcaatatctcagagtatgaagggattgctgatcacaaccatccaccctgaagggattcccctccttccccgccccaaggccagcccagctagagcgggtctggattctgttcctggcctcactgggccttccctgtttctcttccagtgtggatcagtgcagatttgtagagccaggagtcctccaggatgagttgtgggctgtgacacctgctgctctggggagggggcttccccgaccccaccctcactcaggcactcccaccctgtcaggggccagtgcaccagccctgtgctcaccttctcctctttgctgccttctggaaggcctgcaccaccatgcagcttgtgtaggactcaatgtacctgcaggcagcacaggggacaccctgcaaacccagtcctcagccccagacctaagcccctggtccctgggatccccagatcccacccactagtcagctgcagccctgagggcccacacagtggcctggctctgggcactggagacctcaactcctgggccaacaagacaattctaacatacagtctgtcttccctgagaggccccaagcctcaggtctggagtgtctgagcctgctgtcaggcgaatacccaagcccaggtgaggctgaacccaggtgagcaccaaccatggactgagcccaaacctttgcttgaaccctgacccatgtgagccccaaccccaggtgaaccttaatgccaggtgtcactctgacaccagggatgagccccagccccacctccagtggtcttactctatgtgggcctgcagtacacggtcagcacctcgcagcagcagcagggactccagaccggtggagtccgggtaacgcagcctctcctgcagtgagtgcaggctttcctccgtcacctcccagagttgctgggagctcttgtgcagctgttgcaagagccgcaggcactctctgccccagggatccgagggatctggggctggggaaggagtacagtcacactgtgagtagaggacgtgggctccatctcccagggaacatgcacaggccccaggtgttcacatgagagccaccagcaccggccagccctggagctgcagcagggtctgcatccctgggatccgcaggacagaattggtgaaccctagagctgagcaggggaagggcaggctggagcagtgggcagtatcctcgaggaggaaacaggagacacacccactcctcactaaacagggacaaccctgacagcctcagggaactaagtacatacacgaattcccccctggctctgggcctcctcatcctggactactcagatccagaatgtgaagtccacagggtcacacagtcctctgccatttcacagatgcacagaggcacctgtccaaggcctcacaggtgagaattaaactggaagtaaaacctaggcatcctgttccagtcagtcttgttcccctcccggcaccatcaggtgccctaggtgggagcaagatgaaaattcaagcaaagggcagtttccagttttttaccctgggaaaggaggaattccatctctttgtacagcctggtctgggctacaggtaggttcatggcctggcccctcagcgttcctttaaaaaaggagcagtcagacttggcgcagtggctcatgcctataatcccagcaatttgagaggctgaggcgggcagatcatttgaggtcaagactttgagaccagcctggccaacatggtaaaacccgtctccactaaaaatatgaaaattagccaggcgtggtggcaggcacctgtaatcccagctactcagaaggctgaggcacaagaatcgcttgaacctgggaggcagaggttgcagtgagccaagatcgcaccacctgcatcagaagatgctgataccaggtgtcaccactcctatttgaggttgagaaagctgtggctcagcaagtccaacaaggtaggtctcctgtccctgggatcattcctcggtgcccttccctccccactagaaagcctagactcaccggctgggagcaggggctggaggacaaggctgttgacatgggcgagggtggctgagaagacctcctccagccgcagcagagctgcctcctcagggttgcacatggccaggtgccggactcagggcctcctaggtagggcacaggttacagctagatagcacagacaggagcaaggccagtgcccatcctctcaggcagggtgcccagaagcaaggtccatgaccacccacatcagaactgagcagtgagcccagatcgcctcaaaggggagttcctggactggccactgacctctgccctgctccctgcctaggcccagctgaggggtccctgaaggagagagagagctcagagctgccaagggaagcaaccctttcttccccaaagggtagatgttctttaagcccagtttggcctgctcattcctctgctcaaatatccaccatggatcccaagtgcccaggatagtattagtagtgccctggtcttagcctcctttccatcaagtctcccttcagggattctgcagtctctataaacagggtcatactgtcagaggatcccagccctgtcctctagcccatggttcgggactccctgtcacccaaccaggctgtgtaagcaaggagagttttggaggtatgggggagtccggaggcctcctgctagagccacgaatgatgggcaagaaatgaaaaggaagacaggacccagcaggcaagtggaggaaccctgagagtaaaggctcatgggtgtgagggcccagcctctgagggcagcccaccaagcagcaccccaaaggaccacagcttcactgtgcctcagtcggccgtggacagccatggaggactttagagcaaggtaatgatgggatccaaagtcacatttggggaaataaatgtatgacagttgtagaggagatagtgccaggcagtgagagagagttcaatgtggatgggagcctggaccctccatggtcccctaaccagacagagggatcactgatcacaaccatccaccctgaaggggtgcctgctggatgggtgggggcccttggggtgggcaggtgggcttgagccttgagatttcctgccctggagtgagggaccttccaatcaggcaggaatcacctgggaatgcagtgtcctgcctaaagggaggggtgaagagaggcctgggctcaaacctacccccacagccaggctacaggctctactccaacaaagccctcccctaccagaccctggtaccctcacttggcaatgttcatctgcccaaatgacctgatcaggtatctggggcggagagttagagggtcttttagcccaagacccgcagactgtctctctccttgtctctgacacgctgaggctttggagttagccaacctgtgtggggcaggggacaaaatcagggcagccaacgatgggcaggtgacacaggcagacccaaaagggtgagtgggaaggggtctcagccctcccctctccaccctgccccgagagtgccatgcgggcatcccaggcccctggcagagcctacaactcccagggaattggctctggaatggagtggggcgggtccctcagagctctggccaaaggcccaggccaggcattcctgccccacctttcctgctactgctgcttcgagagggtgaggctgcagagagagaggcaggaaggggaagccaccagacacccagctgcagcttctgtgctgcagcttcttctccctctgtgggcccctgaggcagacccaggcccccaggacacagggggctccaggtcagctcaggcagacaaggaaagcccagccaagggaataggggtgcagccaggcccacctaactctcacccgtatctcccgaaactgctggaatggaaaggcgctttgggggtgaccttttcactctcagctggcagtcagctggggtctaagctaagaggtgaggatatccaagcctggttgggaaggtagaagaaagggtgaggctaggataggagatgcagactaggaaccagatcagtgcacgttgaaaagatactgcagtaaataactcgctgctaggaagacttgaacaccaacatccctacactctccggggggccagcaccatgaccccagccgacaccataccctggcaaggagctctctgaccctagagatagcctctcctcctcaggcttcctgtccctcgtccccactgcccagtctcagctgctcccccaggagcagccctcacctggctgctcagccctggacatgcttcaacttatccacagccttactcctctctgtacctcagccacccctctacgaaatgggggttcaaccagatcacagcatttttttctttttatttgtttgtatttctttctattcttttttttttttttttttagagatgggatctcactatgttgacgaggctggtctcaaactcctagcctcaagtgatcaacccatcttggcctcccaaagtgctgggattacaggcgtgagccactgcgcccagccaaagaggatcacagcttttcaaactacttaagtctcccctcaaaaggacaaacaggtggaagggggcttctctgggtgtggggatctggtccttagactccccaccccacaaagcagcctatgactccgggggtgagtcctccagactcaagttggcaactgttaatctgggagtcttccacatctgtggccccaaagggatctataaccctgggaaactgagtcacaccacccagaggaacgggcagaagttaagcatggctggtgaggcagtgggttgggggaaggccgcagtggaagctgggattctggttaggtgaccctgagggacccagctcccaggctagggagtctggggcttcatcctggaagtgatgaggagagtgtaagtgcaggggtgaggcagcgtgaatgtgcatgagtgtgcacgtttgcagggcaggaggaggaggtgctgaaccttaatatgaggaggatcctgcaggagtacccccctccccaacccctgtcccatccctaaccttcccccttccagtcaagggcatagcttcctcaccctctccctccctccagttcaaaggttccttagtgacaggctgtgcctaatgtacagatggggaaactgaggcccaggaacaatgggagggtccagagacccttgtgtagaacttgtgcagggctcagacccagacttctggctccagcccaccaggttcacctagctagatggctcagagagggtgggcaactcacctgaggcacagagcaagatcctgacgggccctgcctcacagctgtcctcaggcagccctgatgctcaccacggggtgcggtggggtggggcagggtgaggacagaactggccagtcacggcgtgcccaggtgagtcagcggctgcccctgtggcgctctaaccagtagccagacctggtctctcctctgcattcctggcctctgtccacgctaggtccctcccgggcagggtcactggggccttccctgtcctctcccaggcctggctccttaggcccctgacacaccttgtcgtgacactcactcactctggtatttcctggtctgaacaggcagggaagttctgcctgctgtggaggctttttcatgggctgccgtggcagccccttcgttgtctggtgcccagtgggggagagtagagacacgcactgccccagggagggggcgctgaactgtcacacctgatccctcagtctcatgctcgcctctccccgctgcacccttcctcggccccaccatggctacaagcctcttgtcctagacaagcacccctccctgctgtcgcatatgtcccagcttcccttcctctccctgcccaggcacacactcagtcgctggagtttcccagacccgagctcctgttccggccgccaggcatttgccatgccgctcccatgcgaaaaggccacctcctggaatcccgggtcgggcccttccgccctaaccagccggcgtcacctcctcctggcagtctctcctgctggctggggccccgtggccctgccaccacggctcaggtcaggcccggggcgctgccccgaacccaagcaggctagcagccaggcagggaggacgacgctgtgagcggggtatcttacgagggactcggacggccgggggatgactgccgccgggaccaaggagctgggcggggaccgcagcagccgaggaggcgggagcccccacctggacgagctaagcgtggagcgcagacacccgtccgcagacgcgcgcccttcgtcgcgcccttacctgagcgctgtggttgccccgcgccgggactgcctgtgcggctcctcgctcgcacccccacc

SEQ ID NO: 1657 - DNA, 24663 bp, Homo sapiens
gctctgtccagatgctcttttttatttattttatttttatttttatttttatttttgaggcagggtttcattttgtcacccaggattgagtgcagaggtgcgatctccgctcactgcaacctcgaccctccaggctcagggatcttcccacctcagcctcccgagtagctgggaccacaggcacacaccaacacacccagctaattattttattttgtatttgtagagacagggtctcactatgttgcccaggctggtcttgaactctcagtttccagcagccttcctgcctcagcctcccaaagtgagccactgtgcccagccagaggctccagttccactggtgttgggtgaggcctagtgagagggtgggcagagggccttgttgaatctgaactgcagcaagggctcgcagatctcaaaggaggcagggaagtgtgctggggtcccgtcagcatcgcatgaactcagggatggctgcatttgaggccagggtcaggctgtcctcacttatcaggggacaagagctggctgatgccgattggaaaggatagaatcctagtgagctgccccagtcccggtaagcatgagtgcctgcatatcctcgctcttcctcagttccacccccttcctgggggtgtcacaggctcctggcagaaccagagcccatgccctgcatttgggctggcacatttagtggaaccagccagagaaatgctgtccctccttcctggggaagtggtggcaaacagaggcgccaaggctctctctgcccactgcccacatcatctctgggactctgcgggtgccctctgccccaaggctactgccagggactcaggtgtggctgggctttccagagcctccctcaaccctcccctcacaggctgaagtcagtacttcgtttgggggagccacacccagagccaggagcctgacttgctcagggcctagggaatgggaccaagagtgatccagcttcttctccagagctgcaccctgcacaaatccaccctctccctacgctttgccctggacactttcagaacacatcacactgcctgtcatcatgcatctccggctagggcagagggagaccgtgcacgtcacccggcacaatgtgacggaagataaactgtgtggggaagagaaactgaggcccaacaggaataaagctgccccaagacccagctcctgcctctcttggtcccacactagaaccactgtttaaataaagtcctcccctcccaaaggtactcctgctccccaactacagcagggtcctgggtcctgggtctgagggtttattggtcagggcccaggcagatgtcatgtgcccctgttgtccccacgcaggcccacagacatcacaggagaatgatttacaagccacttggggcctgctggcagtgagggtttacccaccccccgccccagcttgctccagtgccgccgtttacgtcatgggtacgtggcctgcagttcacggatctccaggcccatcctgttgactgcatacccagtgaggcttcgagcctgccagaggtcaatacagcccagcagactaaagtcagttttccaaaaggactctggaattcagcaaaatgaatggaaggtcctttacagcgtactcactccaccattgtacagatggcagcactgaggcccggagaggctctggaacttgggagaaaggctcaggctaagagaagccagggactcctcacccccagcctgtgagctgctgcagattaaggggtcattgaagatgggctagtggccaagggaaaaccaccacatccagggccacacccgtcacccctcaccctcatcccagtcagggcagcagcagcatcttcctgtgcaaaacaaaatgctcatctcctccaagagctgcttctgagggcctgtcctgccccttgccttgggtaatgagggacaggctggcagtgccctgctcagctcttcagtctgtccaggaaaggccaggctaccagagctccctggagtgccagtggccaggtaagcggtgcagcctcatgtcttctttctggatgtgctcgtaacaggactggagggagagaggcaaggctgaggccagttgacctgcctgatcccaaccacatgcacaggatctagggctcaatagctgtgtgcacccacctcccaacccagaggaggcgtgtctccaactcagccctcagccacagtctgcgaggaaaatggggcccttcctctcccactgtgcttgggaatgcagcatggagcaatcatggccccagggtccccagggctgggatgcactgtgggacccctccctggctcctttaataagagcaggatcagggacactgtgaggacccttcccagagtcacacatgagctgtgaatttgagctccctcccactatggtgttatgatgtctgggaagggaaaagggtctgccccaggggccagggcatttccacctcggtccacagcccctgtcccttacctccagggctgtgagcaggaagtcatacaggcctcctgtgtggttggggtccatcatgtcacggatcaggtggatctcggctcccaggtgctgaattctggagaacaccgccccaccaagagagcgagggagacaaggagaagaggcctgtcgcggacaggcagctggggaaggagcgctggcctggatggctggacacctggggtgtggtcctcactctacctctagcaccccagcaccctggctgggaccctcccttttctgggccttggcttccccatctgtacagagagaagctgcatccataaaccctggggttcagaggtatcagaagatatcgtggttgggggtgggaccctgcccctgccctgcacccccagctcctgactgcctcaccgggcgcgcgacaccacgtagatgagaagtggcagcaggtcgtccatgggcagcttgtactcccggcccaataccctcgacaccgtgccctcaatttccccgtatgtcctctccagcacctccagcttctcccgtgggtccaccgtggtcctgcagcagggtagctggctccaggtcaaggcccttggttcagtcccaaccaggagcaccccacactctgcctccggacccccaacccactacggctcacactcacatgatcttctgcaggcactcggtggctgacaggaaacacttgtccctgaccagggagtacctctgcatggtggagggagtgggctggatgaggccatggccccccagctctgacatcccctccttcccagggccgggcctgagtcccccgccacccttcccttcactgccagctttagtgcagccccaccctgagggctgagtgacccagggcaagtcacagctccactgtgggcctcagtttgtgcaaccataaaacggggtgaatagtctccatgaggttgggaggatccaaacggataagaagataataatcataacaggcactggccactgggtgccgcccagttctgagtgcctatgtcgatggttctcaaacccaagggcttagtgaaacacaggttcccgggcccactccctgcatttctgactcggtaggtctgaggtggttccaagaatctgctttcctaacaggttcccagatgatcctgatgcttccagcctggcaggcacattttgagaacagctgcctcatgtgcccacttcaccctcacaacaattttgaggtggttctggccaagcgcagtggctcacgcctgtaatcccaccactttaggaggcgaaggcaagcagatcacctgaggtcaggagtttgagaccagcctggccaacatggtgaaatcctgtctctaccaaaaatacaaaaattagctgggcatggtagtgagcacttggcaggcgcctgtaatcccagctactcgggaggctgaggcaggttagtcacttgaacccgggaggcggaggttgcagtgagctgagatcgcaccactgcactctaacccgggcgataaagtgagactttttctcgaaaagtaaataaataaataaataaaataagaattttgaggttgttctagtgttggctcccttttactgatgaggcagctgaggcacggtgcacgagcctcttgcacacggtcacacagccaggtaagaacctgtgtttgagcctggtggttacaggccaacagcttacctccaccacactgggaggtcagaatgacagtgtctcctcccaacccaccctgcccctccccagctcctctgcagcctccgcccagcaatcatgaggcaaagggctcctcaaagcctgcaggacctctgggggcccctggcttggggctctggcctccctctcacctgattgctcgtcagcgtgaggtccttgaggggccacaagtgcctgaaattgaaaaagtgagacaggaggctctgcctcgacaaggggcagagtctgaggtcagagggcaaattccctatgccactgtttcccccggcagatctgggtcctgaaaaggggaaggagatcagcctaggtcatggggaggatggaaggattcctggagaaggcagagctccagaagctccagggaggtaagggcggcccaggggcttgtatgagccaggtcgtggtgaccagtagagagggaggggtgaggagactgcactccatccaggaggctctgctgagccagcacagggctgtgagcagggggatgcagccctcatgcagcagaggtggaggctggtgtggggaagcgacactgaggtggtgagggaggcggggcatgcttgggaagcactggcagccaggtctttaggctggtggctggtcagatgcaggacacagtcaccaagatagaggaagaaacagggatttgcagggtgggtgggaagcaccatccctgtgtaacaaaggagacctggatgtgggagcagagacagtgcccgtgccctctactgtggacagtggggtcacttgtggcatcaatggatagatgggacactgaagagaaaggacattttggagactgagggtggaagggaggccctggggtgtggtaaacacctcccgacatgcacccagagcagtcctcagtctcccctgagggacctcctctcccctactctcagcccaagtgctcagagcaggtgatcttgccccagcctcagcagtggatattcaggcaggcctggtcaatcacggctggcactcaggggtgggctcaagacccaagccccaagccgagccagtgagggacttcaggggctctgagggagctgttggaaggcaatgccagctcctgtggggactctgggagaggagctgggagggtatgaaccttgagcggttggtgcttatggtgtttgtcaccacaagggggaggctgagaaagaccaacagaaatggaaggtgcttccctctgtcattcagttgaacacctagatccagccacacctgaatgcataagcttagaacttggtgggtacatgaacctatcaaccccagccccaccttttggctgaagacagtctgagtcgagtttgagtcctggctaacacggcacgggggaagggaaggcttacttctgcacatccaggaactcgagcagttgggtatcaggaaagaggctcaagttggcaatgccctggctgtagaagctgtcctcccgctcatgaagcagcaggtagagcgtgaagagctctgagtagaagctgggcagcatgaggggcagcaccaatccatgcacctggaggtccctgatggggagaccggaacaggttgggatgagcaaggtggggtctgggattactacttggagtctcgtctcaaagagctcctagttccacaacaaacagtgtcctggcctccagcctcctcctccccagaaaaccttttccaagcctgttctcagtcatcatttgcccaattcaattcataacttcattccctcctttgactttgacaaccaagatggcaggtggggcaggagttggatccccatttgactgaaagcaaaaccagggccccagatggaccagcaacttgcagctgagctctcagcagccattccaggctgattcagttccacctcctggtttgctgtgctaggactccgggcggggaatcctccctaatgtctaaccccatttcccttgcctcctgcaaggcagtgacaggaaggcctctctgatcaggaacactttcaggtctagaatctaaaggcaaattgtaaggtttgctccagggactgggggaaacaaatttcatgcccacctaactcctgtataacctcaggctcatccctaccagccctcggtttccccatctgtgtgcagggagaggagggtgcctcggggagctactcaccttctgcatgcgaaagatgagattgggatcatacatttagaacaaagatgcattcaatgcattgtagcagtgccccctccctggttcctcacagaacagaggtcatgggtcattctaatccacaaacgatcaatgcacaatgtttggtcaatagagtgaatgcccagcacttccccagaagcacctctttccccaagggaggtcctaggagcagacgcatgaggcctccctggacacggcaggccccaaggagacctgcgccagtcaccttgtctctgtgtcttcatcctcctccagggcctggcccttgcgctctaaggcaactcgcagcagacccctgtgagtcaatgagagagaaatggtgtggctgccccttgccacagaactggagttctaccaccagtcaacaaaggcaaaagcaggtggcctctcagaactgtggacatggcctgcagggttcatcctctcaaaccacagaagttagaaggttggagctccaggatgttagcctgagaatccagcagcagaaggaactatagcatctaaggcttctatttgcagtgtttcatggggtcacagcccagcctgggactgcaggtgtgttccgagtccagggccaagctcagcctacagtggggtgagagtgcacctgcggtcagagtcagcccagcgcctggttgggtcttggactctagctgagggctgcagctgggcctttgctctcacctccccaccctctaacccttttgctcagcagctgcacactgaccaagcctctggttcattgttgaatcagacacttggcattcctcccaaatgcaaggcagaactgatgcctggaaagggcacactagtgtcacagggcagtagctgtcccgtttgccaccgagcccacctgtaggcagcccagagttcctgggcatgctgcttcacctcctcctgggccagctcctgcaggtgcttgttggccccgacacctgcgtaggtagcctggaaggtcagcatcagtgtccggagcagctttcccagggggtgcagtgagttgctcagagcctgggccagtgcataggcaacagagagagactaagcactggggtctggagcacagcatgcccacaccagcctcccaacacttctcccatctcatacacgagaacactgaggtcctctgaggacaagggatccacaggcctgtccccttcagtcagcaccctgctatgaaaaatgggagcccttccccaccagggacagtgacaatgtcacccccttggccaccccagcagggctctcaccttcctgaggtacagctgcagggccttgggctcccggtgctgcagcagctcctccaggatgtcttccatactgcccacactgtcctcagggtgggtcctgggcaccacacacagcatccctcacccacacctcggcccagccccctccccccaggaagccctccccagcccaccctaacctgtgcatgctcacacagccggcctcacctctcgcaggacaggtaatcctgagacctacgcagctccctggagctctgcacgtcgaagcccagcagggcctcctgcaggtccctggggcagccagcacacacaaagtcccggaaggggctgtagactccctgccagcggctttccacggggaaggcacccacgcccagctgcctgcgatggggatggagggtgggtgatggggcagagagagatggagctgaggtaggcaggactctgcccaggcccttggaggggtgggggtatgagcctggcccaggatcaagccccaagaagggtggatggattgaaccatgcagagggggctgacctccacggctccaggaggaagagcagcagagaaagggacagagaatctaccctgcgacgagaagacagacagaagcatatggaatcctggaaagacggagacagaaaggtgggcagatctggaggccaagccagagagggggtcttggtccaagagagaccagtgtccaaagtctgggattcccctccaagacatccccctctgccctcccttacagctggttccttcctgtggttgatcccgccctggccaacaggctggggcctggctgcgcatgtctaatggagccctgcactccagtgtcatgctcgtaggctacacgcagcccacactcacacccaggctggggcctgcccctagggattgctgtccactcccagctcctgctgtcagggagaagcagcatgcagggacagcgggccaagtagtcaactgtactccctccctacatctgaaatgctgcctgggaccacttcccattagaactgccacccacacagattccttcctctgtgcaatactgagtcttcctcaacagacgcaacaagagcaactgttttccaaggaggaactctgttcctacaggaaaagaagtctatccttctctggaatactccttgataatgactgtgattccacttagcaagtttccttctttaccttggctgccaggaaactcagagccaggctcaatgatcagttgtaaatgccgtaggacatgtctacatatccctttcttttaaggttaacatatgctcttattttctattttttttttcctgtatgtttggtttgtaaaccgtattgtatcctttcgagacaaaaaaaaaaaaaaagcaggacctaagcaaagcctacaaataatatttctctccagttttgtggtgtaccgcattatatccacacagcccctgatcccaagagtctctgactggagttgtacaccctgggctctcggaactctctagagggctaagaggtgggtgcaaaaaggcccctctgaggagacctgagtctttgggatggaaacacagacacatccccagataggcccagagccagaggggccaggcactcacctcttgcaggtactgctcgggtctggtgggagggcagccgtgtccagcacaccctgtgtgtgcagtcctctccctgccccactgccgaacgagccctccagggtgaagccattggggaaggtgaccttgccctgggagccaggagaaggagcagggatgtctgtctgcccagttacccttccagccaatcatgacaggccacaagcctgtccatcagtgtcagagaggctaaggactaatgaatgggcttcccgccatccattcaagctgctccatgctgaggggttcataatcctctatgcctgccagagccccccaccaacagctgtgcccacgtctcaggggctcgctcacctctgaggtaggaagaggagagagatgcagaagggactcacaggcaagagtggggagaccaccactgaggggctggggtgggggtaagcccagggacaggcaacgcctgaggagggcggtgtcttgccacatgaggctgtcccattcatagcaacctgatctccacccctttgctccagtcattatgaaaccaaaacagcccctacatttccaaaggctccagcggggacacattgccttttcctgggttagctcagggaggcacacactgaaggccagtgcctccagggacagctgctcgaggcactggtactggtggagggcgtgtattctgaactaggagggtatggagggacacagccaggagaccaccggtaccctctggatagcaggcaaggccactggtcccctctcacctcactccagaatcaatcgcaactctgtggcagggtggagttgctgtgcccactccttggctccaagggaggtgggacaggccctcccctacctgcccccagccctgagtctaagtggggagattacagacaccaaccaaggccttggcagggtgtggaggggggcctcagtggtcctcaccttccccatgagggtcaggtccctggtgaaggtgccctcatacagggagtcgtcttcagagaggaggatgcccgggcccttggggagaggaagccagggagggtagaaagggtgggtgaggaagggccaggaaactcagggtggagagagatggccaaagaagggagatgtgccctgacacatggcgagaggggccctgagcctcatcacgccccacaggactgtacctaattgggactctagcctttggcctgctaagcaccagccccgaggaccccatccctggatttccccaaatgacaccctccgccctggctcctcaccccagcggcttcttcaggaagcccttgggagctcaagaaatgtggggctttctctgaaacatccctgcttccctgcttgtcactggccctgggaacggcagagctgaccaggctcccttgccccatgggctgccgggaagctcagagccgaaagggttacaattagtgttcggcttatttccaaatctattttgtgtacttattcttccccttgtcttcctctttccttgaaggcctccttcaatcctttcgagaatgaagtagagcataaacaaaccaacagaccataataacaggaacagccatcaggccagagccccacattccccaggcacctggaagggtatgggtgaggcaaacatgggagtcccaggctcggcggccaggctcagcagaccagggtgtgagtgtcagctctgccactcagtgaaggtgacatggagcaggtcctctgatccctctgaacctctcatttgtcattcactagggacacactagggataataatgacatcaacctgcagggctcttgggaagatcccacaagatcagggtgggagcttagcccagagccaggtgtcaagttaggactctgtgaatgtcagctaatgcatcatcatgagcaagtgctccattcttgttagttcattgagtctatggtaagtattcttaacctgagttgctgatggggaaaccaaggtcaggcagagcagggattggccagggccaggggaggtgggtggtagagctggcttcctgcccaggttctggctccctccagcacccaggaacacagccccctttcccatccctccctgaaaggcctcagctcagcctcagtgcccccagcgggagtggggtgcaaagagagggatagcccaggatacactccactcaccaccgtcttgtccgcctggaaggtgccctggtagcagacacctgcctgggtgaccatgacccctgggccgtggcgctgaccagcctgccacatgccaatgtagcgctcacctctggaaggagaggaatgtggccagagttggatcagactcattcccatgtacctcctgggcactctgctggcacggggcggcagggagtgcagataaggggcagtgacatcacctgaatccactcaacagacacagtgccagagaggtcaggacccccaagaggaatagagaatggaggagggagggaggcagcctgggaagggcatctgggaggcttctccgtggaggtggcaggaaggacagggggaataggagtgtgtgcaaagccatggaggtaggagcatgtgatggatacgtggggacttcagtggtccagaaaggctggaggggtgcccaggagacgcagctggggtgaggtcagagaagcaggcgaggctgtgattgccaggccaaggatccagggctttatcacacagcccagagagccagcaagggctgcagtttttagacgtgacagagcagggggtcagaaatgcctctccaacaccatgaggaggggtgaggggcgggggcgaccctgcagtcagcgtgaccaagattcgctcagcctgagcctccgcagcaaccgagggactggaggggaagtgaggggcttaagagagacacagtgggggacaaacaggagcctgtgtcctgcaacaatctggtctgtgagggcccggtccacccctccgtcctgggagtggtggctgcagggcgctcacctgtcaccatcctcctcaatgccatagccgctcctctggcccctctcccagtggcccgtgtacctgaagggctggggggcctgcggaccactctcaaggaccccaaatccgtgccgcaggccctcctggaagtagcccttgtacacctcgtcggtgctgtacctggggagggccatcaacaacgagctctgcctcatggagctcagcccagaggatgggcccagcccatgaaccccccagccagggtcacttactcacagatgccgtagccacacatgctgccttctcgccagtgacacttgtaacagtcgaacttgtcctcagaggcctggggcagcaggcggatgccgaagctgacagcatggttgtgggggtggggatcagccctgacctgagacgcccattacacctactccatgccacccaggagtatccctgcccccaaggagccttccagacaacagggagactctcagaggccctcagccttcctatccttcaaagggcccctctcaggacccctccctccagcctggtcccgagcaccttggagcaccttttggcctgtaccactccctctgtgacctcgagctgagacgggccccctattcaggcccccggttcccctttggtacagtgggcgggggctggaccggattgtctctaagttcctgcttgaggtttgggaattcaggatggggccgggctggtgaccacagcaggggaggaaagcacccttcagcccactgcacgcctcccagcagtagccccagccagccttacccatgctccaggccctggcagaaattccccacgtgattccgcccatccggccatttcagggttcccctggaacacagtggaggttcacgagcctcaggcctacccacccctcagcaacctcagccacctactttctcagacgccctcccttcctcttcccttggactgggctccctgcacccacccagccctcttgtctgagctccgaacattccttgcagaaagcccctttagcccttttctactcctggcccaactgtaccagcagcctcatggggcacactcaccacatcccataaggaaagccctggagacatctaggttcccttttttcccttgaccaacaggaagctcagagctaagaatcaagctcaagtttaatgctggtctgtggggtttctaccaccctcctccccacttctgtgttttttctgtccttttgttcataagtcttctcgagccctttctgaaaggaggcagggtatcagaaactagcggaggtgcttgagagtgtagccttgtgagtcccttctgctctctgggtctgttttcccagctgtggcatggggtggggccacatggtctataaaggcttgcctgtctgtggggtcacacagacctgtgattgaggccggctcaccctatcacttgccctgagaccttgggcaggttatgcccatcactaggcctcagtgtttgtacctatgaaatgggtaaaagcactccatacagagcgtcttcatgaggaccgatggagatagaatgtgtgcaagccatttcaacactgccagacaatgaggtacagatgtgagaattattctcccaccctcctaagaatggaatggcacctgcaggctgtaaggccagcgcgtggttgctgccccttgtcctctagcgtcaccatcaagactttatttggcacagactgtctctgggccaggcccagtccaagaggacttaagagggactctgagaattgactgtccacagagagtaaccgctcctggaacatgtcctgagacaattaggcttgtgtgctgctctctgccccgcagacccccagggagtcccaccttgccacccagagctccagccactcacttgccgtggggccggcccctgcaccactcgccctcgtaggtggcctggcagagccggccctctgcctggaaggtatattctgcgcagcggcagtcgggaggctgggagggctccaggccagcccccagcacggggaagtccttcttcccatgcagggcctggtgaacagcccaggtcaccttccactgccagactgcctggtgggagggggaacatggggaaggggatcactgctgctggaggctttccctccaggaagccttctggggtagctccaggtaccaccccctccaccctccacctcctactccattttgtcaccttggggacccttcaactgcttcttgctactctctgggccctccacccaacctgagatcctcctctgcagtttcagggcctgcccagaggggccaaacaagacctcagggcagggatcaacacaggacccaattctgtctttagaaagaaaaataccctgttctttttgacattctaattcttgaccccgatttactctgaccaggtccccagaagcctgccagacactcgccggcactcctgtggggccctgcagggttgcatacttctgccctcttcctaccctgtcctctgaccccgctcccgcagttcacagctcacccacactcacctggccctgggagtccttggcacaaaaggagaactcttcttcgggcgtgaggaggtgaaacgtgcacctagacagacggaggtgatgagtaggccccagctttgtccaggagggtggaggggcccaagccagagtcccagggtgtgggcaggtgtcatgggggtaaagggaagaaggcctggggtgtcagccgagggggttgctcacccgtcctgcccaggatccacccacaccagcttcagatcaaaggtgtggacattgtggccctggaagaggatggacacaggagtcatccagagcccaggccagatgctcacctaccctctggccaaggcttgccccaagctcaaccttgtgtggccaccaaggctattctgcccagcatgtccaggactgagtccctctcccctctggcttgctccccacctcagggacagctcctccatgtcctttctaccccagagcttggccaggaactcagaaccagcctctagccccctgtggctaccagagtggtctacaaatgaagctgggacctggtcaacccctgctggaaacctctctatggctcctactgcctgggggttgagacactgctgagcctaacatttaagacctcacagaccactacgccatcagggccactccacaatcacaccttcatgagcttgccccaacctctcctcactgtgaacttttgctcatactgttccttctacctggaatgccatcctgctctgacagccagaaaaaaagccccttcctatgggaagattttgtgtagcaacttcctacccggcccagtcaggccaatcactgctccataccagaatggggaggacgtgggaggcccaggcctgaggggtgaggaggagcttgccagccgcaggccagggacaagagatggcccaccagacacaacagcatgtgcaaaggtccagcgtcaggagagggctagcacagggaagggacagtagctcatcagtgtacctggagtggagtgtgaagttgggagtggaggggaattcaaactaaatcagaaccaatcccaaaatcaggcttcaggggacacaggtctaggctgggcagcagcttcctgccaggccccggccacctgtctgcaagggggttccaggccaaccttctaaggggtagagaagactgtgctgtggacctcaccaggacaacatgatttcaggatggatgaaccacagttggtgactggccatgtaacaattcccagcctcaggcctggctcccttctgacttccacaatgctgaaagcccaggcactgctcctgtagggtacttttctctagaagccttctcatccagccctccttagtcacccctcagtcacccatgactttctgtctggggttcctctctcatttgagtacaatgggaactaagagttgtctggtgtctactgtagaacaaactcactcacaatgacccccacattcccgatgggaaaacgaaggtgaagacatgtaaccaaggacaccagctgggaagggctgaagccgggacaaaccctggacagcctttcccctcagcccatgctcctctggggacagctccagtggaccgcccctccccaacacaacgcctttctatccctgaccatccctcccagcccactttctcagtcccagcagcatgcccctttactgctccttttccagccagaccccagaaccctactgtggcctcaagaccttgggtcagccccaccccaacctgcagcaggacgagggcatcatcaaagagcagcacacgctcagcccgcaacggtgcgaccgtcacgggtacgtcctggctgtcctgaaggagtctgtgagcaggggtgcagagcacatcctggtggggcaaagaggacagtacaaggcttaggcacctctgtcctgcaagctgcctgccactctgccacctcccaatgtaccccagacacctcccagaggccccctccagtagacctggagcggaccctgggtcagagataggcagaaatgcactgattatacattcctggctctcttgaagcttcagtgtcccctcccacacctctgtgccacggccccagccatgcccctatcagtcctctcccagtactcggccacccctgcctcccttccacaattctcgttcctctacctagtctcctaattctccacaccaggtccaaacctcagggcacaggggactctcctccctgcaggggcagtccatgccatggtgggcagtgacgcaagggtgtgatcggtgatatccccaggggagaggactggttctgctgattgcctcttccctaggccgggtcagggcctggcccaggacgtgctcagcagacagataagaatggctggacagagggaccttacagccacctgcttcagccatcactcccccttccatatagggaaactgaggcccagagaatacagcaagcagctcaagccccccaacatctccatgcccaatgtggaaccccctccctaactgcccctcaggcccccaactcaccctcagccggcctctcagggtgtgccagagagcctgtgtggccacagcctggtccaactcctgcttcatgaaggactgcaggttcccaaagagggtgactgcgttcaccaccagctcccgggttgggtgatgctgaagggggacagggcagccagtgagaggagagcttactggaatcttccctagcccagtcctggtcccggctggtggggaggcctgaatctaggccagaccttgcccttctctccctgacagctcctcttctgctggtggggcagggggtggaatatgaaggtgcttccccagcttggccctgggcccacgtgtcctcattcccaggacgtgattctacccctgctctctgggtctctgctggctctaccagggcagggccacgtgcctcagacaccgcagggaagggcagtgctttcacccactaagattccctaggacagaaccatgtcttcggaccccctcctcagggctgggccacgtcccccatgtcccctgaaaaccacaggacaggcctgtgacttcctcaaccctctcccacctgccggcatggctgagtccttcttgtactagggttcctgagtataggctgagccccctgagtctgggccctatccctcccttccctcggcttccccacatgctgctgcccctggtacccacctccccaatggtgtccccgaggctcagcaggaggagcacgtactgttgcacgtgatgggcgagtggctggtggagggcctggcccagcgatgcgcccaccgagccctctgagctcacacctgaaagcagctgccgcagcgccttccgctggccccgccagtactcgctgcgtgtagagagggccacgcaccaccttcaccccttcctccattcctgcacccacaccgccacctccctgccccagctaatcccctcagatcccagggccagccccaggcccaaaacctctaccctatcagatcaacacagtacctgagttgccctcacaggtttaagagcaatatctcagagtatgaagggattgctgatcacaaccatccaccctgaagggattcccctccttccccgccccaaggccagcccagctagagcgggtctggattctgttcctggcctcactgggccttccctgtttctcttccagtgtggatcagtgcagatttgtagagccaggagtcctccaggatgagttgtgggctgtgacacctgctgctctggggagggggcttccccgaccccaccctcactcaggcactcccaccctgtcaggggccagtgcaccagccctgtgctcaccttctcctctttgctgccttctggaaggcctgcaccaccatgcagcttgtgtaggactcaatgtacctgcaggcagcacaggggacaccctgcaaacccagtcctcagccccagacctaagcccctggtccctgggatccccagatcccacccactagtcagctgcagccctgagggcccacacagtggcctggctctgggcactggagacctcaactcctgggccaacaagacaattctaacatacagtctgtcttccctgagaggccccaagcctcaggtctggagtgtctgagcctgctgtcaggcgaatacccaagcccaggtgaggctgaacccaggtgagcaccaaccatggactgagcccaaacctttgcttgaaccctgacccatgtgagccccaaccccaggtgaaccttaatgccaggtgtcactctgacaccagggatgagccccagccccacctccagtggtcttactctatgtgggcctgcagtacacggtcagcacctcgcagcagcagcagggactccagaccggtggagtccgggtaacgcagcctctcctgcagtgagtgcaggctttcctccgtcacctcccagagttgctgggagctcttgtgcagctgttgcaagagccgcaggcactctctgccccagggatccgagggatctggggctggggaaggagtacagtcacactgtgagtagaggacgtgggctccatctcccagggaacatgcacaggccccaggtgttcacatgagagccaccagcaccggccagccctggagctgcagcagggtctgcatccctgggatccgcaggacagaattggtgaaccctagagctgagcaggggaagggcaggctggagcagtgggcagtatcctcgaggaggaaacaggagacacacccactcctcactaaacagggacaaccctgacagcctcagggaactaagtacatacacgaattcccccctggctctgggcctcctcatcctggactactcagatccagaatgtgaagtccacagggtcacacagtcctctgccatttcacagatgcacagaggcacctgtccaaggcctcacaggtgagaattaaactggaagtaaaacctaggcatcctgttccagtcagtcttgttcccctcccggcaccatcaggtgccctaggtgggagcaagatgaaaattcaagcaaagggcagtttccagttttttaccctgggaaaggaggaattccatctctttgtacagcctggtctgggctacaggtaggttcatggcctggcccctcagcgttcctttaaaaaaggagcagtcagacttggcgcagtggctcatgcctataatcccagcaatttgagaggctgaggcgggcagatcatttgaggtcaagactttgagaccagcctggccaacatggtaaaacccgtctccactaaaaatatgaaaattagccaggcgtggtggcaggcacctgtaatcccagctactcagaaggctgaggcacaagaatcgcttgaacctgggaggcagaggttgcagtgagccaagatcgcaccacctgcatcagaagatgctgataccaggtgtcaccactcctatttgaggttgagaaagctgtggctcagcaagtccaacaaggtaggtctcctgtccctgggatcattcctcggtgcccttccctccccactagaaagcctagactcaccggctgggagcaggggctggaggacaaggctgttgacatgggcgagggtggctgagaagacctcctccagccgcagcagagctgcctcctcagggttgcacatggccaggtgccggactcagggcctcctaggtagggcacaggttacagctagatagcacagacaggagcaaggccagtgcccatcctctcaggcagggtgcccagaagcaaggtccatgaccacccacatcagaactgagcagtgagcccagatcgcctcaaaggggagttcctggactggccactgacctctgccctgctccctgcctaggcccagctgaggggtccctgaaggagagagagagctcagagctgccaagggaagcaaccctttcttccccaaagggtagatgttctttaagcccagtttggcctgctcattcctctgctcaaatatccaccatggatcccaagtgcccaggatagtattagtagtgccctggtcttagcctcctttccatcaagtctcccttcagggattctgcagtctctataaacagggtcatactgtcagaggatcccagccctgtcctctagcccatggttcgggactccctgtcacccaaccaggctgtgtaagcaaggagagttttggaggtatgggggagtccggaggcctcctgctagagccacgaatgatgggcaagaaatgaaaaggaagacaggacccagcaggcaagtggaggaaccctgagagtaaaggctcatgggtgtgagggcccagcctctgagggcagcccaccaagcagcaccccaaaggaccacagcttcactgtgcctcagtcggccgtggacagccatggaggactttagagcaaggtaatgatgggatccaaagtcacatttggggaaataaatgtatgacagttgtagaggagatagtgccaggcagtgagagagagttcaatgtggatgggagcctggaccctccatggtcccctaaccagacagagggatcactgatcacaaccatccaccctgaaggggtgcctgctggatgggtgggggcccttggggtgggcaggtgggcttgagccttgagatttcctgccctggagtgagggaccttccaatcaggcaggaatcacctgggaatgcagtgtcctgcctaaagggaggggtgaagagaggcctgggctcaaacctacccccacagccaggctacaggctctactccaacaaagccctcccctaccagaccctggtaccctcacttggcaatgttcatctgcccaaatgacctgatcaggtatctggggcggagagttagagggtcttttagcccaagacccgcagactgtctctctccttgtctctgacacgctgaggctttggagttagccaacctgtgtggggcaggggacaaaatcagggcagccaacgatgggcaggtgacacaggcagacccaaaagggtgagtgggaaggggtctcagccctcccctctccaccctgccccgagagtgccatgcgggcatcccaggcccctggcagagcctacaactcccagggaattggctctggaatggagtggggcgggtccctcagagctctggccaaaggcccaggccaggcattcctgccccacctttcctgctactgctgcttcgagagggtgaggctgcagagagagaggcaggaaggggaagccaccagacacccagctgcagcttctgtgctgcagcttcttctccctctgtgggcccctgaggcagacccaggcccccaggacacagggggctccaggtcagctcaggcagacaaggaaagcccagccaagggaataggggtgcagccaggcccacctaactctcacccgtatctcccgaaactgctggaatggaaaggcgctttgggggtgaccttttcactctcagctggcagtcagctggggtctaagctaagaggtgaggatatccaagcctggttgggaaggtagaagaaagggtgaggctaggataggagatgcagactaggaaccagatcagtgcacgttgaaaagatactgcagtaaataactcgctgctaggaagacttgaacaccaacatccctacactctccggggggccagcaccatgaccccagccgacaccataccctggcaaggagctctctgaccctagagatagcctctcctcctcaggcttcctgtccctcgtccccactgcccagtctcagctgctcccccaggagcagccctcacctggctgctcagccctggacatgcttcaacttatccacagccttactcctctctgtacctcagccacccctctacgaaatgggggttcaaccagatcacagcatttttttctttttatttgtttgtatttctttctattcttttttttttttttttttagagatgggatctcactatgttgacgaggctggtctcaaactcctagcctcaagtgatcaacccatcttggcctcccaaagtgctgggattacaggcgtgagccactgcgcccagccaaagaggatcacagcttttcaaactacttaagtctcccctcaaaaggacaaacaggtggaagggggcttctctgggtgtggggatctggtccttagactccccaccccacaaagcagcctatgactccgggggtgagtcctccagactcaagttggcaactgttaatctgggagtcttccacatctgtggccccaaagggatctataaccctgggaaactgagtcacaccacccagaggaacgggcagaagttaagcatggctggtgaggcagtgggttgggggaaggccgcagtggaagctgggattctggttaggtgaccctgagggacccagctcccaggctagggagtctggggcttcatcctggaagtgatgaggagagtgtaagtgcaggggtgaggcagcgtgaatgtgcatgagtgtgcacgtttgcagggcaggaggaggaggtgctgaaccttaatatgaggaggatcctgcaggagtacccccctccccaacccctgtcccatccctaaccttcccccttccagtcaagggcatagcttcctcaccctctccctccctccagttcaaaggttccttagtgacaggctgtgcctaatgtacagatggggaaactgaggcccaggaacaatgggagggtccagagacccttgtgtagaacttgtgcagggctcagacccagacttctggctccagcccaccaggttcacctagctagatggctcagagagggtgggcaactcacctgaggcacagagcaagatcctgacgggccctgcctcacagctgtcctcaggcagccctgatgctcaccacggggtgcggtggggtggggcagggtgaggacagaactggccagtcacggcgtgcccaggtgagtcagcggctgcccctgtggcgctctaaccagtagccagacctggtctctcctctgcattcctggcctctgtccacgctaggtccctcccgggcagggtcactggggccttccctgtcctctcccaggcctggctccttaggcccctgacacaccttgtcgtgacactcactcactctggtatttcctggtctgaacaggcagggaagttctgcctgctgtggaggctttttcatgggctgccgtggcagccccttcgttgtctggtgcccagtgggggagagtagagacacgcactgccccagggagggggcgctgaactgtcacacctgatccctcagtctcatgctcgcctctccccgctgcacccttcctcggccccaccatggctacaagcctcttgtcctagacaagcacccctccctgctgtcgcatatgtcccagcttcccttcctctccctgcccaggcacacactcagtcgctggagtttcccagacccgagctcctgttccggccgccaggcatttgccatgccgctcccatgcgaaaaggccacctcctggaatcccgggtcgggcccttccgccctaaccagccggcgtcacctcctcctggcagtctctcctgctggctggggccccgtggccctgccaccacggctcaggtcaggcccggggcgctgccccgaacccaagcaggctagcagccaggcagggaggacgacgctgtgagcggggtatcttacgagggactcggacggccgggggatgactgccgccgggaccaaggagctgggcggggaccgcagcagccgaggaggcgggagcccccacctggacgagctaagcgtggagcgcagacacccgtccgcagacgcgcgcccttcgtcgcgcccttacctgagcgctgtggt

SEQ ID NO: 1658 - DNA, 24711 bp, Homo sapiens; identical to SEQ ID NO: 1656

SEQ ID NO: 1659 - DNA, 44825 bp, Homo sapiens
tttggttttgttttttattcttttcaggctccagaaatcaccctgaagatttcttctcatcttcctgccatggaagcccaaggcagtgccttccaaggtgccttcttctaccaggtgctgcaaattcattcccagatgtgggttataaaattctggggtccagtatagataaatgaaagcaaaaagaacaaattttataattttttcctaaaatcctgacatattttattccctcctggaaataagtcatttagctaaggcataataaatgtcacagtgtaagagctttctctaatcagtaaaatgaatatgttctggcttgtgcccagagaagcataatagcttggtgccctttaatagatctctgtcattatcaaagccagaggttccaggctggtatttcctataagagtcatggttccagcttcagaaaatcctggacaatcagcatctttctacagaaaaggatctaaattgttcctgtcctggcagttcttcagatatgtagattggaagtgccttgctggtaactgccttaaacactgatgacagtctattgctaaacaattctgagaggagaaactgctcatcgatactggagggttagaaaaaggtttatacttgactagtaggttgttggggggtttaataaaaccagaaactactcacatatggtactctccacacatttcacttgatcctcaaagcaactcgatgaaatagacgagaatttaatcccattttatggatgggtaaacgaactcaggttgtggtgcaagtgccgtgtgccaggaactcagccaggtgccttacaggcatggtctcatttacgactcacaacactatggggtacttttgttatctttgttttagaaattaggaaattgaagcccagagaggctaagtaacttccccaagatcacagagttagcaagagttaaaactcgagcccaggtgtgtttgacaccaaaaactcataaccatgagtctatgcagctgccactcacagctgagtcaaaggatagatctcagattgtctgattccaaactacctgaagttttttcatgccaacctactgtctcttaagagaatgaacaagagagttacttcaaatcaacaggcaagagaggcgatttgaaaacttgattacaataaaggcatggaagatgaagaaagccttgagagccctctaaggcagtgattctcaaactgtgatccttagacctcctgaaccaaccacttggggaacctgggaaaaatggaagcacatagaccccacagatccaggaatttggggatgggtctcgagaacagaatcacccccttgtgattcttattacacaaaagtttgaaaaccactgcttaaggaaacagtgattggaggatattgacaaaagagatacacaagtaactctgaatttctaagtttgttttctgtaagatggaggcagtaggaaaacttgggagacagtggagcaaatgacttattcagagagttgaactcaaacaatttttccccggtcatctgaatcttcccttcagcaaatttccattagggccagagagtattgttttagaccatgtgccataaaccctgagaaagaaacgggcggtgggaatgttcccaggggcggacatctctgtgtttgggtgttttctcctctcacagtgctgaaaacacactgttcattgggagagaatgtttggcctctgtgggaagctttgttctgctgctgatccgctgcctggcccacatcactgctggggaaccccaccaggactccagccctgcctttctggggtcattttacaaggtatttataacatgtacagggcattttgcttctctttctctgtgactcagaccccgttccccaggagaataaatgctttaggctttgcaacatttcaaatctacttgagtccccttgtggcctttggttcctcctgcctggccaggaagaggattttcctaatcagatttcccgtggcagcatatgacaaaatgcacgtaccactgcttcacagaagtggttttcctatgagcacagcatctcagctttctgtggctgtttaacagttcacacataaactgcaccagaactgctaaagacaatgataacccatggtgagggcaagtaaagatgagaactctcaagccccatttttctttcaactattattttaaagctttaacagcaattgtatagaagccctactgatctgtcccccttgccttctcttcccttgaccaagggcctggaggcctatttcagggaagcattccctatcacactgagaatggcagcagtttccagggacagtaaacttgaccaaagcataagtgctatcctgctggaagagcagcccatctctgacagagaaagggatcttctgtctaaactcattgaaatgaagcatgtatctcccttggagccagaatcactagaagaggtaactaactttatcatgtgtatcacatggtcttgactaaaatggacttcttcacagagtaaatgcctcagtgtattcagatatttctgacctcaagccacatatgacaatattttttgttttgtttttgagacaggatctcgctccgctgcccaggctggagtgcagtgatgccattacagctgactgcagccttgacctgctgagcttaagcgatcctcccatctcacccttccaaacaggtgcacaccaccatcccggcaaattttcataattttttgtagagacagggttttgtcaggttgcccaggctggtcttgaatgcttgggctcaagcattccacctgcctcagtgttcccaaagttctgggattacaggcatgaaccatggcacctggcctcatgacaataaaaatcctattctacagggcagacagtagttacatgactgagtcatgaggagtacaaatgtgggctaacttcatgtctcactaatgtattatcaataattaagcagaatcccatctgtaaaactgtgactcatactaactttagatgcccaagtggcagcatgtttacccaaacttatggtgtgctgttttctgtgcaagcttgataatgatattcttaatatcttgttaaagcacttttgccaggtgcagtagtttacacctgtaatctctgcactttgggaggccgaggcagaaagatcacttgagcccaggagtctgagaccagcctgggcaacacagtgagaccccatctctacaaaaataaaataaaaataaattagccgggcatggtggcacatacctgtagtcccagctattcaggaggctgaggcagaaggatccattgagcccaggagtttgaagctgaggctgcagtgagctatgatcacaccactgcactctagcctgggcaacagagtgagatcctatctcaaaaaatacaataaaacacttttttgaaagtatctcagcattttaactattaaaaataaaaatcataaaatttaagtctatgataagaaaaatatcatcctgcactaaaggttaattcattcttatgaacaagaacatatcatgtttcaatatttatatcaaactataattttcaaagccacttttatatatagtgtcactcgatccacccaacaagcctgcaaagtaggtagtgtctatacttttagccacattattgaaaaagaagataaggaatttgcccaaagttataaagctatttgtagtggtggatctgagactagattctagatttcctgaatcctgctaagtaattgtcccgtacacatatctccatcattgaatctctattagttactaaggcagatttattttgtgggtttgataatgatgtcggtaatccagaccacagaattctgttggaccccaattcccacaaatcacagagaacagtccattttctgtgctcatccatcagcagcatttgacatatctgaccatattctcctccttgacatatttttttcatttggctcccaagacactggcctcctctggttttcctccttctctgattgttccttctcagtcttctttgctgatccctgctcttttctccggcctcttaatgttggagggccaggactcagtcccgtccccttctccagtctatattttctgcccttgaaggtctcttctagtcttccagctttaaatctcatctatatgtcaatgaccctcaaatttctatcttcaaccccaattctctaacccatacctccaactgtttattggccatctccacctgactgtttcaaactcaacatgtccaaaacgcaatttttaatttctttccaaacctgctccactcaaaaccttcccccatctcaactgatagaaactgttcttcaggtttttcaggccaaagcatcccttgaaactcatctgttacacacacccacaaccaatccatcaggaaatcctgttgttctactttcaaagcatatctagaatccaaccactgctcatcaactacaataccacccttgtgaaaaggccaccattgcctcttgcccggattactataatccttactaatggcttcctcaagtccacccttgtttctcttcagcctacttgcaacacagcaaagtgatcctttcaaaatggaaattggatctgctcaaaatctgctgtgtctccccaatttactcagagcaaaagccaaataatattgtcatgaggccttatatctcactctcttacctactacccttcccctcattcactcaactccaaccacactttcctcctcactgttcttcaagcactagggacacttctctcgagggttccctgtgcctggaatactctttcccctagggcagtgtttctcacccaggaggaatttttgtcccccaggggatatttggcaatacctggagatgtttttgattggcatgactcaggagaaggggttgccactgacaactagtgggtagaggccagggatgctgctaaacagcctacagtgcatgggacagctcccagagcaaagagttactcatcccaaaatagtgccaatcctggtctacccctgactcccttacctccttcttatcttggttcaaatatcaccttctcaatgaggccttccctgactatccaatcttaatttgcaactcttttccccctactcagcagctttctcttaagttttcctatatcctttcctaacacactacataatttacttacacttgttattactttccttcctcagctggaatgtaagctccatgagggcagagagatttgtttcatttcctgatgtaggccatgtgccaggctcacagtaggcttgagatgtatttactgtgttaatgaacaagtagatttatatgggccctgatgcaatatactgaaaccacaatctacctgagctaactataagacagataatagcaaacatttattaccttgccatgtgctacatgccatgttatgattgagagttttacatacatcatctcacttaatcttctcatgctcttataaggtggaagccactcttattcctaacttatggatgaggaaaccgaggcctagaagtgaaaaaaaaaaaaacaccaaacttgcctaagacatagcaatagttgtggagctggaatgttagtcctctgctaaccaccccctatgaagagatattgctttaatttaaaagcaaaattgtacatagtactctcaggtccacattctggctaacaagatccaagggcacttaaaataaatggtaacaagagtattaactctgtcttccacattctctacagtatattcataaaaacaaagatcttctgctcttcaccagtatggaacatttcctaaaaagcatcctcgctgcagaacaacaaatcctaagaaaaccaagaaatcaatttgggagtgaagataaggtgagatacccttatgatcaatagcattaagataacaattagctatatgccaactattatttattattgtgtttggaccatatttataattgaacatgtccacagaataaaaggttggaaatgagtgatggtatgaataagtggcatcacttcctttaagagcttctcctacaacaacagagggtggatcttatatttcagaaaggatccaagagagcatagagcattggtcatcagggaaatttaaaactacattgagataccacacaccagaaaaatgaaaatagtaaaaaagttgtagtttaaagcatagtttatccctttccctttaggcaggtaacatattaatcctagagagaaggaactgaggattagacttgcccccattcatcaagctggaggagaacaaaaagtagctagaacatgggtccactgtcttctcattcagggtttcttccactacaccacaaagataccaactgctgttttacaaaagtttatttttaatcctaagcatttaaaatgttgtatctttaaaaatcacacgttttggttccaaatcatcactaatattttgtaaggtcaatggaaaatattagcaaagagagaaccccaaagtcttcatcttccccatgcacagtagagacctatcatgtcaagatcaagatcagaaactagcaacctagagaaataaccaggcactgactcctcctgggccccaatccactttatttaaagttattgccagtgtctgggatgaaaacttttaaacctttattaaaataacagctttaaaagtgaacagataataaatttatacctcaacgagttgtccaatgtgaatactcccatataaccagccccagatcaagaaatagaacatcaccagttctttagaagcagcttatgcctccttctagtcacatgttccaagatagagtaaccaccatcctgacttcaaacatcatcaatagttttcgcttattcatgaacttcatataaatggaaccataagatatgagttactttattgcttattttgctccactttctgagattcattcacattgtgggaggtagttgtagtttgttcattctctttgctataaactatcccactgtgtagatacattactacttactcattcaactgttgatgcatatgtgggtattttccagtttgggattattacaaaacagccttgcacaccttctggtgatgatacataactatatttagccaggtacatacttaggactagaaatcttgggtcttaggacatggatatgttcagtgttagtagatactaccaactagagttccaaactatttactgccaacagtgaaggttctggttgctttccatttctatcagcacttagtattttacatcttttttactgttttcatttttctggtgtgtggtatctcaatgtagttttaaatttcccagatgaccaatgaaactgagtgtttttcatgttgatataccatttagataccttctcttgtaaagtgcctaatccagtcttttgcccattttccattagattgtgcctattttttttcttgctgatttgtaggaattatttattctgcaactatttcccccattttgtggactgtctttataaaacaactatataatgtttattttttccattttatttttagatctagaaagaaaatggtaatctcatttcagtctgcattattaaaaggtcttaaatacatcactacaacatctgatgaagctgataagaattattggaaaatctataatattcatggtaaaacacataaatgtgtatcatagttttaagtgtatatataataggggctaatatttgccacagaggttgaggacccctgctcactgtgactaaaattttcagtgtgactaaaagatcattagatcacgtatcttattaaaatatgtattaaagatattgactaaaactttctgggaatgtaaaacttgtatatgtcattattcaatcaggctaaggttgtctattactgaatcacaaagtagatggatatatatatataatatttggtgatctagaatgtgtacttaaaatataggccatgtcacacaaaattcactttggaggccctggttgaaacaccacaaagagataagcagtcatctgaaagtgaagttttggagtgctgatcaggagatacaacaccatcacatgaatttaggttaaaaaaaatccagatacaaacttcaactcaaaagctgctcagattacaaagccaatgcttgaaattcaaactgcttctcacatggataattctgtatcatgccctgtatttatctgttctcatgctgctaataaagacatgcttcagactgggtaatttataaaggaaagaggtttaattgactcacagtcccacatggctggggagacctcacaaccatggctgaaggcaaatgaggagcaaagtcacatcttacatggcagcaggcaagagagcttgtgcagcggaactcccatttataaaaccatcagatcttgtgagacttattcaccaccacaagaacagtatgggggaaaccaccccccatgattcaatcacctccactcgaccccaaggaaggatctcttaacacatagggattactacaattcaaggtgagatttgggtggggacacagccaaaccatatcatgcaccaagagaagtaccagaatagatacacacacacacacacacacacacaataaaatatttgttaacaagtctcctaagcaatgcaaggaagatagacgatagactactaaagaattaaagctttctttttaaaaatattatttgggtagataatgaaagatgactaatttatgaattcagtgtccatctggtattcaacatttttagctctgtaggtcttttgtcataattaagagacatccatacatggctgaggatttagctgtcaatccaactgatgaaaatactaatggtagattactttcaagaaaataaaataaaaacagtgaaataacatgaaaagaagatttacaattaagttaaacaaggatttttaaatcaagctatcaggaacttctgctcagaatcaagtcactacatctaactcctctattttgagttttttgttgttagaattggctacttagtcatcttaattcagctcacatagttagattagtcatcaggtaagtaccaaattagacagccttaaaaatacctcattagttaccattttgattgaaatcgtgctttcatggcacagatactaataaaatggtaaaatagtcattgcccataagacgggctatgagggagctgtcctcccatttattccattaacagggaattcttaaacagagcacgccctcaaaccaatgcataactttataagattaaagactctctagtattttaagaagaaggcaagtcttagtttgatttaatattgggtatgtgtcttcaagaactttatttagctacccacataaattatgaaatgtatttcccagaaagcagagtgaagattaattaagccagacacacaagactatttaggatagttaagccacgagtccagggcccctgggagaggtggcaaagaaaaagtagtacagaacttaaagaccttttttctatattcctcattcttggctgatcaaggcatctaccaggacatgatcctattaatttcctggctgacttcttgggctctgtgtcttatttccattaatacactaacagctgcaggcttttagtaagcacatgctttttaatggaaatgccacagattacaagacagggatcatgttctccttactgctgcattatgcgtttttattgctgaatcaaatcaatagcaagttcttttttaaaatcgacattctagttatctgtaaggaacaagcttgtgtacacacacacacagcccactgactagaaaacagataagaaaacctcaataaatgtagaagccatatttaccaactattatcaaaaaagacccttttccaaaaatatattcaattgtcttaagatttattatttcaaaagtgatacatagaattctatctttgaggaagatgggataggtgttttttctgtactcctcccactaagaacaactaaaatccctgggcaatacacataaaagaaagaagataagactctgaaaggtgtagagaagaaggcagactggctagggaacctcagattccaagggaagatatggaggtgagttctaaagattttctttccccatcgtatattccagacttggaaataaagaagccagcaacccataaataccaatggtaaccaaccaaaagagaccacaaaagcctgctctttagcgaaaggaccaggaaagggacagcgcagcaaaaaagaaaactttaacaataaatcctataaactaacaaaacaacaagaaaaaactggccctacccacaccagcataagttgaatggggagtctagagctccatctttgccagtatggatcaagtcatcccagcctcctgctaggttggtatcagagacgaccgagcagagaactgggaattttcatccccacagggtagttcaaaccctcctccacctcatggtatcagtagaaaccacatagaaagtctagacatccccacacctggcagtaataacctctcccctccctgcagctgccatcaccaccaccacctccctgctgtagtggaatcagaggaggacaagtagagagttagggcttatgccattgtccagtgataatgaggccaccctggcctcagtgttagtggaagccacataaggagctagaactcctatacctgcccagcagtaatgagagaccctttcttgggtattaatggaggccaagagggaaacccggacttttacttccactaggaagtagcaaagcagcactcccttctctcccccactggaatagggtcaaaggaaaccagttgaaacaaagtttaaataaaatcccaagtctcatggtatcaaaagcatccaggtttggcaaaaatcattcatcacactaaaaaccagaaagataaacaaagagtgaggagaaaacctaatcaacagattacaacaccaagatgacaaagatgttagaattatgacaaagattttaaaggagcatcagaaaagtgcttcaacaagcgattatgaacatgcttgaaacaaatgagataagtctcagcaacgaatggtaaagtcacagcaaaaaaatcgaagacagaactaaatgaacgttttagaaatgaaaaatgtaaaaactaaaatataaagcttcgtgaataggctcaacagtaaaacggaagagatagaggaaaaatcatcaatgtttttagatagaacaatcaaaaattatttaatctgaatgaaagagaaaaaaagactgaggaaatgaatgcatagagcaccaggggcatatggtactatagcaaaagatggagcattcaagtaatcaaagactcagaaagagaaaagaaaggggtaggctgaaaaaaaatactcagagaatagctgaaaactttccaaatttggaaagagatataaccccacagatttaaaaagctgaatgaatcccaaacaggaaaacccaaagaactccacaccaccacatcataattaaatttctgaaaacaaaaagcaaagaaaaaatcttgaaagcagccagagaaaaatgacaccctaccactagaggaaaaacaactggaatgacagcaaccttctcatcagaaaccaggaagccaggaagaagtggcacaatatttttctaatgctgaatgaaaagagctgtcaacccaaaattctatacaaagggaaatattctttaagaatgagaaggagaaacaatacattctcagatgaatcaaagctaagaataagccgggtgcagtgactcatgcctgtaatcccaacacttctggaggccaaggtgggaggatcatttgagcctaggagtataagacgagcctggacaacagagtgagaccctgttctctatttttaaaaaagagctaagaatatatcaagcataactcacctaaaagaatggctaaatgaagttctctaaatagaagggaaacaaaagaaagaacttgtaacatcaggaaggaagaacacaggaagtgaaattatggataaatatgatagactttccttctcttgagtttctaaattatgtttaacagttgaagtgaaaactataacatggtctattatagctctaaatatatgtagaggaaatatttaatgcaagtatattataaatgggggaagataacaagacaaagggaagtaaggtttttatattttacttgaacttataaaataacactggtagactgtggcaagttacatacatataatgcaatacctagagcaaccactaaaaaagctatacaaagaaatatgctcaaaaacactaaagatatgccaaaatgaaattctaaaaagtgttcaagtaacccacaagaaggtaaggaacagaaaattgagaaatgaaaaagaacagaaaacaaaaactaagtggtaaactcgaggcctaacatatttataattgcaataaatgcaaatagtctagaaacaccagttaagagacagaaattggtagagtgaactaaaaataagacacaatatgccatctacaagaaactcacctcgaatataataaaataagcatattgaaaataaaaagatcaaaaatagatactatgcaaacattaatcaaaagaaagcaggaatggctatattaatatcagataaagccgacatcacagcaaagtagattaccagaaacaggaacattacataatgatgaaagggtcaatctaccaagaatacatagcagtcctaaatgcttatatacacaacagaactgcaacacatgtgaaacacagagaaacggacaaatcacaattatagttggagacttcaatacctcctctcagcaatttatagaactagacagaaaatcagcaaggatataaaagaactcgacaccatcaatcaacattatctaattaacatttatgggacattccccccaacaacaacaggatgtacattcttttcaagtgcccacaggatatgcatcaaaaatcatatcctggggcataaacaaacctcaacaaatttttttaaattgaaaacatgcagagtgtattgtccaaccagaacagaaccaaattagaaataaataacaaaaaccggtaaatctccaaacacttagaaactaaacaaaatacttctaaataatccaatggttaaagaagtcttagggaaataaaagatacattgaaatgaatatcaaagaaaatacaacatatcaaaatttacaacacacagctaaagcagtgctgagaggcaaatttataatactaagtatatacattagaaaagagggaaagtgtcaattcaataatcttagcttctaccccaaaaatctagaaaaagagtaaaataaacccaaagcaagcagaagaaaggaagtaatagcaaaaataaatgaaactaaacacaaaacaatagaaaaaaacacagtaaagcaaagagctatttctttggaaaggtcaataaaattgacaaccctctagaattaaaccctctgacaattaaaaagaaagtgaagacacaaattaccaatatcaagaatgaatgtagggataccactgcagacctgcagacaccaaaaggataataaggaaacactataaacaactccacatgcataaatttcagagataaaataggctaatttgttaagaaacacaaagtattacaactcacccaatatgacacatattatttaaataatcctaaaactattaaggaaattgaatttataattttttgatttccaaggaagaagtctccaggcccagatagcttcataatataattctaccaaacatttaaaaataggattaacatcaactctatgcaatttcttctataaaatagaagagcattacattctgatctactttatgaagtgtttacagtatgtatataataaattacatattgtactatatatttatagtattactctgataacaaaaccaaagatagtacaaaaaattagaactgtagaccaatatatttcatgaatataaatgtaaaaacccttgaaatattagcaaataaatttcagcaatatataaaatgaattatatgccatgatcaagttgggtttatttcatggatgcaaagctggttcagtatattttttaaaaaaatcatagtaatccacatgtcaataggctaaagaagaaaaattatatgattatataaatggatgcagaaaaagcatttcacaaaatccaacatccatttatgattaaaaccctcaaaaaatgggactagaagggaacttcctcaatttgatttttttaaaaggtagtatctacaaaattgatgagtatctacttaatggtgaaggattgctttctcccaaaaaaaggaacaagtcaaggatatctgttcttagcactcctattcaacatagagccaaaagttacacccatgaaaagcacaaaaaaaagaaataaaatgcatccatattgggaaagaaataaataaaactatccctatgcagatgacatgattgtcaatacagaaaatcccaagcaatctacacagagataaaaaaaattcctggaataactaagttcagcaacatctagaaaggacaaaaggaaaacacacaaaaatcacctgtatttctatatattaccaatgaacatatggatactgaaactaaaaatataacaccatttataattgatcaaaaaatgaaattcttagatataaatctaaaaatcatgtacaagagttgtataacacacacacacgaagaaattgatctaaataaatggagaaacatattgtgttcataaattgaaatactcaacatagtagagacatcctttctctccagattgatatatagggtgaatacaattcctttcaaaatctcagcaagatttttcatagatatagacaagatcattccaaaatgtacatggaaagggaaagaaactggaatagctaaagtaatttttagaaagaataaagtgggaagaatctatccagtttcaagatttacacagctacagtaatcaaaactgtgtggtgttggcagaagaataaacacacaggccaagaacacagaacacagaaatacacccacagtgatatactcaactgaattttcacaaagatgcaagaacaatttgatggaggaaagatagtcttttcattttaacaaatggtgctggagtaagtggatattcatagaggagaaaaaagcactttaatctaagtctggtatctcatacaaaaaattaactcaaaatagatggcaaactaaatgtaaaacataaaactttagaaaaaaaaaaacttcaggatctagagctaggcaaaaagctctaaaacttgacaccaaatcatgatctataagagaaaaatgaatgaattcgacttcatcaaaattaaaagattttgatctgtgaaagacgtcattaagaggataaaacacaacgtagaagtctgagcaagatggcctaatagaaccctctagcaagcatccccctacaggaacaccaaattgaacaactacccatgcaagaaagcaccttcgcaagaaccaaaataacccagcccaccaaggcagttcctcaaggagccagcagaaattgcagcattcctgtgcttagggtacaccccagtgctgatacacctgcagtgaccacaagcttagatcacaacactcaatccccttttaatatgtggaaagccttctcaagaagggcaggtacaaataaatccagattacaaagattggaatacttaattcttcaatgcccaaacattgatgagtggccacaagcatcaacaacatccaagaaaacatgacttcactaaataaactaaattagacaccagtgaccaatcccacagtgatgaagatatcatctttcaaacagggaatcagaatcaccaccttgaggaagctcagcaacatagataaaaagataacagagaaggaattgagaattctttcagaaaattcaacaaaaagattgaaataatttgttttaaatcaagcaaaaattctggagctaaaaaattcaactgataaactgaaaaatgcatcagaatcaacagcaaattgaccaagctgaagaaagaatcagtgagtttgagtcaggctacatgaaaacagacagtcagagaagagaaaagaataaaaaagaagcacacctacaagatctagaaaatagcctcaaaacagcaaatctaagagttattacccttaaagaggacagacaaagagagacagagagaaatatcagggtagaaagttcattcaaagaaatgacagaaatttccaagcctggagacatgaatatccaagtacaagaaggtcataggacaccaaaaagattcaacctaaataagactatctcaaggtatacaataatgaaacccttaaagaacaaggataaagaatcctaaaagtagtaagagaaaataagcaaataacatagaaaggatctctggtatatctggcagcagacatcttcatggaaatctcacaggccaagagagtggaatgacattcaaagtgccaaagaaaaaagaaagtctaacctagaatatcatatctagcagaattattcttcaaacatgaaggagaaatactttcatagaaaaacaaaagctgagggatttcaccaacaccagacccaccttacaagaaatctaaagaaagctattcaatctgaaaaaaagggatgttaatgaaaaagaagtaatttgaagatataaaaattactcgtaaaagtacacagaaaaataaatacactaacactgtagttgctctaacagtatagttgcactaacagtgtcatataaaccacttgtatctttcataggaagactaaaagacaaatctatcaaaaataattacaactacattttaatagatacacagtataaaaagataaataaagagatcaaaaagtgaaagcagggggtagggaggagatggagttcaagtgtagtgttttaattttatctttgctttgcttttctttgtaatcacagttgtcaccattgtcaccatttttaaattggttaataaatgctatttgcaagcttcacggtaatggcaaagcaaaaacctgtaagagatacacacacaaaaaaaaaggaaattaagacatactgtcagagggaatcacttttacacaaagaaagacaggaaggaaagaggaccaacaaaacaaccagaaaacaaacaaaatggcagtagtaagttcttacctatcaataacaacactgaaatttaaatggactgaattctccaatcaaaagacatacagtggctgaatggagtttttaaaacacccaactacatgctgcctgcaagaaactcatatcacctataaaggcacacatagactgaaaaagatattctatgcaaatggaaaccaaaaaagcaggagaagctacagttatcagataaaatagatttcaagacaaaaactgtaaaagagacaaaggaggtcattatacaatgataagggggtcaattcaacaaaagcatataacaattataaatatatatgtacccaacactggagcacccggatttataaagaaaatattactggagccaaagagagatggacctcaatacaatatctgggaatttcaacacgccactttcagtattggacagatgaccccaatagaaaatcaaagaaacactggacttaatctgtactgcacaccaaaaggacctaacagacatttacagaacattttatccaactgctgcagaatacccattcttctcctcagcatatggaacattctcaaggacagaccatatgttaggccacaaaacaagtctcaaaaattttttaaaaaatgaaatcatatcaactactttttccaaccacagtggaataaaactagaaatcaataacaaaggaaactttggaaactgtacaaacacatggaaattttaaaatatgctcctaaccgaccatgaggtcaatgaagaaattaagagaatataaaaatgtattgaaacaaatgaaatacaacattccaaaaccaatggaatacagcaaaagcagtactaggagtgctagtttatagcaataaatgcctccgtcaaaaaataagaaaaacttcaaataaacaatctaacaatgcatccttgaagaactagaaaagcaagagcaaaccaaactcaaaaaccagtagaagaagtgaaagatcagagcagaagtgaatgaaattgagactttaaaaaaatacaaaagaacaaaatgaaaagttggttttttgaaaagataaacaaaattgacaaacctttagccagattaagaaaaaagatctttcctgtaggagtagctaaaaaggaaaaaagagagaagaaccaaacaaataaaaccagagatgaaaagggaggcattacaactgataccacaggacaactatgcatcaataaattggaaaacctagaagaaatggataaattcttagacatacaacctgtcaagattgaaacctgaagagatccaaaacctgaatagaccaataacaagtaatgagatagaaagctttttactactgcttctatcaaagaaaagcccaggacctaaaggcttcactgctgaattctaccaaacatttaaagaactatgatgcctgtaatcccagcactttggaaggccaaggtgggtagatcacttgagcccaggagttcaagaaccagcctgggcaacatggtgaaaccccatctctacaaaaactcaaaaattaatcagacacggtggtgtgcacctgtagtcatagcacccaggaagctgaggcaggaggattgcttgagcctgggaggcagaggttgcagatcacaccaagatcacacccctgcactccagcctaggtgatagagtaagaccctgcctccaaataaataaataaatacacacatacatactattcatactattctaaaaaattgggctaaaaaattgagcagaaggtaatacttccaaacccatactatgaggccagtattacttggatatcaaacccagacaaagatacaacagaaaaaagaaaactacaggccagtatctctgatgaatatagatgcaaaaatcctcagtgaaataccagcaaactgaattcaatagcacattaaaaaagtattcatcatgatcatgatcatgtgggattcatcccagggatgcaaggatagttaaacatatgcaaaaaataatgtgatatatcacattaagagaatcaaagacaaaaccacatgcttttaattgatttttttaaatatttaattttatttcaagtttggtgatacatgtgcaggacgtgcaggtttgttatataggtaaacatgtgccatggtggtttgctgcacctatcaacccattacctaggtattaagccccccatgcattagcattttatcctgatgctctccctccccccgcctcctccctgacaggccccagtgtatgttgttcccctccctgtgtccacgtgttctcattgttcagctccaacttatgagtgagaacatgcagtgcttgacattctgtttctgtgttagtttgctaaggataatggcttccagctctatccatgtccctggaaaaaacatgatctttcctttttatggctgtgtagtattccatggtgcatatgtaccacattttctttatccagactatcattgatgggcatttaggttggctccatgtctttgccattgtgaatagtgctgcaataaacatacacgtgaatgtatctttataatagaatgatttatattcctttgggtatatacccagtaatgaaattcctgggtcaaatggtcatatgataattttgatcgatgctgaaaaagcactcaaaattcaacatcccttcatttttaaaatactcaacaaattgggtatagaaggaacatacctcaaaatcataaagccacatatgacaaacccacagctaggatcatactgaatgggaaaactgaaagccttttctctaagatctggaacaagacaacgatgcccactttcaccatttttattcaacatggtgctggaagccctacccagaacaactagatgagagaaagaaataaagggtatccaaattggaaagaaagaagtcaaattatcattccttgcagacgatatagtcttatatttagaaaaacctaaagactccacaccaaaaatctattgaaactgaaaaataaattcagtaaagttgcaggatataaaaatcaacatacaaaaatcagtatcatttctatatgctaacagtaaacaatctgaaaaagaaaccaagaagctactcccatttacaatagctacaaataaaatacctaggaataaacttaaccaaaaaagtgaatgatgtccacaatgaaaactataaaatattaatgaaagaaattgaagagcacacaaaaaatggagacgttccatgttcatggactggaagaatcaatagtgttaaaatgtccatggtacccaaagcagtctacagattcaatgcaatccctatcaaaataccaatgacattcttcacagaaataaaaaaaaattctaaaatgtatatggaatcacaaatgacccagaacagccaatgccatcctaagcaaaaaagagcaaaactgaaggaattatgtaacctgacttcaaattatactacagagctatagtaaccaaaacagcatggtactggcataagaacatacacattgaccaacggaacagaatagaaaacccagaaataagtccatgcatttatagtcaactcattttcaacaaaggtgcaaagaacatacactagggacagtctcatcaataaatagtgtggggaaaactggatatccatacacgaaagaatgaaactagaccactatctcttgccatatgtagaaatccagtaaagatggattaagaacttaaatataagatctgaaactatgaaactactagaagaaaacattgggaacatgttctagaacattggtctgggcaaaggtttcttgggaagacctcaaaatcaggcaaccgaaacaaaaatggacaaatgagatcacatctcgctaaaaagctttgcacagcaaaggaaataatcaacaaagtgaagagacaactcacagaataggagaagatatttacaaactacccatctgacaggtattaactgctagaatagataagaagctcaaacaactcaatagggaaaaaaattcaatttttttggacaaaaaatccaaacaggcatttcttttgttctctttgtttttatttggctcagaaggtactgaatagagatttcttaaaagaaaacaaacaaggccggccacggtggctcaagactgtaatcccagcactttgggaggctgaggtgggcagatcacctgaggttgggagttcaagaccagcttgaccaacacggaaaaaccccatctctactaaaaatacaaaattagccaggcatggtggtgcatgcctgtaattccagctactcgggaggctgaagcaggaaatcacttgaacccagaagcagacgttgtggcgaactgaggtcatgccattgcactccagcctgggcaacaagagtgaaactccatctcaaaaaaaaaaaagacaaatggccaacaggtatgtgaaaaaaatattcagcatcactaatcagagaaacacaaattaaaactacaatgagatatcatctcaccccatcaaaatggcttgcatcaaaaagacaagtaataactgttgctggtgaggatgtgtagaaaggggaaccctcatacaccattggtgggaatgcaaactcctacagccactatggagaacagtatggaggttcctcaaaaaactacaaatagaactaccatatgatccagcaatcccaccgctagatacatatccaaaagacaggaaaacagtatatcgaagagatatctgcactcccatgtttattgcaaccctattgacaacagctaacatatggaatcaacctaagtatccatcaacagatgaatggataaagaaaatgtggtacatatacacaatggaacattattcaatcatgaaaaagaataaaatctttcataaaaaagaataaaatcctatcatttacgaagaataaaatccttcataaaaaataataaaatcctgtcatttgcaacaacatggatggaactagaggacattaagtgaaataagccaggcacagaaagacaaatattatatgttctcattcacacttgggagtgaaaaaaaaaaattgaacccatggaaatagagtagaatggttggttactagaagccgggaagggtagcagggaggggttgggtgagtggggattgttagtgggtacaaaaatacagttagaataattaagatctggtacttagtaatacaataggatgaccatagtcgataagttactgtacatttttaaataactgaaagtggccgggtgcagtggctcatgcctgtaatcccagcactttgggaggtcaaagtgggtggatcacatgaggccaggagtttgagaccagcctggccaacatggtgaaatcctatctctactaaaaatacaaaaaaaaaaaaaaattagctgggtgtggtggcgggcacgtgctactcgggaggctgaggcaggagaatcgcttgatactggaaggtagaggttgcagggagctgagatcgtgccattgcactccagcctgggcaacgagagcaaaactccatctcaaaaataaaaaaaataaataaaaaactgaaagtgaaattgagatgttcctaacacaaagaaatgatcaacgcttgaggtgatgaataccccaattaccatgatttataacacaacatgtgcctctatcaaaacatcacatgtactccacatatataactattatgtacccataataattaaaaataaagaactttttaaaatacaaggtacaaactggaagaaaatagtttcaggccacacatctgacaaagcaccagtgtctagaatatatcaaatattctcaaaactcagtggaaaaataaacaacgcactcaattagaaaatggccagaagacttacacagatatttcatcaaacaagatattcagatgccaaatgagcacaagatgttcaacatcactagccatgagggtcatgtaaattaaaaccatactaagataccctacacacccatcagaatggctgaaataaaaaattatgacaataccaaagactggtaagtgtgtggaaaagctgaatcactcatacattgctgatgggaacataaaatggcagtttctttaaaaactaagcatgcaactactatatgacccattaattgcactcatatgtttttatttctctggaataaatgcctatgttcacacattgtctacacaaatgtttgtagcagttttattcctaataaccagaaacaatcggttgttctttgacaggtaaatggctaaactgtgatgtatccataccacggaatactgctcagcaacaataaggaataaactaccaatacatgcagcaacctggatgaatctccaaagaactatgcttagtgaaaagagccaattccaaaaggttacctacagtatgattaatttataacatttttgagatgacaaaattaaaagaacagggggaagattagtggttgccaaggggttaagaaagggatgggagtcggaggaagtgtgtgcaactatagaagggcaacaagaggaattcttgtggtgatggaagtgttctgtatcttgactgtagcaatgtcaatatctggttgtgatactgtactaaagttttgcaaaatgttaccaagggggaaaactaggtaaaagaatgcatgcaatctatgttatttcttacaactgcatgtgaatttataattacctcaagataaaaatttttttaaaaagagaaggccaggcatggtggctcatgcctgtaatccctgcactttgggaagccgaagcgggaggatcccttgagctcaggagttcaaggccagcctgggcaacatagcgagacctcgttctctactaaaaatcaaaaattagccaggtgcctgtagtcccagctactcaggaggctgaggcaagaggatgactcaagccagggagtcaaggctgcagtgagctatgattgcaccactgctctccaacctaggtgacagagtgagacctgatctcaaaaaaaaaaaaaaaagaaagaaagaaagaaaagaaaagaaaaataagtggtacatactcatcatagaaaattttcaaaatgtagattaggaagatctaatttggttattatacaaatagactaatagatatgacattaatatatttaggggcttttcaagtatattgactactttttatcacaataaaaatatatagttgattatattttttcccctacacatttgctcagagcctcctgagaggctctaaaggattacacagggatcatatgctcatggatggctgcctctgagccaaaccctagcacattgtggaattggtttcttcctgagtaccaatttggaacaattaattataatggtcatctcaagtactgtgctacaagaattatgaggcaatctctgaacccaaatcagaacactgtgattgactagcagtgtccatcagcagcatggggttcaggggtacagtgtcacctctgctggctggaagaaatgtttttaaaccaaccttgcaaactgcaagggacactattaataaaaccctctgtgtaaaggttcttgaaaaatcactcagtcttctgtcatatccaaatattatgttgcattttttatctagcaactattatatatggttgatttttctttttttagtccactaaattgtacatgtaaagaccaaacagcttcagatttttacagcgattagttctccatgcccagcctagaacacaatacttcttactctgctgagagaatgatcaaccaacaagcattatttaatgccgtgtatcagattatatattaggcaagcatttaatcgccaataaagtcattcagtctataaatctgaacactgctatatgccaacattaaatgggaatatgaggtatctgtactctgaaaactcagtctattgggaggatactgataactatgaaacaattataatagataagtgctcttctaggggcagacagaatgctgtaaggaacccctaacatatgactgtaaactggacttggggatcaggaagtcttcctggaagaggtagcatctcaagtgatacccaaagatcaagagggaagggagaacaatgaggcaaggtgagaagtatcccaatcaagaagtctcaaataccagagtccccggtaatcccagcactttgggaggccaaggtgggcagattacttgaggccaggagtttgagaccagcgtggccaacatggtgaaatgccgtctgtactaaaaatacaaaaattacccgggcatgggggcgcacgcttgtagtcccagctactctggaggctgaggcacgagaatcacttgaacctgggaggcggaggttgcagtgagccaagatctcgccactgcactccagcctgggcaacaaagtgagactctgtctcaaaggaaacaaacaaacaaacaaacagagtccaaaagagtcgaggttaggctgaaaagatatgcaagaactcaagtcattaagaccagaagtcatattctagaatttgaataatttcctgattgaaacattttaaactggagagtaaagattaccttaggatagggaacaagatgagaaacagttactgttgttagtagactgttgcaataatcaggtaactaatgacaattgcctgcacaagggcagaaggtagggaggcagagaaaatgaaatgttaccagaaattctaacttgatggttaaggattaaactaaagtacattcacatacatgccagcatcctaaagcctaatacttacacccattgctggtagtcttgtttctgccccattatctggagaccagaattcacccacacacgtatggaggctggcaaacatcacaaccacctccaggagatggtttgctgaggggccagtaaactagtgttgtggttgccttgagagaaatctagggaggttcacaacaactcccacactatagtagaaagctcttcaagagaggacaaactcacttttcagcagagaaacttgacctcatatgccattaagggtaggtgagtttgtcccacaaaataatgctgctatgtgccctaatgaaccatcgtttctagaaaaaaaagaaaaaatgattactaagagctgcacccaaagtaatgaggctagaatcaagctccctcccccttcatcagcactagcatgactgctggcatgtcgtacccaagttgggactcaaggtcacaactttttgtatccactcagagccactggcccaaagcacaagtctactcacaagagaaccaagctgtgactgctccaatgctaccagcttcctggatccagaatcacctaacagcagaaactcagcaagaaaaccaagatgtagggagaagatacaagcggctggagaagagcaaagccttaaaatggagatgagagaggagaagggagggataaagttttgaagtaggagaaaacaaaaagaacaagtcccctgctgagagcacaggagggtggagtaaaaagagattgagaagacagctactaaatggcttaagtggagattaacaggatctgccaaacaacagcaaggacctggctgagaacaaacagcatgagtaggaatgggtccagtcaacaaggttgtgggaattttctaacaactagagacacagaatttagaagagtcaaactatttttggctaataaagtgaagctggattgtagaatctcccttcctaattttaaaatctataaaatctaacaaagataaaattcaccagcagcagcctaatgggcatttcctcataccataaacattgaaaagtagcagccaaaacaattctcactgctatcaaatttgtagagacatggactgcagagtcatcaactttccctctagcaagtggtagagggtgaggggagaaagaatgaatggtggccgggcacggtggctcacgcctgaatcccaacactttgggaggccgagacaggaggattgcttgagctcaggagtttgtgaccagcctttacaaagatagggagaccccttctttacaaaaaataaacttttaaaagtttgtttcttgcaacaaactgaactaagaagtattaaaaacactgtacgtttatttaaaccattacttttcataattcattgagtcttattagaggtcaacatcttcattctgttaccttactgggtacattcactgatgttacataaaacttcatgtaaaattaaataagaattaaaagtacagctaagaacagtgatgatctgtatgagaggatttaccattgtgtaccctagtccctaatatggtcattttttgtttcatgggcctctcaaccttaaattcatttttattttagagagaataaaggcactcctctgagctcttgcccaccacgtgcccagtcgctgcgtcatcggtgtgtgttgacccagtggtacctgtccagccggtgcatagcaggcctgtaacacttaggatgcttctgcgagccatggtaagtgtttcccaggaggccaacacggccgtccaccacattctttttgcgggggatttgtaaccaagattgaaagggctgtttcaagttttcaacctggaaaaaaaaagtataaagatctctaataagctagctgtaaggactaaatatgaacccataattcaaaagtcaggcacttcaaaagcatagggagcacaaatgaatagaattgaaagtgcataaccatctttgaaaaaaatttctagcacttggcgggaacataaatcactttatactgtacctttttaaaaagttaattaattcaactaaaaactttttaatatgcttattcaagtttatgtttattcttgaattgtccctcttccatccctacctcaccactgccaacccaatccaaaactgcatgttcatgatctctggggccacagcctagaaatcttcattttaaacacctaagatgatggatacagatgttttacagatcacactttgaaaagacattgctgtaaaagaatatagctgattacaggtctgatccccaaatggaagaagacctttctaaaaataaaaatagaattaagggcaaatactgtaaatcctcactcaacaacctcgataggttattggaaactaattttaagctaaatgacatatagcaggtctttgaataacatagtttggttataagactgaggaaaaaaatggctttgtcatacatcattttacttaaagtcactgtttccaagaaactatcaatgacacacatagtttaaaaaactagggacaaaacatttgccagaaatatgtcaaggggttaaaatcgttctggcatataaagaacctacaataatacattagaacttcaaataatgaatggctgaataagagaaaatttgtagggcagtaggtgctaaaacatttgggcacatggaaagttttaatgtttaatttcactaatactgtattatatatgcatatcatgttaatcaaattatctgttttttaaatgagaatagccaattctagaaaaaaatggcaaagttggcacttttacatacagctggtgagactacaaataaatacaactttctacatggtgtttcggctgcatattaaaaaccagtaaaatgttcatactctgcgacccagtagttctgtgcttgagaatcaaatctcaagaaacaacctaaaattcaggcatcactatacgagttaccagcttttaaaaaaatattacaaccatgtggaaacagcctagaatatctgccaataataagttacaaaggaggcaaatgaatattaaaattttaattgctttaacatttaatacataggtgattaagagaacatacaaacaaatatatacatatagtgttaacaaattctctctagatcagtgtttttcaaattgtgggtcatgaaatcaatttagatacttgaaatcaaatgaatttaattggaagtattgggagcattgggagcattgctcctagtaaagataagcactgtttcatgaaactttttaaatgtaaatatacatattttgaatgggttatggtttaaaaagaagaaaaaaatagctgagaaaaactgctctagtggcagaatttataggcctttgacctttcctatatccaaattttctataaatgccgtggtattttcaattgacagaaaaaaaaatcccactaatcttaatctttgattctgtaggaatttaagtggaaggaaacctgtgtatcttcaaatactgtatgaagaaataggacaataaaagattatgtggatcctaaaagctcagccaagtgtagggaatacattgtgcagtgaaggagacagaaaaagttttgccaaaatattaagagtctggcttttaaaaatctacagttttgttctttccatgtttttttgcttctttgttttcataatgagtgcattctttttagaattagatagaaaaaaagtatagaaaagaactggaacactcttgacctgataaatactcttcggattgctgactttaggaatgacacgaggttccttgctacaactttcttcatcgcaggaagtgccagaggaaacgtctgatgaggctctactaacggcataactgatttgttgatatagttcccattcctcccatctgcctttaaaagaagcaactgtaaatggatggtttttctcaccatacctaagtaggaaaagaaatttaagtgctaattagcgattcaactttctacaagatctccaatctttcctggagacaatatgctaacttattttaaaagaaattgccttaaaaaattgaaggacattatgaccttcacctactacactgttataaattaggatattctataagagctattttggttaattgttcagaaaaaaacaaagactagtttcttttgattcagttaatgaactgaattgtcccatggtagataactctccttcctttctgatgttgcctataacacttatctgttatcaacctacagtttgtaatagatactgttaccaatctatagtttgtaataaggtgcagtgattaaagccacatttcaaatattttgcaaaatcattgtgctttccacctcacccactttgaatagaagtctgcattgtctaacagaagtttgcatctaaaatcttaaccaagaagtatccctgctgccaactcaaggctttggggcatcatctttcatgaaggtatgtaaagttgtctaacttaaggtttccaggtatcacacagcacacaaactatgagattactcacctacagcatacttcaaagggatctacccatatggtcatctccttcggaagtcccaggtgagaaaaatctacattactttccacacatgccctttctagaatgggatctttattctgattgttgtttatcctgatgcacctttttaaaaagcgaagggaaacgaagacatgatgacagacactttagcaggagaatcacattatgcacatactgttccaatacacatagctcccacctcatcccctcagcctccttcccctcagcctcctccaccctccactcttacaagtaagacatcatcaacttttgatacagtggctcagaatgtatgttgcatcactaagtcacaaaattagttatctttcatggcaaagacaagttagaaattgtttaatctacctcacataaggggctttgctctgttgtttccagccacagtgtcatctactatgtctcctcctttcaattccacgttcaaacaaataaactcgagcccataaaacttttgttacttatatgcagaaaacaagatcactccattttcctaggagctggctggttgcttggtgattgcttccctttgccatcccacatactagctctcacctgaaggcttgccctttagaagggcaatcagagtgccagtgacttctgtatgtttcaaacaagatcgtcatcagcttttctgcaaagtcttctatttgctgtttacttagtttatcatgttttttcaccaatcttgtgacaaagaaaactgttgttgcaatttcatctctcatgattcaagaaaaatagataaggaggtctgaatcattaaaaggaagcaagaagaaatagaaagaaatggtttaacttattatcaatatttaactgccatttggaaattttacataccttaaagttaaaactgagaaaatctgctagaaagaagtccttagtaaactaggtaagtacatgaacactatcaatcaacataacagccaagaacagcaattcctcaaatagcccagttttaaaggttttcaaaggaaaaaaaaaagtctttttaaaattttaaagcacttaagtaataaatgaaacatcactacaacttaaaaaagatcctgatatgggacagtaattacctcaagcatcactttttaaagatatattaacaaagagcaaaatatttcaggagagagtaattccaaaatgtggctccaagttgcatgctttaggaataatcaaacacattatacttgccaacaaaagctctttagcccctaagaaaagtgggcgagacttagaagaccaaccgcactatcccttatgtttccaactctcacccacacctgttcgtgagttcgaggctgaagtttatataagcctgggccctaaaggctgatggatgtttcaccttacacaggtgctgcctattgaaatgatcatacagctttttcatatgccaatctggtctccatccgattgctccttggcataagtggagtgggttctctatttgaagtgtttaaaattttcaaactggatctatattttctattttgctattataatcttatcttttataacacagagtgagaatcaagtgttctccttccatatcctaatatcgtacattccaatgatgtcatctctaacttagctgacaacatattaaggaattttgccttagatttcttacaaaatttgttacgacaactttgagcagtcattatgttgactacacattttttactaaagtgtttatttgtaggataagtggaagagatctgagtttatctaacctcaccagttctcaaagggcgggtcagtgaccatgtgatctggactcactgtgtttcttgttaaaaattcagattcttggccaggcgcggtggctcatgcctataatcccaacactttggaaggccgaggcaggtggatcacctgaggtcaggagttcgagatcagcctggccaacatggtgaaaccccgtctctactaaaaatacaaaaattatccaggcatggtggcatgtacctgtagtcccagctactcaggaggctgaggcaggacaatcacttgaacccaggaggtggaggatgcagtgagccaagatcacaccactgcactccagactgggtgacagagcaagactccgtctcaaaaaataaaaataaaaataaatttaaaaattcagattcttggaccttatttcagatctgctgaagcaactcttctcaaggtaaggcctggcaatcagtagttatcaagttcccccaggtgattctaatacccattaagcgttaagaagccacacctgacatacgttaagtctttaacgctcaggattagtgatcattcagtttcttcattagtgaaaaggaattcactgtcttacaaggaagtccatttcatttctaaaaagctccaaataacagccagaccttcctttctgtgtggagccaaatctacctctgattttcctatatgtgcagcctagtttttccttctggaactacaccaatcgtgtctaatgttccaccacatgatgacatttcaaatactagctactcagcctccctcagctttctctttgtggagcctaaatagtctcagctttttaagagtttttcctacagacacagctcaccatgctgggtactcacatcacaatgagtgtcaggtgtgtgagtaatcctcttttttttttccagcttgcacacaatgctccaggtgtgctccacccctaaagactagcatgggactgttgcttccctccctctgaatactgtattccagaacacaacctcaggtggcttttaccttgttggcagtggcatcacaccacagactcacattgaatttgcaagtactctttttcattaatgctatcattttgtcatatctttccattcctgcacaatacaaagtttaaaaatatgggcattaagatcggatagacctgagtgtgaattgcaactttaagactcaccatctgtgtaaccttgggcaacttaattttctgcctgtgaaatgggaggtacaatagtgaactcataaggttgtaattaagattatactagataacagtaaagcacttgttcttgagctgggcagatggcctcatgcctgaaatgcaaacactttggtcccaggcgaaaggatcacttgaggtcaggagtttgaggccggcctgggcaactcagtaagacccctgtctctacaaaaattttaaaagtcagcttgatgtggcatgtacctgtagccctagctactcgaaaggctgaggtgggaagatcacttgagcccagaagtttgaggctgcagtaagctatgagctatgattgtgtcactgcactccagcctgggcaacagagcaaagaccctctctcaaaaaaataaaaaaaacctttcactagtgaagaactgagatgaaatacatatattaggtagtgtgctggctattgtaatgtctttgatgcttgagaggtataagaaatgtaagtataaggattatcaaagttggttaaggatacaaaaatagatagaagaaattagttatagtattccagtacagcagagaaaaggatacaaaaatagatagaagcaattagttctagttattctagtacagtagacaaattataggtaacaattgttgtatatttcaaaatagctagaagatttgtaatgttctcaacacaaagaaaagataaatgtttgaggtaatggatatcccaattaccttatttggtcattatatattgtacacaagtattaaaatattacatgtacccccaaagtacatacaactattatatatcaatttttaaaaattgtttaaaaggactatgaaatgggtggctgagcatcttgatatctaagaatatgatttaagatttaattaagattaatttaattcaatttagtaaatatttaaacatctactatgtacccagaacatattaaaataaacaaacgtgaaagtaggaccttaataatcttccaaatccatagtatcttgtttgtttcagctgtccatgatgtagttgtcattcctcttcctcagtggctggggtacctaaactgttgcactttggaatcacctgaagatcttttaaaaataccaatgtctgcctcctatcccttaccccagacattttttttttttcaacagagatggagtctccctatgttgcccaggttggtcttgaactcctgggctcaaggaaccttcctgccttggcctctcaaagtgctaggattacaggtgtgaaccaccacgcccggccaagacattctgacttaattggtatagagtgcaacctgcacatcaggatttttaaaagttccccaagcgattctaacgtgcagcaaaagtggaaatcattaagatagataccgccttagctgtgaagaagattttaagcttattttacacttttgattgcttaataatgccttaagtttaacagattattaggacaaatttgcatcatttattctcgtattttctagccatttgctagggtaacttttgcaaagattattttttaaaatttatgttacaagggacaaagctgaaaattagggtaactccttgtatactgctgaaattttgcttctgaactaaaggcaacagatgcattaacaaacacaaaattttttttcttttcaaatggtcagtttgcatttacaataatagaatggtgccaggtgtttttataattctttcattacttcatcttcctgatgacaaactgttcccttgcactttgagttggtgaagtacattaatgaggttttgaaccctctcctagcattattttctgcaacaggcccaggcaggccttgaaagttatgaatagaacagtagaataacaatgtacttagatttcaggaaagaacaatcaaataaaaagtaaacatcatgcaaggtttccttccgttacttgtttatgacttgaaacaccttatttaaatcacctcctttacattaatgacaactacaccttctgttttaattaacactcacttagtgactatttactgaccacctacttcacagacactaagtattagtggggctgggggtaaaaacaaaattcaactttcctttcaagaggcttatcatctagagagggaaaccaaatacatacacaagtgactacttggatgtaaagtttgggaaatgaaatactcaaaatttaccccaagtttcaaacacttgtaaccaacagattaatgttatcattgaaagaatgaagttcagtggaagagtcggtataaaacaaatggtgattcattcagattgaggtatactgagctttcaatggcaattaaatacccaagtagtaatgtccactgacaagatgtcagaatttagcagaaagaccaacctggtctggcctaagccaatcccagagctaagtagaagagaaaattactgctgaaatttgaacaactctcccactatccttgtgtcatgtctaaaattctcattataagacatttgttcccttgcttaaaaccttgtctttcaaggatatctttttgaaaatgtccagtgaactatccatagtagagcaacaggatggtgttctgtttgggtgaggggattatgtctgggcgaagaaccacagaaaacaagaaataagaggttctggccatttggagtgaggatgaagaacagaaaggcagtgaagcaacatacacatattttatttcctattatgcctgtaacagagaatcaaatggtataaaacatgaatatgactgacatgaccttgtacaagtaatagtttctagaattgcattcttcattttaaaattaggaaattcaacttgatggctaaggaatagtcaagccccaaagttcatcgatgaaggtaaaactcgaaaatctggttctacatttgtcttcttggtttttgctaaacttcacttataaaatgaaaatagttatgcttataaaagttttaaaatagacaaagtaattttaaaatatcatctgaattgaatgttaaatttgctggacttgtgatgtaataaccagtcttatcataaccccatttcatttctttagcttccctccctaaactacaagttatatccgtagtctcacccctccattcacaaatacatgttattgctaaagaggggaaaggtatagatgttttagcaaaagtccacttctgacagaaagtatttttttaacaacagcaagcaagtagcactattttataaaataatgaactgattctgtaacccacacataaactcagttccattatggtcaagccacataaaaggaagttacattaattgctgaaacaaaattgcatttcccaaaacattatctaataaaattctacagccatacaatgttgatttgaactcaaaagaaattaattttagtgcagcctaatcaaaataaaattcctttaccaataatactaagcaagtgttttatccgccacaagcttcttcctaatttgtattttctatctgcattactgagcattcacaatgtaagtggcattgtttgaaagaccacaaaaaatacatacatttatataacgtttcaagttagaaaccaagataactcctattcaacatagtactggaagtcctggccagagctatcaggcaagagaaaaaaataaaaggcatctgaattggaaaagtagaagtcaaattatctctgttcactgacaatatgattgtatacctagaaaaccctaaagactcctctagaagactccttggcctgattaacaacttcagtaaagtctcaggatacaaaatcaatgtacaaaaatcagtagcatttctataaacagtaacattgaagctgagaaccaaattaagaatccaatcccacttaggatagccacgaaaaagaccaaaatacttcagaacacatttaaccaaggaggtgaaagatctctacaaggagaactacaaaacactgatgaaagaaattgtagatgacacaaataaatggaaaaacattccatgctatgaattggaagaattaatatggttaaaataaccatattacccaagcaatctacagattcaatgcaatccctatccaattaccagccttgtttttcacagaattaggaaaaacagtcctaaagttcatagggaaccaaaaaaagcccaaatagccaaggaactcccaagcaaaaagaacagagtcagaggcattatattgcctgacttcaaattatactacaaggctatagtaactaaaatcgcatggtactagtacaaaaataaacccagagattaatggtacagtatggggttctctaacctagaaataaagctacatatatacaaccaattgatcttcgattaaagtcaacagaaataaacaatgggaaatagacaccctattcaataaatgatgctggaaaaactggctagccatatgcagaagactgaaactaattccccatctcttaacatatacaaaattaactatagatggattaaagacctaaatgtaaaactatcaaaactgaaactataaaaatcctaaaagaaaacctaggaaaactccttatggacatcggcttaggcaaataatttatgatgaagattccaaacacaaacgcaataaaaaacgaagatagagaaataggacataaactaaaagtttctgcacagcaaaacaaataatcaataggataaaaagacaactcacagaatgggagaaaatatttacaaattatacctccaacaaagaattagtattcagaatctacaagaaattcaaacaactcaacaaacataaaacaaaccaattgaaaatggggcaaagaacatgaacagacatttctcagaagaagaaatacaaacagctaacaaacatatgaaaaaatgctcaacatcactaatcatcagagaaatgcaaattaaaaccacattgagataccatctcactccagtcagaatggcttttattaaaaagtcaaaaaacaacagatattggtgtgtatgcagagaaaagggaatactcacacactgttggtgggaatgtaaattaattcaacctctatggaaaacggtatagcgatatctcaaataactaaaaatagaactatcattcgacccagcaatcccactactgggtatctacccaaaggaaaagaaatcattatatcaaaaagatacttgtacttgtgtgtttattgcagcaccatttacaattagagcaaagtcatggaatccacctacatgtctgccaactgttgactggataaagaaaatatggtgtatatatacacaatggaatactacacaatcataaaagaagaatgaaatcatgtcctttgcagcaacatggatggagctggaggccattacccaaagtcaactaacccagaagcagaaaataaaatattacgtattctcacttgtaagtgggagctaaagaaatggtacatgtggaaatgaaaatagagaaaatagactctggggactccaaaggtgggtggggagggttgaaaaattacctactggatacaatgcctaatactggggtgataagtacagcagaagcccaacacgcaacattatgcatgtaatacccatgtaacaaacaagaatatgtaccccttaaaaaaagaaaccaagataactcactaaaattaattcagagtgtaagaaaatgttcctatgtgcaacactctatactaatataaatatgtgtatatgtatcagcactctataccattataataaaatgctgaattcaaaatacaattagaatatagaataatactctcttattaatggaacatactaattttagagtgactatattaagtgtcaaagtgattagagaagagaaaggatcaggaagaactaaaggtactagggaagattttacccaggaagtagaatttgagcttgagatttcaagaaactatagaggagctaagagcagaaaggacaatgtgaactttactaaatgtaagcatgatgaaatccttgagatatattctatgaatatagaggaaataaagataacaaatgaggattatgtaaattttttaactaaatataagtttcccactttaaaaaaaaaaagcttaagtgccaaatgaggactgtggaaataaaaacaagaataagcagacacagagtgatgtttaagaggatggcataaagtattttcattcttgtaaatcaattaattagcaggataatcagtctgttttctccttttggcttaatagagttacagaatacaccctagagctcttaagaaggggaaagtttattaactttcttcagctgtgcagactactaactagcttattgaaaccttaaaattacttttataaacctgaaaatctgagggtttttgttttttgtttttttgttttttattgtttttcattttttatttttttaagagagatgacagaggccaatcagtagtaggacaaggccaagaaagttcatctgtttagttctagcctacagaagatcattgatccttcattgactcaatgaataaagccctggacaaaaaaatctggtagagccagtccaatcatctgctgcctatggctaattctttactgaccaaaccttggtgatgtggtggtgccaatgcagcagattctcttgaattcgtaagcgtatgaattttaaaatagcttggtttttgtgagagtcctctcttctgcttcctgtgggctaacccttcccaagatctacttcctcctgtcagcccctaaagaggagagggatcctctcagatttgatcctgagccttctgttttcctcattctattttctattcgagattaatacattaccgtcatcacctactctagtgtccttgatagcagggactggtaggtcaatgaagaatcagccagcagacctttcttggagaactcctcgtgacttcaactatcaagaggataaaagagcttcaatctcttttcagttctggcctcctaccagagttctaactccacatatctaactccaccacaatattcttccatgacctaaaactaaacatgcctatacctaaaatcacaattattctctgactagattttccccctcaacacctctacttttcgtcgaagtctggaagttaatcttattccgtttgttcacttgaaccagttatcaaccaagtcatgcaaagtttccttcacaaagtttctctcttcatcccatattttctacatcacctcgtactgaaatttactaatctcctaaatggtctttcagtctcctctgtctctccctcttctaatctatgctactttatgaatccttataaaacaacacattgtatacatctggggctccttgagcagaataatgaaattgaaactccctgggcttttttttttttggtgaacttcacagaaacgtatgagcaggcaggtaagtaggatcatggaggactttaaatgttaaagtcctctttaatcttatttccccaatgggaacacactcattgctcttccaattggccttatacattacaatctccataaatttgcttgtgtttttccttcacaaattgctcctgctaccaaaacattccctcttcatctctagtatttttgcttctaggctcatcttttccatatagccttctctgtgtcctaacctttgataattttccttttcctttttcctaaatgttggcaataatgaagtttgtattagtcatcaggattcctgaagcactttttcatataaccatcttgatattaaataattatatataatataaatagaatatataacacaaacatgaattcttaatctattactataagttatattaagatatattcatattacatactaatataattaacatattaattatctatatatacacacattgtccatctcaccaactagaccacataaatccttagagattgttctctaaagatggaaaatatgcaacctgtttgctcctactgaagccatacctaagagctccggcaactttaattatagagactattttgttagactgcttatgatttacctgaaagataaattaacattttatactgaaagcaacagtattgattaatcaataaatataaacaagaagctaattaagaatctggtgcactcttactaatgagagtacaatgaaatgaaactagaaatatggaattataaaaaccgctggcagttcattttagctcaaaagaaaatcttctcccataaatagattcaattatttttagttcttcaaaggcactgaattgacttcaatttagtcttgcttcaacatataaactagtttctaggtatactatcaagaagtttaataatctgacatttattgatctataaaccaagatatggttttatatttcctatgagtaaatatgcatttaaaaaaacaggtttaggccaggtgcagtggctcactcctgtaatgctagcactgtgagaggccaaggggggtgcggtggatcgcctgaggtcaggagttcgagaccagcctggccaacatagtgaaaccccatctctactaaaaatacaaaaaattagccaggcatggtggtgggcgcctgtaatcccagctactcaggagtatgaggcaaaagaatcgcttgaacctaggagacagaggttgcagtgagccaagatcacgtcactgcactccagcttgggcaataagagcaaaactccatctcaaaaaaaaacaaaaacaaaaacaaaaacaaaaacaaaacaggtttataaagaagctgctaaaatccagtaatttctaattagtctaattcttcatttcttcctcttccaacaacatccttcaaaagctgtgggagatggtgagtttgtatgtattgaagggagggatatgttgtctccaattgtctccatctttttttttcttttttcttttttcttttttttttttttttttgagatggagtcttgctctgtcacccaggctggagtgcagtggcacgatctcggctcactgcaacctctgcctcccgggttcaagctattctcccacctcagccttccaagtagctggaactacaggcgcgcaccaccacgcccagctgatttttgtatttttagtagagacagggtttcaccatgttggccaggatggtctctatctcttgacctcgtgatccgcccgccttgacctcccaaagtgctgggattacaggtgtgagccacaacccccggcctgtctccaccttttctaattcccaattcccatcaatctagtcttgtatctagaagtggtaaattaagtcaatataaatgtgccaaagctaaagcagaaggtatttgttttctacactcttcttggcttcctcctagtcatcaaccttgtctctcctgatagctccttttccatctccctaatcaccaaaagcccagaaattaaaacagtaaacaattcccctgaaaggtgccttccttgtactgtctaaaacaaatgcaatcctctgtgtgggcatttaaaacaccacaagcattcttacttagattaaatcatgggtctccctggtctccaggcatgcctagacatgaaccataaagggaatgagatccttggagtttctctagtaactgcaggccaaatcaacagcaaccctaagaacaagcattcttttttttttttcaacagaactaggccacacatattttttgtcgttatttaaatttttagttgtactacatagaaaataaactcattttaaaaagttatttcagtaggcaatgcatcttcatgacttttacatatgagttttattttttattacttttgaagaaaagtctgtagaaacctacttttcaaggcatctgacccaaccattgccttggatggcagcaatccagctcaggtaagatatttaagatgcaactaataatcataaaacatcagttgggaagaagtgttcgatatagtattgggtaaaagtgactaacaatttggtagaagagaatcatttttataactatctcctaaccaagatttctctaagtctgcatattgttaatggaatgaagactattttgctcctagtttcatgtatgtatatttaggtgaatgtgagtcatttatgtaatgtgtgctaaaacaccgtgcccctcacaaagataagatgaatacaaaatacagttattgtagatggcttgtctttcacaatttaattctacgagttaatttttacaattaacattttctgtgctacatattttgtattttggtttctttcccttcactatggggtgtacagaacaaagtatgcatttggaaaaaaagtgctgtctttcatatgcaaagaaaatgctataacttattcaaacatccttgggcagttctttagttgttttaatagtgtgagtttgtagtttgtattgaatgatccagatgacctgcccctgttcatgttacttgtggcatctatgagaccatttgctggttttagggaatcaatctataggtgggaagttttcttttgcagaaactaatttagaactaagcctttggtgtcagcaatgggtgctctatactggatgcatgaagaccatatttctaggggaggctgcttccagctgaatttcacaaggtgaggataaagagaacattccttatcctctcctgattaattcattaaaggcaaaggaggggaaggaaagttattagcagagatctcccagaagtcctctgtaactgtcccttttgcccaactgtcacaagatactgtttttctggcatccacagccctaaccctgaatatccaaatgtactcgtgcatcaaggatctactcaagtctcacctcctctgggaaccttctttgacctattacagctctcattgaggacctcccttctatttctgatacaaatagtttctactattctaaatagtccctagtttagtaatttattatatatatactgtcttgaatggtatggccttgatctcaagaggaccacgatttgatgtaactaacaagctgcctggctcactatttgactagaaggcccaggcttcacatcactgcatggccctctaagagtataaggccaagtccccaacagagcacagaggtgcagatgagactctccaagccatcctcccatatgtcagaggctacccaagcccacctccatttggaaaattcaaacctataatttgaggtacctgggaagccgctttcccagggcggaatggtcacggaaactgggtaggctgggggccttcttggggaatgagggagtggaggagctctttgtccctcctgctagatcagaaagagaaacgtctcaagaatctgggcctccatcttctaggcgtctcccttggaggcccttcagg

SEQ ID NO: 1660 - DNA, 8081 bp, Homo sapiens
tttattagagaaaaatgtacttttctatgcctgtgctttctacatttttggaactgatacaaatccacagaggccaaatcgaaatctaaattatctttaatgttaaaatttaattgaccgtgtacataactatgcaatccctgctttctcacagaagtgtctaggattcattcaacagatcatagaaacgaggtctggcatttaacagacgagtgacagaggagctataccgatttatacaacaattatcaaaacactgtcatgtagtttactgtagctcaagttgtgcttgtatcatataacataggttcaagttctttcttcagtcatcagaataacagaggttgaagagacaactgggtaagtgccaacttttccaaaagctgtttcaaaaaaaaatttaagtaactgtaatacacatttctgcaaataaaatattccagtgctacatcaatcctgagtttttaatattaaatatgcactacttacagttctgacatgattttatttaaaaacatgtctagttatcaagttcactgtcttcatcggaaaaaactctgtcacaaaggtcttcaaagtcctcaagagcctaaaagaaaaagtctagttcactgacaaaccaccactttatatctcgcattttaaacagggttaattaaatgtcaaaaggaaacagcttttaatattcaaaggatgccagttattcatttcaaatagaaaaaactataatcaatacatggagctccaaatacccaattaaattttttaatgccagatttcagtgacatattattttagcaggtctaacagtcatgtactttgcttaaataaaatgggttgaagaacatcttaaggtcaagatggagcgaagacagaaaaagacgggcaggcttatatcatgaaatattatattttttttcagcaggtagcgacccatgtattatcagcaatagcctacataacatggtttccattgaagggataaaatggttggtgatatgacctcatcaagttagagaaaacgtaactgtgtttgaaatatatactctttactcaacaaatagttcaacagttcctactccctaaaatgttgtaggttaatgctgaggaagatgtaaaaaatgaatacacaatcttccgtatttctatgacatgagcaaatgcacaaataaaaaacaagtaatacaaaacttgtgtaactgctatggaagggcaactcactcgggcatgtagccaaaaatggagactgatgttgatttagttggcgaaaggtttcaatcagtcaaaaaaagattttaaaagtattgtgagggaagagcatgagcaaagcatgggagtaacggtgagttccttcagggaaggcggtcaacctggagaagtgggaggaaagacagaaggcggcaaaacaagcctaagagggggtcatgtaaaggggagagtctctgaatatctaagaactgagacggggcatcactgacaggctgggaagacggaagggctgggaagcattttaggaagggaagggttttagaaagataatattgccaatcaatgaaggatggctcagaagagaagagagaactcagaaaagagtttaatagtacaggtaaggaagaatgaggtcttggactagggtagccgcagtgggaatttaaagaaagaaattaaaggaccattgcagaggtaaaacttgcctcgtgataactacatgggaaggataatgaactcagaagagtccaagatgatagcaaagttcctaacctaagtggtaacatgaaacattaatactgacaggaaaactactagtctcatgttcataccaattaataaatggtatctggagaacattatagcaacatgttctctacttgtaacttctatttaaataactgtttgtgtatagataatcctcaagttgcttgaaaattttattttcaaactcttttcccagtttatttaacacatctcagttagtgtagagaagtgacatatgaacatgtcttttccaaggttattaaaaagaataccagatctccccaaaaaagattccactgcttcctaaattatctacatctacatgaagaagaggtcattgtctgatgataatttgctaatgtgctgtacaacagcagataattcgcaattcacaacgtgttaataatctgctggctttcccattctgttatacatctgaaccatctcttatgattacaaattgtcatgtagaaccattactaataattttgtaagtgaatatgccataaaacactcctgtgtttcagcaagaaataaaaaagacacacagtagttacgcttgcctacttcctatttaactaaaactcttgaaacaacacaagtaaaaaagccatccagaaaggatttatggacctcttgccttccaccatagatttgtcattgatgtcctgaaaactgaaaataaaatcttcattaaaacccatttatgcctagtgttccattattggaacgctaagcttgtgggaatcatatatatcctactgctcaaggtcatggccaaggtctgatttttcacacacaaaaaaaatttgcaacctctggcataaataggttaatgtgttaataaagtgtcaattttatacataagatgtgtatttctaggtaaaatttccaatttaccttttcctgttctaaataactcccacaaactattcatgaatcctaaaaatacatttaccaattatattatatctggaacaatacattcaaagtgaaaatgctaagtaatttgaaatgtataatcaaatgtctttccatacattcagaaacaagcagactgtcttctattatgcacgtgttgtattttataatgtattatgttaccaaatagaacagacctttacgaattggtcacgtagcagcttcatctctttcagcctctctctcctaacacttctatattgttgccacttcttctgttgttcttgaaatattctctagaatcccaaaacaaaatagtgataaaaattgggtaaattttaatacttacaaaacataattctgcattagctttaaaggaatactgtttaaatcaatacctctgaacactttcttttagacaacatttaggaccaattttaaacaattgtgttcaccaataacatgctaaaatgatgtattaaccttttttatcagtcattaagtaaagaattttcttacttttacacattcaacacatatgtcctaattcttgatttccaatgaagagtatttgatgaaccttcctataatttgttgaccacagataggtaagatctatacagaaattaactaagaaaaattctttctaagattttaagcatgtattaaatctcggtcatttcaatatgcacatagatgaaccacccaataatgattgcctttctgcaccctgacctaatctccaacaacagtgttctcctctcctctacgtggcactcactcacacagtcatcccctagattttgtcattcccaatgacttcaacacctacgtaatattaataatagcaatgataaagagcaaccatgggtcagatcacatcctgaaaaacttaaataaacctgttacacagaaaccctttgatcctccaaacaactctgacgtaggtactcttaccatgtctcctttcgtagataagataatttgcccatggtttccgagctagcaatggtcaagctgagataaataatttttccatggtttccgagctagcaatggtcaagctagaatcccaagcagtgtggatgcatagtcccagcccttgaccactgcactcagctgtttctccaacttcccaacatacagccactacctccctgccatcgtaggtcactcacttcagtactacagctcaggagtctgttgggacctgacacccactgaatggagcactttttactgcccattgcccactcccgtgtgctcagataactcagtcccagctgaaattccacagccagtcatcatatccccatctctgcatctattccctgcccaactctccctctatcaatctgctcggctacaccccgacccaggaaattccaaccctacagctgtgcttgcacaaatatgccaactgggcttactttaacttcttcatcgttatgatgctgacttcagttggacccctaatgctgcgtggcaattatattcccctagtccattagtccactaacgggcccccctctctgggctcatgcgctcttccttctttgctggatttctgcatgaactattactacctgagacactgacataacaggttatacataaagctaagcatgataccaacaattagttcttcctcttctccctcttcttcttcttcctctttctgctcgtctgtgatgtattcttcaaggacatttagcaacttcagagaatgtatataatcacgtttctgcctgtaacacataataagtaacacggtcatacgtcatagagagatgaaaaattaatcctattcaaacccaaactgacttgacataatttatactataaagtagcaagggagtaatagcagctgaaatcttctttttggaaaaaagtgaaatgagttactctcattttgaaaggattcttttcttcctgactactagagcagctatcttacattctttacctgctgaagacaaaggagggtttactgcactataactttcccagaaacattttctctaagagcagtttactttccatttcctcttactgaataacatatgggttctcataagtaggttcaagaatatcatagccattcatcccataagatttcccaaaagaaaaacttcacttaactatttctccactttggcacaccaatgattttgtaaaagaaatagtgaaaacaatttaactaaaatagataacttatttacaacataaggttatccctttctacataattgagtatcgttaaggatctacagactaaacattgagaacatttatcttatatgcagctaccatatttctagaaatggataaacattaattttacaagaaggctatttttatctggaaggcaaaaagaggtcatcttcattggcttctaggtaatatctcttaattctgttaaactgaggttataaaactaaagaaacttacctacttagagaacaatcaagtaaaatatgttgttcactagagacgccaatatgtacaggatagtttttgaaattatttgcaccaactaatacaaagaaatgatataaatatcattatgcaaaaaagccaacagtcataccttttaagttgcttttttctcaaagcatgtttacttttgttctttgttttgctgcaagttttatccattttcatcctttttctttttgcagtaagatcctctttaatgtcagttagatagtaaatgaaaatggattaaaagttaatgttgaaaagtagtttctttgcatatactgacatcaatatgggactttatggttcagcaatttcagaaggatatttaaaatataaaatgcaaagatcatttcaaaaagcaagatttactcacttattttctgtaaaacctttcaggtattaacattcgcatttcaattccagttggtataactgaaaatcacttaattgacagatgatgaaaaaaagcaaataattaaaagtctctattttttaaatgtgcagaaagagttataagcacagactttaatttctacatttataaaatgtcctacaattcaaaggagatgcttccatgaaatactgcacaattcattacgtaaagcacacaaaaaagtatcttatataatagaaccctcaaaagggtagaaataacttaatgcacaataagaaaagcatttttaagcaatctagtgattgatgctattaactgtattttaataaaagaagcaatggccatgagtataaaaatttaggtttaggtaaagaaatacattcaaaaacacttttgaaatgttttcttggagctttttatgacatttgtacccatagtgctgtgtttcagaaaactgtaatactgcaaggaatgctttcctaaacatgatttcacatcagagctctaccatcaattgctaagaataattttcagcaatcataaaagatttgtaccacaatgcaaatattttttacatacagtctccatctataatgcccaatgtattaggcagctcacaaaaccagcactttgtcaccaagctttccaaatatactgcttgtatgaatcatcgctagagaagagctgaaaactgaattgagctttttaaaaataagagtattgtctccatcatctctacagaaattttctcaaacttttttgaaaatatggtcctataagagtgtaactaatatttcacacagcaatataaagtttatgagtttttggagccaattacatgtttctcactaggtagaaaagttgtccttacttttctactacacagtttattactggaataataatagaaaatgattttagaaaattcaattttctcttgtactttaaagaaaacaaaatcagaaagctgtgacaatagaacagctaaattaggaacatgaaaaactcatattaaaaactctgagtacagacggacaggaagagaggaacaacagacaactgggcctacttgagggtggagggtaggaggagggtgaggatcaaagaccacccatcaggtactatgcttataaactgggtgacaaaataatctgtataccaaaaccctgtgacatgcaatttatctacataacaaacctccacatgtacccccaaacttaaagtaaaagctaaaaaaaaccattgatatatgacttaatctgtgtatactaaaaggaacgaatagagctgtttctcctccactgtcctctaatatcctccaaacaattaaatttccacatgtatgaaagaaaagccatccatctcgcttcaccattattagaagcattctcacattccacatcaacaatcaaaaaggtaagaaaaatttatcaaatagattacattaaatacgtacgttaaatgctacatatgagaagccatttaagacagtcttgtcgtccactaattcatataacctactgcaacagttgtatgactgaaaacaattttcataaactacagataactcctaaaacatacctgcagtatcttctggcttcttggtattagccctgtaaaaaaagttacatcaaaattttaacaaaatactacacaaaatgccatgtttgttgggaaaagaaatgtcttatgtgaaatgttctgcatagaatagaacagtgatgacatggtccaaagctgacttttcctaaaagaccctatccgacaggcaaaagtgacttaaacactttaccccgtgtgttcatctgtttcagcaaaaggttctctttccccatgctcatcagttacatcttcctcccttgtttctgtaaaacggtttctttcctcacattcatcacggactggatcctttcctgcattaaaatgtaaaagacaaaccttttttagaggaagatgctgctgtggacattttttgtggagaaatgtactagttgtagacttttttggggggggggggctctctgccaattaaagctttaaagcagagctatacatggaatcaccggttcctgaccattttatcgagggacttttggaagcccttcgggttcaggttccagtaaacaacgtactacagttcagaccccttggatgtcaggactgcacccatggagaagagctgctctgagagcatctgtaaccctgctatgagggggagccttccacggggaagcctaaggcccttgagcctgctttgaaaacctggcgcatcttagcacgtgcacaatggactccagagccacgaaggggcctggggcctcgggctgcccctgtgcccccagcgcagaaagcagacagaccgtcctcttgggcgtgcaccttcttctgggtccccttgggctgtatttacctgcatgcttcttcccccaggccgccataaattgagcctccaactgggccttggcagccctcctgcccacaggatccgtggctggttgtcctgggaagctagaggcgatccccgaac

SEQ ID NO: 1661 - DNA, 449250 bp, Homo sapiens
ggttatttgcagccccgagatctacccagctgtggtgttatcccctttgttcaaagccttctttgtaacactggatcaaggtgtaggaacttcagctatgaagggtcaatggagcatcattttcggtaagagaaacacaaagatctttttcagaaatctcagaaagctgatacatagaacaggcttctgctttttgtaaagcctcaataatttgggataggtcagagatcatgagaagtatagaaattaaagttttattaaattcagagtcatataattctgcctccaactaatggttagcttccagcaggagatctttccactgtcacttgcgggactcacagagtaataactgattagcaaatgccatttgcatgtaataatttgttttctgtaggttaaaactcttgacttcaaaattacttgtctagccaacttttcattttagtgccacatgcccccagaacaattattttttgagctacctactgggttttttctcctgtgctactagttgactagaatcttgtcgccagctgagggaaaataaaactgggcagtaactctttatttgtcataaaccacctaaacggactacaggacagttaagttgccttctctgagtctctgaatgctgagctatgcctgtggttgcctacagtgtcagttggccttaaactcaagaagagaaggagaagaagatatttcatgtgagaagagacaaagtgagggggtttaacttgggggatcctgaatgccctggaaacttctcccaggtgaagttaggaagggaaggaagtggctagcggattaagatagtttgaatttatcaggtatgaatgatctgagttttatttaatctatatttactaatattaaacaatctaagatatttaaatgtaaagcaaatgttgacatatatgatctttattttccaactctaagttacaagaggaaaattaaaagtttccagataattttcggcatatcaggtacaatatttataaatggtgttgttttagttcatttgggctgctataatgaaataccataaactgtgtggcttataagaaacaaatatttatttctcatagttttggaggctgggaagtccaagatcaaggtgccagctgatctggtatctggtgagaaccctttccattataaatgacaccttccagctgtgttctcacataatggaagggatgaggcatctctccagggtctctttaatacgggcactaatcctattcacgaaggctctgtcctcacgatccaatcacctccgctatatcatcttaggggttatgtttcaacgtaaaaatttggggatgggagatgccaactttcaggtcatagtaggtgcttactttttctgagacaaatcatatagaaatatgatataaagaggctcatttgaaaatactgtaaagtgataaccctgaaaagttcaatggtcttttcttgaatgtgtggagaagggaaatatacaaaactctgtctttcttggaagcattagaagagcttgagacttagcagtgtctttatttcaagtctttcttatgtctcttccttacttggattgggaggtttaaatgatgttgaagtggaaagaatatgattttgtggctaaacaatactggctctgttacctgtggttctgtgaatctgtgcaaattaattgacctctttgaatctgtttactcacttcaagtgttgtgaatgttaaagacaaatatagaaaacatctagcgcaatgcatggcacagaggcattcaaccaatgggagttgataataacaaattcttattactacggctgtaacaattataaaaatactacttgaaggccaggcacggtggctcacacctgtaattccagcactttgggaggccgaggcgggcagatcacctgagatcaggagttcaagaccagcctggccaacatagtgaaacccagtctgtactaaaaataccaagaaattagctggacacggtggcagatgcctgtaatcccagctattcgggaggccgaggcaggagaattgcttgaacccaggagggggaagtcgcagtgagccaagattgcgccactgcactccagcctgggtgacagagcgagactcattctcaaacaaaaaaaaccccccaaattacttgatatcaggaaataatctacctttgttttctttgtgtttttccacatcaacatcctcacttcaatgtgcagaaattcaggggttataaaagcaacctggtgagattcttcacctaacattctgagagtggtagtcaggttaatagctcaccagcattgcaaagcctttaactttgagaacgaagaatgaaattcctcactttgtctggtagtgcccaagtcagaggtataagaaatacaaaataaaatagggaaaggaaattgtaaggagtaaggaaagagggagagggagaaaggagacaagaaagagtgaagcacgctgtcagtagggcctctggtttcagactcagccacttgaccaagcagatttcatgcgttttcatattggagtaagtgtggattcaattgaagttcaagcccataaataaagactcactcctgattattttgtggtaattgtctcagttaaaaaatacctgaaagcggctgggtgcagtggctcacgcctgtaatcccagcgctttgggttgttggggaaaccagccccacaccacctggcaggtaccccaagtccagcggagacaaaggaaatagaaagagaataagagttcaaaggcgggtccaggggtcctgagcatcggaggctcgctcaccgcgcagagctctcaggctccgcctactttattggtttacaaagctctttgttcttagggcagatgggagggggaggaagggatgaggaaaaggattaatcagtgaaggagaactcctgagtcattcaataagaagtatagcaatggcggtttccgtgaatttccttgagcaaaggcgtgtctaaactacttaagatctttaatttatctggactgaaatgggtgggagcgggtttcaggaggagccaagatgtttgattatactccactgcttcaagggagtgttatctccctgagcaacctgtggaatgctgcggagctgttacgctctcgggcataaagacaggaaggcagtaaggagacttttctcctcagaagctgcccatggctgtctcacacagaggagaccaactcgtctggcatcccagcactttgggaggctgaggcgggtggatcactaggtcaggagttcgaaaccaccctggccaacaggctgaaaccctgtctctactataaatccaaaaattagctgggcgtggtggcaggcacctgtagttccaactattcaggaggctgaggcaggagaagagcttgaaccggggaggcagaagctgcagtgagcagagatcgcaccactaaactccagcctgggcaacagaacaagactgtctcaaaaaaacaaaaaatcttgaaggcaaatatcacagttaatttagttcataatgtgtctggaattggtgggttcttggtctcactgacttcaagaatgaagccgcagaccctcatggtaagtgttacagctcttaaggtggcacgtctggagtttgttccttctgatgttcggacgtgtccggagtttcttccttctggtgggttcgtggtctcgctggctcaggagtgaagctgcagaccttcacggtgagtgttacagctcttaacacggcgtgtctggagttgtttgttcctcccggtgggctcgtggtctcgctggtatcaggagtgaagccgcagacctttgcggtgactgttacatctcataaaagcagtgtggacctaaacagtgagcagtagcaagatttattgcaaggaacgaaagaacaaagcttccacacagtggaaggggcagcctggctgctggctagggcagcctgcttttattcttatctggccccacccacatcctgctgattggtagagccgaatggtctgttttgacagggcgctgattggtgcgtttataatccctgagctagacacaaaggttctccacgtccccatcagattagttagatacagagtattgacacaaaagttctccaaggccccaggagaggagctagatacagaagtgtcaattggtgcactcacaaaccctgagctagacacagggtgctgagtggtgtgtttacaaaccttgagctagacataaagattctccaaggccccaccagagcagctagatacagagtgtcgattgttgcactcacaaaccttgagctaaacacagggtgctgattggagtgtttacaaaccttgagctagatacagagtgccgattggtgtgtttacaatccctgagctagacataaaggttctccaaggccccacctgagcagctagatacagagtgtcaactggtgcactcacaaaccctgagctagacacagggtgctgattggtgtatttacaaaccttgagctagatacagagtgcccattggtgtatttacaatccctgagctagacataaaggttctccaaggccccaccagactcaggagcccagctggcttcacccagtggatcccgcaccagggctgcaggtggagctgcctgccagtcccggtgccgtgcgcccgcgctcctcagcccttgggcggtcgatgggactgggcgccgtggagcagggggcggcgctcgtcggggaggcttgggctgcacaggaacccacggaggtgggggaaggctcaggcatggcgggctgcagtcccgaggcctgccccacgggaaggcagctaaggcccggcgagaaatcgagcgcagcgccggtgggccggcactgctggggaacccagtacatcctccgcagccgctggcccgggtgctaagtccctcattgcctggggcctgcagggccggccggctgctccgagtgcgggcggggcccgccaagcccacgcgcaccggaactccagctggcccgcaagcgccgcacgcagccccggttcccgctcgcgcctctccctccacacctccccgcaagctgaaggagtgggctccggccttggccagcccagaaagggactcccacagtgcagtggtgggctgaagggctcctcaagtgccaccaaagtaggagcccaggcagaggaggcgctgagagcaagcgagggctgtgaggactgccagcacgctgtcacctctcaataagtttccatgacctccctaattcctcaggtaagttcactttgggcagaaatcctgggtaccatctgatgtagcttatggttatgaaaatcagcttcctcattcctgcctttgttggggggtttccccttcattttaacaagaggatttcagagcagaaatatgaagcactgcaggcaacagaagtggatattcttgtgttagtggtcactcctattttgtttaatttaaaatgctttgtaatgcgaatgtgctgtctaaacccgaccctcacttccctttcactgtctgacaaccttcgggaggcggatcgccatacccatgctggggcactcccacccttagtctacagcacccggtgccttgccttctgggctttgattgggtgacctttcatttccagtttcttgaaatgtttccagccatttcctactggtctcatttggtggtcatcaatattttaatttatttttttctccattctcaaacatgcccagaccccctgagaatcatctgaccctctctgcctcttttccaaccaccatactgcctggttctcagccttatttgattatcacctgctgctgcctcacctcagcttctcagtttgcttttcactctcttgacactcttttttttttttttttctgagacggagtttctttcttgttgcccacgctggagtgatatgatgagatctcggctcaccccaacctccgcctcctagacttataattttttttttttttgagacagtctggctctgctgcctaggctggagtgcagtggtgcgatctcggctcactgcaacctccgcctcccgggttcaagcgattctcctgcctcaacctcctgagtagctgggactacaggcgggtgccaccatgcccagctaattttttgtatttttagtaaagagggggtttcaccatgttggccaggctggtcttgaattcctgacctcaggcgatctgccccccttggcctcccaaagtgctgggattacaggcgtgagccaccgcgcccggcctatccttgtttcttaaatggctttcctgacatggagacgtaacagcattagattcgccagggagaaggattccttctgtgcctgccgtcccattccgatgctttggggccctccacaatgatgagtactcccctccccttcctccgcaccttccaccgcatggtcggcctttctctttttgtattccccatctgtccagcccttacacagcccaaggtcttcctcttctatatgcagtcagctctgtcgtggtcagctacctgctcgcgatgcagcaccatggcttctgcacactgaggaaagacagctccggatgggtctggggtttatttcccagcccctttcataacttagtggagagctggcccaggaggggtgagtgaagaaagaaaaaacgatccaagctcctgagcccagagtctcccctcctgacccagccacttgcctaaggaagccctccctgtaactgcagtcacttgtctacctgcaatagagcattttagggctgggtctctgtcctggggttctctccttgccctgcctaggcatgtctcttgatggactgttgaaaacttgggaattatgtgctttttgctaggtttttatttttaaatttctcctccaataaaacttattttatttttacaccgtgtttagtatttcaattttgttttctttcctacttcaggttataaagataatttcttacattattttcttaaagtattatagtttttcctttcacccgctggtctggaattcatctgggttttacgtctatgtatggtgaaggtaatgatttaactgcattttttttccatttggataagtattttttcagttgtattattaaacagtttatcaatttcacattgatttgtaatcccattgtgacatgaattaagtttttgtatgtggtgcatctgcgtctggcttctccaacttgttatagccccagccattccttgaactataccctgctgtcttactgtagctttctaatgtcttgatatctgaaggagtaaatgtctctatcttgcacttctcctttagggaagtctttgttcttccatgtaagtgtaacaaccttgttgtacaagtcagtgaaaaatattattgggatttttattggagttgcattgcatcttgagatcctgatgcattatttaatttatttaggttttctttagtgtctttcaacatagctttatagtattttttcatgaaggttatgcatatctttcattaacttacttccttgttactttatatttgttgttgctattgcaaatagtattttttaaaaagttacactatgttacttatcattgcttgtgtaatggaaataaagttaattttaaaaatcaactttattgatctatacaataacatttaagagtacatttcaatgaatttgacatgtctatgcacctgtgtaaccaccatcatgattgaaatataaagcatcttcattttcctcagaattctcctgtgctctatcccagcccaacctacctccactcaccccacatcttcagatccaggcaatagcttgtctgcttttggtcatctagattagatttgccttttctaaattttatataaaggatatatccttggtgtttggcttctttcacccagtaaaatgttttgagatttatttatgtggttggttgtattagtatggtcatgcaccacttgacaatatttcagtcaacaatggactgcgtatatgacaggggtcacatagaattataataccatatcttaactgtactttataaatgtgtagacatgcaaatgcttaccattgtattacaactgcctacagtattcagtacaatgacatgctgtacaggtgtgtaggctaagagcaataggctacaccacatggctaggtatgtagtaggctccaccatctaggtttgtgtaagcatgttctgtggtgttcacacatgatgaaattgcctaagaatgcatttcccacagtacattctcttctttaagtgacagatgactataattcattcctttttatttttcccatgggtaaggatgacccgggatgttcttttctgtttttttggttaatttttaaaaaaaattttgtttctgaatatatattttaaaagtctttatttttaattattgtggatacatactagttttatatatctctgaggtatgtgcaatattttgatacaaatacacaatgcataatgataaaatcagggtaatcaggatatccatcatctaaagtataaatcatttgtgtgagtgtgtgtgtgtgagtgtgttaggaacattccagtttcactcttttagttattttgaaatatgtaataaattattgttatctatagtcatcccagtgtgctactcaacattagatccaactccttctatctaactgcacttttgtacccgttacttatcccctctatatctcccacctcaccactacccttctcagcctctggtaactatcattctactctctgtctctatgagtttaattattttaagctcccacatataagtgagaacacataatatttgtctttctgtgcctggcttatttcccttaacataatgccttccagttgcatccttgtcgttgcaaatgacaggatgtcattcttttttatggctgaataatatacgtactacattttctttatccatttatatgttgatgaacactaaggttgattccatagcttggctgttttgaataatgctgcagtaaacatgagagtgcagatgtctctgttttttttttccttttggattggatttatacacagcagttggattgctagatcacatggtagttttatttctagttttttgaggaacctcccttctgttctccatagtggctgtactgatttactttcctgccaacagtgtacaagagttcctttttcccaacccctcactaacatttgctattgcttgtctgtttaataaaagccattttaactgggatgagatcatatctcattgtaatttggattttcccttcttggatgagtagtgatgttaagcaagtgttcatgtcctagtgacccatttgtatgtcttcttttgagaaatgtctattcagatttttgcctatttttcattgaattgtttgtttgttttgtattgagttgtttgagcttgttatatattctggttattaatcccttgtcatatgtgtagtttgcagatcttttctcccattctgcgagttgtttcttaactttgtttgttatattattttctttgctgtgcagaagcttttgagcttgatgtgatccatttgtccatttttacttttgttgtctgtgcttttgaggccttactcaagaaatctttgcccagacctatgtcctggagtgtttccccaaagttttattctattagtttcatagtttcaggtcttagatttaagtctttaatcaattttgatttttttttaatatggcaagagataggggtttagtttcattctgcataaggatatccactcttagcagcatttattgaagagactgttctttcctcattgaatgttcttggagcctttgtaaaaaatgaggaatttaatgcttggatttatttctgggttctctgttctgttccattggtctatgtgtctgttttcatgccaatactgtgctgacttggttactaaagctttgtagtatattttgaaatcaggtaatgtgatgccatcagctttgctctttttgctgaggattgctttggctattttaggtctttgtagctgcatataaattttaggattttaaaaaatgaattttttttctatttctatgaagaacatctttggtattttcatagcgattgcattgaatctgaagattgctttggggaggatggacattttaataatattgattcttccaatccatgaacacggaacatctttctaactttttgtgtgtcctcttcaatttctttcatcagggttttatagttttcattgcaaggattttttgcttttttggttaggtttattcctaggtatgttattttatttgtagctattataaatggtattgctttcttggtttctttttcacattgttcactgttagtgtatatacatgctattgatttttctttgttaattttgtatcctgcaactttactgaatttgtttatcagttctaatagtttcttggtgaagtctttaggtttttctaaatatgagatcatgttatatgcaaacaaggataatttgacttcttcctttccaatttggattccctttatttctttctgttgctggattgttctggctgggacttccagtgttatgttgcataaaagtagtgaaagtgggcattccagttccaaatcttaaagaaaaggtcttcagttttcccctgttcagtatgctagtagctgtggttttgtcatatgaggtgtttattgtgcttgattgtgttccttctatatccagttttttgagagtttgtatcataaaggaatgttgaattttatttaatgctttttcaacatctattgatatgattatatagtttttgtcctttgtcttttgatgtgatgtatcacattgattaatttgcatatgttaaatcactcttgcatccttgggatggatgaatcccacttggtcataataaatgtaatattaaatgtaatattatatttacatgtaaatttaaatgtaatattaaattcagttaaatgtaatattaaattcagttttgttggtattttgttgagaatttttgcatctatgttcatcagaaatattggcctctggttttcttttttgttatttttttgtgtatatgtctggttttggtatcagggtaatactggcactgcagaacgagtttgacagcattccttcctcttcaaccttttggattagtttgagtaggattagtattaattcttgtttaaatggtaaaattcagcagtgaagccattgtttgggtcctgagcttttctttgatgggggaatgtttattactgttatcttattacctgttgttggtttattcaaattttggatttctttgtggttcaatattggtatgttgcatgtatctaggaatttatttatttcttctaagtttttcagttgaagaggacacacaaaaaatagaaagatattctatgttcatggattgcaataatcaatattaataaaatgtctatgcttccaaaagcaatctgcaaattcaatgtaatttctaccaaatcgatgtattgatatatagttgctcacagtagtctctgatgatcctttgaatctttgtggcatcagttgtaatttctccttttttgcctcaaactttatttatttgggtcttctctgttttttcctatgtcagtattgctaaaggtttatcaattttgtgtatctattaaaaaaactttttgtttcattgatcttttaaagaaaacttctgctctgatctttattatttcttctactaattttgggcttgttttgttcttgcttttctaattctttaagatgcatactgtattagtcaattcttatgctgctatgaagaaatatccaagactgggtaatttataaagtaaagagatttaattgactcacaattctgcaccgttggggaggcctcaggaaacttacaatcatggtggaaggggaagcaaacatgttcttcacatggcggcaggagagagaagcatagagcaaagggggaaaaagccccttataaaaccgccggatctcatgagaactcactcactatcatgagaagagcatgggggaactgcccccatgatctaattacctcccatgaagtccctcccacaacacatagggattacaattcaagatgagattttgggtggggacatggccaaaccatatcacatagttaggttgtttatttgaagttttttttctttttttaaaacttttgtgatgtaggcatttattgctataaacttgcctcttaatactacttttgctgtatcccacaggttttggtacgttgtttttctattttgatttttttttaaacaattttaaaatttccttcttaatttcttcattgacccagtggtaattcaggggcatattgttcactatttctgtgtttttacaacttgcaaagttgatcttgttattgatatctagttttattccactgtggtcagaaaagatacttaatataattttaattattttgaatttttttagacttattttgtggcctaatatataatatatccttgagagtgttccatattctaaaaagaagaatgcagattctgtagctgttggatggaatgttctgtaaatgtttattaggttcatttcatctatagtgtagataaaatcaaatgattcttcattgcttttctgtttaaatgatctgttcaatgcaaaatatggggtgtcaaagtctccagctgtgattatattgagatctctctctctttagctctgttaatatttgctttttatatatggatgctccagagttggatgcacccaatttatattattatatttatattacatttcgctgtctgagaggtcacatatctctgtcactgcaggattggtcactgattacttagtttgtttggtgaggttgtgtttttctggatgttcttgatgcttatggatgttcattaatggctgagcattgaagagttaggcatttattccaatctttgcagtctgggcttgtttgtacccatccttcttgagaggactttccaagaattcaaaggggaataaatgttgtgacctaagcctgtggtcactgcagctgtttcagcactagctgtttcattcctaagcccaagaatgctgcaactcttgaagactcccagataatcagccttgttggacttagggaagttaagagagcattctctgggttaccagttgaagtctcttgctctcttccttctgtttcccctaatcagaaggagtatctttccacactgggctgcctggaattgggggaggggtgatgcaggcactcccatggtaccatgttgggtcacacctgaagctcatgttcttcctgatgagtacagtactggggcttacccaaggcccatggccactacttcctggctgctgctgatgtttattcaaggttcaaggtcaccttactcagcaggtggccaatcctgctgggactgggtccatcccatcagggcagcagattctcatctagcctagatgggtctagaaatgccattgggaagcaaaggcctggaatcaggggcttcagaaatctgcctggtactttattttacagtggctgaactggtatccagcttgccagaccaagtcctctgtaatattccttctcccttcctcaagcagaagtctttccccaagctcactgcctggagttggtggagggttgatgtaagcactctaatggctactacagctggtattgcattggtactgcaactccactgccttcaaaaccagcagaacaccagggcttatctaaggactgcagttcttgtggcctgcctgccactcaaatttatttgggatctcaaaccactttatcagcctgtagtgaggccagccaggacttggatacctcttgctgtggcacaggatgctcatctggctcagggctggtctaaatgctccctctgtgggcaccagtagaattctgccctttgttgcattctattgtgatagggcagcactgagtttcagtacaaagattcacacttagtttgctctccctccctcaagcacacagaatctttctccatgctgcactgcctgggattgagtgaggagaggtaggcaacgcaagactgtcctttctatcttcttcagtgcctctttccatcttaaatgttatgaacattaaaaaataaatctgtgtgtggacaaatattttaatttttcttgggttaatacctaggagtagaattcttgggataaatgtttagtgtatgtttagctatatagtgtatgtccaggctgtttgttcgaaagtgttgtgcaattttatactcccaacatcaatacataagaattccagttgctccacattcttgctaacacttattatgttgttctctttaattttagccattatactgttgtattgtgctttctaattgtagttttaatttacattttcttgatcaggaatgatgttaagcatctttttatgtgtttattggccatttcaatattttttgaggaaagtgtctgtttaaatattttatgcaattgattttttatttttggttttattgaattcttagagtttttttacatatactggtcacaagtctttaatcatatgtatacatattatacatgtattgcaaatattattttctcatttgtgctgtgtcttttgaagagcaagggttattttgataaaatataatttatcacttttttctattttgagtagtgctttttgtgtttttctttaacaaagaaatatttgcctaatatttttgaagattgttcagattttttcctgtattttctatgtttaataattttagcttttgtttataggtacaatttattttcagtttatttctttctatggtgtgatgtaacttttgaggtttatctttttacatatgtatatacaattctagtagcatttgttgaaaaagctattctatttcattaaaatacattgggacctttgtttaaaatcagttgatttgttaatagtatgaagggctgtttttggactctcagatcttgtaggtttcatttcacaacatcagaatatagcaaatattgcaataaagtgagtcacataaattttttagttttccattgcatataaaagttatgtttacactatattgcagtctgttaagtgtgcaatagcattgtctaaaaaatgtacataacttaaataaaggaacactttatagctaaaaaatgctcatgatcatctgagccttcagtgagtcaatctttttgctggtaaagatcttgttttgttgccgatgactgctgactgatcagggtggtggttgctggaggtggaagtggctgtggctatttctttaagtaagacagaaatgaagtttactgcatcattgactgtttctttcatgaaagatttctctgtagcatatgatgctgttttatagcatttacttacagtgggacttctttcaaaatgagagtcaatcttctcaaactctgtcactgacttaccaactaactttatgtaatattctaaatcctttgttatcatttcagtaatgttcacagcatcttcaccagaagtagattccatctcaagaaaccactttgcttgcttatccataagaagcaactcctcattcattagttttattatgagattgcaacaattctgtcacatcttaaggctccacttctaattctagttcttttgctatttccatcacatctgcagttactttctccactgaagtctggaacccactcaaaatcatccataaatttgaatcactatctatgactctatagctttatgaaattcatttcttaaataataagatttgaaatttgaagttacttcttgctccacgtgctgcagactggatgtttgttagcaggcttgaaaacattaatctccttgtacgtcttcattggaactcttggataactggctgcatggtcaatgagcagtgatattttgaaaacaacatttttttctgagcagtaggttttgacagtgagtttaaaatatacagtaaaacatgctgtaaacagaggtgctgccatctaagctttgatattccatttatagagcacagaagcagttgatttagcatagttcttaagggccctaggatttttggaatggtaaataaacactggcttcaacttaaggtcaccagctgtgttagcccctaacaagagagtcagcctgtcctttgagactttgaaggtaggcattgacttctcctctccggttaatgaaagtcctagatagcatcttccaatgcaaggctgtttcatctgcattgaaaatctgttgtttagtgtagacacttacaccaattattttagctagatcttctggagaacttgcttcagcttctatatcaatgcttacatcttcaccttgtacttttatgtaatggagacggcttctttcctgaaacctcatgaaccaacctctgctaacttcagactttccttctgcagcttcctcacctctctcaggcttcatagaactaaagagaattaggacctttctctggattagactttggcttaaggaaatgttgtggctgatttgatctatccagacctttaaaactttttccatatcactttcttatcatttgtgttttcactggagtggcacttttcattttctttaagaaccttttctttgcattcacaacttcattaactgttagtgaattgcatttattaactgcttggtgaaaaagtcctagctttcagcccatctcagcttttaacatgctttcctcactaaacttaataattcttaatcattaataaacatgggaggtggaggttgcagtgagctgagattgtgctactgctctccagcctgggcaacaagagtgagactctgtctctaataataataataataattctaataattctagcttttgatttaaagtgacagacatgtgactcttcctttcactcgaacaattagaggtcattgtagggttattaattagcctaatttcaatatcattgtgtctcagggaacaggaaggcccgaggagaggaagagagatgggggaatggccaaacagtggagcagtcagaatacacacaatatttattgattgagttctccatcttatatgggcatggtttgtggcatccccgagcaattatgatagtaatatcaaagatcactgattacagaacacaatagcagatataataataatgaagatttaaaatattttgtgaggattaccaaaatgtgacacagagacacaaagtgagcacatgctgttggagaaatggcattgatagacttgctcagtgcagggttgccatgaaccttcaatttgtgaaaaatacagtatctgtgaagcacaataaagcgaagcataataaaacaaggtaggcctgtacacaattcaataattgttagtatattcagagctgggcaaccatcatcacagttaattttagaaaaatttccccaacctgacaagaaaatctaaatgtattagcatacacttctcatttcctcccaatctcccccacgcctaaccctgggcatacaactaaactactttctgtctcgatagattttactattctggacatttcctacatatagaatttgtataagttataggctttgtttggtgactgccttctttcacttagcacgatgtttttaaggttcattcatgttgtagcatctaaaatccttcattttaaaattgatgatcaactaatattcccttgtatagatacaggacagtttctttatcttttcctctgtcgaagtacatttgagttgtttccacttttagcctattatgaataatgctggaatattcatgtgcaagttttaaaataaatgtatgtttttgtttctcttgagtatatgctaggtcatatgatagctctacgtctaacattttgagaaaccgtcagattgtttttcaacgtggctctaccattttgctctcccatcatcagtggtagaaagcttcaattactccacattctcaccaatacttatatttctgttctttagattgtagccatctaggtggatataaggagttatcccattgtgattttgatttacatttccctagcggtttatgatgttgacaatctttttatgtagtttttggccatttgtatatcttccttggagaaatgtctattcaaatcttttgcccattttaaattggattatttgtctttttattataaagttgtaagaattcttcatatattttacagacaagtcccttattagatatatgatttccacatctttcccccccattttctgggttatctttccactttatgattgtgtttttgaagtaaaagtttttaattttcatgaagtccaacttatctttttcttttgttgtttgtgcttttggtgtcatatctaaaatgctcagcctaaccttcaatcataaggatttcctgctatgttttcttctgagttatacagtttagcttttacattttagtctattatccattttgagttgacttttgtgtatggtgtgaggaagggatacaacttcattcttttgcatgtggatatgcagttgtcctaaagggttaccttctatctatagattagtttggagagaattaacattttaaaaacattgaatcatccaatccatgagcatgatatagctctccatttattttaagctttctggaatttctctcaggaatgtttttgtagctctcagttctatgtatatttcattaaatgtattcctaagtagttaatattttttggtattgttttaaacattttgatttctcaaagaactaagaatagaactaccactctatacagcaatttcattactggatgtctatccaaaggaatataaatcattatattaaaaagatacctgctcttgtgtatttactgtagcacaattcacaagtgcaaagttatggagttgacctagtactgtcctcagatccttcctctctggctcagatgaatgggagcagtaatgtgagtcagccataacaaccttcttaggagaattacttctgcctttggatctgcttagagataattctcatttgataacaatttgccctgtttgtctaagcaaaaattaacaaaaattgtaatagaaagaataatcatattgcttcacattccttgcttattcttgtagtccttacgctgaaaatgcacatatctcagtgttagtctcaccactgccgcttctcttcctgcttatttacacagtgctgggtgctggatgatcctcacaccaccctattaggtaggtaatattttgatcttattttaaagataatctcccaagtgtgacactgctttaaacacattttgactccaagggagctctcattgggtctaagttttctcatcttcaaactgaggaagggacctgaataatgatttccaaggccccatgtacttctgacaacctcaagtgggtccttcacagaattgcaaggatgtctctaggtgcagcattggttcctggccctttgaaggggtgattctcagtgtcagtctgagggctgggaaagttcagtcatctctgcccagtggccttctcttgatctccccactgtaatctcttttatccccttccctttgcaagtcttttcctagcctggcaggtcaagcattacctgataaaagtctcaataaagacctgtactcagaaaggaggaaactgctctccacccaaatcctattatagctctgggatttccctgctgctctggaattcactctctctctcacacatacacacaaattaacatttaatcaggattttctatgtatttttctgctataaacatttctcatgttaatgatagttcctaatttggtcttaaggacaaattgaggtacttttgagataataactagaaaaagaatgtaaaacctgctcattattacaggggaaactcatcttgaattacatcagtttctataatctgataattctatggtttccgaggcgaatctcatgtatgggtgaggcaggagagtttgaatcatggttcatagctttcagaggtcatttttagcctttaatatgaggcctcagtagagaagtaatttcttgttgtgcttttgaaattctgatccattcaagttgaaggccacacttaaaaggtaagatttctggctggtcatggtggttcatgcctgtaatcccatactttggaaggccaaagtgggaggatcactggaggccaggagttcaagatgagcctgggcgatatagcaagatcctctctctacattttttttttaaagcaaagcaaaacaaaacaaaaacaggtgagatttctgttgagtgtacgtagcaaccacctgtagtagaaggtcctctaagccagtgctcagttctctgggctccagacctagctttgctgcaaacattctgcttgcttttagcaaattcactttgattgtctgggccacatttcctcatctctaaatagctgacttgaaaggcattgaatttattttattcatcagtaaatgttgaacctgctctgacttcattataggttgtgagaattaagtgataatatttgtggaagagatttactgtaactctttgtgatgtaagctttgttattttttcatggtagatatgcatgttgacaactgttaattcattttgactatgttctctaatttgtaaaataaaggcatggaattaaaaaactaaaacattctccgtaattatctctgtctcctcctcatgcacagatcatatcatgtccgtactgttcactgatgtatttattccaggcaccgtgtgcagggcatgctgtataatatgtgttaaataaatttaaaaaatggcttataaacataaaatggctaagctttcagataatacagagaatgagaacgattttctaattttaaatttgtgaagattttttaaataatgatttctcttttggatgagggtcaggtgaaatgggctctcagggtagatgatgagagtgtaagttggtacaagtttaattgaaagcaatttggtatcaagaatcttaaaaaatgccaaggaaacttattcttgttaaagagtttcacttgcagtatttattctgtttaaagtttgtctaggttccaaactgcagctgaccccaagaaagtcaacaacctggcctttttaaaagagatacaagacctggcagaggaaattcatggaatgatggacaaggcaaaaaacttaaaaagactttgggtagaacgatccaacactccaggcaagtaaacctctcataactgtgacactacctacctggacatagcttaaggagagctgtggaggctatgagaacccagaatgctaaatgctcaactcctgcctgtgctaaactttcatagtgagtctttgatggatgaggccagcacctgcagacggttgtggagggtggagctggattctctctcctcaaccccctcggaaggcaccttgtgcagtgcacacactgcataaccttcagagggctgcagcccatcctgactttgtctccacagttaccttctcaccactctgcctactcctttacactcttcggctgttgtcttcctttcttgctttctcttattctgtttttaaaatctgtccccaccttccccaaacacacacacacacacacacacacacacacacacacacacacacacattcccaattcatttcctccttcttgtatatttggattggtcttttccatgttagtaaccctttaagactggccttggatgatttatttactttgattacaaaccttttggattattggggtggattattccctaaacaaaagcaatttctgtttattataaagaacatccacattataaatggcttcatcttatttataatctatagtagggaaagttaggatggataaagatcttagagagttttgcttacaaatggagaagtttgcacctcagaaataggcagccagttgcctctcttcacatccctgagtcattgcctattgtgatatttgttaataaatgggggcattcagttaaatttgaaatttaaataacaaaaatttgttaatatatgtatgtcccaagtgttacatacttgggtaagaaataatttatttctaatctgaaattgaaatttaactggatgtgttctattttaaatttgctaaatctgataatcctaagtatatagctccaactataattcctatgtaattttttctttcttcatggagtgtatacaaaaccacgaaataaagagtttggcagaaacatgaagaatgggcttcccaaggcagatggcattatgtggtatttttaagagacaaaatagcacctttgtccaggatggggcagggctggccatggcctgcctgaaagctgatttcacaatggacccaaaatgtatcaaaatagaccagaatggttccaaacaccaaatgatggagttcttatattacactctattttggggtcattctacttttataaaatttgattttcaaatgaggtttttaacatgctatttaaagaagaattaaatttttttgagatgaagttcccactttatttctagttttctattatttgagccattttctgtgagatatgtaacttaaaataatctgaaaaattataatttcacttttttctcttcaagtttttccttcatttttttctttttaaaaaaattttcatttattccctctctcctatcctgaatttttgcaatgcccagtgaaattagatactaattaaataatacaataccctttggcaaattgttgaaatttggtttaccagttaaattttttccatgaatatacttagatttggaaatctatggtgatagctttcttcagataaatcttatgaagatagatttattcttcagttttggtgtatttgatttttgggccagggctcttggatactccatttgactttagaattaaaagtaggcatttagcatgtgctttttcattgatgattgaactaatatctcttaaaccttctttattatagattcttcttatggttccagtttttttacagtaagtatcttaacaatagtttgaaaattagtcttcagagacagaatggttaagtttacaacactgtttttaagtttacattttcaaagattatttctaatgacttgtataacaattgtatagaagctggatttgagagagccaaggtctttgtagatacgggctaaaagacaagtttgaattttctgaagcaaggctctgggtctgtgaaaagcagaggtgaaacctgaggccagcaggtggtgggcgatccacagagttgctttgtaagatgggtacagagtttatctgatcccagggatggtctgagatttgtgcttggcacataagcggtgactccctcgaggcacgaagccctcagttaaggaactagttatcaacaggggggattttgacctccaaaggatatttgtcaatgtctggacatatttttggttgtcataactgtggaccagtggggagggtaatattaacctctagtgggttgaggccagagatgtcgctaagaatcttacaaagcacaagacagcttctacaacaaagaatcatctgacccagaacatcagtagtccggttgataagcctcaagttaaggtgcaaccctgacaatattaaaaattcttccttgctcatattgcagcaccagacactgactgactgtacaggactttgtagtaacattgcattaacagaagcatatgtgtctgtatctgtttaattctaagaaagatttagacagctcaaaaaaaatatgccataaaaccattaggagaaaagtaaaagaataggggccagctaatggattggaatgaagcaagaatgtcagtgcatccattaaataatgacactagcaaagagtattgaacaaacactcatcttaacttggagatttctgatgcaccaggtcaaaaggaaaatatgggacacacactcaaaatcttacaaataatgaaagaacttaaaaatagaataaaccatcactttaatgattaaattagcatttaaaaaagaaattataatacctgatgcttgtgatgttgtagcttactgatataatctcatatggttgtgacaatgtaaaaagatataataatttttggaaaagcaacttgattttcttgctctgtaattgttctgaaaattaatgttatgtataatacaagggaaataaaaagctgtatgcataaaatgttcattgataatgatggataattcaaatttcccaaagtaagataagttgaccttggtggccttcttagtacagtcacttaatagtgagtatggtatgtggaaaatgagtatgttattagatcaagtgtaaaaagcagaggacagtatcatatccatcgtatgtttgcgatgtaaaaacatttcggtgcaaagaattgaaggaaaaaagatttgttacaatgaaagagttctatgttgcttttttattatagaattctgataaagatgttataccgtttgattttcactgagagtgaaatggctatctgaataatctgagcagaggaatggtgggacttgagttatgtttttggaggatttctttggacattgtgtcaagcagagaccgacggtagccagagcggaagtgggagcccacgtagggaatcagctcatccttctatgcaacattaaatggaggtattttagaacagacgcacagttagtgagggaggtagtgagatgtgagggtggttttgatatattttggaggtaaaatcagtaggctctgttgatgaatgtgaggtaggttatgagagaaagagaagaatcaaagatgactctatgtggtttgacctcagtaattggaaaaatggagtggccatttactgaggtggggaaagactgaaacaggtttttctgaggggagaggaggagagggtataaagggaaatcagaaattgatttgggggatgtcagtgagatatccaagtggcattgccaaggaggttgtgggagtttccagtttggagctgagataaactctcttggctggatatatcaatttagaaagtgttggtgcataaatgagacttcaaggtcatcaagggagagtgtgtagacagagcagagaaagagggctgagcaccaagcacttgcatttgaaaaagagtatcaggcaaggaggaggaaggtgagaatgtggggtgttgtggaagcccaggaaggcaattttctaggagatggggatgatccattgtctcaagtgtggctgattgatcatgtaagaagaggatggagaagtgccactgggattagcagcatggagttcattagtgatgttgacaagaaaggctctgatggaatgatgagggtaaaagcctgactggagtgggtttaaaagagagtgggggcactccgggctcagtggctcatgcctgtaaccctagcactttgggaggctgaggcggtccaatcacctaaggtcaggagttcaagaccagcctggccaacatgatgaaaccacttctctactaaaaatacaagaatgatccaggcgcgtaatggcaggtgcctataatcccagctactcgagaggctgaggcacgagaattgcttgaacctgggaggcggaggttgcagtgacctgagattgtgccactgcactccagcctgggtgacagagcaagactcggtctcaaaaaaaaaaaaaaaaaaagagagagagagagagaatgggggcaggtaagtggagacagagagtgtatatgactcaagatggtaggctgtgaagcagtgaagtatggggtggaagctgctgggcattgcagaggcctttgctgtctgttcccaccctgctggctctctaatttctccccagctaagatggacagttccccgagagctcagacatctggtcacagggccccatgtcaaacacatgctgagagtattttgctttctgttcttccccgaagtcagttcagcttgagagggcaggggagctaacaaccccattgcaacccacagctggggtgaccaccagactcacattgcctgggactgagagtcccttgttccaggaaacatctcagtcctgggcaactggggaaggttggtccaacttcccccagcaatggttcaactctgggcagtacctttgttcctgagaggctttgaggattcaagccagcatggcctgtgcaggtccttgatggctgcattgacttttccctctttccctctttccccactgcaacatggatgttgcagtgaaccttctccagaccattttgaagtgagtgaaaaagaaaaacataactaagtatcaatatgttgtttttttaccttatttttaaatgggaaataaaaattactaattgttggatttaaaaaaacctcacaataatgttaccttgaaacaagaggagcttctgcacctccacgaacgtccctcatctgtctgtgtacatattttatatacaggcagtgatgttgttcagagcgtgtgctccctgatttaaaaaagtcagcgccatattttaatatttcatatgttgttatagtttataaatggccagttttaatcgctgcagcattctttccacctcctcagctccttcttcctgggaccatctcctgaataagccacctatatacaagtccttgttgcaggggaacctaaacggagacaggagatatggatttattttccttctttattattattattatttttttagagacaaaaaatgctctgtcgttgagcttcaaactcctgggctcaagccatcctctggcctcagcctccctaaatactgggattataggcgttaatcaccatgcgtgcgtgcctgcctgcctgcctgcctgcctgccttccttccttccttccttccttccttccttccttccttccttccttccttccttccttctttgcttccttctttacttccttccttccctccctccctccctcccttccatctttcctctctcctttcttccctccctctctccctgttcagcacagatggaaccatccatttttttccctaaattttttcaatcgatggtttattgaatccaaggatgcctaacacacagttacgaaaggctgactgtacttcactgtatacttctgaaaaacaaggtcattcttgaacataaccacagtacaattattagaatcagaaaattaacactaatacaatagaattatttaacctatagactttttccagatttgccaattgttctaataatgtccttaacagcaaaagaaaatcttggatcatgtattgcattcagttgtcctgtctttagtttcctttgttctggaacggtctttgtttttatttcatcatgatttttgaatagatcacttattttgtagactatctatctcaattttggggttgcctgatgtctgttcgtgattgcatttggggttttgtacttatggcaggaacagcttgtgttttttaagatggcagataataacatgctgataggaatgaaccgatagaggggaaaagagagaattgctggatgatgctcttgaggggtgggagagcaggagggctgagctcagcctgaggactgaagcactgaatttggctggggatagatttttttttcttttgccagtggaatatatgatagattgtgagaagagaagagagttgagtgggtattcaagggaaagatcatccaggaatggaccaggggcacgagggcaatggggacaagaaagaggtgttggcagaatggaatgtggggcctggtagggccaaagagtcattagagttggggaactgtagaaaaggagtggggttggtcatcgaagagtgaggtgcataaagttgtagctattgataatgaaaacaaaatgaagattttgaccagagaaatgggtgattcaagcaggtggaagaaaatatcattggatggaagggagataaagtaacagaggggatttgaggatcattagatatggaaattactgagaatggtggctgaagtcatgccgaaaagcatggtagtgtgctagaagccagaatcctccagaaatggaaagagctcattctgggagcttcccaggaccctgctgagttctgagaccctcttttcattccactgagagtggtgtgaggaagagggagtgtgtctcgtttggagtagttggacctctggagaatgcttctttttctgtttgtttgttttaactctatctcatctgaaagataaatgctgtgacttttatgagtggtctaaaatgcaggactcacttttattgaagaaatgggaactaggcagcaagaagagaaccagcaactgcggagcttggatcacagagtgtggggtagttgttactgggatgtcatggagcattggggtgtttttccacctagggagagcatgcgggctcagtgaggcactggagacccatgttccttctatttttgcacttagccattcttggcatataataagaaagcctcgggtatctagagaaatccaaaggctctatactatgggccagctgcatttgccttctgatcaagccatcagtgctcagtgaaatgttgggtttttttgttcatatttgaattactctcttttctttatcatttacatgtaaagaatagatcattacattcttatccaggatctatgtcacagactttgttgcttcaaaaactgtagaagttggtacagcttgttacaaaaatcggccttctttgtcttcttaccccatccatatttttccctccttgtccatatttttaagccattaaaaaaaaatcctccaactgcacagaatagttttaacattgtgttcagcagattggcaaatctgttcaatgtagtgatatattaagtgtgagtttctactaggagaatgtctacaattttgcacctttgtagcatctgtctgtctcatttactttattaataaaactccagagggaaacttttggtgtattttttttcccatcagatggatctcaataagaccgaggaggtaatattgaaactggaaagcctccatcagcagcctcatatctgggattttctacttttactgccgagactacacacaagccatgatcatgtggaagatggcatggatgttgcagtgaaccttctccagaccattttgaagtgagtgaaaaagaaaaacataactaagtatcaatatgttgtttttttaccttatttttaaaatgagaaataaaaattactaattgttggatttaaaaaaacctcacaataatgttaccttgaaacaagaggagcttctgcacctccacgaacgtccctcatctgtctgtgtacatattttatatacaggcagtgatgttgttcagagcgtgtgctccctgatttaaaaaagtcagcgccatattttaatattttgtatgttgttatagtttataaatggccagttttaatggctgcagcatatatcattctggtaaagtactatatactgtaatttacttaataaatttggcattggatttttggttgtttctgagtttttcactattagagataggcttgaatataataatttcaactaatttcttaagaaattatgccatagttgcccagtatagcattcagaactgataagctcagttgcttcagttgtgtaattcagttagctggacgttggtctcctatgctggatttgacccccatgttacctggggtgacctttgggagcatcccttcccgtggtgggcttcttatgccttaatcagcatggccctcttttataaccaattgaattattttgtgtaaactcattgtatgaataatgggttttattatttttcattagcaaaggtttatattcttctctgttttttaactgttacttattctatctgccattggtgagagccacattacccttaagctacaacaaaaagggccctgtcctggggcctgtgctttggggaggtccccgttctggctttccctggactgtgcctctgctcatggctcagactgcccatggggtgaaggggatgtgtccacggagcccacacaccctgattccctctcaccctggagttccctaatttaatgaccagatcatggtcaagcctcttttctggcccctccttctgagggcaagtcttaacactggactgtggctcctgcagcccaagggtattctagggatggctgcagccattggcaggagtgtggggtgggaggcacgggtgctgttgggctttgtaggctggaggacctacctatgtgcactgaggccccttgaggtacagaccaagctgagggtggggagcacataggggaggagtggactgaaggttggggccagggacaggtgctccccaaactcccacattctggtgcgtaactctgaggatcacaaaattctaaatttgaatgtagctttccaagttgttatgaagatctatttgtcaatgtaggaaaatggaacgtattttgatagttagttagcttgatttataacttaaatatttgaacatatttgaaatgcctccctttgtattcttgcccgaagctctgactgtgttagcagtgaacaacgaaaataattggctattctgagagatgcaaaatttaaaatgagaagatattgatgacagttgttgaaccatatcagcttcagtataaattgtatttccatatttggcttcagtggcatgatatcaagaaaatctgcattcatagaagtatttgcaagtggtaccaggtttcagtgatatatcttataatcctgggatacgcttcaatacacaaagttgtcataaaagatttttcttgatgaaaatctacaaggaaataatctgtttggaagcacagcttatgattgtgttggtctcatgttgctaaaatgcagatatattccaacttctgttgagtgcattttctaatctacaaatttaagcatatttatttataaaataaaatattaatattttaaaaataaaattaatatgtatatgtagattctccctccccaaagctccttgttctttgaaacagtttaacagccactgattaacccttgacctattcagatccataggttaagacagggtggaggattgaggtacatggtattgccccccaaatattagactgattatctgaacttgaagcagccaggctgactgttcatttgcttttctaacatagcagccctttgcaccctggctggcctcatcagctgccctgcggcaggaagaatcaaggctgagtataaaataacacctatggcagagccaatgcaaacttgagttctgtgtcaaaggcagagtggaagatggcctaagttctcaagtgtttcaagagaagaccttacctcttacatttagttactagttcagggagttagggtcacattaaagccacaaagaatgctgacatgtaaatggtccagccacatcttgcaacagcactaggggcccagtccatgggatgtaagtaaacctagaattgatgctacttgttttgctaactacccactcatattgctttttgttttgttttggttctagttccttaatatccctagaagatttagattggcttccactcaaccaaactttttcccaggtttctgaacttgtactgaatgtgaccatttcgacactgacatttctgcagcaacatggagtagcagtcaccggtatgggtgccttgtagctattgctatatttcaaaacgtttaactacttaaattcattgacagttgacatagagctaaaatgatgttcaaaatgatttaattaaaatttcaaattcaaaaaagtatcaattgtttctgttaatacaagacaaaaatagaataaaaattttgaactcgaaactgaatttgactttctaccactgttgacattctgcagtcattgctaatataaatgatatttttaagttaaaaataactgattttaaagttctttgactttatttcatctaatattagacctatcactagctctgtgattttaatctttcctctctctaagctcctattgggaggaaatattttaaaaatggcaaagctagtaagaggaggcaggttgatgtggacttacagagtccctaactaaataagcagccctaccacaggggagggaatggaattatatagctcttttcttgatccaggatattattatttcctgaattaccaattgagtctgagctttttacttttaattcccttcttttctctatttttctatctttggctatttctctaagggaaatacagtgagagaacaacaaagttggaattcatccacccatttatctgttcatctgtccatccatccacccacacatccattcatccatccatccatctgcctacccattcacccactaaacaactcatcaacctctttatacatctatccatctattcgtccattaatccatccatctatccatctattcatccattaatccatccatccgtccatccatccatccatccatccactcactcatccattcatctgtccatccacctccccattcatctactcaccaacccaccaacccattcatctgttcatttatttattcattctctcattgaataaacaacgagcacttcctatgagccaaacacttccccagagagtgggaataaaaagctgaataagacatagttctttaatgagaatgcatggacacagggaggggaacaacatacaccaggtccagtcgtcgggtcgggggagaggggagggagagcattaggacaaatagctaatgcatgcgggtcttaaaacctagatgatgggttgataggtgcagcaaatcaccatggaacatgtatacctatgtaataaacctgcacattctgcacttgtatcccggaacttaaagttaaaaaaaaaaaaaggcatagttcttactttcaaggaagtcatgtttagtaaaggagagagatatgtcaataataaaaaacaaacaaacaaacaaacaaaaaacaaagaccacagagtaaggatctgacatctgcttcaggaaaaacttcaaggaggagttttgaagggtgagttggagtttatcaaagagatgagggagcatttccaggaagagagaagactgtgagatacttgggcttgctgagagctgtgaatgtttgacattcagtgtgtctgaggtacagtgggcagtagcagggggtggcatagaaaggagcccaggccaaaacacgagtggccatgggagcagtagaattagatctgcattatagaaagacactcctgggccggtgtgaggagtagattggaggcaggtagttctggggttcaggatcctgggagcaagtcttccatcagccactttctcctgaggtctcagtctcctgaactattattattattattattattagagatggagtctcgctcttttgcccaggcggcagtgcagcagtgagatcttggctcattgcaacctctgcctcctgggttcaagcaattctcctgcctcagccaaccaaatagctgggactacaggcgtgcatcaccacgcctggctaatttttgtatttttagtagagacatggtttcaccatgttggccaggctggtctcaaactcctgacctcaggtgatctgccctcctcggcctcccaaagtgctgggattacaggcgtgagccactgcgcccaaccctgaactattgtacaatgagattgttatacacagagatttctacaatcccattcagaattttgctgcttcatggagcaaactaacatgaaaccctctatggccccaaattccacctttccacctgttgcttctttcttcttgttgcttgtgactcagcacagtgagacccacatggaatttttttttttttttttttttttttagctttctgtaagagaaagctagctcattaacgtttaactccattttcaggttaggttagttccactgggaagtatttcttatgctgagaacaaaacccagaggtggggtgcgagatgaataaaacacctcatcgaaatcttcccagtgaccttaatttaacagactcatttagaagctcaagtttttgtacatcatccaaattacaacaacaaatttgccttacaattgaaaatgtaattaccgttaagaatgtaattaaaataaacaattttctattaactctccagcgagtcaaagctaaggaacactattacaaaacatactttgagaggtaactaaaaattgtcttcatgtctcttgtctccaagaaaaattcttttgcttgatgagccaattccaatgtgaagaggaagggatgagtggcctcatgtggctttaggctactggtccaattatgttatgcactaaaactgttaatctacacattctgaattctctgttgtttagcaacaaatttctgaatccaagttgtctttcactttttgagaaagattttatacttttataagtatgctacactgatgtcactattttttctctcctttctggaactctgtgagtaattctaataccttctgagaccagtagagattaatagttacagctcagctttggaagccagatcatttgggtttgaatcagaggcttaatctaacaagtgggactctaagaaaaaggggataattacagcacctacctcatagtgttgttggaggactaagtgagacctcccatggtgtattcttagtctaggtcctagtacctcttcaacatacaataaatgctggttttaatctcagacaccaatcttttttcctcccatgatgccatgtaaaggcaatcagactggaaacaaaaaatcttgtatttctgggattttccccatctttaacaccttcctgaagtccccgttgacttggtctgtctttgtgaatgtcatggattgtgcttttttttgtagacctcactgcaattataaggatcctatgagataatgcttgtgaaaatggcttattagtggctggcaggtgaaggggctcagtcaatgggtgttgaatcatcatgatctgaaacaatctaatttctaaatgaaggttcaagattcaaacacaccaagaaatttatgtgtttttatgtttgcagttgctgaggcatactccccagagattttgtcataccttgggggtcttcgatttatattttgaatgtgtcactactagatagtgccatgggttttttgggtagctcatgaattttatatgttgataacttgagttaggggaactttttcttatgacttcaaataattattgagaatacagttttaaagactccatagtattttatgctatggatatactataatttatcctttccctggatactagacacttaactggttttcaatattttatcagtatagaaccaataaaatattgtcgtaccttaatttttgctcagatatctgattaagcttcttgagaaagacttttagaagtgaaattattgggttcaatgacttgaattttataaagctcttgaaatatgttttaaaattatcttctggaaatgttgcaaccatttgtgccagggagcatgggacacttcaccattctctctatagcagcaagtgtttattctgtttgctttttctatctgatgccccagtggtgtttggtcttcatttgctcttcctttagaggtgaaaaaaggtattttttttctggattacattaaacatatcaaaatattcaaacaactgctggtgtaaatcttttgttattccaacagagccagtttaccacctgtccatgcagaatatagtgtgggatccacagaaagtccagtatgatctcaaatcccagtttggctttgatgatcttcacacggaacagatcctgaactcttcagctgaactgaaggaggtacacatgcttgactgcttctcacaccgctgggcctttcctggagactggatctagagcatgctgctggggcagggtgagcgggtgccacgggagaggcagccagacaggagagttcggtcaaaacccgagctccttacgcagaagagacccctactgtctccagcttttctagaagtgtctctttcttcttaccatgtagttttatcccagaatggaaaggcagcttagaaataatatgacacttgattgctctgggaactagcagtgggagaggccaggtcaagtgagggtgtgagattctgaagacagcgctagtggggtccaggtaggaagatggtgcaccagctgtagtgagtggggatacaagtgggtgaatttccaggtaaagagatagttttcattagaagagtaggagctgtacgttatggatgcctgctgggttcaccaaagttgagcctcttccctaactaggtgaaataagggagttggactggatgatcgatccccaagacccagttcactgttggtattgctgaggttctgggagatatcttttagttacagagtcccttttgtcactccagcccatttgtaggcacttctgctttgcatggtgcaggtccaagaactatgcgggacctggagctttggtccatagactccacctccagggttagagcatttctggtgcagctcctaggtcagtgttgagttaggaatgtttggagaggacccactctcttccattaggatctcagtccatgctggttatgtagattttgctcacttttttgtgagttccccacaacctggtcttcccagatagcacttttcacatttcagtgcagctagtttgtgttcagactgttgctttcagtatttagactctggatctgtgctctcagtctcaggggttagatggttgggttgcagccagcagaccctcatgctggcttggtgtttgaaaacccagttctaccaggtaggtttaggcttcaccaaagtatactaaattttgtgcttcttgtatccctggcacaattttattaatcatctcacaattttatgaactatctacctaccacaggacttgaaattgtgacccttgggttttctcatggatgctgatgtagatggaatatgaaaccccagttggctgacttttattctagttttctccatctttataaccccgttttctcattatattatagtttgagtgaactatgtaaaacttttaccttagaatgttcaatatattgagattagaattaaaaggaaagtgatcagaaaataccactgtgtatatcaacagagctccatggaaattgtacatcatgtgtgtgagctttctattgctgctgtagcaagttacccccaacatagtgccttaaggcaactgacattttcttttatcatagtgttctggaggtcagatgcctgaaatggtctcactgggctagaatcaaggtgtctgcagggctgcaatccttcttgaggtcaaggggacatactgttgtgggggaggaaaaattctttttttctctattattccatcttcaatggctggggctcatgaattaacctgataaaagacagataaagaagaggaaaaccagttattgtgtaggtatgtatgggagttcacaaagagaaatgtgtagatcttccctgatgaccattctgtttttcactttcagtatagtattcaataaattacatgagataataaatactttattataaaataagctttgtgttagattatttttccaattgtaggctaatgtatgtgttctgagcacagttcaggtaggctaggttaagtttggttatgttttgaggttgggtgtactaaatgtattcttggcttatgatattttcaagtcatgatgggttgatgaggatgtaacctcattgtagatcaaggatcacctgtattttaaggaagcagccagattattaaggcttatatgccatccaaggctatctatacaaaggaaagggggcttggggtttctgagtagcaaggcaagttatgggaaggtgaggggaggaaatatatggtgaatgagttatcctgttttgcagagaaatctcccaggtgatcagagttatttggagaagcagctctctttttggtaggagacatctttacagatgaaaattatcttaataatgtaaattttctttataaatctaaatttcctttaccaaaaggaaatttatactctatttttaaacagttagggaacggtaagaagtttttcctgcctctgctggttttcagtttgtctttagctcaaaataatccatatgccaaagaaacatactttggggtggcgtattctgttttcttgctttttccagcttccagtggccatccacattccttgggtctgagcctctttctcaatcatcaaagccagcaatggcaggtctagttcttctcatatcccatcacttgggcactgacatttttgcctcctttctccaataaaaacccttgtggttacactgggctcaccaggttacccaggataatcgcccatctcaaagccaggtgataagtagccttaatttcatctgcagccttaaatctcacttgccatacaacataacatattcatgggctcttgggattgggacatggacatcttgggggaacattgcctgcttcccacccttcgtaagtgtaattgcctggtgagctcttcctgcccactgcacagacaaaaccaattcattgagactgcagtattgcagtagagaaagggtttaattaatgcagagctagccaagggaaaaaactggagttattactcaaatcagcctccttgagaactcagagggtagggttttttttttttttttttttttggataatttggtgggcaggggactaggaaatgagtttcgccgattggttggggatgaaatcacaaggatgtggaaaaatgcaaaagtctgaaaaacgtctcaagagaccaatcttgggtttgacaatagtgatgttatctataggagcaattgaggaagtcacatatcttgtgatctttggccccatgactcctgagcagcaagggattatagaaggcaagctagggaccagtggctgattatcatttagctacacctacattttagcagcattcaagccactctcataatcttaatcttgtggccttttattagtcttacaagggcaggttctgtacctgagaaatgaggggattcatcttagggagggactactatcaaccttgctaaaaagttaaactacaaactaaattcctcccatggttagcttggtatatgcccaggagtgagcaaggacagccagcctctgaggctagaagcaaggtggagtcagccatgctagacttctctcactctcataatctgcaaaggtggtttcacagggccctttccatctgcatcagcctgtgagcctaggccctccctggggtctgtctgactcctgaccctgtcactctctgggcctgctgggggcctcagcacatgctgcccctgcaagagaatagtcctcctctttccctgcctctgcctcctgaattggaaaatgatttatctaacctcacatcctctgtggatctcctgtgacctcacttcagcctctgcctctacttcttcaaccttctataatagggcatgtcccagggagcctgatggctgcatatctgcctctcataggctgtgagcatctgagtggggacttggccttatctatctaacatgatacatggtattgttgattatttttaattaagggaaaaaaatagaacaaaacatcagggaccctgtgctttgacagtcacaggttaatattttaaatcctgatccaaaaggaacctaaaagtgaacacatgggactaaaattaagctttctgactattgtcattgtttagtcaattcaggctgttataacaaaagaccacagacttgtaaacaacagaaatttatcttggtgtgtcctcacgtggtagaaggggtaagggaactccctgggtctcttttatcagggtgctaatcccattcacaagtgttcaccctcatgatctgaccagctccccagggccccatctccttataccatcaccttgggggctaggatttcaaaatacgaattttggcggggaggccacaagcatttagaccatggcagtcaccaacagaatctcttaaagatggcattataattgttgtaaaatgatgtaataggggaatgtgcttcattatatcataaacataagtatttacaaagcagtgttacaggaactctgttgaagttctttttttttttttttctttaagacagagtctcactctgttgcccaggctggagtgcagtggcacgatctccgctcactgcaagctccgcctcctgggttcacgccattctcctgcctcagcctcctgagtagctgggactacaggcgcccaccaccacgcctggctaatcttttgtatttttagtagagacggggtttcaccatgttagccaggatggtctctatctcctgacctcgtgatccacccgcctcggcctcccaaagtgctgggattacaggcgtgagccaccgtgcccagccactgtgttgaagttcatgtataaaataaaggagatttggttcaaaaacattaaacagtttctgacccaggacttcaatttgaatctttccaattttatccacttttgatagtcagaaaagaaaatgttcttggcaaaacaactttgttagtccgaagtatgaattaaactgggctgacccatgttcacttttggcctaagaatgaaaagaaacaagatttgatgtcatctccatgtccttggcctggagaaacagctgttcctattgtttgtggatgaaactgaaaaatataactttttttttttaactaccaagtcttccctcaaggtaaatcacatagatatcatcacttacttcttcaatcaagcaaatgtaagaacttttactgtggcaagatcgtggtgttatttttagaagaggaaggttctaggaaaggagctttatgtctaaatattttttcatattgttgtcagattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgctgtcccctctctctatgttctgttcaaaggtgtgccagtttgagtgtccaaatccattctcctcccctgccctgccatgtttactgttggattttatgtccctccaaggaaagggccttaggagccccacatcctggccattgagtgcaccttgtcccatgtgcatcaactggctccagctccataggcctaggccctcaacactcatcaccaaacagtctatcctaggcttgcacacacaccttggcaactcagaagttcctagacccatgctctgttattggtgcatgagattgccctggagtactatgaccagctctttggacatttgcatgctagcattgggcatccctctagcactttaagctctgaactggccttgtctcttcactctggttttgaccagaagctctgtgcacaaacagtgactgtgatttcagtgaccataatttaacaacacgaagggaggctctagtctgtctttatagggatgttggtgtggggcagagggcctgagtgattagattgctcctggcctcagaagctcatggagccctggctgtttcacagctttgcgcttcttggggaggttttggagactgtgaggcagagctcccctggcagtcacttcccatttgttttatcaggctttgccgtctctgtctcatgtttttccttaaagaacacacctctttaactttgttctccgctaatatgtgtcatgtataaaggccaaaatctcaaatggtagataaaacatccttaaaaatatataggtgttgtcgtctgcttcgtggcactaaagtcatccggcactaaaataatcaagggacagtgctgaaatgaccagcatccaatggtctagtggacacacttgctttgtgcattatctgggtaacataactcatggttaattaaggcatagttagcacacatacatgtacatcgtgcacctctccatgccatcaggcttgggcaagaatgatctatttttgtgtaatgttgatgacaaaccacagtgctaattgacttcagtatcatcctcaccatgtccgtgtcgtaaaatgacacttagtaaccatgtattaactttggtatatatttaaaaatatgcaaatatatttatgctatcctaaatatgttcgtttaggttttaaattgtatttcatttgtttagaggtgtatgttattcccttctctctttttctcttttgggggaaaaaagagaaataaggcagagattataaagttgtgtgcatccattgttgcaacatgaaatctttaatttctgagtagaaattaaatcatactgcaattgctaacagacattttaatttaccaaaaaataaagattggctgtctgtcatctagagtggtatgttaatatttcttaactaaatactgttctttccaatttgctattattaatgctagtattttggtttccgaatttgtaggtgtttgttcagtggcaacagggtagcctgcttcagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatgtaagtcgcatttccctgtttgattattgattaggtagatgacacagaatgttaaagagtgcgtgatgatactgttagaaacacattctgtaaaactacagctaaataatgaatttcttgttagcaaatgggaaatcagaggctttcattgtggaccatcaccagggtagaagtcttggcagcactctggatgcctattcagaggctgcaatcgaccgaatacgggagcaatgtttgagaaggtgtcagtttcctagattttagattttatgtctttggcatttgtttaaaaatgaataaattcatttcggaggcatttttatgtacagaactaccttacatgagtagctcttttcctagaatcttcctcttcaaaaaatatgtttttatatttacttaaagattttgtatagttgaagtgtttacataaggtccagaaatattgtagaagtaggaaatggtggaacttgtttcttcctttttaagataaccacaattgattcaccaaaatagccgactagatctttttccttagtaggtgtggcagtttgtagtaacttgaatcttattatccttctgaagttaaggctgtctttggaaaagaagaatatgatttctcaatattatctcaaaaatgtgcatttcaaaccaggtcacacaaattcttgctctctgtgtaccatgaaggagagttgtgatgacagaattggataggaccatattgtgttcttatgattacttaagaaatagcaattctaaacacttccagttctttcacattttctggaacttttagcaaacaggatcttgcttttgaaggtcctatttcctaacttttacttaagagatgttctggggcctgaggtgcttgcgctaaaggcagaaatacagttccctatccgggccataaaagctacaggaggatggatgcagggagccagcaaggatgccttgaagtagtgttctaggcaaagggcagggacaaaacatctgtcataaatgaacaaatgcagggacattgcactggggatattgaaaacctccctgctggtctgtcacttaatgcacattaatagaaacaccacattaagtcaccgtaattatcctacaaatctcgaatgccccctggcactttagcctaggattttgcctgctctgtgccaggccaggggattgaagccccaggaagctgtacttggctcttagtcctacagagatggggggaagctgaagactataccacactctaggtacaaagctaggatagcccacattcttctgcccccatataaaatttccacacattctcagtgccaggaagatgaggcccaaacactggctttgctgtccatctgctgtttttttttctttgttttgttttgttttgctttgagacagtcttgctctgttgcccaggctgaagtgcaatggcgcgatcttggctccccgcaacctccacctctcagactcaagcgattctcctgcttcagcctcctgagtagctgggattacaggctcacaccactactgcccagctaatttttgcatttttagtagagacagggtttcaccgtattggccaggctggtcttgaactcctggcatcaagtgatctgccctcctcggcctcccaaagtgccggaattccaggcgtgagccaccgcagctggccaccttcagccttatttaaatctttctgagattcacatgcacccttagcagaaaattgtatatcttttatcattagctttggtccaagaaaccccatccctttttcactaccttgtcttcatagccaattgttcatatctttttctcttcctaagctgcaaagttcacccaaaataaatggaaatcacaccagactctcagttttctactgagtttttcgtgtcattacagactgccttttctcctccaggttctttctggttcctgcccacgtccctgcagtacgggtggctgaggtgtgggagctcttcacccaggctctagcagatagcgtggattttggcaaggcgaggactcacagaggtgcctctgcgccttccagcaaggactcacccttcaatgtcgcacgttgttgtgaatgtgaagtgtctgttcacagatgtggggggaatagtccctagggtctggccatgtggtatccttgcttgtcagagtttaaagagacttgacagtaagatccaggttccaagccacacagcatttcttttttccttggggaaaataaaataatctctttctcactttctagctctttccaagtgccactctgcttccttctcagtgtaatccaaagagtcagaacaatgactgacctaagcccagttcattctgcagatggccaattccaaaagccatgtgtccagcttcactctagcatgaggtgtcaggagtctggtcagcagccagaaagcccaagcatgtggctctgatggagcaattgctccgccttgtagggtgatgacgtggggatgggtaccagttcctgctggtgtcttgtaggagaattatcattgggaccttgctcactctctctataccctttacggtgcttgggtccatcagctctccagctagagaatagcagcaactatttatcaagcctgtgttcaaccccaaactatcaagatgccatgaagagactgaccactatggcacagaagtcgaaatggacgccaggcactcaaagcagtgggatggctccagccagtggaacattttgcttgggcttcaagtagctacatctctttctgcttttctccttctgtagcttgcttcgtttatcacaggtgaggattccatgcagttgctcaaagacacagaaagcctggactcacctgctctgggcagttctgctgcccacagtgtggctatgccttgcttctccctctcccgtatttattcccaatttcaggttcttcacattatcaaactcattttctttccagcttctcttctcagttgtttcttccatgtctggagcccgttagtctgacattctagggactatttgtattgagctgcctgggtggtcgttcttcctttgaccttggagaatcctacaggcattgccaattggctcaagttgggaccactgcgatgggtcctgtataccatcacacaccatctctatattttgaaacttttctcaaaatatttttctatatctcattaactataggcttcaaggcaaatgtttttagaccccatgtgaaactttatcctaaccctcacttcttttacacacacctaggaatatactttcccattttggggtaaagagaatgtttaatccatattcagtattgaaagaatctcccaatcaggtgactcaatgcaatttgtcaagaacctggttgtgtgatgaagtgtgactttcagtctagtgaacacacttctcaaagcagtggaatattttcctttgaacggaatttttatttccctaattggcacttcgaactacttttcattttatttcatttatttatttttgccctcagattacagcatctgtggaaattgcaaagcttgctgcaaaacctgccccagtggccggcactgaagagatttcttcagcttgatggagctctcagaaatgcgatagctcagaatttacattttgtccaaggtaagctagctttggtgttatttgtccctgactcactaagagtaaatgtgaaatttattggaaaatggacttgaaactgcctgacacattgtaaagttgggagataactttgctggtgtcatatgcatatttatgctttactctgatgccttctaggggatttaaaatacagcacaccaaggctaaataaacaataagggcacagtgaagagcgcatccttctgttttccttaagcccatgctgtggcctatgacaagcagtgtcctaaggctgggttgactttcacattcacggcagcatctgtggttttcaggctggaaagggaccagagtgcgttgtgaataagcgtatcttttgtattctgttccttctactgcctcctcccaccaatgcttcttggtgtccggtagggagagtgtgttccccctgggtttgcagaatgcccttctttgaactttcttgactatggtgagcattattctttcttccctcttctgaggaagttgggtttggacttttgcccagatgggctgcagccttttcattttctcagggaggagagggaaaaagtgaggggggatgttactttagaagtaaaaactcattctcactagtctttggaaaggacaaaatgatattacaatgactcctgttttcctttctaaggaagagaagaaaatgtataataataggtcaagtttttaaaaaatccatgttttcaggatccagtttattgattcatggccatgtataaaagtcaagcttacttaccttaggtgaataataatcaatttgtctactttgcagaagtcctcatttgcctggagacatcagctaatgattttaaatggtttgaacttaaccaattgaaactggaaaaggatgtgttcttttgggagctgaaacaggtaaagcacaacaaataattataaataagcatttttaataaaacattcaagaagctcatgcaatattcagttttgctccttttgtgaattgtgctagctaaaaaagggaacaatatgcaggtttttcaaaactttatgttgtgtttaaaatgtttatcattgcttattatatttgcagttcttgagcccatgaagagggtatctaagcctctttaaatgttactccttcccactcttattaatcttttagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgtaagtattctaccatcttagctcttctaagggcacaaatttaagattaaattcaccaaagatgctaatatttaacctggagtttcgatgaggaaagttttgccgtaagcccacacacttaaaggaagctggctctctgaactccagctgcccttcaatgctggcctttctgtctgactgaaaggttgtatgccacccgcctggccaaaacctacttgaaattcctcaaactttcaaaacataccacttcttcttttctggcttcctggatccttgatctgcttcattcttggctgcacatgctaagaaaagcagaggagtctctggtgattagtcaatcccagcaaaactgtggctttgagtggttacaagctttaaaagtcatattcctctcatgtaactgcccaggacaatgggctacccctgttcagcgctcaagtgggactgcagaatgttgaacgatttgtttggaaagattattttgtcaagttccagccctattcttcttactgagaattaaaattacaatatttatatttttagagttcatttttctctctcagtattaccttttttttttatatccttatataccatggaaataaaaccagtgaaataatgaaactagtgaaatataaatggtgtctcagcaaaatgaaaattgggatagtaattgaatagtgtgcataattcaatcaccgatttcttagcatctactctgtgcatgacagtatgctgaagggagtacaaacatgaagaagacactatcttggtagagaagggcaaacaacagtgagagccttggagctcagcatctaggagtcttcccaaataagtcaatgagccttagatgaggtgtaagatttggaagcaaagagaagtcaggagaggatgctaagcaggcagaaaattatatgtgaagggctgggcatagtagctcatgcctgtagtcccagcactttgggaggtctaggtgggcagatcgtttgagcccaggagtttaagaccaacctgggcaacatagctaaaccccatctctacaaaaatgaaaacaaaaattagccagatgtggtggcacatgcctgtaataccagctactcaggaggctgaggtgggagaattgcttgagcccagcaggtcaaggctgcagtgagccatgatcacaccattgcactccagcctgggtgacaatgtgagaccctattaaaaaaataaagaaaagaaaataaataagaaaagtgtatgtgaatgcatgcaggcacaaaaaacattacctgtttgcaaatacctttcttgctactagatgtcagctctttcctggcagaaatcctatctcaaatttatttttatctgtaaagtctaacttgtagtctcatacgaagcagggaactatgtatttataggttacatatacttgaggtagccttttggatgatgcctacgatacgtatcactaacaaatcaccccaaagctcagtgacctaaaacaaaacacattattttctcgctcttctgactctgggttgaccagtctccgtggggtggttcttctgatggtcttactgggcatcattcatgtagttgcagtcagatggccgtgagggctggagtctggttagctaggatactgagacgagggcctctcatcctcctctcagactcaagatgtctcttctccaggtaacctctccatatggcctttcagcagggtagccagacttctgacatggctatccagggatcccacacacaagcaaaaacaggcaaggagggagagtaggagctgccagtcctcagagaaggtagaactagaactggcacaattcacttcagctgcattctatgggtttacgtgagccagatctcagcctagaggaattgtggaaggtggtactgagagtgagactctcagggggtctggttcacaggctacttgttgcaactagctaacacagatagctatgacactgagtcccatcctactttattattggattaagttttatttttggacttattaacctgaacatgagtaaagattcaagtctagaactataacttagataattaccatgccatagggcacgatctttgatgtacagtttgagtggaccccttgtttagtgatacagggtcaaggctgcgtctcaaatacccacatctgaattgctttatttattataagcaatatcttcttttcttgttaaggatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgtaagtacatgtttggtgggaaacttataaacaattgggacatcagaatgatttcaactgccccttctacacaaatgatagatcaatatggtagattatattttgaatagaaagaggttcaatttattttaaaaatattaacctactggtactgttggaaagcatctaataactgtaaaatatgaaagagttcccttaatgtttaaccactgacttaatctttcattagaaattgaggatccctggtaagtccaaggtatgcatgtgatggaagttcttgttaattactcagaaattgtgcactaagtacaaatgggaagcttctcttgggagctgtaactctacagaaaattcgccttgattttattttatgactctgtgaattatatgtgtgatcaatttccattttccttgactgctaggatgttcttcgtcaaatatgtcaaatagggaatatatattttcttaatatttaagttcacttcctgttatggcctttaattttcctctttttttgtccttcttgatttattgtcttatattttatgtattctcataaattgcttttccttatttttcaaatcgaggtagaggagtttgtaaacaaacttaaaaaattagtagaactatttgaaagattctatttccttacataagtggactgccatgcatttgcatatatttgtttttagaaaaatttataatgatctgtcatctgcaagatcatttttaaattttaattttctctggattctttttgattgcaggatatttcatacacttgaaaaaacacaatttttcctggaacaagcatattattggaaagccttcaaaaagtttatcaggaagacttgcgaagtggcccaatatgtaaatatgcaagagagtttccagaacagactattgggtaagtcagtagcctaaactacaggaatgggggatgctttccccttttagtgaggtgacataatttcctgagagtccatcctatttaacaaagcggggcttaaaatgggtggctctccaagcacaatttggcattgtgattacttcatataattttttctcatcaattatgacaagacttaccagaagtcctggtttgactgagctacattgttcctgcaaaatttataatagtgactgcttttactctcaagactgtcctggtttgggtgataaatacttctatatgcagactagtcatgatcctactcacaagagtccagattttctgttgtggcccttctcactttacttagcattaagattgatgctcacactggggacaactccccatgaacctatagaagaaaacacaaactgtttttctctatacacacactcaacacttccaacactgctgtgaccatatgtgtggatttgttccacaacaagcaattctccacttctccattgacactaactgggtgtcctacaattcgattcaattctcgcactgtctgcctggaattagcatcagatcctgcaggttaagggctcagtcccacaagattgcccctacttcagacgccaaccccaagtccaggcttcccttctcacttctgatcaattgggtataaatcaggattcccatgaacccctcgttgtgttcagtaatttgctggtacaagtcacagaatgcagaaaaacagcttacttcctaggttactggtttattaagcagatataatttaggaacagtagatggaagaaatgcatagggtgaggtatgtgggggcatggagcttctatgccctctccaggcctatcaccctcccagcacctccatgtcctcatcaacctatgagcactctgaacactgtccttttgggtttttatggaagtttccttatgtaggcatgatatattaaatcactggacattagtgattgactcaacttccatccctctctcccctacctagaggttagaaggcaggtaagggaatgggaggagggagaacctgaaagttccaaccttctaattacagggttggttcccctgacaatcagcccccattctggggctatccagcgcctctagtcaccagtcattcattagcctacaaaaagacaccacttcctacattccaagggtcttagcagctatgtgcctgtcaggaaacaatggcctagaccaaatatatatgtatgtttttattatgttaatggctcacctctttccttatcagcttcataaaaccaaaaattccctaaaatataaatattacaaactcataactgtatgattcacagggagtcctcctgttccccagagatctactttttggaaagatgccagcatgtaaaacttgcacttctgacctctgcttttttactctagagctggttgtctatttccatctctccttgggaattatcttctgccctggttttccagcatgccatgacactgctccatcacagtggggttatcagcttctccttagaaagcctgcatcttggacgtcagggacttggacaggaaatgggagtttctcattccttttctgtggctattacgaccttgccttttcttatttcatgctgttttttaaactgctacttttagaggctgccagagatactccctctgtagctctcagtatcaaatccacatatggtaagatgggcctttgcattttctacagattacactataaaactcttctgtatagcagcagtattgggttgatggtaacttctccaatgagttggccatgttcttctgggttgagtactcatcctacactttaactttctcctatactacctgtcctcattatcacttattattgcccacttttgactcttttcagaaacaggctacagagagtgatatgcaatagtggcaacaggcttgtggttcagaagtctcaatgatactgataattgcaaatatttattgtgctttctatgattatcttgtttaatcctcattcaacctgtgagataggtaccattatgatttcattttcagatgagaaaattgaggctcagaaagattttattcctagcataggtctcaaaagtattaagcatcaaagtcaagaatgcaaatccaggaagtctcactctggatcctgtaagcttaaccactctactttctttggacagacccttgctgggggctgatctctgtgaaaaggcttgcactgtcacagaaatataactagtcttattaagaaacggaatttaaaaaaaatatttttactaaatatgtatattattttattaatttattttttatctttattattttctttcttctagtaaatttagtgtgattgttgttctttttcttgttcttgactttcagattttcttattttctaataggtacttttaagacaataaattttcctctatgccgagctctaggtatatttcacacattttaatatgtcattcaactgccttctggcatgtaagagaagtcagttggtaatcttataaaagctccattgtatgttatgagtcatttttcttttgctgcttttaagattctcactttgtctttgactttcaatagtttcattatgaggtggcttcgtatgggtctctttgggtttatgctacttgaagttttttaacttcttgcatttgtatatccatttagttttcaaatgtggggtgttttcagccgttaattctttaaatacactctctgcccctttctctttttctcgtcttctgcatgtgtacattggttggcttgatggtgtctcataagttccttgggctgtgttcatttttttttctttgctcctctgatttgattgtttcacatggcccatctttaagtttgtgggttctttcttttgcctgaatttctaaattcagttattctattttttagctccagaatttctgtcgggttctttgtaaatacagccatgcatcacttaataatgtggatgcgttctgagaaatgcattgttaggcaatttttccattgttcaaacatcatagagtatatttacacaaacctagatggtatagcttactacatacctggagtatacggttagcctattgttcctaggccacaaacatatacaggttattctactgaatactgtaggcaattgtaacatgatagtaagtatttgtgtatttaagcctatataacagaaaggtaaggtaaaaatatacgattataatcttacgggaccaagcatcattatgtggtatatgactgtaatctctctctctttgctaatattccactttgtttataaaccattttctagatttagttttgtgtttttcactgtgttttctttgagttcattggccatatttaaggtagttgttttaatttatttatcaagtaagtcagaggcctgcatttctttagcggacaatctctggagatttatctggttcctttgaatcattcatgttactctgttttattttggtatgtcttgatacgttctcttgagatttggacacttgaaaaaaatttccacttcccccagcttttgtagcatggctttgtgcaggggaagaccttcattgcccaaaatgttttaaaggctcagggtcttttaaatcttttctgaagatgtgtattccctaagcctaagtgtgtgtttttattccacttccctgcatacatactatctgctttaaaatgtattattcagtctcctggttcatctcaaaagccttggatgtttattgtattcctatgtccataattgattactcctagccgcctgcaggtctgcagactccctgcagctctaacatgccacagtgactgactgctgctttcagtggcctccaacctggcatccaaactatgccacttttctcatctgtgctctacatcaggcaagacagaaaccagtcacttcggcagcccctaggcaagccaaatattgccagcaagttctattttttcccttgtatactgagggaggaacttgaaattgatacacatcttcctgacagtggcatattgtgccatgaaggggatgaagagtgaatgagaaaaatgtcacaaaatttcacaatgagtgtgacattttcttgcattattagggatttacctggttgttgcatcttcttaactgatttctagtgcaatggtgcaatctcacctcactgcaacctttgcttccaggctcaagtgattctcctgactttgcctcccaagtagctgggactacaggtgaatgccacagcacctggctaatttgtatttcttgcacaagtggggtttcgccatgttgcccaggctggtcccaaactcctcagctcaagtgatccacctgcctcagcttcccagagtgctgggattacaggcatgagctacaacacctggaatgtttcttcatatttatccatcttgaggacttaagatgtgtggacttatatatttattgtctttgaacaattccatattactatttctttaaatatttcttttacctcaatttctttttttttcttattaggactgtacttacgtgtgtgtgtgtctgtgtgtgtgttcgtgtgtgtgtcccaaatgtttcttcttttttctatattgttcctcctgttttctttagtctctatgcctcagtctgggtggtttttctctgatttattttctagttaagaaattctttctgcagaatgtgtttaattaagcttactcctttaattcttaatttcagttatatgttctagaattttcattttattttataggttttactaaatattttctgcctgataacttcaataattttattttctgggtgtcagtatctattgtatgcttttcctatttttttccccaattcctattgtttttttatacaactttttttcttttaagaggtagagtctcactctattgcccagggtggaatgcagtggtacaaccatagctcactgtagcctcgaattatgaggctcaagtgatccttttgtctcagtctcccaagtagctatgacaacaggcttataccaccatttgcagctaatttttttattttatttttttgttaagatagggtcttgctatattgcccaggctaatcttgaactcctgggcttaagagattctcctgccttggacacccaaagcactctacataaatctttttattaaatgcatttcagacattatatgtagagataatgcgacactctgcatgatttttttttcctccagaggtgctttagttttgtttctggcaggcagtgagagtggaggcatatcgctttaattcagtcaggaattaaactatttttgagcatgctatgaaactttgtgagagctcaattgtttcttgtcttcttttactactggggtgtagccttctgggggtatcaagctaaatttgtggtgtttactaaaggcaatttttcctcagctgtctgtgaatttcagtttctttcctagtcttgtgaggcttttgaaagttcttattttcgtagcctctcttccctcatttttgttttggaaacaacagttgcccacagtggaaaagtagcttcaaatgttggacttcatctctcctgtcttccctattctgtaatgttggcacacaaattcccagtgcctcagtagctctctgatgccttaaaaatcattaaaaatattgttctcacttttctggatgtttgtagtggaagggttggactacaacaatctagtttgctacatacagaaatttttttccaatttagaattcaaagctgtcatgtcactaacctctgagtgagaaaggctgtgcctgtgactcagtagttcagccttgagaagctttctcagcatgagtagtgttgtggtaaagagcttgaatgctgacgtcagactaattagtttctaatcttggctttgcaacagattagccatgtgatttggtggcaaattgcttcagtttccttatctataaataagtttcataatattaaaggaattaatacttaagacagtatgtgatgatcccatcacccaggtagtgaacatagtatccaatagttagtttttcaacccttgcccacccctctttccctaatctttagctcccaatttctattgttgccacttttatatttatatgtacaccatatttagttcccacttataaatgggaacatgtggtatttgattttctgttcctgaattaattttctgagaatactggcccccagctacatccatgttactgcaaaggacatgatttcattcttttttatggctgtgtagtgtttcatgggagtatatgtaccaccttttctttatccaatcaactcttgatggacatctagctggattccatgactttgctattgtgaatagtactgtgatgaacatatgtgtgcatgtgtctttatggtacaatgatatacattcctttgggtatatacacaataatgggactgctgggtcaaatggtaattctgttttcagttctttaagaaattgccacactgttttccacgatgttgatctaatttactttccctctaacagtgtgtaagtgttcccgtttctccacaacctcaccagcatctgttactttttgactttttaatgatagccattctgactgcagtgagatggtatctcagtggttttgatttgtatttctctaatgcagtggagtattttttcatatacttattggccatgtgcatgtcttcttctaaaaagtgtctgttcatgtcttttgcctactttttaatggggttgttttttgcttgttggttttttaaattccttatagattctggatattagacctttgttggatgcatagtttgcaaatattttctcctgttctgtagggtgtctgtttactctcttgatagtttcttttgctgtgcagaagctctttagtttacttgggtcctatttgtcgattttttgttgttgttgcaataactctgatatcttcatcttgaaatcttttcctgttcccatgtgcagaatgatattgcctaggttatcttccaggatattgatagttttaggtttaacatttaaatctttaatccatcttgagttgatttttttatatgagatgagaaagggatccagcttcaatcttctgcacatggctagccagttattccagcaccttttattgattaaggaatcctatccctattgctagtttttgtcaactttgtcaaagatcgatggttttaggtgtgtggccttacttctgggctctgggctgtctattctgttccgttggtatatgtgttttattttttatttttattattttaccagtaccatgttgttttggtttctgtagccatgtagtatagtttggaggtgggtaatgtaatccctacagcattgctcttttgcttacgattgccttggctattcgggcacttttttgattccatatgaattttaaaatagttttttcaaattctgtaaagaatgtcatcggtagtttgttaagaataacattgaatctgtgaattgctttgggaaatcttaataatattgattcttcttatccatgaacatgggatgtttttccatttgtttgtatcacctgtgatttctttgagcagtgttttttaattctcattgaggagatctttcgccttcctggttagctgtattcctaggtattttattctttttgtggctattgtgaatgtgattctgttcttgatttggctttcatcttggatattgttggtttgtacattgattttctattctgaaactttgctgaagttgcttatcagatctaggggctctggggcagactatggggttttctaggtataggattgtatcatcttgcaaacaaggataaaactatccctgtttggagacttcctctcttcctgtttggctgccttttatttctttctcttgcctgattgctctggataggactttcagtattatggtgaataggagtggtgagagtggtcatccttgtcctgttacagttctaaagggaaattcttctagctctttcccacttagtatgattttggctgtgtgtttttcatcgatgggctgttattactttgaggtatgttccttcattgcctagtttgttaagggtttttaaaatgaagggatgttgaattttatcaatagccttttctgcatctattgagatgatcatgtggtttttgtttttagttctgtttatgtgataaatcacatttactgatttgtatatgttggaccaaactttcaaccctgggataaagcctacttgattgtagtggattagctttctgatgtgttgctgatttggtttgatagtatgttgttgaggatttttgcatctatgttcatcaagcatactggcctgaaatttttgttgttgttgttttgtgtctctgccagggtttggtatcaggatgatgctaggctcatagaatgagttagggaggggtccctcctctgcaattttttggattagtttcagtagggatggtatcagttcttctttatacatttggtagaattcacctgttgcttatttatttattttttttgagacaggatctcactctgttgcccaggctggagtgaagtgatgcagtcgaggctcactgcaccctcgacctcccagggtcaagcaaccctcctgcctcaacctccctagtatctggaactacaggcatgtgccgccatgcccagcttatttttaaattttttgtagagacagggtcctgctatgctgctcaggctggtcttgaactcctggactcaagtaatccttctgcctcggcctcccaaagtgctgggattacaggtgtgaaatactatgcctgacctttttggtagtcttttaaattactgattcaatttcagaactcatattgatcagttcagggatccagtttcttcctgttttgatcttggcaatttgtatgtttccaggaattcattcatttctttcagtttatgtagtttgtctgcatagaggtgtttgtaatagtctttgaggcttttaaaaaaaaattctttggggtcagttgtaatgtcccctttttcatttctgattgtttattgagaccttgtccctttttttctttattagcctagctaacagtctatcaatcttatttattctttcaagaaaccaagctctgcatcattgatcttttgtatgtttttttgtgtgtgtgtcttcattttccttagtttagctctgaatttggttatttcttgttttctgctagcttgcttgcagaaaccatgtgcagaaggggttggtttgctcttgtttgtctagttcctgtaggtgtgatgttaggttatgaattttatatctttctaaatttttgatgcgggtgtttagtgctataaacttccctcttcacactgctttagctatgtcccagagattctttgttgtatctttgttctcattagttttctaagaattttatatttctgccttaattttattgtacctataagtcatgcagaagcagtttgtttaattaccatgtaattgtgtagttttgagcaattttcttggcattagttcctatttttattgtgctgtggtctgatagtgtgtttggtgtgacttttttttttttaatttgctgaggattgtttttatggccaataatgtggttgattttagagtatgtgccatgtgcacgtgagaagaatgtgttttctgttattttgtggtagaggattctgtagaagtctgttaggcccattttgtcaagtgtcaagttcaagtcccaaatatttttgttagttttctgtcttgatctaatattgtcagtggggtgttgaattctccttctattattgtgtggttgtgtaagtttcattgtaggtctctacgaactcattttatgagtctggatgctcctgtgttggatgcatatatatgtaggatagctaggtcttcttgttggattgaacctttaccattatgtaatgcccttctttgtcttttaaattattgttggtttaaagtttgttttgtctaaagcaaactatagcaagccctgctttttttctgctttccatttgcttggtagatttttcttcattccttttctttcagcttatgggtgtcatcgcatgtgagatgggtctcttgaagacacatatggcgtcttacttctttatccaacttccactttgtgtcttttaattggagcatgcatagttttagcctgtttacattcaaggttaatattaacatgtacagatatgattctgatatcatgttgttagttggttactatgcagacttgattgtgtggtttctttgtaatgttaatgatctatatacttaagtgttttttttttgtggcgcccagtaactgtctttcatttccatatttagcactcccttaagtatttcttttgaggcaggtcttgtggtattgaattcccttagcatttgcttgtcccaaaaggatcttatttctcctttgtgcgtgaaagctctgttgttatttccttagcttggtctgttctgctgtgaatacttgcaattgtattatgaaattcttatagtgtgtttttcagctctgtgagtgagatcagttctattctttcttgtaatgaccatttcatttttcagctcctgtatcattgccttatattccttagatttcttggattcagtttcaactttctcctatatctgaatgatctttgttcttatctgtatttctgaagtgtgtcatttcagccatttcagcctggttaagaacatttgctggggaactagagcagtcatgtggaggaaagaagacaatctgactttttgagttgtcagagtttttgttatggttctttctcatctgtgtcagctgatgtttctttaactgtgttgtaatttgaatacagtcagttgactccttttctggatatttttagaggaaagaggctttgtgcagggtctttatttgtagttgatgatagttctgttttaaattctttgagaaatctccaaactgttttaaactgtggctaaactaatttacgttcctccagcagtgtatacctttaccattttaccaatgtagttttatcacatttttgttaattcaatgcgcaggtttagagtgctatgtctatgttaatagtgttcatttcttaattttgtggggaatcaggatcacatattctttcttgcacactgttctatttttcttgagttaataattgtctcatgattttcgtttgacagttttctatgaattaatcaccaatttaacccatacttgtcaaacctgtacaatattaatatggtaaaaacgttagatggtctataaatgtataaatgtcttcttctatttttcctgttgacttaatgctctatggtcttcatgctccatttgtagttttgtggtcccctagagccaggggtcactctctggtgattcttttacttatatccctgaagagtccctactctgcttttctgtgttggaacttgtttcctggattctatgttttatctttcttggtttatactcttgttttagagaagcatatcttccagcaactttttcagggaacactttgtaggtaagtgatttttagagcttgtatgtcttaaaatgtcttttttttttactctcaaatttgattggtaatttagttgggcataaaaacataaatttgaaattagtttgcctcatgtaccatggtatattcaatccagcatgccaatatattgactctctctgtctgaaatttttaggctgagctgatagcttttagctgtgagcaaccctgtctatttactccagtatgtctgaaaagtatttttatttatttatctcctgtcttcaaaaagtttgggaagaactttatttagtttatagtgttcttgttgataaactccttagataaaatttctaatttttcaatgtagcttccccgccgcttttccttctcactgataaactttacgtttcttttttagtccaaatattctgagattgtatgaagacttaagttagtgtgatacttaaaaataaacattttggaaaatgtttttggattacttctttggtaatttcaaaccctgccttgtttttttctttctagaactcctgttagccatcagttgaaccccctgtatgaattcctaactttataatcttttaggatattttttcttctactttctgggatattttctccatttgatttaaaatacttctttaaagattttttaaatcatatttttaatttttgagaactttttcttattctaaatatgttcattaaaatagtttttttgttcttgttgcatcttcttttatcacattgagacagtcctttattttaaagtttatataagcattttcgattcctactggtttttatttttttcttttgtgtgatctgtcttttatgtgtaaactttccccagtttgtaatgattctaggctgttcattcatatttaaaaatgaggcactagaatggtgatggaaagtgccatgtcaaagggggtggcttgtaaagtgggagacatcactctaggataatcgggcagtaagccaatctcccataagatgattctcagttattggcatagttgcacatcttttcttttaggtggttcaatttctccaaagcttacacaatagaattcttgaaatacctgctaacaacacacagatggaaaggaatagacctgactgccagcattatggaaacaaacaaaaaatgaggtgatgaaaatatcattgttcaaaaataacaggttaaattaatccccactatttccagtaatgttgttacatccataccatcagctgtgtctattactggaagctctgtatcagtctggttttatttcttcagactagtcaatctctagctttctactgacataggagaggagtggatgcctggctggggtgatggagagagtgtgttagaattcattcttgctcaaaattttatctaaacccatctgcatatttttagttcaacctctcatgcttatagtcagatgcttatacctctaagtcatgagactttgggggattctgtgaaggaaattaactttaccctcttttgatttctttttcttgaagtttaagcttaaacttttccttctctgctatgccatataccccttgtctatttgctttcttccttctaactctttctcatctgccgttgtttccttttccattcattttatctatgtggttgtatatttttatattatctactctcatttcagtggtgttttggctctacttttcactggatattccacagcttgatagggaagtcctaagaaagtccaagctggtgggaattatacacacatttagaggtgtatgtcagcatagaggtctggtgtacagagcagataacaatttgagttgtttgaaccagaacttgtggaatgagtggaatttgacagctagcaactgaaagaagagtgttcaaatacttgcttgatatagtctcctcacagacatcagacacacaaatctttccatgttgaactttgaaatattatagctttgagtaaatgaatgtatcataaaaatttttcatcatgatacacagacatgggtaaggtgagatgaataataactgaagtaaattaatagactgtgtgttctcttttgcttgtgttgcatgtattgtgcacacctgatttgcttacatctttgctactcaaagtgtgatccctggaccacagtatcaacatcatctggatcttgttagatatgtagaattgtggccccatctcagacctactgaatcagagtatgcattttaagaagacgcctagatgacttgtaagcacaggaaagtttgagaagcactggctgttgttatgcattcatcattaggttatacattctttatttcctccttttcctattagaacaaaacaaaacaactacacatgataagtatgtggtataatagagacatcatttattctagtcaatacattatctgtggttacttaaattcatggagtgcagttttatgatgcagataaagcatgaactgtttggtgttttggcatgggttttggaagcagatggacttggtagcaaacattgcatttgacacagattcttaattacttttacccttggtaaaataaaaatttacatagttttctttactgagttcttatgaagattaaataaaatgatgtttctaaaatgcttagcacagtatcgtaggcacatgcaattaatattagtacccttttcttcctcaccgaaatgagtgtcaaaattttaaggcattacaactaatggccagggaatttgatatggaagattttatttacctattttgtttaaaaaattatttgatactgttgagctttttaaattttttaatttttatggatacatagtaggcatgtatatttatgagtaacatgagatattttcatacaggcatgcaatgtgtagtaatcacatccatgttgacatatacatatatccataaaactgtaatcacaattaagacagtgaaagtcttcatcactcccaaaagcttcttctctattgtcaattccggcttcctgccctgtcaccaggctaccattgctctgctttctgtcactgtatttgagttttcattttgtagagatttttataaatggacatatgcagtatgtacttttttgtctaacttattttacttagcataattaattagcattaattagtgtgagattcattcatgttgtagtgtgttcagtccttttatcactgagtactattccatcatatggatgtatcacagtttgtcaatccattcacacaattcacaatttggttgctgactctttctggctttacaagtaaagctgctgtgaacattcacggacaagtcttgtttggaaatatactttcttttccttaaaattgaaatgttttgattatgtgggagttgtatgcttagccttttacaaaattcacaaactgttttttaaagtcattgtacccttttacactcccattggcagtgcatgagagttaaaatacctccacttccttaccaacacttggtatgatcagtcttttaaattttagtcattccaatagatgtgtagttgtatgctattatggatttaattcgtttatatgagtaataattttgaacacctatcttttcatggacttctatgtcatctgtatttttgttcataaattgtatattcaaatctttcccactttttaaattgggttatttgtttattatttagtttataattttcctgtatatacaggatacaaactctttatcagacatacgctttgcaaatatttcctcctggcctctggactgtcttttcattcttcttaacaaagtaatccaggagaaacattttaattttgatgatattttgtttattttttttgtttgttttcttaatagatcctgcttttggtgttgtagctaagaaacctttgctaactcacagggttgcaaagatttttgcctatatattttttctatgagtttaatagatttatgtcctaaatttaggtctataattcattttgtgttaatttttgtatgtggtgtaggcatatactgaagtttattatgattacttttgcataaggggacctaattactccagcaaaattttttatgaaggctattctttttccattgacttacatttgtatttttgtcaaaaagtagttgtataaataagtgggtcttcttctgaactctgtattttatcccagtgttctatttgtccatctttataccaaaattaactatcttggttatcatagctttacagtaaaacttaaatttaggtagtgttagacctttaattttgttcttttttttaaaaaaaatgtttttaactattctaggtcatttgcctttccatatgaattttagaatctgcttgtcagtttctcaaaattatgctggaattttaaccaggattgaattgagtctatagatgaattaagggagaattaactttttaattattttcaatgttctagctcatggtatatctctccatttattttgtcttctttgtttttccttaacaaatcctgttgtgttcattctaaaagtctttcacgtcttttttcagatttatccctaagattttaatactttaaatgcttttgtaaattgattcttaaaaattttgatcttcaataatttgttgctcatacaaatatatataaatatacatttaatttttgtaaattcatcttgtatcatgcaaacatgctaaatttactttttagtatttttatagatttcatcagattgtctataaatcatgttatctgtgaataaagatggtttaattgtttttgtatgtcttttatttattttattcattcttattacactggctataacttctagtataatatggaatagaaatgatggaaggtaacatctttgtcttttccttgatcctggaagaggcgcatttaatctttggcaattgagtgtaatgttagctataggttttcatagatactttttattaggttagagaaattttcttttattcctactttggcaagagcttttaatcaggaatagatgtcagatttgtcaaatgtttttctgcatctattgagatgatttttctttttaatttttttgaatttagtttttgtaaaaattctagtcatatagtaaattgcattgcttattttaaatgttaaattaaccttgcataactgagataaactccacttgatcaaaatatattacctttttatctattattggatttaatttgttaaaattttgtttaacattttgcatcagtttttatgaggggcagtggtctttagtagtctttttaaaatttgtctttgtcttatatttataggtaatcataacctcatagaattattcagaagtattctcttattttcaattttctggaagagtttgtgttggatgggtattatttctcacttaaatgtttggtagatttcactaatgaagccatctaggcttttagggttttttattagaagatatttaattacaaattcaatttttaatatacattagggccactcaagttgttcaatttagtatcataaggattttttttaaactgtattctattattaacttcttaatttgtatagaatcagtggtaatagcacctttctcatagttgatattcataacttgtgccattttttcttgatcactctgcctagaggcttatcaatcttattattgatcttctcaaacaaccagcctttgatttcattcatttttctctaatgtttttatttttacttccttgatttccactcttctttctttattctacttagttttggtttaactgactcttctaattgctttgcatgggagatgaggtcatcaatttgataccattttgttttctaatgtaggtgtttaatggtatacattttcccctaaatgctgattttagaggcatcccacaaatactggcatgttgtactttcattttcattcagttcaaagtactttctatgtttccttttgattccttttttcatctatgagttatttagaagtgttatttttcaaatatttgggattttcaagaaatatttctgttattgatttccaatttaatttcattttaaccagtgaacattctttgtaggactttaatcctgttaagtttattgggacttgctttatggtctggaatatgatctaccttggtaaatgctccatatgcactggagaagaatatgtattatgttgttgttgggtggcatttttttataaacagcaattacatcaagttgtttgatagtattgtacaaatcttctgtatccttactgatattatgtcttgagcagcattgaaatctcttgactataattgtacatttttctatttcttcttagatttgtattcatttttgtttcatgtgttgtgaagctctgttgtaatgttcacaaacatttagaattgttatatgttcttgattgatacttttatcatcatgaaatgataattatgttatcatctgaaacctactttgtctgatagctttcttttgattagtgttagagtggtatgccttttccatccttttacttgtaacttatgtccttatatttcaagtgcatttcttacaagtagcatacaattggatcttgttttatccaatcttacaaattttgcctttttttgagcatgtaaattatatattaggttggtgcaaaagtaattgcttttaaataaatttatcatacctttaaaagcaaaaaccacagttacttttgcatcaacctaatagtataaagtaaataacataaaccattttatgtgattaatgttcccttctgctagttctatcattcaaactgctgtcatttttgattgattaatttttctcttctttatgggtcatatttttctgcttctttacatgcctgctaattttttattgaattccaaatattacacattttaaccttgttttgtgctaattatttttgcatgcctataaataatcttgaaacaaattgcttgaaataatttgattctttaggatctcgtttttaagatttgttaggcaggactggcaaagtgctcagtttgatgataaatacttcccactcctgaagcaagaccccttttttgtactttactcaatgactaatgaattatgaatatttcagtctggctgatggaaacaaagtgtattgctggtcctgagcaccagaaacggttatctttaatcctttaaaaaaattatttatttatttatttattttgagacagtctcgctctgtcacccaggcaggagtgcagtggcgtgatcttggctcactgcaatctccccctcccgggttcaaacaattctcctgcctcagcctcccaagtagctaggatcacaggcgcccaccaccacacccggctaatttttttgtatttttagtagagatggggtttcaccatgttggccaggctagtctcaaactcctgacctcaggtgatccatctgcctcggcctcccaaagtgctgggattacaggcgtgagccaccacacccggacacctttaactcttttgggtgttttcttccatggtctcaggtagtttcctcaaatgcctgtgttgattattactcatctgaatactcaagcgaagcacactgacaatttccttgccttgtgcagccttctctggcactctgtcctgtggtttctagctgtctttcagagtctaagctttttcccaactcagcacgtccactggactctggtgcagtctctccttcctgtgccatggcctggactcccttaaagcagcaagctgggataatcataggtctcgctctgttgtttactgcctttcatggatcagtatattacattgctcgatggccagtgactggtacctcatcttgtctggaagcacaagtcaaattagaagattcctactcatctttttttttttttttttttttttaacattttcaaccatattaggtgaactactctagcatttttcactttattagatttgtctgttataaccagtttataattaatgtagaaaatgtctttttatttagcttttcctgaggaatctccttgttttgaagaaaacatggattggaaaatgatcagtgataattattttcaatttttgaataacttactcaagtctccaacagcttccatatccaggtaagttatcagaatccaacttctaggtcttgatttaattatcatctgaagataatcaaaacctaattataggatatgcactctttaaaatttatgagcctgatttagatattgacacaatctttcatatgagctgttcaataaatattcctttaatagagtgtgtgactcaagtatcaagttgtttaatagaatgtatgactcaatggattttgaaaggaaatacagatcgtagtaagaagattttccttcaataataacatgatttataatagatgctccaaaaataaggtatttgttttgaaaaattgtcttagctagttacctagagtttaagcaggaaatcaattctatagattctgttagtttcaaagactcctgggagagagaagtggtctttggaactaaatttgtcggactattttctgctgtcctatttcagcacgtgtattgaaatgcagatttttatgtctggttatgaatagtgtgtccagtttaaaggtatactcggttatttgtggggtgtattggaacatgatgggagagatgttttgcataagagcagtaacgctcaaacttgagaatggattaaatctgtgaagactgctaaaaataaaaatgtctgcaccttgccccagtcatatgaaatcttgctctgtgtacaggacccaggtttctatatatttcacacattctataggtggttccagtgcacaccaaagttggagaaccattctgctatatctgtctagaatggggattagtcattcctatggaacttcttaagcccagctattagtaggaacagaagaaaggacaatgggatggatcctctagagaatcaattccttgcttaggtcagatttttaattcctctttcctgaaagcctcaaaaatttaatagccctagaaaaccagcacaaaactagtctatatgtgcacaaggacacatttaattttatatttgtggacccatagcagttggcacagtgtctttcatcatggatagtggtagataattagatgttgatttaatgaatgaaaaatcattgaacattaagtgcaatttatattaagaaagctgaacttgaaatgacaaaacctgggtcgtctcctagtcatgccacataataacagcttgaacctgtcaattaaaaaaataaaaagtttcttttttcatgaaagggaaataatgacgtgtacttcaaaaggctgttgtaggaatgaactaagatagtagttgtgaaagtgctttataaactaaattactaaagtaatataaaaacgtggcaataatactattagtagtactacttctacttcaatttattattctattgctactccataaccctctcagttcccaatacaaataagttttatattctcctctatcaaggcacaatgacttggatggtagttaggcatctattcttagggagggctggatttaggcaaggtttatgttgaattcctaatagaactttcccttttctgatgggattttttccctaggaattatttcaaagaagccattctgtcctaaaaataacaactaactaaattaagaccatatttttgtgtggggtgctcaggtctcagctatcagggaagtaaacagcattcttgcctttgataggtcttatgtctgtcctatgtcagacagtgtgttatacaacaagagcagagggttaaaaaacttaggaagtaatttaccctgtaaggcataaatagccaataaaggtcaaaaattccttacccacaattctgaactcttacaaagtctgaaaatagaggcttttcttatggttgacatcacaactcattcagcaaagatttatcatgaactgatgtgaagcagtttcaagtgtattatcctgcgtcgcgagatcattcacaggtctcactgcgaaagtgttaatacggtgatgatcagggctgtcccagccctcactgagatgcatgaatacatatctgatacctgtatcatgctacatttctaaaggatgaacatcctgaattctgaaacacatgtaaccccaagaatgtcaaaagtggacttgtaagttctgagttagtagaagttagttctgcaagtgtggatttctgttacaagaggggacttacagtgtctgagttgctcttctgagaactctgtattttaaaattaaacacctggcgataagctaccccatatataataatgagtttctgacagtaggatgtatatagtattgttgaaagagcactggaatttgccttccaggactgggagtgcccacaccttgctgaaaccctacaggcatggtttctaatgcactccactatctgtgctacctttacatgccaagacattttgaaatggaattaaatcctaagattcttctggcataaatagcaaacttatctttaataatcatacatattattgttaaatatgccaggggaaaataattgagaatgctttctttttggtggtaggaaacattttaagctaaatatatataacttcattgtgcatttctaaaacactttcaaatcctcacattagtttaatttctgttggaaatcatgttgtctattaaatgtttcatttgtgttttactatcaataaatgagtattaacttggaaatttgataaatcaaatttatttttttattttatactaaaataattctattaatattacagggctttaaatttcacaaagcaccttctaatgatggaaaagaagttgcacacccttgaggatgaacaaatgaactttcttttatcatttgtggaattttttgagaaattattgttgcctaatctttttgactcctccattgttcccagtttccacagcctcccatctctcacagaggatattctgaatataagttctctgtggacaaatcatttaaaaagtttaaagagagacccatctgccactgatgctcagaaactcttggaatttggcaacgaagtgatttggaaaatgcagactctcggaagtcactggataaggaaggaaccaaaaaatcttttgagattcatagaattaatactttttgaaattaatcccaaattactagaattatgggcctatggcatttcaaaaggaaaaagagctaaattggaaaacttctttacacttttaaatttttctgttccagaaaatgagattctgagtacaagttttaacttttcccagttgttccattcagattggcctaaatcaccagctatgaacatagattttgtacgtttaagtgaggctataataactagtctccatgaatttggatttttggagcaggaacagatctcagaagctctgaacacagtctacgctatcaggaatgcatctgatcttttctcagccctttctgaaccacaaaaacaagaagttgataaaattttgactcacatacacctaaatgtcttccaggacaaggattcagctttacttctgcaaatttattcttcattttaccgatatatttatgaattattgaatattcagagtagaggctcttcgttgactttccttacacaaatctcaaaacacattttggatatcataaaacaatttaatttccaaaacatcagtaaagcatttgcatttttatttaagacagcagaggttcttgggggaatttctaatgtatcttactgtcagcaattgctttcaatttttaactttttggagcttcaggcccaatccttcatgtctacagagggccaagaactggaagtgatccacactactttgacaggcctcaaacagctgctcataattgatgaagattttcgtatttctttatttcaatatatgagccaattcttcaacagttcagtagaagacctattggataataaatgcttgatttcggacaataaacacatttcttccgtaaattattcaacaagtgaggagtcttcatttgtttttccattggcacaaattttttcaaacctctcagcaaatgtcagtgtgttcaacaagtttatgtccattcactgtaccgtttcatggcttcaaatgtggactgaaatctgggaaaccatatctcaattatttaagtttgacatgaatgttttcacatctcttcatcatggtttcactcagcttttggatgaattggaagatgatgtgaaagtctctaaaagctgccagggtatacttcccacccataatgttgctagactcatattaaatttgtttaaaaatgtaactcaagccaatgacttccataattgggaggacttcctggatctcagggattttttggtagctttaggtaatgcattagtttcagtaaaaaaacttaacttggagcaagtggagaaatcccttttcaccatggaagctgccctgcatcagttgaagacatttccattcaacgaaagtacaagcagagagtttttaaattctctgcttgaagttttcattgagtttagcagtacctcagaatatatagtcagaaatctagattcaataaatgactttctttcaaataatctcacaaattatggagaaaaatttgaaaatatcatcactgagctaagagaagcaatagtatttcttagaaatgtatcacatgatcgagatttgttttcctgtgctgatattttccaaaatgttactgagtgtattttagaagatggctttttatatgtaaatacctcacagaggatgttacgtattctagacacgttaaattccacattttcctctgagaacacaattagcagtctgaaaggatgcattgtatggttagatgtcataaaccatttgtatttgttgtctaactccagtttttcacaaggtcatcttcaaaatattttggggaatttcagagatatagaaaacaaaatgaactctatattaaaaattgtaacttgggtgttaaatataaaaaaacctctttgttcatcaaatggctcacatataaattgtgtcaatatttacttgaaagatgtaactgactttctaaatattgtacttactacagtctttgaaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttactttaacatcctggaaaataattcctcttctaaaactgaaaacttgttaaacatatttgccaccagtccaaaagaaaaggatgtaaacagtgtaggcaattccatttatcacttagctagttaccttgccttcagcttatctcatgacctccaaaattcaccaaaaataataatttcacctgaaataatgaaagctacaggtcttggtattcaactgataagggatgtgttcaactccttaatgcctgtagttcatcacactagtccacaaaatgcaggttatatgcaagctttgaagaaggtaacttctgtcatgcgtacccttaagaaggcagacatagaccttttagtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaaactgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagcaggcaattttgatgttgcctttcttacccatctgctaaatcaagaacagctgactaatttctcagttgttcagctgctttttgaaaacatcctaattaatttgatcaataacttagctgggaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgaggtgagtatacttttgctttgtgtcatatatgcagttgcgatatatctcaaactactttattttctggagtatagacatgtcaaaaacagtatttgtatctaatacctttgaaagatctttgatgtaaatttgtcttaataaatattttatcaaaatgtcaaggtaaaagaattttgattactgtcatctagtaaaatataaacccagcccagggtaattaatcacgtattattcttacatttttagattatgaaaacaattatgaattctattttatatggatctgaaaaattagttttcatagctgtacatgcatatacaggattgacataatttgaattgctatactaactgtctaatcaccaactaggggcttaagtattctcaacccaatgaatctactgtggtatttgcatttagagacataaaaattgataatcacattatcttcttttcatatatctttaaaaatctcgtttgaagtttgccagtgaaaaggctggagggaaattccaatttattccatgatgtctgctttagtcaagtttcaagcagagtaacaaaaatcatcaaaggatttaatccaaggaaatcagcttacacaattttgggggctggctgagtaagtctgcaatcagtagggctgactgtcaggaagggaggcccacagtaggcaggggcgcccacagcaggcaggggcgctgcgggcatgagtgaaagctccttgtccacagtggtcaggaaggaagaccaggggaagggagagccactgactatgaatacccagcagtggttttgtgcctctaagttacagaggttctatgccctctttcagagttttcctggcccactcaggacagtatcccttctgactaatttaaagttaactgatcagggattttaactccatctgcaaaatctctttatagcaacacctaggttagtgttcgattgaatagctgggagaagatgtacttatattacaaaatggctataactcccatctatcctagaactctcatgagagaatctcccctgtagcccacccagatgagaaacatacaagaaaggggcttcttcagctattgtttagcctagtcatgttgatacatctgtctgagcaatttgctagtacttctaaagctcagaaaaatataaatatgctaaccacttttcagacacttatctcttacatcaagaatcacattgtagtcattttactttctttcctaagtaaaagcccttttaacctttttcataagcaaaagtttgtggctttttaagttgctaggtttaaagaactgtaacagaatttgttcatgaaattcctcactcttttcattatttggcaacaaaatattgagtttcatctgaaattattttagcatgtcatcttttgctcagtattatcttcccatgatgctattataaaacaaataaaataatataaatcactatgtatcttaatatttccactgttaatgtattaaaaattaaattaaaagtatatatatatatatatttacagttttgtcccaaaagataaaattctagaaattctgaaactggatcaatttcttaccctgatgatacaagacagattgatgaacattttttcaagtttaaaggagactatatatcacctaatgaaaagttcatttatattagacaatggagaattttattttgatactcatcaaggactgaagttcatgcaagatttatttaatgcccttctcagggaaacttcaatgaaaaataagactgaaaataatatagactttttcacagtggtgagtcagttgtttttccatgtgaataagtctgaggacctcttcaaactcaatcaagatcttgggtcagctcttcaccttgtaagagaatgttcaacagagatggcaagacttctggatacaattttacactctcctaataaggacttctatgctttgtatcctaccctccaagaagttatacttgctaatctaacggatttgcttttctttataaataattcattccctctaagaaacagagcaacattagaaattactaagagattagttggtgctatttcaagagcaagtgaagaaagtcacgtcctgaaacccctcttagaaatgtctgggactctggtcatgctgttgaatgacagtgctgacctgagagatcttgccacatcaatggactccattgtgaaacttcttaagctggtcaagaaagtttcggggaagatgtccacagtttttaaaactcattttatctccaataccaaggacagtgtgaaattctttgacactctgtattccatcatgcaacaaagtgttcaaaatcttgtgaaagaaatagctactttaaaaaaaatagatcatttcacatttgaaaagataaatgatttgttggtgccatttcttgacttggcctttgaaatgattggggtagaaccttatatatcatcaaactctgatattttcagtatgtcacctagcatactctcatatatgaaccaatctaaggacttttctgatattttggaagaaattgctgaatttttaacatctgtgaaaatgaacttggaagatatgaggagtcttgcggtagcatttaacaatgagactcaaacattttctatggattctgtcaacttacgggaagaaattctgggttgcttagttcctataaataacatcaccaaccaaatggacttcttataccctaatccaatttccactcatagtggccctcaagatataaaatgggaaataattcatgaagtgatcccttttttggataaaatattatcacaaaacagcacagaaataggatctttcttgaaaatggtgatctgtctcaccttagaagctctttggaaaaacttaaagaaagataattggaatgtttctaatgtgttgatgacatttactcagcatccaaataaccttttgaaaaccatagaaacagttttagaggcctccagtggaattaaaagtgactatgaaggtgatttgaataaaagtttatattttgacacacctttgagtcagaatataactcatcatcaacttgaaaaagcaatccataatgttttaagtagaatagctctctggaggaaaggacttctgtttaacaactctgaatggataacttccacaagaactttgtttcagccactttttgagattttcattaaagcaaccaccggaaagaatgtcacatcagaaaaagaagagagaaccaagaaagagatgattgactttccttatagtttcaaaccatttttctgtttggagaaatacctgggaggattatttgtattgactaaatactggcaacaaatcccactaacagatcaaaggtaattaaaaagctgaattcactttgtttttttctctaccgcagtagctataaaatagaaccatgcaggaattacagtgaatcggggtaagtagttcttcttgacttcaactttgtttacactctgaagttggcttcaacatagagcaattcaggtccagtcattctttttcataattcgactcattatttggcattcaaatataattgcagtttattcaaaatatttcaaaagtaagttattttattctcagaagcaaaaacctcttattctattcactcatcccaagactagttgcataaacaatttttctgttcatatcctctggcagccaagggtcctatgactcagtatacacacaagaacatgaagctgcttgcttcacagaaaattatgctttcagttgtagctaaccacaggaaagggccaggcagctgctggcttctgcccttttttgattctgccagacttcacgtggttgatccacctccaagccctcctatcgctgaaagttatgtccatagaaacctgttcttaaaagctccagtcttgctagttgtcatgccttggaagcagtctgttgccttaggttggagaccctgtgcctcttgatgtgcagaggcccagagatgctgcagctgtccctacctgtcctttctgtgggtgaaaatactgttagggtggtccctggtctctgtttctccctgctttcctctctggcccacatggagattggagatgccatgtcaaccctggttcatttgccaggcaggctgacttattttctgttggttctattactccagagatgtaccttgaatccagtcatgttctatgagttggaaagatgtctttagttggtgaaacaggtagccactggcacaaataactattgctacctaggaatttgactgctagttttcagagcttccttcttcatctcctccttgcttctgatgtcaaactatattttgtttgactttagtgctcttctctgaattgtcttttgagctgaggtggtcctggcaaccccattctccaccaatctcaggttttatctcaaatttttcagttctccacagagggagtttataccttagctcttcataccatcatgttttgacaccttttcaacatttacctttgcatttcaaaagaatagaacaaaagaagaaagaaaagcaagtattaagcttattggccacaaaattgatgctttgaaataattctggagacctaaagttttctaaaggtccagaatgtgttatctgtgttttcttatgttcctatgaagaaaatatgattatgcagggagggaggatggttcttacatgtgtgttataacttaacctacacagtagagatgcacatgggttgcacatttttacccttttatgtcattgtatatatttttttgctaagtgttgttgagatttgtgaagttttccagcagactgtgaagccctcagaagccatggagatgctgcagaaagtgaagatgatggtcgtacgtgtgctcaccatcgttgcaggtgggctgctcatataacaagtgctctgcaattgccctgtgccagttttcagaactcaggtgtcagagagatgagtatattgcacttgagtttcttttagaacaaagcacagctgtcttagtctggcaaccaggccttgagggatctgcccctcccaacctcattcccaccactgggcctctactccagccaaattgaacggcccgttcctgcgcctttgctgggttttctggtctctgtctttgctcatggaatgtgcttcccttgtcttcttgacctaaactacagccgtactctgtggcctagagctgggggtgtcttgtccagaagtgttcccccatctcctttactggcaaagaccttgaggagactttgatcacgtgcagtatcgtactttcttctttcttacatttcctccctctgctacagtcaatattttttgaagatagaaactgtgtcataaccttctgtgtgcatttcctgatgggtgctgagtagtccctgcagtaacctgaattccctacagccgtggcacttattgctggtattatagtttttggtgtcttcttttcctgctgcagtctgtaagcttactgggaacaggatcagtctcttgctaaattctgtgtctccataatactcagcatagtgtccagcaatagtgactatattgtaaatgaattaattcatctgctaagatgatacttgccaaatccattcctgcacatttcagtgcaatctcctttcaatgccactgctgaaggagagtcccacgagctgctttagagggtaactagatgatcttagggcttttctgaaaatgtgaacattagactttagagcacacttgagtccatggaatggaccacagttgtttaagtaattcacaggtgcacagaggtgctgccatcctctggcccagtctcctgagcagggctgcccagagccccctcagtgggctactgggcctgagtaccctgtcttagctgatggcagtgggttttgacaacatgaatcgaagcccagaagaggaggggaggcgaggagaaatggggaagccaagggtggatccgatcagatcaagagggaaagaaaaaagtgaggggtcatctgagtagggcttactccatatcctggccccggactccctgccccctagctcatctgatccacatgttcattcttctgcctttccttgatttactcctggatcattattattatttcgattactatcaggttgttatattatgatttgtagattacgtgttatttcctctggaaagcttttcttcacctaccctgtctggggtcacatggccttagctccttgttatggctcttaccaccgtgtgctattctgatgatgaacatgtgtctcttctacagttgtgagaacccagagactgtgcctgtctattgatcactacaaacctggcacatggggattagaacatgggaaatgttgattgacatttgttgaatgaatgaataagtgccagaagctcttctatacttacgtcatgtttcactggaattaccaaatgtgaaatctgttcatgggggagtgctcagcagcgagaagtagtgggtgggctgttggcatgttctgggcctattttgtacgactgagcaaactgtgggggcctggggaggatgttgtagagaggagtctggtttacccaggaaggggcacagtggacgtattcccaacatccactatcagaagaggaagggttaccggccccaggatggctaattggtgggtgtgggccactgagtctgtgagccaggagtatggaccagcatctactggggagcggtatggaggagaaatgagccttgggcagaaccagcatgtcaaatccatttttcaaaacaaaaaagataaatttttctttgtattgataagtgctagaaagaagctaaagtatggccatgagggtgagagtgaggggtggaggagaggagaagaccttgagggtgcagttcagggtgaggacatttcaggtgagacttgcgtagtgaggatgtgtgtctgccatgctcatggttatatcttcccagggtttaggaaacatactgacataggcatgataggcattcaatcaatatgtgtagaaggattggataggtcaatgcatgagggctggcactaggttgggcacttgtgactgcttgagttaatctacacaatcactgatgggcttcagactagtgtgctgggactcgtggtctgtaaggctgcctccttactgtcacgatggggcactcaggattatacaccttcatgactggtaaggctttattgccccaaatatctttgagggcagagtcaaacatgactgttaaaacaagtgatgtcgtgagaagtgctgtaatggaagaagcaggcgctttgagattgaacaggctgagttccttgattcatgctgagtgacacagggtagcttctgaatctctgtgagccttgaagaaaacataggggaacacctatttcaacctatgtgagaggattaaataaaatgagtcacctccaaggggcttatcctaaggagatgccttgaacatgctagttgccctgtcctgcaagttgaagatgcatctccctgcatgccattgggaaaactacttctcagcttagagggctagttcataagtaaaaactggtaatttagggactgtctatcacagggttagttctaatctgctcactcatccctttttttgtaatacaaatggttgtttgaacagaagaattgattggtcattgggtctaagaaacatggaaaaggagtaagaaacagagggagaagtgggacaagcttgatttaaaaatgaaaccccaactgctgtgtaggggttttgcatgtttttttttcttttaagataatctgtatttccaattagatgttatgaacattggtgattaggaatattgctttctgttgtcaaatagaaatcagtaaagtgttacaatctaagtacaagttaggatggttggtacatgatttcagcatttggaagtgtgctcaggtaaaattcaaatcaaacttcttcctcgttcttgaatgcttatcttccatattgaattcagccacgtttgaagacacaattatctggacatttcacagtcagctaatataatggtttttaaatgaattaaacattcattaatgtatgaatttatatttattttgccattctgtattgcagctgctaaattaatatagcatacttgagattacattagtaacagataattaatttttaatttttatattttatttcaaggaaactcaagcataactaacatttaaactgccaccccactgtccttattgaattgttactccatcctgtagaataggagggcagtgacagatcccataaagttaaagggatggggtggaattgaccaatgtgggcaaatagcccctcctctcccatcatataaagggaacaagaataagatctgttattattattgttgctgaaaatgcactatattttcgtcatatcacagagttgagttcagtatctccaggaggaaagtgacaactttccttctcctgatctagtgctttaaagatgccaaggacaatgcaggagagctcatgcaacggaaggagcctcagtgggcagctactttaatcttccagtttccctaattgacgaattgaggcccagagagtgagagtgagtttcccagggtttcagagtgaagcagtcagagcccatttccagttgaagagacctgagagggtccatggggctgaagggaggagaggaaaggggtccagagagcgctggcagatctggaaagccagagtgggtctgaatgtgtccttggagccaagaagaggggccacagcaagtaggaagggctggagccagggattgggagaggcaatgagaggtggagaaagagggtacccgggaaagttggaggagtcaaggctcaaaaccagctcttgttagtgtcgagacagttgtcaagtgtccttgagggtggtgcctttgagggcaggcttcaagacgtgttagatgtgaggcacatggaggccagatggcctgacagcccagcactgcatcccatgatcatatcatccctgacctaaccttgcaggaatgctgggcttggtcactgtcgactccacgttgtcattttacattgaggaagcaaggggctgacacagcccacagcttgcctgatgccatacattacatcagctttttcagggtgcattctctgctcttttaggtttgaacaacataacttataaacacattattgtgtcttcccgagaccagaggatatgtttatgcttaaagataagtgctgtgatatataacagcacattattaccttcatttcaaattttaataagagattacttaagtgacacattttatatttcctacaataaagatacctgtctttgaaattagtaaaataagattaatgagaaaagaaaaacaaataaggcatcaaggtgggttgcttctggaaagcatgactttggatatattgtgtctactctgcattttatgtggttgaaaactgttttagtaattaataaattttatattttagagtagttttagattcgcagcaaccttgaatggaaggtgcagggatttcccatatactcccttccccaccatagcctccctcattatcagagtggcacatttgttacaattgatgaacccacactgacacagcatcattccgagtccacagttcacattgggcttcactcttggtgttgtcattctatgggttaggacaagcatataatgacatacatccagtgttacagtatcacacacagggttttactgcctgaaaaatcctctgtgctctgcccattcatctctcccacccctctagcccctagcaaccacggatctttttactgtctccatagtttttgtcttttccagcacgtcattgagttgaaatcatacaatatgtagccttttcagatgggcttctttcacttagtaatatgctggaactgttttttcccttccttccttccttccttccttccttccttttttcagacagagtctcgctctgtcgcccaggctggagtgcagtggtgcgacctcagctcattgcaacctctacctcctgggttcaagcaattctcatgcctcagcctcctgagtagctgggattacaggtgcccgccaccatgcccggttaatttttgtatttttagtagagacggggttttaccacattggccaggatggtctcgatctcctgacctcgtgatctgcccaacacggcctcccaaagtgctgggattacaggcgtgagccaccgtgcctggctcagaactttttataaaggacttttgagaaacaatttattattcataatttaagagtcaggataacatttttttttctaattaaaaaaagattttatttcttataaaaatgtattttattttctgtcatgaccaagcatctaggaggtacaaagccctgtgctaggtgccacaatgacaggaaggcagtgataagaaaatttgcccgtggcaggtcttgtgcagatggatttatcgtgcggtgggaggtgagcacacaggcatctgcgcagcagggaggggaggggctttgctcagcctgggaaaggtgggtgtctggaggcagaactctaaaagatacgtaggttcaggaagggagagtgatgccttgtatctgatggccttgaggagacaggagggacatagggcatgactgcagagaggtggaggcacctgaggctgcggaaagacattggatgcaacatggagcctttgcacagattcctgtaatgggggatctcctttggggaagagccttgtggatcagagcgtaaggcagattggaagggtgaggtgggagtgggactgttaagagcacagcagtttcctgggcgtgatctatgggtgctggacagacgcacagatggagagacattgggaggtcatgctgagcagatggggaggttggttggctgtgaggaccagggggaggagagtcatgactggcttccaggaagtgacttgtgaggcatggggcatggagaagaccacacatagacagtgtgtaattcatccttcaaactggggcacttttgagaatgacagagggcactgttcataaccatgcaagaataggtgaaaagcaagtctgtcctgggcaaactggggtgaatgggtaccccacttgtaggggatacagggaaaggagccagtttgaggaggtagagataattaatatttacaaaatcaattaggcccagaaaagcaaaatctttattttattacatttggaactcaaaaggcacagctttaccctcatcatctgaatgttcatcttgatgatttaagaaatgtttaggaatttgtatcactttgaatctttaaaaagtgattttgtgagagtggctagttcaggagaggactgtctattaattatttctctgtgtgtttcctctggcagaaaacccttcctggaccaaggacattttgtgtgctactctgagttgcaagcaaaatgggataaggcatctcattttatctgctatacaaggggtcactttggcgcaggaccacttccaggtttgtcgtctttaatatttcagagaatttcatgttcatgactattggcccttgcaaggcagtccagttattcaaacttgctgcttcgttcttataactacagcaatggtgtcatacacagtcttgttgcaagctgggcttgcagaatgactgctcacccttcctccctcttggcctctcccagtggtgtgctgggttgagtggcactgagttgagagatcggattgttaaattttcaggaattttgcaagctggttgttaaacatagatgtcatcattataaataaattatataaacttatgatgaaataaatcatgttagaaacacaagtaataattactcaagattcatcacttcctaattattttagtatgttttactgttatctctcttcctgagatgatttgcttttgttgtatccacatgatggaaatactatgtagtcttgtgctaagtgcagttcttcccttctctacgtttaatgacgttatggtggcagcatgaactgggccatgcaggagcttttgcaccatggaaattggcaagtgctccaaatcagaattttttttttctggagagttagtttttaaatatttaccagcccaacactggctctaactcattgaatacactggctagtaccaaaaattgatggctgaatgggaaccagcatagcaatttcctttttattaaattggacacatgcccaataggctcccatgcagggtctccaactatagctgaatcagacaatgtgtctcttatttgggccccactcctttgtcctagaattaaagacccctgggcccctaggtaggcctgatccccctgacaagcttggacaatggtgatgtccttccaacaatgcagtgaagacctgtctctcttctagttctggttctgaatgttgtttcttgcttttgtgatccatattatctgtgagtatgagattatcacagaaagcagagaaatagatgatgccgagagagatgagagatagccatgccagactcccacagcatggcaagggtgtcgaatgccatgccttggtgaagtgtcaggagggagtgagagctgctgatctctaatcaatgtcttgtggcctttggaggagtggtgcctgtcagcaggaagccctgagcagtccctagcaatgattgactttacaaccccaaatttacattgatttttttagaacatcaaattcttatttccaggttgtgcagatctttgtcaggtattaaatgtggatacaggaaaaaaaaaagccccacagacaatttttttttttttttttgaaacggagtcttgcactgttgcctgggctggagtgcaatggtgcaatctcggctcactgcaacctctgcctcccgggttcaagtgattcttctgcctcagcctcttgagtagctgggattacaggtgccagccagcacgcctggctaattttttgtatttcttggtagaggtggggtttcactatgttggccaggctggtcttgaactcctgatctcgtgatctgcccacctcgacctcccaaagtgctgggattacaggcatgagccacctcgcccggcccctcacagacaattttttagtgatgagtgaaggttataataataaaatagtcaagagactccagctttcagagcaactgactcaaagactgtatttatagttcaaattgttatatgattgtcaacaagtctggctggtaacagttgggttagttttgataaagagcagaagttcctgtctttaatgacaaaaatagtatgttgcttatctcaggatgcaaagcttttaagatgggtctgtggttcaagggcttcaagtatgtgagacttttagaaatacaaatctttttcaggctgtgggatatgaagtcgccaacagagatgggcaaaaagcacaatgccatttgctagttttcagtatctaaataaatattttaaatatagttttctcagtagcaacatggaattcccatttagagagaaagtttcagctgattgaatcgatatgacaaaagtttggggctgtcaactccttaccctcttccaccctttgttccaaatagtagaaagtagcaataaggaaatgaatggggcagaaattaaacttcaaaaatgacagcaagtgcccactgtatttcctgggctaagctgagttggagaatgcagctggaacttcaggttgggtgggggcttcctactgcctctctagatctagacctttgggtccacctgtatacacttatccagcatttcttgattctaggcctgatgtagccggagaaggagagtctgataggtgctgccttttccacgtggtggttttacctgatcccaaaagtatagcctgatgaatttcaatctcaactttggcctagatgcctctgcttacctggagcctggtacacctgtgctgaagaaacttggaatttttcttccggtagtccttgctactggggtagaatgtgcacttttctactttataatcccctctatgtcaaaattattattttattaaatttaagaataacatccatagcaggaatattataaatgcattgaatgaaaattaatttgcatgcagttacaaattacaaactagaggttctttgctataagggaatactccatggcagagccctcatgcagtaggtttaattcaatctatgttctcaggagtgagttggcccctaaggggatactcacctgtatctattgttctgacctagttgtatttctgcattgatatgctacaaaaagggatctctttggagcaaggagaataccgagcctgaaatgcctgggtgagagaattggagaaggtttagagagcttcacactcagggaaaaaaaaaaaaaaaaaaaaaaaaaaaagagaaaagaagaaaaaagcagagtgtgaaagtccaagggcttctgtgcatgttattagaaatgtgcatgtagcttggagtcttgaggctggacctagacatctctctgccttgcagatgctcttcctgagtttgctaccatcctttttctttctgctttgctgtggtgacattcagacatcagacaataaatggggtctgtgcacattaggggcagtgggtgggtgaaggctggaggaggctgtgtctcttctggtagagcagtcagcggaaacctaagtgaagaaaggaaagaagtctgtacccttgagccctgtcacacgttagaaaatggagacgggcttgagctgagcactccttgtcagaccccttcaggtgttactcacacaatgcaggggttcagttgcttggtgggtatcaacccaatgaccacaaccaaggaggatttaacaatgagatttaagtaaggagaacaccagggatggttcccaaagtagtgcctctgagctggggacgggttaggttttataaacgtcatgtaatgtggatctgattgactgggtcctgccatgggtgatgccagagctcaatccagttggatcctggatcctgccatgcaatgtccgcttcttaattcaatccctgctcctcagtccgagcactccagctccccctgtggttgcacactagttcatccaggcatgcccgggttatgtgacctgagggtccatggcaactgaaaaactactcacaactttgttacgtaaaagtcgaaccagattggcctggtgcggctaacatagacagcagacaccactccacctgctcagtccgtcaaccttcacatgcggaatctcactcctcacctccggcttctgagcccggcattgacacagactcagccacgcccatccccacgtcactcagctcccggcactttccctgggctcctcttgcatccttgaccgactgtctccaattccacacctggctcctctatgtggcagaaggacccaggctgtctccagaccctttctgttctcagtctgtgctcacatgctagggaatcttatgcagattcatttgcaacctaaaaatcccaattacttcctgacaacttccaaatttccttctccagccaacacctcccctgaccttcatgctcatgtgttcagctgcattcccactcagatgtcaagcaggcccctcaactttactcatctgaaaaaaaacctcttcatctttccatgtaatttttcccacccctggtgttctttccctcagatgccagggacaacaaccttggcatgcttgtttagtctttgttcttcttatttttttcagttagaaaactctcccttctaccttccaaatgtttccctgatctggccatgttctaccacctccaccagcacctttcagatatgagccagctctcccttccttctccccttgcctcgatccctaatgcggtagccagagtgacccttccaaaacatcatcagatggtgttactcctttgctgagagtgtccagcgtcttccagtcttatttggaataggtgtccgatttctaagggaggccactgctaggtcctgctgtctgggtggcatatctctccttctgccctccccggcactctcttctccacctcgctggctcctttgcacccacctcagggcctttgcacttgctgctcccgcacctgcagtgtgcttccctaatgatgataaggagggttgtacaccttcctcttgcacctccagcactgcccccacccctgccttattttcctccaggtcacctgtgacatgctgaccagtttgcccctacagctgtctgctggtagtgttcctgcactgggttgtgaacctcatggaggtaggagttttgtctcctgtgttcatagctctcagtccggcacctagcctgggcctggcacttggcaggtgctccataagtattttttgaatgaatgaatgaacagtcctataggatttctgttcaagttccactcccaaatcacttgggaagaaaagaaacttataaaatgaatgacaataatagatgaattagagtcaagaagttgcatgctttgtaataatctattggctggtttagttccccccacagtgagattttgtggtttggttgaggcggtggtgacagtggcatgagtgctctgatcatggattaacgttcatcatttcctgagaagtcttcagccccccccccgccacacacacactaaatctacctcagctctgctggggggctccatcttggggcggcctccagagcttagctcccaaccttgacttttcagcagtcttcacatttccttggaacatatatttgtgagcttcctctggccacttgaatgattcatgattttcctttgcaagagaaattgacagtggttttgaaaaaaatattcaaagttttacttcgacagaaatattatctaagtgttgacctacatatgataccttcccataattggtgcaacctggaactatgcttccaatatcagtaagaatatgttgatataaataaaatgtgatgaagcaaataaattctgatgatgtaaaataaagtatttatggtagaatagctgtgactagggaaagtgtatagattcatgtgtatgtttatagacatagatgttatatgtttgtggtgttttctgggttattttaaatattatgttacctatatttgtcatttaattccacatatggtgttttgcattttgtcaattaataggtattattctaaaaggtttttttttggcaaaatgattggttgtttaaaaaactgattgtttctaggaagatacggataagatgtccatgaaatcttagaggtgggggttagagatgtggagagtggggacctacttctggagtctttccagatgttccccagagtcttaggagcctctccacctgcagtggacagaacaggagcctctcaggctgtactgctgaccttcagagcacggcaaatcccggttttatccacctcacataggaatagccacatatgatttctttctaatcattgtgtttgtggctgtgaattttgaaaagcctcaagtttctttaatttttttttcattttcatatttattttttaataatatatatttgaagtgtacaacatgatgttttgataaacatacaaagtgaaatgattactacaaacaaatgagcatatctgtcatctcagagttatctttgtgtgtcgtgcgtgtgtgttaacagtacctaaaatctactttcttagcagatttccagtatgtaatacaatattggcaactataattctcatgctgtatattaattctctagatgtgttcattctacataactgcaactttataccccttgaccaacatcttcattcctcccaagttcatccctggtaaccaccaccctatgctttgtttctatgggttttttttttttttttgttttgttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccgtttctatgggtttgacttttaaaaagtttgactctacatgtaaatgagatcctgtaatagttttctttttgtggctgacttacatcacttagcatatcttctgggttcatccatgttgctgccagtggcataatttccttctttttacagctgaataatattttattgtatataatgtcacattttctctattcattcatctctttagaaacattttggctgattctatatcttggcttttgtgaataatgtaaatatctctttgggacataatttcatttcctttggctttatacccagaagtgggatttctggatcatatggtagttccatttttaatattttgaggaatcttcatactgttttccataatggctgtaccaatttgcatttccaccaacagggcacaaggtttccctatcctgcacacccttaccaacactcgttatttcttgtctttttgataacagccatcctaacaggtatgaggtaatagctcattgtggttgatttgcattttcctgatgattagtgaaattgagcaccttttcttttacctgtttgccattttgatgtcttctttggataagtgtctgttcaggttctttgaccattttttaaattgagttatttgtttttctgctattgaattgtgtgtgttcctaggaacagagcttcaggaagttaagagccaggcgatttggtggagaattgcgtgttctctgctgtgtgttcaagaacaagctgtcttgcttggctggctaacagcggagccaggagtaaaatctgggcttctgtatttccacagccaagggctctttctactactctgcaatgcacagaagcaactgacatgattgttctctgtgtttcctgagactaatgagaataaatcaaaatcttacagataagtatgtgtgcttctaacctatatcattgctatgttttctaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgtatgctctgatattctttcatgccctccccagtacttccattcatagagaggatgtctaggactctttaaaatgtgaatttcagacagtggtctgtataatatactcttaatgtgcatattaatatatattttccaaacatcaaagttttccatgacaatttttgagtggtaaaatgtaacagcagcattaatcagaaggctaactttattggcgataaagatattagatataagaatgtaatccacaacgcttggtggcaaatgcctgtaatcccctctaatgggaggctgatgtgggagaatcgcttgaggctaggaatttgagaccaacctgggcaacatagcaagaccctgtctctaaaaaataaaagcaacaacaaaaaaattagcaggatttggtgctgtgcatttatggtcccaaccacataggaggctgaggcaggagggttgcttgaccccaggagttcaaggctgcagtgagcagtgattgtgctactgcactccagcctggctgacagataaagggcctgtctcataaattaaataaataaatgaataaatttctgtttgaacagcaaatatttttcttttcttttctctttttttttttttgagatggagtctcgctctgttgcccaggctggagtgcagtggcgcgatctcggctcactgcaagctccacctcccgggttcacgccattctccctcctcagcctcctgagtagctgggactacaggcacccgccaccatgcccggctaattttgtttttttattttaatagagatggggtttcaccgtgttagccaggatggtctccatctcctgacctcatgatccgcccccttcggcctcccaaagtgctgggattacaggctgagccaccgcacccggtcgcaaatatttttcaaattaccttcatgtttgatcaattttgcttagtgttctgaaagtgtaaagcaccagaaggggaaataaggaactttaaattctgcaagtgactttttcactgaaagaatgatgttcatctgaccctggctatcctaatttctcgtacgttccatgatctatcctatctattctcttcacagttgtgaaaagccatttattatgcatcctcattcccctggttcatctcggttggcaggagctctgagaaagaaatactggagtgtgggtagtattaatggatattcacatacagatggtattgggagacatgtgggtctaattgttgcaggaactttatggaaatgtgatcttgttatccagtccatctcttgggagctgaggcagtattattcattccaacactgtttctgatgttttagcttgcctaatttagctttaattttctgccattttaggttggccaaaagcctcgaggaaacttggtcatcagggaatcccatcatgacttttctcagcaatttcacagtaactgagggtaagtatgtggttttccaagtttgcttgattaaaaattaaatttagtttctcatgcaaatatattattaaaataaaacatacaacagaaaatttatgctatatgtgatacataatcatttacaacttggctggtatgatgtatttggcatttataaagaaagtcctgaaatcctagggtaccatgttgaagcagaggaacaaagagaagcttctgtggtctggattttgctctggccttgcctcctcggacaagcaattgatgtctgtgtgtctctgtttccttggctgttcactctgtcaactcatgaagcttcttgtagcattaacatgccatgtctgaagaattctggcaaatacttaaatgatccctctcttcttaaaaaagtgagatgagtagatgcatgtatacaagtgagtttcttatagcacttggtcactgctccctaagaagaagctctttctttctttctttctttttttttttttgtgtctcactctgtcacccagctggagtacagtggcgtgatctcggctcactgcaacctccgcctcctgggttcaagcgattctcctgcctcagcctcctgagtagctgggattacagggatgtgccaccatgcccggctatttttttttttttttttgtatttttagtagagacagggtttcaccatgttggtcaggctggtctcgaactcctgacctttgatctgcccacctcggcctcccaaagtgctgggattacaggtgtgagccaccacacccagccagaagaaactctttctaaagtaaatgttcttaaaacatacaggccttagagagagtagaccagtaaccagaaaataccacagaacctggcattttggtttattgtcatataaattatttaagttattcccaggggagtaaggtatgactttatttagtgatttatgggttgaatggtgtgaaagaaactatcctagccaggttgtaatatcaaattttgttttcgcagtcagtaatgatctaaacctttattacacaaatttcttattttccttactttgcagatgtaaaaataaaagatttgatgaagaatatcaccaagttgactgaggagcttcgctcttccatccaaatctcgaatgagactatccatagcattctagaagcaaatatttcccactccaaggtgtggtgctgtttcttgtctgtctgttttgctcatggaaggagccttagcctgaagtcactggcactgtgttgtcctttcttccttcttgccttcctctcctttggctagtgtagtgggttgctgcacaaatgatataattggaggcagaaaggaaacaagagaacaagcaaggaaccaaagggtgtcattgtcccatgccaaaatcttagggtttttaattccataatattttctttatttggagttagaacaaagttggtgattatttattctgttgatttccagccctgatgcatgacacctgggaagggtctcggcttgattcagcaggtgttgcaaaattcttaaaatacccaaaaccaaaaacagctaaaaatatcttaagaatcaactatgacttcctctgagtggagagtgactgggcacagtctgactatgtgctaccgtagtgaatcactgtgaacgcaaatgagtaatggcaggctgtgtcatctccaagctgaaaaatgtgataaaacaatcaaagagctactgcaacaaaccaagggatgagtaacacatacgggccacatggggtatggtttctctgtggaaaaggggaacggggacatctcatgttttccacagcagatatcacctggatccttagcaggagattttctgagacagctttcagcacttctagttggggttttatcttcctgtacagagaaccttccagaagtagtaaccgtggagctgactcgtaagtgaacgttgcaattgaccatcaactgggccccaacacacgtttaatatcatgtcaattctggttaattggggcttattgcaagcttgacgggtggactaatgaagaattaatctaaattaaaaagagattagaagctgggaaaccaaaattcaaatgacagtgtcaccaagttacttataataaggcacttagtatttatcttcaaggaaaaatgtcaaattcagcttattaaacatgcaagagccaaggaaagcagggggcagtgctgaaattgtctcttccctacctcgcatgatgccttatagagaaacaatgaagatttttggtttaaaatctttagttattgaaacgagtaataggggaaagaagcagtggaaggagtaatcggagcagctacctgggaatgttttaagaccagggtcagattagctaacttctggggtccctttcaaattcagttttatgatactttttgggtttgggctcaactgtttttgatgaccactgcctgatgaaacaagtggccactgggtgtcactgctgttctattatgggagggctgtgcacagagaaggctcctgtggtaatgtggtattgtcttgtgtagatggttctgtagtgctttttttgcactctgtgtatctttctctacctctttgtcagtatgaatcattatgatcgcctaaacagctggacagttaagtaattgggaggagtatttaaaaagttgcattcttgcgtttcaaataagtaatgagattatttgctttgatggttaagtatatccataaatgcacatgtatctacagatcctaggcaaggaattaacattaggttaggaggtgacactttggatacttgttttttctagattgtcaggtttttagcagcaccatattatttctagtatccttttcttatctttcttcctgggtttctctaccatagctttagtcagtttgcaaataatcacatcagattcttagtccaggctgttggtggcatgcagggaatactcttcagtggtgctaaagccctggcaaaattgcagaaatcttcattcattcatttcttcctttattcacttaggaggtttctgcatgacaggcatggtcccaaaaacttgggctcaaagcccgtgctccaagggagccaatgttctgtgggggatgacacagtaaatatgcaaacaaaagaaggtcagtgttaagagaccagaaagttctatcatgcaaatagaacacaacaatgaggacaggtggtccctggaagcctccctgaatcggtgaagatggatgtcagactggaatgatgatctgcatatgaagagctatatgagagtcacagagctggggcatttctgtcaaaagaccagagacaggagtgagcagaaggaggcaaatgcagcagatgcatggataccatctcatttttctttcctgccctcttccctggctgcagagaacctgccatgggcacccacccatgggaatttcctttttcttgcagagctctattctctaatatcagcatcacccaattaaaaccacaaatcacaggggcttcctggacactggagcccatctagcccagccttctgtcctgggtttgcatcctgtccacctgccctgtgaagcacccatccacttcatgctgtgttcctatgttttaggcacatgttcaaatcaacaatgacttccttctttgtgttgggccaaatttttattcttttaaaattagcaatgaggccaaagtgtcaggacccaaatagattgagagagcaatcaaaagtcggccctctgtccctttattttctgtggtaaacaattaggcagagttcagaggacttttgcttggaagatgaatattttttcacagtcctcagtggattcattctccccgcgccacaaatcttaaggaggaagggagagggcattccctgaaagttccaatctcttctgggaggctccttcaaatggaaaggtattctgaattttttttctttctgtttcttttgagcagaaatgattgagtttggtgaatctggtcaaatttccttatctcacttggggccggtcctgggggctggttctgtcggttgcgacattaacagagctgctgggcataatttatggagagggagagattccttttaggagtttggaaacattacacattccacttgttttaatacatgaagtttgtttcctggaaagctccaacagatagttcttggtgaaactcatttcagagcagacactggtcaaaatttgctcattcttttttttttttctttctctgaagacaaaaagtaattaatgtgtgactagagttatgggtttctgggatcatgagaagtttggcctgaagtttcctggaagacaccatctgtcatgtgcagagtctcattctagagaaagtccttcctaggccttagactgcttgtctggctctgtcaccacatcaggagattggggtttgtggtccttgtaatccaggattcacagaatgaagtgcacacacccatccaccaccatctcattctctggtgttcttagagtagggcttttctctttgatttgtttgatttgttgtcctaccagagtattctcagtaaatgtggtaggttctcattaaacattcactaaaataaagtgaaattccagctactctccttccattaagtcagctagcgtttcttaggtttatgaaagccacgttaccttatttgctcattaggaattctgagaaatgagtattgtgctaagggcatttgtgtctcatttaactccctctgagcagggcatttctcttctttcacagatgaatgtgatgctgtggaagtcacagctgggagagggcctgaaatcaaacccacgtctttgaacttgaactgtgttattcttccatcacatgatgttattgcttcaatttgttacaaattaatagttctaagaaaattactgcttgccgatgggtttcctcttctcctacttgcacttatgtaaatatttttaaaccttaattccccaattggcattgatctctgcaaaaatgcttcttgctaattttggcaaaatattttttcctttttatttttaaaaattaaacttttattttaggcttaggggtgcatatgctggtttgttatataggtaaactcgtgtcagggggtttgtagtacagattatttcatcacccaggtattaagcctagtatccaatagttattttttctgattctctccctccttccaacctccaccctcaaataggccccagtgtgctttgttcccctctttgtagccatgtgttctcattatttagctccaacttatatgtgagaatttgcagtatttcattttctgttcctgtgttcatttgctgacgataatggcctccagctccatccatgtccctccaaaggacatgaccttgttctttttatggctgcatagtattccatggtgtatatgtaccatattttctttgtccagtttgcccttgatgggcatttaggttggtttcatgtccttgctattgtgaatagtgctgcaatgaacatacatgtgtaggtatcctcatggtagaatgatttatattcctttgggtatacagccagtaatgggtcaaatggtagttctctttctagttctgtgaggaatcgccacactggtttccacaatggttgaactaatttacattctcaccaggagtgtataaatgttcccttttctctgcaacctcatcagaatcggttacttttttgactttttagtaataatcattctaattggtgtgagatggcatctcattgtggttttgatttgcatgtctctaatgatcagtaatattgagatttttttcatatgcttgttggctgcatgtatgttttcttctgaaaagtgtctgttcatgtcctttgcccactttttaatgaggttgtttgtttttttcttgtaaattttttttaagttctttatagatactggatattagacctttgtcagatgcatattttgcaaaacctcccgttctgtagattgtctgtatactctgttgatagtttcttttgctgtgcgtaagctttttagtttaattaggtcccatttttcaatttttgcttttcttgagtttgcttctggcatcttcatcatgaagtctttgcccattcctatgtccagaatagtattacctaggttgtcttccagggtttttatagttttgggttttacatttaaatctttaacccatcttgagttgatttttgtatagcataaggaagaagcccagtttcaatcttctgcacatggctagccagttatctcagcaccatttattgaatagggaatctttccctattgcttgtttttgtcaggtttgtcgaagatcagatagttataggtttacggccttatttctggactctattttctattagttccataggtctatgtgtctgtttttgtgccagtaccatgctgttttggttaattggatattctttcaaggtgttttttgatatcaaattctgatactttaatttgcaaagtatcatttttttctctcaacttcatcagtcaccaaaagatgagagtatcttttatattttcatccaagtcgttagtgcagaaagattaccatggcataggaaggtataacctaacacctatttatttgtttgggctcttaaatcagttgcaacatgtctgtctggggtgtcttggtaatttattagcctaataatttcatcattaaaagaaaatgactttatattgacatggctcattgatcatgactgtatcgacatggtttccagcaattttctttttcttcaagggcttacacataatcttttggataatccatgattagaattcttcaagaattgacattattatctattagtaatttctaaagtctactttacaaaataaaacctggatagtttttatttccatcacgacttcttaaaaactgtagatagtagaactgtcactctttctgaaggcatgaagagggaacagggagagagggaactggaaatggagacagagaagttggtggagaaggtggccagacagcagccatggcctcactgaagaactacagccaggctgaatggtagttctctttaggttctttgagaaatccccacactgctttctgcagtggctgaactaatttacattcccaccaacagtgtataaatgttccctttttctacaatctcacaaacatcttttattttttgactttttaataatagcctttctgactggtgtgagatagaatctccttgtggttttgacttgcatttctctaatgatcagcgatggaacaatagacatgggggactactagagggggactaccagatggggaggatgagagggggaaaaagagttgaaaaaccacctattgggcactatgctcactacctgggtgatgtgatggttcatacaccaaacctcagcaacacacaatttacccaggcaacaaacctgcatgtactccgtaaacctaaaataaaatttgagaaaaaaaggaactgcagccaaatgatgcctgccttactgggcaaggacaccattggcactgccctagaggccagctgccaagatgcttatccacagatctcctaggcatcctgttttacccttccagtgtgaagatgtttctctttaggaatatgaaaaccaagaaggaattaattagttctcttaagtgtaatcatcatccttaatcaataaacccacctaattcttattcatcttttcccttaaatatcctgtaagtcaaaactgtgcttttgctggcagtgactgataggcttcttagtagtaacgtcatttttgagcacttatatacactacccctgagctgaatgctttacatctcatttaattctcccaacaaccctttggagccctttgtcttttattgtcatccctggttgtatagacaaagaaactgaagtgtgtagatgttaagcagctttcaggaagtcagacggtaagagctggagtcaggatccaccaccttgccacagtgtggcttcagtccttctggccaggttctcgcagccttctcctgccctccgatgctcatctcttgtacttgcctctttatcctgtgagcagctctgagctcaaatgggtccccaatggcagagagccacactgctcctctctgaagggcgtagggcctatttttaaatacctgcgctcctttcattgtcttgtcttacaaattctaacttggcagactctctctccccatcatctccagttcccttgaatcactgtccgtgtttcccttccggtcacaactgagctgagggcagcctttcctcccatgctttcccaacctctgagtctacaatgagcagctgggcaacatggaggccatctctggtgctctcctctgaatgcgattcgggtttcagcagatgtccaataaacaaagctcttgctaaaaatgcaaatgcctctcctaaggatcattgtcatttttaaaccacataaatactcagataattatctaagtggccaagtgtgtatgagccaggctcgcagggcagagaggcatcgccctggatcctaagcccccttacagctttccaaaccaaacactgacacacaggaaaatcagcaggaacttggcattctgtttctgataatttgcagcattagcctatgcaaagcccgagataaaaggtgcctgttttactttgaatagaaatcacacaagatatttccaatcaagcacaactcagtgttgtctttgcttttctaatcttcctcccctcctacctactctcaaacaggaacaacgaacgaacgcaatacaatctttaaaagataaatagtaatatttggaaaaccacaggaaaggagagggagcaaatgtgctgctggggctgtggcttctgtgcattgtgactgcggagcttccacatgacagggtgtgggatcctctctatttggtaaaaagagatgtaaaaaatttcaggacaaatattttttgtcctgggactagactctaaaaaacgtattaaatatgatcttgcatggggaccactgtgtgacatgctagaaagtaattaatacaaatgttctatgacaaatgcagaaaggactctcattgggccagcttgggttgatgctcatgaaaagccagggtgattcccctgaattgggggtttggatgaggtccattttgagggatagtttcatgcaaaagcctattttgtgggactgatcaaagagaggctcctcttgtgaaagcaaagggtagatgcctatattctgctcccaacctcctcctgagagcttcccctctgcccagagacagcatgattgaaaacagtggcattaaggaaaacttcaccaatgtgtgtctgcacaatgccagccctatatgaaaaaaggtctttttggtaagttagtgatgaaaatacttaatatcctttcttaaagactcaaaatgcacactagcatactagagtatcatagccattggtgatgattaattttgtgtgtcaacttggttaggctgcagtactcagatatttgttcaaacattattctaaatgtccctatgcgggtattttttagatgacattaacagttaaatcagtagactttgagtaaagaagattactcgtcataatgtgagtcagccttatccaatcagttgaaggcaaaaaaagtaagaaagtcccccaaggaagagtaagttccatctccaggtagtccgcagatgtgagctgcaatgtcagctccttcctaggtcccaaatccgctggcccaccctgcagattttgggcttgccagcccccacatttgcatgagccaattccttaaaataaatctctctcaatgtatgtatgctatgtgtcacttaatgactaggattcattctgagaaatgcatcattaggtgatatcatcattatgtgaacattatagtgtatacttacacaaacctagctggtacagcctgttacacacctaggctatatggtatggcctgttgctcctaggctacaaacctgtacagcaggttactctactgaatactgtgggcaattgtaacatcgtggtaagtatttctatatcaaaacatagaaaacacaagaacgtattttactatacctgttctaaacatagaaaaggtactgaaaaatatggtataaaagataaataaaatggtatgcctgtatggggcacttggcatgaataaagctacaggactgaagttgctctgggtgagtcagtgagtgagtggcaagcggatgtgcaggcctaggacatgcctgtacaccactgtagactcaataaacattgtgtgtttctacatttataaaaaaaaatttctttcttcaatcatagattaaccttagcttactgtaactttttttactttataaactttatttatttatttatttttttaagacagagtcttgctctgttgcccaggctggagtgcagtggcacaatctcggctcactgtgagctccacctccttggttcaagcaattcccctgcctcagtctcccaagcagctgggattacaggtgtacgccaccatacccaactaattttttttgtattttaagtagagacagggtttcaccatgttgaccagactggtctcaaactcctgacctcaggcaatccgcctgccttagcctcccaaagtactgggattataggtgtgagcaactgcaccctgccgaacctttaaaattttaaaaaacttttggactcttcagtgataacatttatattaaaacacaaatacattgcacagctgtacaattgttttcctttgtgtccttattctataagcttttttctattttaagtttttttacttttaacttttaaaatcgtatttttaaaaattaagacacaaacacacagtctagtctaggcctacatgaggtcaggatcatgaataccactgtcttccacttccacagcttgtcccactgggcggtcttcaggggcaataacatgcgtagagctgtcgtctcctgtgataacaatgccttcttctggatacctcctgagggacttgcctgtggctgttttacagttaaattttttttaataactagaaagagtatactctaaaataatgataatatagtatagttagtacataaaccagtaatatagtcatttattatccttgtcactattatgtactgtacataattgtgtgtgtgatacttttgctatgaatgggagtgcagcagttttgtttacaccggcactgccacaaacacttgaataatacgccaggctacaacactacaatggctgatgtcactagaagataggaattttttcatctccattataatcatatttttcatctccattataatcttatgggactaccaccgtatatgtggtttgtcatcatgtaccagatagcgatattttggtcaacaatggaccccatataggatggtggtcccatgagattatactactgtatttttactgtacctttttactgtaccttttctatgtttagatatgttcagccacacaaatacttaccactgtgtgacaactgcctacaggattcagtacagtgacacgctgtacaggtttgtagtctaggagcaatagaccataccctatagccaaggtatgtaggaggctgtatcatctaggatgctgtaagtgcacactatgatgttcacacaattaaacaattacccaatggtgcatttcccaaatgtatccttgtcattatgagacacatgactgcacacacacacacacacacacacacacacacattctcttggttctgtttctctggaggaccctgactactacaccattatttatatcttactgtattttgggaacattttatggcatctgttgagttctccgtgctcttcttcagagagcatggttcctattcacataggttcatgcacttcggcctcagttggcctgaatgtttcacagcaatcatacccatcaggagcaaaaacatggagcaggaagtatggtttttgttttattttgctttgtaatttggcatatcacaaatgtccttaactgaaaagcatacccaaatgaagaggtgtgtcaaagcctttaattgcgatgcatgatagtaataaactagagactaatataagttgtcctcagtgcctccttctgagtgtacttgctttaaaaaaatatataacaagcttggtaatcctgttttcaatctaaaaatgaaggagcaaaaaatatcagcttcacactgatgacggtgaaaagtggaagctgataaactgaaagccaagggtaagacttaatatcagacaaacgagacacagatgctaactacgggggtggcatcggagggtgggggcttggtgggcattcagagtgagcctcgtggagagcagagggacagagtttcagaagggtgatccaaagacctcaagcgagggcaaattttataagaagtcagagaatgatgtgcgcacttcagaaacatttccatcaaaatgttgagaatcgaaccccagtttgggctccccgcatctgcaggtcagtcccgggagttgggaaatccactcttgggcgactccctgccgatgaagctccggtctgaggtggtgaagcacatgacgtcataggtatactcacctctaatctctgtgctttgaaacaggttctcttcagtgccctcaccgtagctctgtctggaaagtgtgatcaggaaatccttcatctcctgctgacatttcccaaaggggaaaaatcttggatcgcagcggaggaactctgtagcctgccagggtcaaaagtgtattctctgattgtgttgctgagtcgaaacttggatgtgcgagctttcatttacaaggtatggagagcatgctggctgggggcagtcctctgcaggactctgctgtggtggctgcagataagtacagtagtcctaggggtgcggcagtgggagatcagcacctggccactctgcagtggtctccaccagcctctggtgtcacctgtttgctgaatccaaggtggggctcaagaagactttgttgtaataaagggatgttcaggagacccttcagggggtccttggaaataagtgtcagggcattgggacagagttggtggtgatctccatgctcattgtggaaggacccactgcaaaaacacagcaccgcttcctaatgccaggtgttctctcctctgtaagggccacctccctggagcatgtttgaggaggctgggattgtgcatggtccactcctgagcggcccgagttaggtgctgctccctgcacggtggccctatctgtcagcgggaagcatccagctctgccagggcctgccctggagagaatgtggaggggtgggcagcacaggaagcccaatcccctgtgtgtgccggctctgacaagcatgatcctctgacaagcagcagtgtgagggcagggagggactggaggaagctaaagatgatgaagtctgcaggagagagtggagagtgggaagtgaggaggagctggggcaagcccaggcccagcactttccggacgggcccagaacccatgtaggggcaacctagctccaaaccacagctcactgctctcaagctgccccttccagaagcttctcctccttctggcctctactgtttgaatctttacttaagtttccagaagcttcccctccttctggcctctactgtttgaatctttacttaagtttccagaagcttcccctcttacccttaggcactgatcttgctccaagtaccattgttttccctttagggaagtatttcacaacctctgggttcattagagaggctgcagggtttgtactatggtaaggtggctgtaggcaccctgagtttgggtgaacagttttatagtcagcaaagggtagatttgccatttcagccacgcatgatttccttagtttctattacttcaagagtccagggagtaaatgttggaatgaacacacacacacccacacacacacactccaagaacaaatatttgttttcagaatgattacattttaaacccataaggaggagaataaacatttcttgcatccccataatttgcaaacccacctctatcttggtggaattcgtatttttcgctaacatgcttatggtttagctctgcatttgctcaccacagcctctcttccaactttacagtttgccttttgggaaacagagctcccattggcacgatgctactttagtggccactttgttatgtgcacaaaggtccccgatttgaagtaagtgcttgtagaggcccacataattactgtgacaagggccatcatctgtaccaagatttctttgaaggataagatagtgggttggattcagtctcccagacacaatgaaaatgacatcatcattaataacaacagctcttatttatcaggtaccttctatatgaagggctctatgaaagttgattaaatacaagatatggctcaggatgttagggcagcccgacctccatgtgagggccacgtgcaggtgcagctcattcccaagtccatgtactttctgattcactcagctgacaatgaatttctgaagccttcagcaaagcacagtttgctatattaattcggcacatcaatctggtctcttggagctgcgctggatccctgtcactccccaccataagtcaggggccagtcactgtgtgccacttttttttaaagggcagctgcaattagaaagatgagtagaagaagtgacaaaagctacacaccatttctcctgctagagttgtctctatagtatgaatggacagaattctgtcattataagcagagtgcctctgtgaaggatggagctgtgatcccggagccctgaaagtcatctgcagagctaacagctaaaacactaatgagcaaaaataagaagcagtgacaactgggttcctctgccccagcctggaaaacagaaaattcaatatccaaatgacagacagtggaaattagctgtgattttccctgctctgtgcgaagagctggcatttcctcatttatccattcatccaacaaatatttattgagcaactaatatttcctgttgctattttatgcccagtagctacatgaaagatcaagacagaagaaaagccttgcctccagtgtagaactgagaatatgaaaaaaaaaaatcatgtaaaatacagagcatttcagttggtgatagcataagtaagcttcagagggcactgacatttttaaagaatccaggttaaattcacatccctgaacctttctaactgttagacttcaggaagacttttaatctcctcaagccccagttttctcatccacaaaacgaacagtataatgcacatccccaaggtattaggaggattgagatgatgtgtgaatgctatgaatactgtaaagcagtagataaatgtaaattgcttcacatataaggactgctcatattttgagcctcttctcaaatttccaccttggtcacctcaaagatacaaagaaatatttggcaaatgatttgaattttaatgatagatcacatttgtttctggtttacattttaacaatgctagtgcaattcagtgtgctccaaaacacatgagctatatatactctaatgaagataactttcatatagtaccgcaaaggcgtctctgaagttcaagagagaataaaatcagataaacaagttttcacagctcaaaagatgcttctgagtgtaaaaatacagtgttggttatttcatgttgttttgtttttgttttgtcctttagactctgatgccttctgaagcaaatggcttgctcaactccttgctggatatagtttccagcctcagcgccttgcttgccaaagcccagcacgtctttgagtatcttcctgagtttcttcacacatttaaaatcactgccttgctagaaaccctggactttcaacaggtgtgtgtttcatctttgtccctagggaaatattcaaatttgccccttctttgtatttgcccctttttgcctttatcttcccacatctaaaatttgcattagacagcaaaatacaggaatgaaagtaccttttcatatctctggaagcaacagcataacatagaataaggcctggcatctctctaaaaactgcatgaaactgatattgttgatctacattccaccagtgtggagattgggatagtacatgcattatctataaagtaagaaattactaactcagttattgcacagatgagatttcaagggcctgtttaacttaattcagagagcaaattgctttcaaaaaccttaaaacatatatttacttataaataattggcttacaagttacagatcatttactgcaaatgcaaacacaaacttgatttagtttagtgacttgatgttaggttttgtttgaactctttttgcctgggatggaactgactgggcacgaatgaggaggagtgtggaaattttagggttggacgtgtaggatgaggagcaagataacaatgttctcagaactgccttggagacagaatgtaagtccatcatgtgatagataatttgtatagctataaaatatctggatatcttggtagcatagacatacattaagactagtaattagtctgaattagtgatattttatggattaataatttattactggacaaatagtgtaaggacttatgtgtgtgtgtgtatgtgtgtgtgtgtgtgtgtgtgtaggtatgacatttccctcttctaccaggtatgttggccagaaaagttaccgtagtgtttcaaatggtatcccaaggacagaaaactctaaagcagacattccattcttttgacttgttgaatatcttgtacattcagtggaggaaggaactagactttcagaagtgtgtgaaggaattgttttaagtcactatgtaattgcaatttagttttcttattttctcaggtttcacaaaatgtccaggccagaagttcagcttttggttctttccagtttgtgatgaagatggtttgcaaggaccaagcatcattccttagcgattctaatatgtttattaatttgcccagagttaaggaactcttggaagatgacaaagaaaaattcaacattcctgaagattcaagtaagacagtagtaatatatatatatgtgtttagattcgtttgtatcttgataattggccttaaattatagtaagtattctgtctgtgtataaggttgctatatactggcatagaatcttctgcttccacctccccaaatgctggcatggcagctgactttgaacggttctagtgcctttgagcacagacaaatcctctcacctgagtcactaaggaactgtgtcaccaaggaaatgtctaaaacacctgaaaccccagccccattggtttcccaggctaaccagtattggtgagggtccaggcataaagaccatgagcactgctttggtccatgcaaatggctatattataataacgaagagaacttgtctgtggccacctccaaatttgctctctatgaagctcaggtacaagtgaatatgcatgataggtacaaacgaatatgtcacgatgggtacaaatgaatatgccacgataggtacaaatgaatatgtcacgataggtacaaatgaatatgtcatgataggtacaaatgaatgcaaattaatacataattttttggccccaatttaagtgaagatgtttttattagaaaggcagaataaacatgctggtgaggttttggagtttagacggttcagctccatcagttgtgcatttttggacacattgttttatgtgtctgcatcatgttggtttcatttataacgtagaaacagtagcacctggctcataagcttattgtgagatgcaatggatatgaggagtgttggtgccttagcataagggtataaatgtatcctagtgtattcgttttctatgctgcatgacaatcattgcacacttaatggcataagaaaacacacatttgtcatctcataatttctgtaggtcacatgtcgggatttctgagttaacatttttagttttgtacatatcgtgactatacttttttctgcaataaaattgctcctgttcatattaagcttgcaatgtaaagagtaggtcattaaatttcagtaagaacaacttctataattaatggcttaaaaatgtattatgtagtcatattcttttttttttttttgagacggagtcttgccctatcgcccaggctggagtgcagtggcttgatctcggctcaccacaagctccgcctcccaggttcacgccattctcctgcctcagcctcccgagtagctgggactacaggtgcctgccaccacgccggctatttttttgtatttttagtagagacggggtttcaccgtgttatccaggatggtctcgatctcctgacctcgtgatctgcctgcctcggcctcccaaagtgctgggattacaggcgtgagccactgtgcctggcctatgtagtcatattcttcatttatactttggggaaagtatttctatcaactttattgtcaaataatttttttcctttcaaatgggaagtttgggaagatgaaagtaacatttaaaacaaccacaacaatcataccttgagtatttataaatcatagtatcaaatctaagataatattttcattttattcttataaagctaaaataatattttcattttaaatgttctcttgatgagtaaagaaatagttatactgaagtattcctcactagcttaaaaccttataagatttagttcctactcattatggtgatgaaatctctaccctcatcaggtgaccattgatttagacaatttagttaagtaaatctttaattgaaatcaactagcatcacaagactcatgagagccaccaagagggattaagtacttgcgtgaaaataaggcaatttaatatgtcaaaattcgtaagtttgatggttctgcacgggctcattaaagacagttcagtagtaacttgtaaagctaacttcataaaaaaagctcagttccggtctcaatattgtgactgttgaaatgagaattttcttgatgaaaaaccagatttattttttgaattgtcattttcattttcaagtgtccatgtcattatttaatactctttttgattacttagtttgaaaatgtaagtcattctttcctgcctttgaagtcacttaagtgaacatagcatgaagtttcttatgagttgagagctgctgaaaactataacagggaaaaaaaatcttattttacttcctgtcttggtttatttggtgttgctataaaggaatatcagacactgggtaatttgtaaagaaagaggtttgtttggctcacagttctgcagactatacaagaagcatggcaccagcatctgcttctggtgaggcctcaggctgtttccactcatggcagaaattgaaggggagatgccatgtgcagagatcacaggacaagagaggaagcaagaggggggaggagggagatgccaggctgttttatttacttatttttaaacaagcagctctcttgggaactaatagagtgagaactacactcattactgtgacaatggcaccgaaacattcatgagggatctgcccccaagatctaaagacttcttgttaggctccacctccaacactggggatcaaatttcaacttgaggtttgggaggacagatattcaaactatagcactcccaaagttcagagtggtgtcagaaaaaaatatggctgtcattgaaaatgaggcatcctggatatgtgaatgaatttccctattaacctaggcatcgtgtatcattagcaactttttttttctttctaattgcaacagcaccgttttgcttgaagctttatcaggaaattctacaattgccaaatggtgctttggtgtggaccttcctaaaacccatattgcatggaaaaatactatacacaccaaacactccagaaattaacaaggtcattcaaaaggtaagttaaaataaatgagaatcatatagaccatacatacactaaatcaggaaggaatctttaaaaatgtctgacataattattatgcgccttggattatgtagaaggctcttgttttgaatctacttcattttagcctgagtgtttttcctgtcattgttattgttaaatctggatttgctgactccttcccttagaggacactttgggggttggggttgttatttagaataattaatgcagtgaacttacagaactctaatatgaaaagtcaaggacagtgagacagagaggaggactgtttggagtaattccaggaaaacttcgagaacaaatgctaatctgttttgcttggtgcatccaacaattacgaaagaatcagacatgatacatacaaactgatgtattagcagttagttagtattttggttagtgatgtttctgaattcactgtaaggctttgcttcaccctgtggagaataaggtgagatgaagacaccaaagcagggtgtatccaggaggaattgagacactatgtggctctgcttattttcctttccttacattgtttaacctctctaatctatttactgcaggatttgttattattaatatttgcactttctttttaaataattgtgttgtattttcctggagtcttttcttgcctactagggggcctgtaagcctacaggcacctggaaaggggacattttaccaaggacacaggaataatttggtcttattgtcaaacacagaagagaagatacctgcactattcatgataagcttccaagcctcaaatagcattaaaaatttggaaactgtgatcatatggcatgggatcatatgagcagttaagtcatttttgatcaaacttgccttcatgagtttcatgcttctgacccatggttgctgtgtgaggtcacagcactgtttcctgtaagttccctttcccactttgccacctacctcaggggctgcatttacctctgcctactctgaatggtatttaaactttaaaacatttatataatttatttaatttttgttttgttttgttttttggagagacagactctggctctgtcacccaggctggagtgcagtggtgcaatcatagctcactgcttggctgaagcagttctcctgcctcagtctcccgaagtgctgagattacaggtgtgtgcccccacgccctgctaactttttagtttttttttttttttgtagaggcatagtcttgtctacttcctaaaaaaaaatcttgaaagtgtcctttcagaggggtatttgccaaaagtctgcactctcacatggaacgacattgatctccgtatatcctcagtgtgagctgttctgttgggcaggaactctggcctcacagctgccatcccaggactggagcctctgcgccattactcgaatttccttagtgtagtaagctttttagggttttggatatttaaggaatttcacagaaaatggctccatatcacagctctattttaaattcaaaatttaaaaataggccatgactttaaaaaaagatgatatgctatattattatgttaatattattaatatatgactatagcattgcatattatgatgtattctgcagtataacaattagtgtgatgatctctgcttttaaagagctcaccctattgtggggaagagaaggcaaatagctgaagaaataagttagatatactatgctataaagaccattcagtgcagcagaggcacaggctgtggggggcagctggtctccctggaaagaaagattgggcaaagcacttggaaggatgggttttctaagcccctgtgaggtggagacgggaggattgtgggcctggacagaggtgtggggaggtgccaagccccacatgtgtgttctgagaatgatgagaatttttgaaaaatcaccaaagatttcactggtttttgcttagcccctttttagatattgcaggcagtattgagagctgatgtcttttttacttatttaaaatggctagcaactttgcatgcaggtatcctggttttgcacttgtaaagctgattttatggcattgtacctgggatgaattatcctagcagtcagccatggctatttggttttatgaaaattgtttctagtcattagactcatggtctaaagtcccacagagctgggagacgcttgtaggtttgcctcttgggctatgcgaagcaatattatctacagtgttggagtggcccatgctataaattatttaagacgtggtctttttctctccattacttcttgttaggtggaaccatctgaagttgccatttttgcaggaaaaaaaatctataaaagttggtaatttcatttggtttaacttgtaatagcacaggtgacacccagaagcatgatgctgtggtaagaaacgtgtgtatgtgtgttggaaggctggattttggtcccccttttcctaactctctgtgaccttgggcttattgcattctctttgaaggactcttctcctctatctgtgaaatgaaagacttgagtagatccgtgattttcagtcatctgggagacggctcttcatgggggatgcatcagaattacccacggacccttagtaaggccttccgcctctgggctctgatatccccatccctgaacacttgtacccctcacacccatccatatccttccacagagctgtgtgcacctccatctatcagccttaaagacagtggaggtcaagcattttcatgaactggaaaaaaaatgatggccaaaacttctagagagtgttaaaaggtaaacttagggacattaaaatttcaacaagtttatttgagcattcggttattcatgaattaggcaatgccagacaattcaaccctccactgactatgttgggatgtgggatgtggggtaatagaagaagcttgtatgaagtgtttgctgcagcaacagggagaaaatatattcgttaaagtcaaaagtccctagttggaggttagttggaggtttctgattggttaattttaacttttgttttactgtttgcattgatttgggttttggtttgcctacataggaactcaaggtgctatagctgtcttagcctaacagcctcctgatcaactattttaacaggagttaatttaactcatactctaagggtgtcagactcagtatttgcaaagaaattgatgctatttccatgtcattagtcaagagattccaatgtattagtatgctctttttattttataggtcagagtcgtgttcagttttggccctaggctgatgaaaaattgaagaacaatgtgtagacacaatgtgagcttgaagggaggctatgaaagaaaaacagaaaaaagaattatattgttttcccaagaataagtagcatgcctgaaatgatacttcagtgagaatcaccaggcacattctaggccactggtgcacaaagtaggtttagtctgggcttctaagggacgtataagcccatgaaaacagaccgtcttattttcatctagctctctccctttggctaaaggacagagctttgaactgtcacactcagtgtcctcctttgtgaaactgggctaaatcataactctcagtgccatttggaagtggaaaaaataccagaaataatattcagaaaatagtaaaccaatgggatctcctcccctacaagtgttattcccagaaatgcattctgccattgttgcctctggggagtggggaagacagatgtcacctcagaaagaggaaagagatggtggaggccagtggttcaaaccggggtggggttggagaaattttacccaactgggcacatgtgacagtatctgaagatatttttagtgtcacaagtaggaggcgctgctggcatctggaggctggaggccagggatgctgctatacatcctacaatgcacaggaaagcccccacccccaaacaaataatgatctggcttacaatgttagtggtgctgaggttgagaaaccccagcataaaggggtatataatgccagacgggagcgggtgggagcccctgggaagagaaggatgaaagtagaggaagctggtggtcaggtgggcatcctggcttctcctctactggtgatggtcccaaacaggggctgtgggatgatggaggagctgcaagctgagggccttggccctacccatgtgtcttgggggatagtccctgtgtaggccggccctgagctagcatgtggtcctagcagtgtggctgagcagaggaaggatacctgaattagtgtctctgagcatggagtagaagggagccagatttccctgacatccatgtcctgagccagtgtgtcaagtggaggccttggggacctgctatgagccggctgccgtgagagcgaggtggcctcagcaccaagctggcctaggccaggctggcagaggagatggctgaggctcagaaagcaggagccgaggtgagaaggaagcagcaagggagaaggcagtgccagaccccaaggttccaggtaagatgtgggctgggcaggccaggccctggcagcaccacagacaggcagacgaggcacatggctgtgggagtcctgggccctccacccctgactgtcaccaggctgcccctggagaacatcagggggtttgagcattcaccccaaagagcctgaatcactcagaggaagctgtttgaacagggagccactgtcagcaggcaattttgagactttgttctctcttcaccatccccagtgggtaaaaactggatcagctacaggaaatagagaactaccttttctttgcatccccaagcagtgaggtgtcagatatttggctttgtagcatcatctgtctgtatgcataacatcaatcaggaaacagagcaggtcccataaaatggcagccctacgttgggaacctggtgatcctctgtctggaagccgcctgcagaggagggactctgatagttatgtttgtttccaagtcttcccatgctgctcaagatggcaaagtttttcagtaaccttgtgtatcactccagacatggcagcagcccacacatacctggaatttaaatgccatacttccttgggatccagtgtgccagagacgcatgtcctcacctgaccactgtgttggagaggtccttcctcctttcaggctggcctcagcaggtggcagagatcagagagaggccaccagcggtgatccagacagccacgccatgtctctccctgttcccactctccctgtcctctcaatgcccagggcagccggtgctcctacctccagttccagctgtggggggctccagctgtctttctcttgcctttgttcctggagcttatcctccaaccttcttaagaagtatcttctctcctcaggcacccccaacaggcactgtgtgtttttgctttgtttttaaattaacatagagtaagttcggcaggctttttttcggtcgacagctctcacatttgtctggatcagtacacagaacagttccattgcccgagcccacaccaaatccctcattttgtcccttggtaatcacactgtcttcccaccctaaacccatctgttctctatcactataggtaggttttctttgtgagaatgccctataatggaatcatcatctgtaacctttgaaagtggtctcttttgctcagtacgagggctgtgattcacccaggtcattgtgtgtatcagcagttgcctcctctttattgccaagtggtattctgtggtgtggattcactgcagtttgttcgtccattcacccactaaagggcgtgtgggttttttctagtctttggcgattatcagtggagctcttaccttgcttttatcactacttgaaattatctcattgacttacaggcgtacttgtttattatttgtcgcctgctgtaatataagcttcatgaggggcaggagcttgtctgtcttcttggccaccgtccccagtgcctagaagaatgctaggaataccttcagcagtggctgttgaataagttaaagaataataattatttggctcttgtacccatttgagccaaagacattctggtgttaaatatacaagggagatagagtagactgtatgccaagccctctgcccgctgccagagccaggccttagctttgcagatatgcagtagctttgtctgagtttagcagtggtgggtgccatcaagaagattatctcccaaggtcattaatttcatttactgagcttgggccaggcaccttatgtggattatctcatgtatgcctcacaaccaccactgcaggtaggtactaatatccccattctatagctaggaaaaccaaggttgaaagaggataagttagcttgaccagggtcacacacctatcaagtggtggagctggaattcaggcccagtgtattattttgaagcctgtgatatggtttggctgtgcccccacccacatctcatcttgaattgccataatccccacgtgtcaagggcagggccaggtggagataactgaatcaccggggcagttttccccatactgttctcgtgagagtgaataagtctcatgagatctgaagattttataaatgggagttcccctgcacaagctctcttctctgctgccatgtaagacatgactttgatcctcatttatcttctgccaagattatgaggcctccctagccatatggaactgtgagtcaattaaacctctttcctttataaattacttcgtctcaggtatatctttattagcagcatgaaaacagactaatacagcctgtattagttttctcaggctgccataacacagtaccacagattgagtggcttaaacaacagaaatttattttctcaacattgtggaggctgaatgaccatgatcaaggtaatggcaggactggtttttcctggggcctctggcttgcagacagccatcttctctttgtgtcctcacatagttgtccctctgtgtgtgtgtcctaatatcctctttttataaggacatcagttatatggattagagtccaccccaatgacctcattttaacttaattgatgatttaaataggatctttaaagacctatttccaaacaaggccacattctgaaatatcgagggttaagacttcagcatatgaatttgggaagcacataattcagccagcccacaacagtgcctctttggaatgatcttttaccacttgtaaatggaaataattagagctctctatgaaacttgtgaaccctgtccttatggttttgcagctggttatggaatcacattgaaaaatagtagcccagggaggctagtttgctaattactacaggaacgtaggactgcatactaaaaacaaaaaataagtaggaagcacttggaaaccagttgcaggtcatctctcagcagccacctgtcctcgggacctatatgaattccccactgaaccttggatgctcacatgcatggcgtttgttccttgggaacgttccagagcagggtccaatctcactcatctgtgttaactacctagcacggtacaatgatgcacagtgtttgcttgtaaaaagcttgttaagctgcatttatgtatgaagatttttgttgcaaagccatttggaggaggagaagatgtgcttcgaattgctttcttaattaaaaattttccctaaaaattgagctaaacgttacttcccccttccctttggtcactagagacctcctctgtcagagaaccaacaatgtcttttttactctgacaatagtttgctctcaagttactgaagcagtaacttagacatgcctatccatgggaagcctgctaatttgtgcctgagcaaatttttgcagactaaggatggcttgcagctggtggtaggaaagctgatccataatggccaacttttagttttccctgtggtccaggtatgttctgtaaataggacttggtgctaggtatatgagccaaggactgagaaccaggaacctattggtggctatgaccaccctgtggctattgtgcagaaccctaccttacatgaggcatcaaagcattggcatccctgcctcaacctccctcatgcccttagattagcttgtgtggcttcgtacctttgccagcatcacatcccaagaggcttttttttctttttcaaaaaatatcagacggtgcttaaaactgtagcttttggtactttcagtgatcttgacatattgaagaaatctgattactttttctttttgttcttttcatggcatctgcatttttttgctgtttcctgagtgcagtgtccattttgttattagccaatgtatcagtcaaggttcaagcagaaaagagaaaactggttaagtttaatatgaataattattactataaaaaggcattagagtaatggtggattggttatcaacagtgaagagatctctaaagaatgcagcaatggcggatacagggaataactcttgcccctagagctggggcagagaacccaaggaagaaacagaactacaagtgacttccccatccaggcttgaaatccagaccctactgaagttagcacaaccatggcccttagtatggcagagaaaatcactgaggtgagtggtaattgccatgaatctgcactctagggtatctggagaagttctacacttttcaaatctgcaaggctataaaagggcatacctgaggaagtcatctaggtggacatgccacacctgcagaaatccctgggacaccactctttgggatgccatggatgttgcctatgagaaggtgccatgtgctgctggttatgcgcattgcaggagctgaggtttagagaagctagatgtgggggaatccaggagcttgctccatgggagccttttggaagcagcacactggaatctggaagagaaaatccctcttccttcactgtccctccagagccctcttctggcaaagcttaacagtgtatcaactggcaagggagaatgtctaaaaggcccaactttattattgcagaacaggcaatgaagggtgaatttcaagttgtgagaaggtaaattaataactagccggctgtaaattggtttctttgttttagactattgaagtacaaagagtttccataaagcacatgagttcttaaatgtaagttttaatttatcaaacatatattgagtagagggaagaattacttgctctaatcctgacaccgctaagagctaatgttggttgcaaacctcatttatgccttatacctacaataggggttggcaattgtcatacacgttttgcaggtaaagaaagtgagtcttaggggtaagtaaccttatcaaaagctgtcaacaggaggcagagatgggatttgaaacaaagtctgtttaactctaaggccaatgttttattttttctgttatattttactgtattctccaagtagaaattcacatgtgagtatatctatttctgcctcagaggaactgcttgtggtatgaaggagatgtggagtcccagtgacaagggcatggggaagactgcttcctatggaaggagctggccttaagctgccaaattggaatatcgggttatgatgggcagagatcagctctcagtctcatctatctggtatagtggattctgattggatctggagcaacagagcaggacagatagagagttttacatttgctcatagttccagaactctaacaccaataatttcactgttttaaatgcagattgaatcactctttattgagcacttacttctgtaaggttagaggaaccatcatgttcactgtattagtccgtcctcacactgctatgaagaaatatgggaaactgggtaatttataaaggaaagaggtttaattgactcacagtttcacatggctggggaggcctcaggaaacttacaatcatattggaaggtaccttttcacagggcagcaggagagaatgagaaatgaacaaagggagaagtcccttataaaaccatcagatttcgtaagaacttactcactatcacaagaatagcatggggaaactgcccccgttatttaattacctcccaccatgttcctctcatgacacgtggggattaggggaagtacaattcaagatgagatttgggtggggattatgggaagtacaattcaagatgagatttggttggggacacagcaaaaccatatcagacgctttcccaagtcctccctcatttacttctcacaagaaccccagggagtagacattgttaaatccattttatagattaaaaaagtagtaagaattgtgaatgtttatattcccaagtttattagatgataaacagaagctcatggcttgaatccaaatttggcagactctgcagccaatttattttcattggccatatttacagtattagttataaaataataaggatcctgtatactaaagcttctttcactatcatcagtttgggatactgggtacctaatttacctcattttaaaaaataactttgtgtagcaatgcatggcatttcacccatccccagaatcctgactgccttcacctttgggaggatgagaatgaagtaatacagtttaaagatatttatttgtttgtaagcagtagagatgggaaacagcttggccatcaacacagaatttggtgaatcagatatagactgatcttcaggagaatatcaggcaaagtgaagaataagcacaggctattgctagtgttgtcattaaacggacacaaagcctgataactaacttccatagaaataaaaattcttggttccatgataattattaaaggtgaaaaatgccagtgaagtggaagctgcccaagcctggagtctacataaacttgtacgggctggaagtgcacaggctctgcacatatgtggggctatttacatgtgcagagcaatggggaagggcactggtgggacctttaggcaggtcaaggtctttcccagggagccctacagagagaacaaaatccattgcaatccactttctgactgtaggcatcaaatcagttattggaaagcaagttgtccgtggtttggtgaggctctcagatgggtgaaagtggccaatatggaacattttatcaaaactcagcaaagttgcccagagtagaagtaattacattttacaagtggccttgtttgatataacctcctataaaatagcagttctctaagacagcagtatcagtagaactgtgaatgtactttttctgtgagactagataatatccaaaccctcagatgagcatagatgttgctcttttactgaccttggatacctgcaattttccatcattcgttttcctgtctgcttggaaatggtggtctatttgatataatcttaattaatttattagtgaaatagcacattagaacatgaggaaaaattataaacatatagttcaaaaaataataaaaaaacccaagatgtattttaaacaaatgaaaagatgctcaaacttaatagtaagagaaatgcaaatccccaaaatgagatatccacaaatgagatatcatatcaaaatgctaaaggctcacaatttgatatattttgttgtttggaggtattaggagagagtcactctcatgcattgctgttgggagtgtattcgtgtgaagtctttgaggccatgttgggaatatctatcaatactacaaagacagctattcgcacatgcaaacaaggatatttattgtgccattgtttgtaagcagtagagatgggaaacagagactggacatcaatacagaattaattgaatcagatacagactgatcttcaagagaatttcaggcaaagaaagaacgtggatagtatgagtgaagaaaaacagaataccaacataatgcatctgtttttgtaaacatatagataaactcagggggtccacattgaagaaccaataacgatgcttcttctgcatttgaaactgggcttctaggggacagagtagaacccttttgaaggcttggaatttggtacagtgcgaaaagtgtatacaagataaaatcccaggaagtcttttaagctagttatttcatgttctattgaatttgtgtgctatattgaggacatagggcattataattgagtgttagcatcctagggggctggctgtgtgccctctaaatgccctgtctagccatgtcctctgtatgggaaggtcagggcacaagtcccttttgtttcaggggcaacagaccagcctttctcttttcctcccatccgtccatccatccatccatccatttatctattcatccatccacacatccatccatctgtccatccatccatccatccatgcatccatccatctactcttgcatccatctatccatttatctatccataaaatcattcatttatctgtccatccaaccatccatccatccattcatccatccatccacacatctatctgtccattcatctatgcaatcatccacccgtctatccacccatccacccattcattcatccacacatctattcattcatccatctatccatgcatccatccatccacacatttgtctcttcattcatctatccatccatccacccacctatccacccattcattcatccacacatctattcatccatccatctagccttctatccatccatctatccatctatgcatccattcatctatccatccatccatttatctattcatccattgatctatttatccatccatccatccatccatccatccatccatccatccatccattcatccatccatctatccatccattcatccattaatttatctatccatccacacatccatccatccattcatctatttgtttatctctctgtctgtccatccatccgtccattaatctatcaatccattcatccatttatctattcatccattcacatatccatccattcatccatgtattcattcatccatccatccacacatctatctgtccattcatctatccattcatccatccatctacccatacacccattcagtcatccacacatccatccatccatccacccatccatccatccattcatccatccatccaaatctatctatccatccattcatttatctattcaaccatccacacacccatctattcatctattcattcatctgtttgtccatccatccgtccatccatccatccatccatccatccatccatccatatatccatctatccatttatccatttaaatccatccacacatccatccatccatccatccattcattcatgcatctattcatccatccatccatccatccattcatctatctgtccatccatccatccatctattcattcattcaaccatcgattcatctatctatccattcatccatcaatccattcatccatttatctattcatccattgacacatccatccatccatccatccatccatccatccatccatccatctatacattaatccatttattcatctatcctcccaaccattcattcatccatttatccaagatggggagaaagcaggctcttattagtatgaagtgcattgaggggaatcgggggatgctgtatccgtgggtttttcccttcctgattttggccaagtgaaaaagaaatatttttcttttatctactctgaatatgtctacttgtttccttttcaaatcttcaaattcctctgccccattcccctttgatgcaataagaaaaaggtctgaataaggagggaagagggtgatataactaagaaaataattgatataacaaaaaataatgaatacaacagaacaaataaacccagagctaatatcttgtgctatgacctagtcacattcttttaatattttcctctatcttaaaagaaagaatagctgcaagtaagagaggaataaatcattttctaaaattaaaagttagtaggtggtgtataaatgaaaccaaagcccaagacatttctcctaattaaataaaatggaaataagactttaatcacaggatatctgaaaatcctgacacacttttagttgggattatcagctctgagcctcattagttccctataatcttctgaaggtgattaattaaacaatatgattatgaattcatagatttaaacgtgttaaatgtatttcagtccattgctgtttttatttatttttcttgatgctcaaatgatcccaactgtggtcagtgggcacctcttcatttagaattccatgttcttttaaaaattaactttttaatttggaggcagttgtagatttacatgcatttgtaagaaaaaacatggaaagatcggtgtacccttcactgggtttcctaatggtaacatctcatgacactacctataatgcagtatcacaaacagtattctgccattgatacagttcacttgtcttccaatttcccattttactgtgtgtgtgcgtgtgtgtatttagttttatgcaggcttagcacctgtgtaggtttgtgtattcatcgccagcactgaagcagaacaaccatatcacagcagggtctcttgctttacctttcataaccacagccattaattcctacaccactcccccgcaagtccctgacccctgccagccaccaatcaggtcttcatttctataattttgtcatttctagattgttgtatacatggaattatacagcatgtaaccatttgggattgactttttaaacttagcataattccctagagtagtatccatattgtgcagatatcaggagttcattcatttttattgctgaataacattccctggtatgcatggtccacagtttctttaaccatttacacattgtgggacatctgggttgtttccagcttttggctattgtgtcttctgtttctcttttcttgccttcctgtggattacttaaacattgttgagcatcctcaccctaagacatgattttaggatacccattctaaaaaataatttattgatactgtctttgagtgtatctttttgcatgatgttcttacaaagaacgtctggctctagatattacaatacagacatacacacgtggcttaccacagttcattggcattgagattttaccacttcaaaccaggtatggaaatccacttcgacttaggtccctttaccttctctgcttttaaatatcatcatcttgactatcagaaggtgttatgatttatgttttaatcatcaaatacatttcataaaactcatggaaaacagtatggtctgttgtattcacccacatttctgctctgttgtttttttcttccttccaaatgctccaagattccgtttcatattttcattttttaaagtttttcttcatctgagaatgtctttattttatcttcattcctaaaagatatttacattagattcagaattcacaatgacaattcttttcttacgtcgtgataaatgttaggctactttcttctggctcccagggtttcagatgagagatttgctaacctttgagtgggtgttccctagaggtaacatgttatggttctctggctgctttaaagcttttactgtgttcagattttagaagtttaattatggtgtggtttaatgtagatttctctcagtttatcatattgagtgtttgctaagcttcctgagtctgtaggtttttgtatttctacaattttaggaagtttttcagccattgtttcctctcatactctttcagttccactcagtttctcctctctttcagagactctaatgacaccagtatcaaaatttttattattgtcctataggtacttgaggctctgttcactttcctatcaatctcctttctccctgttgcacagattgggtaccacacattgatcagctgtcaggttcagtggttctctcctctgccatctccattcttctactgagaccatctagtgagttcttgtatttgcgttattgcattgtccatttctggagaatccatgtggttcttttttataatttctttttattcattgagattttctgctattttgtttgcttcaagacaatttgtaattgcttgttgaagcattttttaaatgatgggtgctttaaaacactagccaggttattccaatatctgatgtgtctcaatattggcatcaattgattgcttttcttaattctagttgtcttttctttggttatttttataatgggtggttttcaattgtatcatgggtattctaagcaatataataggagactttgagccctatgtaaaaatcttttatttttgtgggtagtcattctacttaggcttaacacacagatcttggcccactttgtgtgctgtggttccaataagagtttaattttggtttatctgatgcatctgggactccctgatgctgcagtatgaaaggacagatgagatttctccagtccagctgcctccatgttggggagatggagcctccagcagttggagaagaaggggacttcttaggagcccaggtctttgttgcatcaggagccatcctgctgtggggcagccagtgtttccaggccaggtcacttgatattgtggaatactccttgccctgtctcctgggtgcttgttgtggttcctctaccctcaggggaagaacaaccatttgcctggctattcattaccagtgtcatccgagctgatccccctgttggtgttgcaggggcagcttggtttgttggaaggactcctggtccctccagagaggcagcccagctaggctgccttctgttactagaatgttagaaatgtgaggtattttggctggggattttaatgtgtgtgtacgtgtgtgtgtgtattctctatttgcagtttttaaagattttacagatcttctacatgtgttgcattaataatgttattcaacctttgcatatctgtatgcatttttggttagtatagctggcgtttactgagtatttgctatgtgccaggcctggtgccaaggtattggaatactaatttgtcttaatacttacaagagtctctatccctatttttttttttttttgagatggagtcttgctctgttgcccaggttggagcacagtggtgcaatcttggctcactgcaagctccacctcccgggttcatgccattctcctgcctcagcctcccaagtagctgggattacaggtgcctgccaccgtgcccggctaattttttgtattttttagtagagatggggtttcattgtgttagccaggatggtctcaatctcctgacctcatgagccacccgccttggcctcccagagtgctgggattacaggcgtgagccagcacgcccggcctctatccctatttttattgaatactgaagctgagagttcaaggtttttctctgtttgctgtgctggctgcttttcagctcctgtgccattgtgagggtctcctagtgaccctagggagatgtggttagactctcaaaccctccttaagcattgtccctttggcatttagactattttcagtattaaatgtaataatattgcaatagacatcttcatggaaataactttatattttatttaaactatttccttaggatagagtccttttatcttgagagagtaaagcatgtgcatttgttatggatcagtgactgcatttttctgataccaaattattttataaaagtcttatgccagtgtactctgccagtagcaataaatgaaaaaatataccaattttattctatcctcaatagtgttgggtaccattaaacaagtaagtattagttgagaatgtatctttgaggaagaaatgtgggcaagcattgattaatttggtcagtatatactggggacatatgctgtacccagcagtgactctaacactggcgagacagcagtgaacaggcaggtagcccctggatggacagagtcaaggagagaggtttcagaggactcacctgtgatgtgagagcattggaacttttcatgttattgaggaaggcattagctggcctgcaggcagatctttgctctggtggccacatcatatacagtccttgttggaagatttatcttaatataacagctgaataagagacatatccaaatatgcttcattttgcaggctaattacaccttttatattgtggacaaactaaaaactttatcagaaacactgctggaaatgtccagccttttccagagaagtggaagtggccagatgttcaaccagctgcaggtgagtggttggtctttgccaccgagggatggggagctactgctagggcatgtccgagacatcagggctgccctgtagaagattctacagagtcacatcaggcatagtggttctagttgactcatataattgacataaaactagagatgtgtgaaaactttttgtgaattttcagtattttacccatgcaaaatggtatcgttgtgagaatgattaataatttaatagtaactttttctttaaattctttattaagcttaatgctttttagattgtttgcatatttttgaattgcaggtctattcaacaatcaatgatcatttctgcatattctgtattgataacttaatatttttaaaaggaacgacttacagtttagaatggcctgactccattagagtctgacaatcattaatataaaactttaattcaggtagatcacctaataattttttgggcatttgtgtagcttcaacttaccttaactctgataggatgagaaaatatgcctgcattttaattcatgtttagtttttttattaacttaccaggtaagtagttcagagtatggactcaggagctagaatcctttgagtttgattcccggctcaacccctgccaccagttgtgtgatcttgggctagtcactgaagttctctgtaccttgagtttcttccctgagaaatgaggaagcgatagtagttatgaggtataaatgggtcaggatacatggagcccttggaataggttttgacacagagaaaatgctactgtgtgagtctgagttttccaagaagcagatgccaagacaggattacatgtgcaataattttattttgggagatagctgctgaggaaaggaagaggaagctagacaggttggaagcaaggttgtcagtggtgatgcaagtctgaccctgaggaaaggagagagggagagggtcgggtggaagcatcctggtgggccctgcaatttaatggaaatcagataaggccgagagggagtcacagagctaaagtcagttatcaaggtaggggtcccatgtcagtggagtcctgtggctcctgggagtgggcctgatgtggtggtcattggtgagagacagcccatgggaggcgtggcctcagggcaaagtgccatggattcagagtgcagcagtgggccctgccatttccgtttcctgcagttggaggtctgcgatgttcattctcacagcgaccatggccatatgtattagctagtattgtaatcttctttaatttgtttgtgtatggattaatttgttaatacagacatcagcaaacctttgcagttaatgggacagatagtattttagactagataaggtctctgctgcaactatatataatctcatgcaatattataagcaccaagtcgagaatgtacaaatatctaggagaacataaaacagtgcctaactcggcctcaaaaatagggcagctccttgtgaagtctatggtgtacctgagtactacttactaagtagccatgtcagaaatcagtcacatgttcaaccagttgaagaacttatcttccaaaggataagacggcgtaagttgttcctctatttcttagctttgggatcatgctcaagggaactcgcagtaccttgggtttgtagtagtcgatgtgtatgttgcaggcctggttctgccactagatggagtggttagagtctctgaggaaagccctaactttgctctgcttccctgttccatcagtaaaagacaacagtaccctcctggggatgttgttgagattaaatgacatgatgcataataactaccctgcacattgactggcaaatagcgaatgcccagtgaaggaagataaataagattccaaaaaagaaaagcaaacaccaaactttcataataaaaccttgtcatccttagacaagattagttaaaactatcacatgtaataaggtgaatgtgagaaataaaagagctaattacaaagggcacatattacttgagaattcctatatggacctcttgtgctattaggttatgtgctggaccaaaatctggatagtgtacaaatattctccaagaaattggcaaattccaaaattaattcccagtcattgatcctgaggcagagcctggatacatcagtatctttccctctcagcttcttgttggttgttgtatgttgtaagtgtcaggcagtgcaatgcaagtacatggatatcaatggcaaaataaaggggcaagatgtcatgaagttgatgaaaaaatcttggagaactctccacagtaaacaatttgtctccaatcattgaaaaatgaggcaaagtcacaaccatcaataataacgagagaagaatggtacagatgaagcaatgaaagatgcttccgaagatgaatagccaaacattgagagagggtttgggaaattctgaaatcctccttcagagttttcataacaatgaccctctgtttacaactggcctctgggaaaggccatgcaaaggaaaggaatcttatagaaaggttcattatataggttcgtttgaaaattttgccaaaaacaaaccacttaattcattctttgtttttagtattaacacataattacaactacaacataaattttcataattgttgattttgtttttcaaggtaagcttctaataagatattatcctgttatttattgtggtgttttaaaacttcttttaagtggattcagtttatgtgccttgttcctttgtaatgaaactttgaataagtctaataagtattattcaataatacgaaataatgcaattatttttattaagctatattatttttctttaggaggccctgagaaacaaatttgtaagaaactttgtagaaaaccagttgcacattgatgtagacaaacttactgaaaaactccagacatacggtaagtgtgctgatgggcatggtagtgttcttctgcccatatggctctgccacttgggtgggtcctcccccttgggccatggcattgctaggtgacttccagcaagtcacttttcctctctcagtttctattttcttatctggatcctgaagggcttgaactaaatactccccaaagtttgtttcatacctgaagttttttcgattcactgattcaggacttaactagtaaagaacctagttaaaaaggaagttttctgattcaaacacaagaattgtgaattacaaaacaagtttataaaagaaattattattattattgagttaaaagtaacttgaaagccattgcatagatttgaaaatgggaagctcagataaaaacattacctatcagtaaacatttattgtacctctgcaattgatgtatctgtgaattcatttaggtgttttaacaaacatttgctggacacacgaggagagccagttccatgaaataatccatagaggggcataaaatattcctgttccaccatgcagtgcagagaagaagatgaccatgcttagaaactgcaacactgtggcaaaatcagcgatcagggccctgccagagaagctctcaggagcctaacccagttggtggggacctggagtcagagggaggatgggtgtcaggctgttccaggtccctggctccctcacactctgcttgtacatgggaaagggtttcggatctgccttacatatgaaagttagaggaaggcaagacattttattcggcataatatagtacttccctttaaaaaaatttctggtgaatgcaatacttaatattttacttcagaaaggttaatcatattttaaaatgtttcatattttaaatgcattacataattttttcaattaattaaaacacctttaaaagaagaagtagcactggaaagtttataataatagtgtccccatcttctgttgctggaaccaaggactgacatgggtctgagagatttcctgtgtggaacgcagatgtctcctgagtttgcgtctaccatggtgctagtgttaatgcagatgtcttagagtgtgaatcgtacctgagccacatttgttcaacatgttgctgcttagccaacagtacatttgaataggttttcccacatgtaaacttctattgtaaaattaagagaaagttccccagaaatttagaacttttcctacaagtgtgttgggacacagaatatgagattcacatggaattttgagatccatgaggtgtgatcctctcttctttctgcttccgcctgacgctagagattgaagaccatatcatccaggtgaatgttggttattttccatccgaccctgtacagccctctgggagcaggcacagagtggggtcaggcattcacgggtggggtggcggtgggggattgatcactgaccagatgcaaatctccttttgtaactatgctaacaaatgaactcaccttactgcatgcacccttttaaaatttatacctaggtcatactcacttttcttcatcctataaacagtacctggaaactgaggtgactatttgaagatatactgatgcaacttttgggaatatttgcccaatcatgctgtcatttttattcattatataactttcattttatttttattttttttagacaagagttttgctcttgtcatccaggctgtagtgcaatggtgcaatctcagctcactgcaacctgcgacttctgggttcaagcaattctcctgtcccaccctcctgagtggctggaactacaggtgcgcaccgccatgcccggctaatttttgtatttttagtagagatggggtttcaccaagttggccaggttggctcgaactcctgacctcaggtgatcctcctgcctcggcctcccaaagtgctgggattacaggcgtgagccactgcgcctggcctcattatataactttaaaaaataactttttgctttattacaaaaagtatatatgtctgttgtagaaacattagaaaatacaaataagccagaaaacaaatccacctataatcttatcaccacagatagctattttaaaagcctcggagttcttttttaggtgaatttatatgtactcatatgaagataagaatatgtattttcacaaaaatgattatactgttcacataattttgttacctgagtctcctgagtttgcatctaccatggtgctagtgttaatgcagatgtcttagagtgtgaatcgtacctgagccacgtttgttcaacacattgctgcttagccaacactacttttgaataagttttcctattcaaaaattaagattattataaaagtttttcatatctataaatattgactgttactaagaaaaagtcccttcatctagctctgccttccatttcactccatagtatgaatttaaaattacttaggaatttctttgggatcggtccttatatttctaactgatacacctacggcagtatttcttgatttatttgttacaggaattatcaattgatttcttgttctgaaagatgcagatttagttttgtactacatcatttccctgatcagttgctcccactatggtaatatgaccattttagtagttataaaacagtatgaggagataaatgttgttcagtgcagagtcaggctatgcattataatgacattcccttatttaccatgtttcccttttcctagagtttcatgctctcttgctactacatgaaacacctgttctccattgctcccagctctgtgtgccaacacatcacctttatgttgagtcattttgtctgtgcagacgccacccagaccccctaccatgctccacctgggcaggctagccgctcctgccagcacccagctgctttcctaggaattctctgctctgctctcctggggtggataccatgattcctgggctctaggtcctcatttttgttttgttgtcatgttttgtgggttcatattaatcagtgtagtcttgaaaaagagaatgagagaaaaaattcctgagtgattttactcagtaaagtaaaattacatctgaatgatatgtggaaatatcctctatttcattaccaataattttgcatctcttctttctctctcctttttgcttttaatcagtcttgtcagagggttatcaatttttattagtcttaaaaaaacccaccgtttatggccttatatttcatttgatttcattgatttctgctctctattggttttttccttttgccctgtgtgtgtgtatgtgtgtgtgtttggtaacttcttgagatgaatacttaaattattcatgtccaccttgtcttcttttcttttctgatatatatatatatctttctgatatatatatatatatctttctgatatatatatatatatctttctgatatatatatatatatctttctgatatatatatactcatatatatatactcatatatatatattcatatatatatactcatcactagacacttccctctggcattaccttaactgcatctcactaattttgatatcttgtattttcactctcattcagttaagcatattttaaacatgtggtgtaatttcctttttttttcacctttaggttatttgaaagactatagcttaatttctaaatatttggtattatttatttatctttgggttaatgacttccagctttacttcacagtggtaagataatgtacttcgctaatacgatttcatttgcttaacatttatggagactcactcaatccttgcacacagggtcagttttggttcctgcattgttgggtgccgtcttgagcatcctcactgtctccttgttccatcagctcttaagaggtgtgtgtttacatttctcgttatgactgtgggattgcctatttctccttgaggttctgtccacttaggctttatatactttaaggctgtattgtattttctgttgaggacttgtttgagacatttatattttcctttgtttgtatttaaattatcttccagcctctcccccttcttttacttctttatttctttccggaagtttttctgtgactgacttagttatggtttcttatgagaatcctcttttggctctgtagcatttcttgaatcagtggccaaatatcttatatttggggaaagtcttggctactatcttttgaagcattgcttctgatcacttctctctctgctttcctctgcaactcttctaaacaagatgaaaacttttcacagtgttcaatgcttcttatttccttttctatataatccaacctattttctctttatacttcagtttgtgatttcttttcttactagttttttaatcgacaaattctctcttcagctgggtctaatctgctattaaacataccaatgaagttcttcatttcagttgttgcattttccgcttaaaatttaaattttcttattttaaaatagtttttagctctctggtgaaagtctattttcatctaattttggacacaatactcacataagtctattttcatctaattttggacacaatactcacattttggaagtgcatgtttgtgagctttaatacttgtcttttgtgggtatttttttagtctatttttctcttgcttttttttttggttatttttcttgtcttgtctccaggaatattaaggattaaaaaaattgaaaccagacattataaatggaaaattgtagaaataaatttgagtctcctgatagtgctatattcctctagataatgttattttcctgcttgtggcagagagctagggcagggccacgttttcctaatccatttggggatggagtggattgatggaggtagacttcagccttagtagggaaatttccagtttcctgtactcctggatagattccctatttgggtggggtggggatctcacctataaagctgataccgattagggcccatgtagatccagagctcaaagtcccgtggaccactggagactcagcctctcagtttttggcaggatcaaataccaggcttcccaaggttctcttttctcttgcatctctgacctttgagcttttgctgccttggtagctctttaaagtctttatatagattttcttttttttttaatttcaatagggttttggggagcaggtggtggttggttatatggataagttctttagtggtgctttctgagattttagcgcagccatcacctgagcagtatacactgtacccaatgtgtagacttttttaaacttttaaactaaagtctttatatagattttttaaaggccattcatattttctggttgttcttggaaggaaacttcatctgccccacattgtcctccattactctaagtggggtttcctcaatatgacctttcaatctgaagacgacagctcttcaattaaggggagttttcttgtcatcatttctttgatatttttacctctctataaaaataatgctattttaactttagtttattttaaaattactattactgttttctatttgtttattttgagttctctctttcatgttgaagggttcacttaaatgtttggtgatattatgtgtgaagcattaaaaccagactgaaagtgatttggtgagtagaagttattgtgactcagttcatatcagtagttctcaactgaggatgattttgtcctctaagggatgtgtggttatgtctggagatatttttggttgtcacagctggtcacagctactgccacctaacaggtagaggctaggggtactgctaaacatcctacactgcatggaacagccctccacagcaaggaattatgtgcccaaagtgtctgtagggcctaggttgagaaactctcatttagagcaataagatggagtcacttcttgaaaacaaatttcaggaggagacacgttggaatgtcaaatcctctggtctgttttggctgatgcctgccatgtctggggtcctcaggtatatacactgaatggtgaacaatcgttaacttgtattattctctggggcttggccccacattagtgtagaattttatactatgttgttttatgtccacctatatgtgaacctcagtattgtttttgccctttcagacttaaagtagcctgtgtttctttaccacatagggtttcacatgggccctatgtgtttttcttggctcatttttcctatatattgtgagatgaagcaacccaataagagctgtgattctaggactcttaccagaggctttgcccattcgtgtcctgtcctctgtaatccatctttctctcatagcagtgccctcatcatttaggttggggagtgtactcaaggtctccaaagtgatggaacatgcagttaatactagaccacattttatttttattatatctagtccattgtgcaggaactattacccaacaaagatattgcttctttcctcccagaggagggagatctgcccagtgtcctaagacctaagagtttttgtgtggagctgcttttctaagttgtagttaatgccacataataacattttagtcaacattgatctgcatacatgatgatgttcctataaggtcataatgagctgaaaattcctactgcctagtgactttgtagctgtcagcacattgtagaacaacacattactcacttgtttgtggggatgttggtgtaaacaaacctactgcactgccagtcatataaaagtctagcacacacaattatgtacagcacgtaatacttgatcatcgtaataaactactgttattattggtgtatgtgtttaattcaattcagagtgtacttcatatatatatttatgagttaagtgtaaagcagcctcaagtaggtccctcaggaggtatccagaaaaatccattgctagcacaggagatgacagctctgcgtgtgttagtgccctgaagacctccttccagtgggacaagaggtggaggtggaaaaaagtgatattgatgataatgaccctgtgtaggcctaggctaatgtgtggttttgtgagttagtttttaacaaaaaatttaaaaagaaagaaaaaacctaaaaataaaaacaagctagctcatagaataaggatgtaaagaaaatatttttgtacagctgtacaatgtgttttgtattttaagctaagtatgattacaaaagggtcaaaaagtcaaaaaattaaaaagtttataaagtataaagttatagtaatctaaggttaatttatttttgaagaaaaatttaaaaaataaatttagtgtagcttaagtatacagtgtttataaagtgtataaagtttataaagtgtacggtaatgtcctaggccttcacattcactcactgctcactgcctcatcagagcaacttccagcctgcaagctttattggtgagtactcaatctaagtgtatcatttaataccatataaaatctttcatatcatatttttattataccttttctatgtttagatatgtttagataaacaaatccttaccatcgtgttacaattgcctacagcattcagtacaataacattctatgcaggtttgtagcctaggagcaataggctatgctatacagctaggtgtgcagtaggctgtaccatctaggattgtgtaagtccactctgtgatgttcacacacgatgaaattgcctaatgctgcctttttatgccgcatttctcagaatgcatcctcatgattaagtgatgcatggctgtaagatgtacctatgtctcccaattatatgcatgataagaaagcttaaagccttctccaaagcagttccagttctgctactggaagataatgaaagtcacactatagtgagaccaagtcactcttcactgtgtttaacatctgctgttttatgcagttaaattgtttaaccacgcttgctaggcaagcttatagtgcagcctattccaaataacaaatggtcagcaacacacagatacagtagaaaaatgtctccagtttgccctacaccgagaaatttaacaatctccacttctccattaaaaaaaaaagccccccacaatgcacaatatactttttggttttctattttctagttgttatgcttactttcatgcagaaaagttaattaaagatattcagttggagcctcgctctctccttatagctgttacatgataatagttagcacttactgtaaatcagtttatagtgtatatataaacttcaactacatttacttttcacagcaatttcatgggtaattttgcttttcttatgctacagatgaagaaagtgaaacttttatagattaaataactatctaatgtgaaacaagataaatagtgcaattgccatgggagcaaagccatgtcttgtcagctttgaagcaccagtgacctgcactcctggagcagtgacagcaggggtcaatgccacttctatgttcccaaaccaggttaccccagcccatgtatttagtgggtcttgctttttgatgcctcccatggctataattgcccataagaatatccaagtttagcctcatacccacactatttagaaatcagaagaaccctcaagggagttttcatcacagccattgcataccccataagtaccagtcattacagtagcatttcacagcactgctgtctccagaacctgatacctcaatacttctagcaggtactaggtggtgttccagggcccatggaaaatcatggaataaacatgatgaaatgtccaaaggaatcacttttgcagcaacattttggggaaaatgagacataattttatatactgaaacaaatgagtagactagtacaatataacattttcacacacaaaaatcagttatttcacggaattttcaccttctcaaggctcatccaggatcctgtcttcttctcgcacacccttgtatccaccctcctccctgggtggagtaatttgagaagtgcaatgcaacaaggcaccgtcagcacagtatgctggagtcaccagccaagggctggttcagagatttggtgccatcttaaagaaggaaatagatagagaaaacagacaagaaatgttaagaactgctggtgtcagcactggctccgcatcagccagtccaggccagctgtccagccccagccctctgtgttcccacagcagataaattgggatgctgagtgtttcattttggttaggtggaggtggggctggaaatctggaaagtcccctgccacacaggacattgctttgtgctgtgctacctgaactgttattggagtcttaaagcaagataaaggcagtggagtttgtctcctcctctactggaaacaattttatatagtgtattaataaccgttatactaggaaatagttattgagtgctctctatgtgccagacacagtgtcaagcatgttacacattattctacttcatctttggaaaaagaccattgagcagatgattatcatttcccttccataaagagggcgaggattattcagcctcagatgcccactgaggggtggtgagcaggcacccaactccatctgacccatagtccacaaggcccagtagacggtggagatcctgtgtccctatctccaggccaaatgggcaccatgccaagataaattctttaaaccaagccacatgacctcttgttgagtgaggtgggctggaccagactgctagccaccctctaatccttccacgtcagtgctgagggaaaggcctcactggtgggccttacagtggctcggaggctcagaacttttccaaggaactctgagatgctgtgtcccagttgggggactccggggactcatgacactctgaggcagaagactcgacgctgtggatccttctagctcctctttgattgtgtcatccaaacagccaaaggtccttttctgccttaaaccttagaaagtgttgactataaaactaaatgagaaatgaaaactgctgtgcaattacatgtttctgctattgacgccatttgagaactctggcttgagctattttcttctcactgatttttccaatgagcgtgttttattcttctatgaattcagtttgacggtcttaacttaaccaggcccttcaggctctaccaaattgggaattacaggaggatttctatgagatgtgtgtgtgagctctgatggcaatagttaattgatcttatttactaaatggctttatgccttttttatatcttttatttctctctggaaaacagtaccaagattttcattctttctgaaatatagatgataaatctcaggcttagagactggctctttcagagccctacaatatttggtggaatcaagaacccaattctttgaattctggatcatgtaattcttctactatgtgttaggcagggctgtctggaattcctgatgtttgaatatttttaacacacagtaagcagaagtttcatatggttccactcaatataaatgcagcctggtgtatttgtaagaaggtggacccaaaagctagatggcatgtgtttgaatcatggttttgaaacttactggttgcttatactctttgtgccttaattcctatactttaaaatgaacatgccactagcaattccctatagatataagggttcagtgagacaatacacaagtgcccagaattgtacctggcacaagactgacactcatacagtgacacttcactattattgtagatatttagcaaaagcttaattatcagaaatccagccttcccaaatccttacactcatgtcttggcctgagatcggcaaattactggaacataataacagcagttacaacataatgaataacagtcttttctttgagaaactgtgcaatgtaggttgaggggatgaagggcagaaggagcccgacacttcttgatgttgtttggcagcttacatgttctcatccatctgaagttggcagatggaaactaatctttccttaccagggaagaagttgaggccaggacatgtcaactgatttttctacagacctcaggatgatggagatgcatcttcatgtagtttcttattcagggctggcccccctttacagagccccaacacccctttcaaacatgggctgggtgccaagcaagcaaaacccagacttaatccagaaaccttggaagccaggaggatctgggagcagggaaaccagtagaggagggaagcaagcatgagaggcagaggcagctgtcagtgggtactgatgctgccatgtccggggacaaatgcccacaggatggcaggtaggctccaagcttcgatggagggtggaaatgagcacagggagcagctcacatcatttggaaagttgagtgttcaggaggtcagtgagatacaggagggccagcaggaagcagtgactgcacacagggccagggatagactgttgtctgtcaccatacatctttcctgctgctttccctctggaggtcatgttctgggcattcccacgctgccttgctctagatcatttggtttttccagctccttcctgaaaccagagtgaaaatactgagatatcctcagccttttgccctgaaaatgtttgatgtcagcattcatagccaaggtgttgcgactttactctgctgctctatttatgtttcgaatgcacagatccaggacaaagactacacaaggatttggtttcctcagtgtccatgctccttgataattgcttttgcaaaattaatttaataaaatgactttcccaaaatgactgcttcagggaaggcgtgttttttttagaattgcttgactccaggttggaactttttttttcccctgaactctctgtgagagggtctttcctatcacatgtagactttccttctgttgtttatcctgttgtctccaactgtgtttccttaggctgctgtattaccctttgtgctttaactgtttttttttcatgtacatgtatcagtgttacagagcatgtgtataaaagtgtagagtttacactcagcaagtaaatgccaaatttcacatatgaccaaaatttgactcttttgagcaattttttagtggaagaattcatattcattttcaaatccatttgcacaatctccactatatgagtggtaagcactggggggatacagaagttgatgtgtcctaatctgttcactttcctcaggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtaagtactcaatgaaaaaatatgttcgccaagatgccaactcctgtaagttgtcattttgggagtttctccctaaaggtgtcttatgatagctcagaaagaaaagaagtcctttccagataaaacataaaataaagcagaactgtttaccttggataaaacataaaatgaagcagaaatatttgccttggttaatgaaaagttgtaccttatgccatagtgactaataacgttttcaccatcctaggaccaatgctatttactgcatctgcttttacccttttataacatcatgttctagttaaatctcacaccataagttatattattcccgattaaagttatactctaatttcctgcatcacctttccttttatcagagtatcttgatatcctggttggggcggagagcaggcaatggccaactctgctccattatttaattgttcacccattcaagataaatatggtggtgctctcatattcttttggaatacacattgaattatttttaattgaggttttgtattagtttcttaaggttgctgtaacaaagtatcgcagactaaaacaagagaagtttattgtcttagagtgctggaagctagatattccggatggagacatccactggtttttcctgcgggctatgaggagagaatcttctctaggcccctctcattggcttgtaggtggccatcttctccctgggtttctgcacctcatcttccctctatgtatttctctgtgtttaagtttccctctttttataaagacaccttcatattgagttagggcgcaccctaatggccctcattttaacttgattactctttaaatgttatctccaaatatagtcacattctgaggtactgggggttaggacttctacatatgaatttagtaagggacacgatttagctgtgataggctttatgcatacaattcaaagaatccgtgtggcataaaatagaatccatgtatttaagttatgaatgataagtaaccccaaagagatggattctgcacattgagttaacatctgcaatcaagagaaaaaaaccctgcaaaaaacatctgacaaataatttctttgtgttgattataccacagtttgcttttatgaaaaatacaaagcagcactggacagggaattaagagatcttggtttaggcttaccaccaattgcctgtgtgactgaaagtcagctttgccactgcgggctggggctctgagtctgcaggagtggagggctgtgagtctcaggctcctgcaacttttcctgtctcacccagtgtaggcgtggtttgagccactccctacagtgtggtaatgcttcgtttttccttttctgccactaggtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctgtgagtagcctggggcaggagccaccgacagtgagaagggccttgcatttgtctagctgaggagagaaaactcagtttttctatggttatttcaaaaagcactgttaaaaaagttcaccccccactttttaatttcgtaaggttcattttttttatatgcttgtactcttcaggtagaagaaatataatggttgagataatacaatcaagtgaagttttaaatttgacatcaggcatcatctatagttttaaatacacttaaaataaatttgatgaataacattcacaagggctgtgcatgtccaacaaaagattccacttacctaaccttgggaaaactgagggaggttattttctctgcagtgcaaatccttagatataggctgtatactggacagggtggtgaaggattccatacaggccttgaccatggcttgggtacccatgaagtaatatgagaacatttaggagtttgattgtgtaatttggctgctgacatctataggaagaggggaagctcagtgaagggctggagcagctggacaagaggacttggaggggacatcatggaggcattaaaacagccatcagggaggccaggcaggggatgtttgcagagaggacgggagactatggtcggactggggctcagtgaacctgagggtgagcttggacaccttggcaggttcagacaatgaacagacttcaaagctcaccaaagcggggtgagccgtattgctgtgggctgtggggctcagcctggatttcttactttcctcatggtgcatactgttctcataagcattctgctcccacagctggcctggctctggataatgtaggtcattcatttgcaatccctgcatgctggctctgatgcagggcctcaggaaggtaccaccttcctaccctctctcaaaagcacactaggaagtaagtggctgaacatgaggctactgaagggaccggtttgcgtgttctcttagttatgagaacagggacaagtactcatccttcatcgaaacactgccagtaacaactcatggcacctcccacccctgactggggcagagccatggaccaccaagcagaagtcaggactgcctctccaggtgactgggcgacacacacgtgaggataggtgacttgatgtcttgacccctccttcctgtctagtgataggctgcatacataatagcacatccacacattttttatgaaaatgctggttgtacaggaaggactttcccacagtgggaggataaaaggctgaagaccacctgattgaactcatcttgggatagcctagtgtggtgcggtgaacaaaaggtcaggaagaaagagactaaggcgacattttcactcaggggctgccttgttaggcagactgttagtaagcctcttaacttctttctttgtaaaatgatagcttttctttcttttcaaagtgatgatatttttggctatgaacattttcaacctgtgattttctgctcctaaagcatgtttcttggaggtgatagcagcaggagcagaaccgaagaaaagtgctgttgttggctagttgtcatgcacagacacttcatacccagtgcaaacacctgagagctctgagaattagtgatctgtgttagatactgggagaagccgaagttttattatgctcattttctaaaggcaaacctgaaatctattgcattctgacaatctccttctagctccaaagtatgctatgatctccacccatgaaagagcggggttgtgcttacgtggatgggaacatgacaattccctctgctccggttcacaggaggagactgggggtttactttgtccactctgacataggatatttcccaagaaggcacgatgggaagaacagcatacactcctacaaatgtattgatggaaatccagaaatggcctgagtaatcagttttcaattcctactgatcatagtgtatggctaacagacattgcaagagagctagaaaggaggaattgagggacatggatggagacatattttttcaccccttgaagataaattctgatgtatgagaaacattccagcctaaaacgttggaatgagtggaatacccaggtatgattctgatctcatggaattacctctcttattctactactgggatacagcaatataactcctcagaagtattgctttatttctttgagaaagatgaagaagtattttaattctctgaaatatttaaatctttgagatttctcactgtgctatatccatcttttatctcttgtttcgaagtctccctttcttgagggcttagagtacctgcagtgattgaaacacagtctgagatctcgaaagaactcagtcacttgagtaaaaatcctaaagcacagtttgtactgtagacaatgtttgttaaaatttttttagcagtttcctcctgcttactgaatgagctacatattcattaatttatgaatttattcaatgacttttatgtactatttgtcagtctctagactgaataagtaaagaaaataagtaaatcagtaaagaaaataggtgaatcagtaaagaaaataggtaaaaatccctgctcttgtgagacttccagtccagggaagcagaggtgccacaaatacaattaagaagacaattgcattgaatgataggaagcaggaagtgccgtggagctgggaaataggatgagcagggtcagggacactaggaggggaagatggaattgttaatgtggatggggtagaccctatcaggaaggtagcattttaacaaagacttgacgggatgcagaagcacaaggggaagtgtgttctagggcagaggaaccccccatgcaaaggccctgtggtaggagtggcctagggtatgtgtgaagagtcaccagagcagagtgcacaagggcaagagggtgggagatgaagtcaaagagctgattgtagattgcatggttgcaggtgactggagtggtattaaaagactgctggagagtttcgagcaggagtgatgtcatcatctgacttatactgtaaaagtcttgctcacgctgttgggtggaaaagagcttgtaggggtatgtgtgggacagagaaatcatttagaaggctgttgtaataacccaggtgagagatgatggtggcttggtccagtgtggtagcagagaagctggtaaaaagtggtctgattcttggttgcattcaggaagtagaggcaacagaattgccaaaagatttgatgagggcgtgatagagagacatcgaggaagattcccctattttggtccaagtaactggattgctggaattatctctaactataatagaaaaactgtgggtagaggtttggaggataaggatagaaactcagctttggacatgtctagtaggcagatttgttcaggaggctgggacaatgtatggatctattaatttaggagtctccccgattttgatggcatttagaactctaagatattaccatgggaaggagtatagatagaaaaatagagagggccgagaccaaatgtggggcccctcccatgaagaggtaaatgagaagaggagattgagaaagtatcattgaggcaggaggaaaacctacagagtgtggaatcctggaggtcaagctgagcaaaagactccaggaagaggagtgatcaagtgtgtcatatgtggctcatgggtgaaataaggtaaagacagataatcgaccattggatttacaccatccaggacttcatagagagtagcttccatgatgtggtgagaatgacggccaaattagagtggacagaatggagacttggaggggtagaattggagagtgaactcagacagctctcaatgggaagaaatgggaggtgacttcttcttcttcttttggaagaagtcttttttttttttttaaatataagatgctacctggggaatagtccagtaagatgggaaaattggtagtgtataaacgggggggacagctgtgtcctgaattagtcaaggggaagagacctcaacaagtggagagacctactataggtgggaacatggcaattcacctgtggtaacaaaacctgtttaactctatttaactaaaaattttccacttttcttgcacacagatctctctctctcctccttttatttttcatgtagtatctaccagcagctcatggaactaatgtcctgaaaggcatgcattggaaaatgttgctggagactgtagagatggataggcagcagcagtttttgaaattgcatgttcctatcaaccccctgattcataggcagttatcatagaataattttatgattggaactgtagtgtgtacttcatgaatataaaggaattcaaatgttaatgtgttgcttcaaagaataagccaacttaataaacaggttttcagaaaacaaaaaccacaacaatatcctgggattgttttatatgcacaaagaatatttatttgaaaggtcacctgttatttcctctattgctttttggctgcttcaattcccaccaccctggggtgggttcaagagaaggagaaatggagcgtgctgggtcaggctgagtgatggctcccgtgaggcgttgcatctggactttgatgtgtcttgggcaaagtggagagtgaagggttgacagccactcatgcttgaaatgttgaattcctgcttaaaaaaaaatcagcttgatccacaacagaccagtgagaggacctctcattttatttattttgattgtttctcttccttgggctctacttcaggtaactttattaaacacctctctcttccatttagtcaatagtcattgttctcagcagaaattcccattcttgatgaccctcagcgctcagagctgctggaagccccctctgttgcccgcaggctctgtcctgtcccaccaacgcaggtaatttgttggtgataccaactgtagtgggaaggagaagaaaaaccctcattaaattttacaattcttcactttctcaagccccacacagctcttacaaacttatctccttgctgggcagaggaggatggtttctcattaaaacctcagcaaatcgtttctccaatttgtctatgttctttccctcaacagcagcaaagtaatctcttaaaattgtatcacatttaaaaaaatcatctcacttattctctaaaaaccttaaaagtacagtggaagaaattgagacgctgatagggtaagttatttcccccaagatctcacagcatcttaatacccctcactccccaaataaactattaattgccacttgctacttttaagcactttgtgcaggatgcttggtcacttggctgccatttcactccattgtatttgaaagtctggtatgttttcggccgggtgtggtggctcacacctgtaattccagcactttgggaggccgaggcgggcagatcacaaggtcaggaattcgagaccagcctggccaacatggtgaaacccggtttctactcaaaatacaaaaattagctgggcatggtggcacgcgtctgtaatcccagctactcgggaggctgaggcaggagaattgcttgaacccaggaggcaaaggttgtagtgagctgagattgcaccattgcactccagcctgggtgacaagagcaaactccgtctcaaagaaaagaaaagaaaaaaaagaaaggacaggacaggacaggacaggacaggacaggaaaggaaaggaaaaaggaaaggaaggggaggggaggggaggggaggggaggggaggggaggggaggggacaatgcctgcctggcatgttttcttatatcctagccagagctcagatttgagcagtagttcttaaccttggttggtgggagtttggaagtgtatggggtgttttgatggtaacagtggggaccagtgtatgtttagtgcctaagggccagtggtgacaattgttgtgtgataaatgacactgtagtgtgcaatgaagaatagtcctagccaaattccaaaacaccctcatttagatccactgtttgctctgcctctggtaaattatttcaagggccttcatcattcactcatatagttattcctctattcatctatgtagaaacattttgttttcatattcactgtatgacacacattctatgctgggatggatgcagagatcagcactatgcagttcttgaggtctagaaactcactgcttaatgcagtagttagtgtacattcataactaataaggggcgaaaagggagatacagatactgtaaaagtggcagcactgggttgctcacaattgatttcatgccttcctctacctagtaaaatataggagaatttcttggtagaatctgtatgacctgagagtctgaattaaggtctcaaagtctccttctttagacatattggatcttgacagtgcatctcaccttctaagtttatccgatctctttcgagcttcctggatccctttagagtctcagacttgacatgatgacagaactgggatgaaaaaactgcatttgggtgccagctttgacacttgctggttcgcaggaccttgggccagttttgcgccagctttgggtgtcggtctcctcagctcatacggggtattaactgctgtctgcccagtgcattggcttgtagtgcgcagtgaattatcctgcttgaggagaccttgagacttgtgaggggcaacgccaggcactgtgaatgggtgggatgctctgagtggcagcccactccattcttgggcagcttcaaatctgagaaagttcctccacctactgatgcagaaggtcaatctgcatgactctggcaatggctgagtcaggaacactagagtcttaaatgccccttacttcaccttccctgacctccactcacctccaattcacaaatcacgtcagacttcagctggctgtgttgtgcggaaggcagcggagacagagctagcaagtgacaggggcaacatgagtgtgcctctggttccatgaaaaggaaagggaggataaagggagagagagaaagtggaggccaaatgcactggtccttctcttcagcagttgcccccagctatgtcctgtctccccatggttgatgtggactggtcctgggcagtagtggtgatggaggccggtggagaggggcagaagcagggaagggcagaggccgggctgatgtgagaggtggtggctggaaatttgcctcctccctgcacttgcctcaaagtcctacatcctgagaaaacaaaacaaaaaacagacaacaacagcaacaaaaaccagctgatttctcagggtggttctttctatagtaagactttggtccaacacgcccatgacttttctgtcattgcactcactgatagtgctgacagaggcaagtaacagatcaaataccaggagcaaggcttactaaaatggaaaccaaaaagtccacctgcagaaaaagcaatggtgacaattagtgtttgtgaagatcagagtatccctttagaaaggcttaaagaagtaagagagtttaatttccttttttgtttttacttttattttattttattttttattatactttaggttccagggtacatgtgcacaacgtgcaggtttgttacatatgtatacatgtgccatgttggtgtgctgcacccattaactcgtcatttacattaggtatatctcctaatgctatccctcccccctcccccaccccatgacaggccccggtgtgtgatgtccccactctgtgtccaagtgttctcattgttcagttcccacctatgagtgaggacatggagtgtttggttttctgtccgtgtgatagtttgctcagaatgatggtttccagcttcatccatgtccctacaaaggacatgagagagtttaatttcctaatggtataatttatagatagttctttgatttgggttccagagaaggggaaacatacagagaatattctcgattcttagtttgattcatgctctcctgataagaggaaaatcctatttctgaggttactgagacatccctgacctttgtgtgtatgttttttatttttagttctataaacaagtgatattcaagagtgaagaaaatagagaaaataattcacacttaatatcctgttccaaatagacacttatttgtttatttatgttttcttttgggatgagtccctcattctttgtcgttgtgattcatgttttacaaactagaaatcgcaaagtcttgccaagagttagcctgaaagtttttgtgctacatactcatttgggaactatttacgcagtacttattatgtgtcatgcactgtaatcgcatgacatatgtagtagggaaagatgtagtcctgccttgaggaagcttggagagcagggattgttatgaccgtattaagatgagacaaccagcctggacagcatagcaagaccccatctctacagaaaataaacaaaattagctgggcgttgtggtgtgttctgtagtcccagctaattgggagggtgagaggggagaattgcttgagcccaggaggctgaggctacagtgagcccagatcatgccactgtactccagcctgggcaacagagtgagaccctgtttggaaaaaaaaaaaaaagacaagaaaactacgaatgacttaaatctgctctgctgtgaccccgctctagtggagactgcaagggacgagaatcacagcacctctttaaaacttggtactcagtgcagttgttgttggtgatacataatacataatgcttcaactttaaatatgaaccacttccaattattaagatcctagaagagagaaattaaagtcaaaaaatgaaacaattttcttctctccctttctccctactcatcctccttcattcctctctcggtgtggttactcctcttttaacatgctttttccttattttaaaaattcatgatgtgcaagttatttcattcttttcttatttgacttctgttttctcaaagaaccctatttggacttcatcaattctctcttttgtctcatctaactttttctgcttttatttttattacttccttacttttctgtatcttcaatatattcttttataatttgagactaaagtttaattcattatttttagtttttttcttaaatatttgtagttaaatatattatgtaggtaatatatttaacataaggtaatgactgttctttcaactcctaccttatatcccatagatctcatatgtagctaacaatttattgttttctagatgcatgcagtacaggtttctattttctctttgacccaagagctgtttaaataaagcttcttttaatttccaggtgaaaattctcaagaattttaaatatatgaaaaactatgtttacacagcttacttgtaataagaaacatacaaattaaatctgctttgtaatagtatgtttttacatatcagagggacaaaatacaaaaattgcattatatactaaattgccaagttctgttgctaaatcttaatttctgaattgcagtcaaaatatgattcttattatttctgttttggtatcaagtaatatataacccacttttgtgaatgatttgtagacacttgaaaagaatttctaattccctattttagggcagagaatttggtctgtgttatttttgttatgtaggatttttctatccttaatttatgtcgtcttgatctgtcttagactgggataggtaaattatactcccttattacttggttgtccttctctctttttcctgtggagtttggcttttggatatttgtgctttgttactgtgtgcattactatgaataattgtgtcttttaatgctttgtggacataactctaccttgtttgatattgaaatggtgaactctgctttttttcccttctcttcactcttcctcttcttcttttttttttttttttttttgccttttggtgtttctatttgcttgatatgactttgcccatcctttcatttaaattttttctgaagcattttgtttcaagtgtgtctcttgtatgcattatatagcttcttatatatgtggccttaattctttgatagtataaaatgcaattataaattatatatagtcttgcctctatcttgtgtttcttatgcttataatttttcttttaagctaatatttaataatgttttattattattgtagtggttaccttataattataacattatataagtaatataaacccttgtttttttatcacaagcaataaaaacttaaaatatgttctcttatttcatcatatattttctcttgtccatcatgcaattttagctggtattgttaatcttacttaatgttgccttttgtactgttaaagacacttatactaatattctacatttgccaatattttaaaaaatagtatttgagtttggcatgcaccaactttttcttcgtctctaactcattccccattatccttccatttgtttttcatatcatttctgcatttcagggaatagtagcatttccaatctgtcttgtaaccttaattcctgtttttgttttagtcttgcttttacaggaaaatgtactcattgcttaccatcagccctttcactgtaatttaccagtcatcatttggcgggatgaagtttgccatctagtaatttccttaagaagctctcataagataatataacctgaattcctacatacgtaaaactctttgtagcatttatatttgaaggacatcttggctgaatagaaaacccttggttcattccttccttaagtatcctgtaaaaattgtctttggtcttaaatgttattatggagaaatctggggccacattgttattttctcccttttatataacttggtaattttggcaagctgccagtagcttgaaaacgcaataaattttataagagtatgtttcattgttgaacattctaggacaattttctatgatgacaagacaagtcctttggatgtgtagattttaattttttttaatggagactcttgatgtattctagctttgcaaatttagaaatacttagtttttctttttcagggagtttaattgcctgcgtttcttttccctgtgtttctaatcaatagatttttacattttaaaaaactctattcctgtttcctttagttgcatttcttgcacctattttctacatcccttactgtattttgtgcagtatcaatttggcctgtgtttcttccaattttattctcctttgtctgatggctagtttttttcacatattttttctaagttcttccaattcccattttatatctttctgctactttaccatctcattaactcaattctaatgattgtgctgtgtggtgtttcttatagaggggcttgccttgtttaaattgtttaaatatatttaaattgttgacaaaaagtatgttcactattatcatctgttcaatgagaccaactttttcgcatgggtttttcacttgttaataattatgcaactctcaatctctttttatttcttgcccaaatgttgtgctaaatttttgttaccgtgattgttactcatctggaatgaattggatattcctgtccaggtatctgcaagagggtcctggtggtggtgaggaccaggtgccattaatgaccttacagctcaaaagcttacttttccattgccacaaagatagagtgcttcctgaaaacatatggatttctcacatagcctccgtcttctgtttccctggaaatagggtctaggagaaggcttctcacgctagtcaatgtaacttttttttgcttttttattgatacacagtagttgttcatattcatgagttacttgtgataattggatacatgtgtacaatgtgtgataatcaaatcagggtaattgagatagccatcacttcaacaatcatctctttgtgttaggaatattacaaagcctgtcttctagctattttgaaatatacaagttattgttaagtacagttcccttagtgtgctattgcacactagaacttatcccttccctccatttgtacacactaaacaacctctaattatcttcccctcccctttacccttcccagcatctgggtaactcactactctactttctacctcaatgagttcattttatttttagctcccacgtatgagttagaacatatatttgtctttctgtgtctggcttatttcacttaatataatgtcctccagttccatccgtgttgcttcaaataacaggattttttctttgtaattgctaaataatattccattttgtatatatgccacatttctttatcttttcatccattgatgaacacttaggttgattccatatcttagctattgtgaataagtctgcaataaacatgggagtgcacatatctcttcgatatactgattttctttattttagatatacactctgcattggaattgctgggtcatattgtagttatattttttagttatttgaggaaactccatactgttctccacagtgtctctactaatttacattcccacctaacagagtgtgggttttcccttttctccaaatccctgccagcgtctgttattttctctctttttgatagtagctatttcaattggggtaagatgatatctcactgtgggtttgatttgcatttttttgatgattcatgatgttcagcatatatttgtataactgttggccatttgtggtcgtttatttttgagaaatattgagtcagatcttttgcctatgttttaattggattatgtgggtttcttgctattgtatttgtttgagtttcttgtatattcaggctattagtcccttgtcagatggatactttgcaaatattttctcccattctgtaggttgtctttacactttgctgattgtttcctttgtttgcagaagctttttagcttgatgtaacatcatttgtctatttttgcttttgttgtctgtgcttttgaggtcttacacaaaaagtctttgtccagaatcagtgtcctgaagcagttctctgatattttcttcttgtagttttattgttttgagctttacatttaagtctttaatctatttagagttgatgtttgtatatggcaagagataaggctctagtttcattcttctgcatatggttattcagtttttccagcatcatttattgaagagatagtccttttcccaatgtatgaacttggagcctttgttgaaaatgtgttggctacaaatgtgtgggtttatatttgtgttctttattctgtttcattggtttatgtgtctgtttttaaccaaagaagtgaaagatatctacaaagaaaactatgaaatgttgatgtgatgtgagaagttaaagaggacataaaaaatgaaaagatatcctatgcttattgattaaaaaaattgttaaaatgtctacattacccaaaacaatctgcagatccaatacaatccttattaaaataccaatgacattcctcacagaaatagaaaaaaatcctaaaacttatatggaaccacaaaagacccagaataaccaaagctatcttgaggaaaaaaaatgaagctggaggcatcacactacttgtcttcaaaatataatacaaaaccatagtaatcaaagctttagtctccattttatttatttctgctctaatataaagtctttcatcaaagaaaagcccaggacctgatggcttcactgtgacccgtgttctgcttgctccaacctctggtccttgcccttttttttcctttgcctggagcagtcttcctttagatacctgtgtgactcatttccttacttcatccgctttctgcttgagtatttttttcccgctgtcagctcagctaatcaccctgtctgaaatagcattccttctcacttttggttaagctagttcttttttactcatagcatttatcactacctgatattatgcatctctgttttagtcctttctgtgctgctatcacagaatacccgagactgggtagtctgtgaagaagagaaatttatttggctcataattctggcaggaagtccaagatcaggcagcctttctggtcagcttctgctgagggtgtcatgccacttcaactcatggcggaaagtgtaaggggaagagggtgtgcgctccatacatgagaggcaaccctgcttcataacagccagctatctcaagtacctggaatctatcaatccagtatcctggaaactcaacttgtctcatgagaactgcattaatccattcatgagtgtggagaccccataacccaaacacctcttaaaggctgcatcacctctcaataccatcacatgggcaattaaatgtcaacatgagttttggcagagacagaacatagcaatctctgtgtttattggattattttatgtcccctcccaccttgccgacacactggaatgaaagatccttaatggcaggacctttttctgtttggctcattcatgtatcaccagcccagtaacacggcttgtaccttcagttggtctcaatgttgaataaataattattatgtggatttagagctcagagagtatgtggtgagaagacagagggtccagcttgaggtaggaatgcctacatttaaaggcaggtaaaggagaagttgccaagatgtgggtgcaaagctgggagttgttctggaagctaagagaaaagagaggaggagggaatgaccaatgccatccaacatgtctgagaactcaagaaggaaaatgactggataattctcattggattttgaggcatgactgtcattgatgccctagataagagtcatttcaagtgtatattagaaatggagcccagttagagtgggttgaaatatgagtgttaggaaaatagaaaggaagactttcatttgccaattttcacgtattttgtagatgataatctgtgatcaattaatatcaataattgaagatagataatggtcccaattaaatgggggaaatggcaggcatggattaatgacctgctttgctccaacctgctctgcctatggcaggtgtcagagagtattgtggttgggctatggctctctgagagatctcgaaccagttgtgtctccttcatgggttccttcatgaatttgcatacctacaaaatcagcacaccaatcatggccctcctacctaagtcacaggcatgtagaaatgaccaaaggagatatcactcctgaaagagctttctaacttggaagaaaaatgtaaaaaattagtagagtcattttgcttgtctccggatgctgactgaattatccccttacagattcctgaacaacgttggtttcttttttccactgataatgatgctgacgtggatggtgtctgtggccagcatggtcagaaagttggtgtatgagcaggagatacagatagaagaggtaaatatccttaaaccttgcctgggagacaaagatagggaggctggggactttggaaatggatcttgtcccataaccaacctgagcctctctgttttgcttccctctcctctgctggggttctggtgtacaaaatagctgagtccctgttccagaaagaagattttatgttgaagtctgaagcaatgccagatattttccactgacatgaaagaaagccaaagaatagccacatgagattgcaagaacaaagccagtgttcctcattcagcaacttttttaaaacccagaaaaacatagcagcagacttcccatcttaatttatgcttagaattttttatgtagagaccctgctattttttttgtaatactgttataaaacttgaaactatcataacttaaatttttttatttccataggttttttggggaacaggtggtgtttggttacatgaataagttcttcggtagcgatttctgagattttggtgcacccatcacccgagcagtgtaccctgtacccagtgtatagtcttttatcaatcaccatccccaaccctttactctgagtccccaaagtccaaagaatcattcttatacctttgtgtctcatagcttagctcccacacgtgagtgagaacatatgatgtttggttttgcattcctgagttacttcgcttagaataatagtctctaattccatccaggttgctctgaatgctattatttcattcctttttatggatgagtatatcccatggtgtgtgtgtgtgtatgtgtatatatatatatatatatatatatatacacatacacacacacatttatatatatacatttatatatatatatacacacatatacatatacacacacacacacacacacagacattttctttattcactcattgattgatgggcatctgggttggttccatatttttgtaattgcgaattgtgctgctataaacatatgtgtgcaactatctttttcatgtaatgacttcaggagtgggattgctggttcaaatggtagatctacttttagttctttaaggaatctccacactgttttccatagtggttgtactaatttacattcccaccaacagtgtaacagtgttcctttttcaccgcatccatgccaacatcgattattttttgatttttttgattatggccattcttgcaggagtagagtggtattacattgtggttttgatttgcacttccctgataattagtgacgatgagtatttttccatatgtttgttgaccatttgtctatcttcttttgagaattgtctgttcacgtccttcacccgctttttgatgaaattgtttttttcttgcagttctttgtagattctggatattagtcatttgctggatatatagattgtgaagattttctcctgctctgtgggttgtccatttactctgctgattatttcttttgctgtgcagaagccatttagtttaattaagtcccaatatatttatctttgttttcgttgcatttgcttttgggttcttggtcatgaagtatttgcctaagccaatgtatagaagggtttttctgatgttatttttctagactcgttatggtctcagggcttagatttaagtcttttatccaccttgagttgatttttgtataaggtgagagatgaggatccagtttcattcttcaacatgtgggttgccaattatcccaacatcatttgttgaatagggtgtcctttccccactttatgtttttgtttgctttgttgaagatcagttggctgtaaatatttggttttatttctgggttctttattctgttcgattggtctatgtgcctatttttataccagtaccatgctattttggtgactatgtccttatagtatagtttgaagtcggataatgtgatgcctccagatttgttctttttgcttagtcttgctttgactgtgtgggttattttttggttccatatgaattttaggattttttttttagttctgtgaagagtaatggtggtgttttgatgggaattgcattgaattgcagattgcttttggcagtatggtcattttcacaatattgattctacccatccgtgagcatggcatgtgtttcctttgtttgcgtcatctgtgatttcttttaacagtgttttgtagttttccttgtagaggtggttcacctccttgtttaggtatattcctaagtattttattttattttttgtagctattgtgaaaggggttgtgttcttgatttgactctcagcttggtcactgttggtgtatagcagagctactgatttgtgtacatgaattttgtatcctgaaactttgctgaatttatttatcagttctaggagctttttggatgagtctttagggttttctaggtatatgatattatcatcaacaaacagcaacagtttgatttcctctttactgatttggatgcccttcatttctttatcttgtttgattgctctgactaggacttccagtactacattgaatagtagtggtgaaagtgggcatccttatcttgttccagttctcagaggaaatgctttcaacttttccctgttcagtataatgttggctgtgggtttgccatatacggctcagaccatagtgaaataaaattggaaatcaactacaaaaagaacactcaaaaccatgcaaatacatggaaattaaataacatgctcctgaatggttgttgggtcaagaatgaaatcaaggtggaaactaactgaactgaatgataatagtgatacaacctatcaaaacctttgggatattgcaaaagcgatgctaagaagaaagttcacaacgttaaatatctacatcaaaaagtttgaaagagcacaaatagacaaccaagggtcacacgtcatggaactggagaaacaagaacaatagaaacccaaacctagcagaagaaaagaaataacaaagatgagagaataactaaatgaaattgaaacaaaaaagtacatttaagtctttactccatcttgagttaagttttatataaggtttaaggaaggagtccagtttcaattttctgcatatggctagccagttttcctggtaccatttattaaatagggaaccctttccccattgcttatttttgtcaggtttgtcgaagatcagatggttatagatgtgtggtcttatttctgagatctctattctgttccattggtttatgtgtctgtttttgctccagtaccatgctgttttggttactgtagctttgtagtatagtttgaagtcaggtagcatgatgcctccagttttgtttctttctcttaggattgtcttgactatacaggctcttttttttggttccatatgaattttaaagtagatttatctaattctgtgaagagtgccaatggtagtttaatgggaatagcattgaatctataaattacttagagcagtgtggccattttcatgatattgattcttcctatccatgaccatggaatgtttttctatttgtttgtgtcctctcttatttccttgagcagtggtttgtagttctccttgtagaggtccttcatccttcacttcccttgttagctgtattcttagacattttattctctttgtggcaattgtgaatgggagttcattcacgatttggctctctgcttgtttcctgttggtgtataggaatgcttgtgatttttgcacattgattttgtaacctgagacttggctgaagttgcttattagctttaggaacttttgggctgagacgatggggttttctagatataggatcatgtcatctgcaaaaagagacagtttgacttcctctttttctatttgaatacgctttatttctttctcttgtctatttggcctggccagaacttccaatacagtgttgaataggagtggtgagagagggcatccttgtcctgtgccagtttttaaggggaatgcttccagcttttgtccattcagtatgatattggcgacgggtttgtcatgaatggctcttttataaaaatttaatttaattttaagttccaggatacaagtgctcatgaaaatcaaataccaagcttgaggaggcaatgtccttcccagggcccttcacagggctgaatttgcaagcaagcagatttacctttccactggtccaccttctttctcctaccatctgatttgttcttcctcaagtacgcatgctgtggtaaccttgggttttttctctttttggtagtatatgcggatgatgggagtgcatccagtgatccatttcctggcctggttcctggagaacatggctgtgttgaccataagcagtgctactctggccatcgttctgaaaacaagtggcatctttgcacacagcaatacctttattgttttcctctttctcttggattttgggatgtcagtcgtcatgctgagctacctcttgagtgcatttttcagccaagctaatacagcggccctttgtaccagcctggtgtacatgatcagctttctgccctacatagttctattggttctacataaccaattaagttttgttaatcagacatttctggtaagtaagttgttttgtaaaaaaaaaaaaaaaaaacaacaaaattgcaatctatctaacaagacaaaatcccaccactctcactttttcaatttgtcatgttcatatctacatgggctttctgatatctgctttttaaaatcttacccacaaatgcaaaccgttgaaactgcagggtttttgctggacagcagcccattaagaatgtccagtttttacataacagagactttctgcagattctggaaaataagcaacattcttaaggaagcatataactttattttctctttcatgcacagaaaaaagctagatttctaaagcaattttagaagtaaaaaataagcattttttcttgaaacattatgaattacatcacattaagtggaaaaatctctctgttagcaatgtcagagtcactcatccatttaaaatgtacctcctaaaaacgtatgataacactttcaggtctgtaacatcaaatacgtagaacataaaaaagtattcattcttttatggcaattgctggcaagcgcagtgcctgacacatagtaggaactcaatcaaagcgagggtgaaccatcactattaaaatgatctgtttcagagagccagtggcatcactataaacacttgcactgtgctcaagactttattctctccagcaggtcaagtgacttcctaaaattgcagtctgttgagagataagacagagtcattaacagagactttggggaggtgtcaaggagacctagattacggggctgctcaggggtatttaaaggcccttaaaagtcctttagtccagcacaggattcatgacggccccagtgcttcactcacttattgggagcaaaacaccttctctgctcatttagggcctagagtaaaatatttctatgaaagccaagtgatttgtcttcaacttcagtaaacgattcaaagctgtctggtttctactagccatatgctcacaacaaagatatacatacagaatgaaaaagtggttatattccatcagtgttttatctattggtatgtgttcattggtcttgattagcttatgttacatttgtaaaaacccataaccaataacttcctgttagtgttaattagctgttttcagaataattaacacaagtgggaccattggtggtccttccccatatactccttgtacatagaaaaagagtcatccatgatctgacctgattttcagatggtgttatttttaattttacttcagtcattatattcgtgggttctgtgcacataaaatttgattttctgtttacatattcaaatgctttctagcaagtaaaaaatatctaactctggtacactgtattttttaatgtaagatatttttttcaatggggtttcgttctaacataagacttctccactgagatacaataacatttttcttcaatacaccttctttctagtgtagaatagtgtatgcattccatcagtcagcctgcagtgtgctccagggcattcacttaataataaaaaatagtaaattactctattccagttttcactgttttgtgttacacatttctgtgtatgatacattggatttatgacacttcaagcatctcggtaaagagaaataattccttttaacgttaaaaactagcttgttatcatgcttttcagagtgggctgacattccgctaagattttcagatcaaaatatttaaatgactgcctgaagcgatggttgggcgtcatcagaatgaaaagttgtcatggcttcgctccttgaattaagtgttgtggattttctgtggtcccaatcaaaacactaacgtgcagtttttctccatcaatctgtgggcagtgccttctttcgacaaccgcctttggacaaggggtattttttattacattcctggaaggacaagagacaggtaagagcatgcatgtgtaaaaagtgactctcagtgaatcacgtttttggaaattaatagttatattgcaagtgatccagtaggaagtcttcattatcaagtagagcattcagaatgaggtttggatatttgctttcactgttgtatacacctcccactatctggtagcaccagttttgagaacaatcaagaataatcatggcatcccttgcttcagacactatccaggtcaaccacccagccaatgcttgggtcttccttataccacccttgacgtctggtctggtgagtgaccttctgaaccttccaagatagggtgtgcaaatgtgtccatctgttagatcaggggtccccaacccctgggccatggagcagtccgtggcctgttgggaactgagccttacagcaggaggtgagcagcaggcaagggagagaagctttgtctgtatttacagccactctccattgctcacgttatcgcctgagctccacctcctgtcaggtcagtggggccattagattctcataggagcctgaacgttatgtgaactgtgcatgcaaaagatctaggctgcatgttccttatgagaatttaatgcctgatgatctgtcactgtctcgcatcacccccaggtgggactgtctagttgtaggaaaacaagctcagggctccccgtgattctacattatggtgagttgtataattattttattatatattacaatgtaataataataggaaaaaatgcacaataaatgtaatgcacttgaatcatcctggaaccatcctctatcccccggtctgtggaaaaattgtcttccacgaaactggtccctggtaccaaaaaggttagtgaccactgtgttagatgattgttgacctgggatctgtcttcctggatcctctacccatgttttctagttcttcctttctaattatccctttcacatgaccaccatctacatatttgttggctctcatctttactcctagatttactagattgttcctgaagatcaagatccagaaataggtctaataagcataaaatagagtgcaattatctcataccaatgcaggctaaaatgattttctaaaaatctattggcagcattttttgcttatattgagaatttgacaactaaaattctaaaccagaacagacatatatttcatagatatttgtatggttttttttgggggggggtgtttttgtaaacagaggtaaaaccatgctataagtaaaatttgactctagctattgttgtattagccagttaatttgtactggtctttgagttcttagagtttttcaataagatgtattaaaatgttcttttacagatgagtaatcttgaatgatttcttctaactgatctttagaataaattgaatcaaaatgatagaaacaaaaaatggaaactgttagaccatttgaatattttggtctaaattccaagtacacaatgattaaaatgtatattttattgaactgtagcctggtaccatagggaaatttagaaaggggaatatttttcttaagttgtatgttaatccagaaataaatcacaaacctattgtaaaaaaataataataatttcccaccctagttcttatatatcctattatatattttccaagagcacagagagttacacagtttagaatttgggttctcaaggagactttaaaaaatttttttgaatgcttattttccttaaatataaagtcctttctactcaggtaaataaaaccagatatgagtaaggtgacctttaaaactttttaaagtattagatattaaaaagtagttaacaatccccccacctgatatcattgaaataggtgtaagattgcacaagttaacatttcatgaaaagttatggccagtgatattgaccttctttttgttttagttctgttcaacttcacttgagcttccagaagtaatgaactcatcatgacaaaatctaccataaaagagcttgtgcagttctaactctgacctttttcttcctgctagggattcaatggaataatatgtaccaggctctggaacaagggggcatgacatttggctgggtttgctggatgattctttttgattcaagcctttattttttgtgtggatggtacttgagcaacttgattcctggtaagaattttgccttttgtaagataacacaataaattttaaaaacagtttgaattaatatgcataaatattagaataatcacttattctttaaggaagatccagaaagggaagtcttaggatatatatttaaaaggagctgtacatttttgagaaaaaatgtgatgcctttgtttcccaagtgaaaggtaaaaggccatgtgagggaatagccaggatgaaattagcatgaaaactcaccaggcccaccaagcagctccccaaaagtgggcttcagtctacacagaaaatatcctggtttctcagagagtgtttggggagggcaggcatgagggggtgagggtgggggtgctcagagtgccttggccagaaagtcactcctagtggggatctagggaccaagcgctcagccagtggcaggtcggtgcatggcaggacctggggagaagcaggcagagcctaaaggcagctggacagggtgggctgggagtgaggggccatgtccaaccacagggctttcactgttgtcacggatatggggtttcccaaatgtggtggtgcccttcttccctggtgtggcaggcatgccccagagtctggaggacaagtatatcaatggccaaaaaaaaaaaaaaaggccagtaatggtaatgggttttcctagctgttttgggaggaaaagaggcacgcatacctttacctttttggttcaggcccgaaagagcagaaatagcactttaaaattacttattttattttttagagataacactttgatggtggtgtattttcttgctgaaattacttggcaactctggttctatgcttttcaaagcaaatagtgtctaactaaattaaaactaaaaattaaaaaaaatgattctaatcttatacaaatgaaaatggagggatagaaagaaaacaaatgcagttcattctgtttgtgaaaacacattccagacttggagagctcatgaatcatttagggatgggtaaacataaaaataatatgggccactgaaaagatcattttacacaaaagtaggaatatatggccctcaagaggtagagagagaacataaattggaaatgtgatttatttaggaaaaacttagactgcattgtcttggtactttgaataaaatttaagaaaataaaacttaagaaataagattctaggaaataaaggataaaacaaatgagttgagaaggccaagggttcaaggaaattggatgagaagcaattgactattgagaagaagcaaaaataacataagaaagtaatgttacaaaatacatttgtgatgtccatctaaaatacaaagaccagcaacaaagtctactctctgcaatgttgagatgaagataaaatgtgtcccgggacccagaatgatctgatttctccctcaaccatcagcatctaaggctagaggctcttggggcaatatttttctacattatggtaaagcaaaggaacattgtattcagctgagactttccctctgaatcccactgtggaattctaaattgaaaagttttaaaagagactgagccttgaggtggatgtctggtgtgcagagggctcactgtctaggtcatatttgaagggaagaaaagggaattgggagtagactcatggaggaaggtaattgaactcagaaaagctgagtgatggtgagaatgtcctcaccagtgggacagtattgagtcgttccttatcctgtgggtcaggggatgtttggctaagctggtggcttttaagaagaaattctttctaaagttcaatgaggtcaacttgaggctcagaggaaattaaaaaaaattgttttcctcaggggaccaggagattcaaatgctagagttggtaatcttttggaagtaccttggccatctgaaccatgccacatttggaactcacgtatattcgactgaggaaaccgtgatctcctgttccttctttcatctcctcctgtccttccattccttcagactcctaattccctgccctcccattaggtgaaggttaaacaaacaatccaccatcttcatacactcacactgcaatcctgcagtctcacaatatggctcatgattaacatctacccaatatgttaaacttgagctatttcagaatcagctcttaccctgccacatccaactggagaaaaagatctgctgattttacttcacaagtctcccttaagttcacacggatgtaccttttctagggaatgtctccatgttttcatcaagccatacaaagtattctgtgacctctaatgagttatgattcccagatacactggatcctacaccctgcaaagggaagcaaatgcagtaggacctcaatccacctttgaatggcagacactcatttcaacattttgtttagtgaatttagagtgggaggttttatattttctctttgtgattgtgacactaattttagctaccagctagttaggaaaaaagatcagagtctattacagaatttaaaaaaaatcaaagctcgcacatatttataacacatatttaaaaatacaaaggcatagagctgaataaatatgtcaataaatatttttgactttatcacaaaattcagattcttttatttcaaaagctaaaaataagagttggcaatttgcatattcttaaattgcacaaagtatttcttttccactttgacaaagtctgccaataataacaaagaatataattgccagacactactgatgggctttcagatccataaagagggttataatttctaggaggtctcagacccaataccttctttttaagagaaatattttatattacctcctttactctcttgaaatgaaacttatggataatgaaaactacctgcatatgagtcttaaaattaatgtaatttaaaaattttaatataaaagagaaatagaaactaatttatagtaagttctcggtgctcaggcatgaatgcatcggaacacagaatgagatattcagttgcttatgcttatgtggaataagttcggatttaaaagaaggagaaaggtcagaagccatttggcactaaaaggaaagaaaatgcataagtaaagagaaatgtagatactagaagtaaagctaatattaagtagtactagatcagacttattggtatgtgattataaagatgaaaataacttcagttgaagtaggaaaaacgtgggaagaaatattatacatgaatgaagtgaataaaagaatgatatttttgtaaatgacctgggtctttatttaaaagtaatcaggaaattccctttgttaacacatggggcaggtaatgacaaaacataacagaagatccattttctgtcttacaattctatctcatttcagtttctccattcagcctccagtctttaaagacgttggagatctattctttagtagtgacaggaaatagaggactgattggacaaaggaataatattaataatataagagggttttatagagaagccaaggggtgaatatctgggaacagcatcaaaataagattgaaaactaatagggagcctcatgttaatcatctcaatgtgtaattttcaccaaatggtcttattgtgctatacagttttaaaatatatatatcaaatgacaatgtaacatagttactaacccttattaatacaatttagtgcattttctaaatttctactattcaagaatatctggttttaagtttgttaaaagcaatcttcacatcttttgtcatgtgtttgtatataatggggcagaatgaagattgatacagacatactgcattgcaaactcaaacgcagtgagtgacatcactattgatggcgttgttttccaaaacaatggacaatttctgctttaaaaaataatcttccactagtttacacagtggttgaatttctgaaaaatttagtgtatactgaaactgcacggaaactttgagtttatatgtcctaggctcaataaccatgaaacactttgcatttgcacggctgtgtgtgatcaggctcacagaaggcaagtcaaggacatttctttgttgcactttgtagggtatcaactaacccaggcatctgcacactaaaggcaattgtaccatccccattgtattaatcatacttttttattttctgtatttttgaggctttgactggggttgaaggagtgcagttactgaccctagagggactgttccttccagggatagccagttcctagccatagtaaaggactcacctgtggatgtgcctttcacaagcaaaaaaccaatccagagcccacgcccctaccacctgctgtacggggcgatcacactcggggtcactgtccacctggcctgatcagcccagggcaaggtaccagccaactagggacagactctctcccgaagagcctgatgaaattattcacagtagttaattagaaatgtacttgcccttcctcacatgttccttcccttgaaaaccacagtaaaggctcttgttcacattcccacagcacccctccctacttcccctgtctcctgactgacactggtgcttccctgtgtgaccctgtgtggtgtgtcatgcctccttctcttggggtctgtgagtaacaaagtgtagtttcaatgacagttatctcctgatttgttggcatcatcatacttgagtaataataaaatctatattttaaaacactgttccagagtctcctgtgggtaggagggtgtctccagatgggaggtaggaggcaggaggcaggtgagaaatttctctcttttgctctctgtcacacacatacacatacacacacacacacacacacgcacgcacacaccccatacctcagacaaatacttttctctcgattttctttctttgttataaagtgaccctgtgagtatgaccccagcatttctcagccccggtgtctgactgggagactctgtagatccagcatcagatcatttcctggcctgcggggctcagcgtcaactgcaggtctccacgctcgagtcaagagctcacaagcaaacatctggtcctctcgaagagttttcattgcataaactctttttatatgcttccaattaaatttgattctgctcgatctgtctaatttcattgacctcttcttttatcactgtcagttttggggggcaatgctgattagtttcctggcctgcataagccagcaggcagttccccttgaggagaaaagctctgtgtaaatggagggcctttgcacatattaatgtgcccaattacatctggtaatgtgagcaggttgtatgtgcttctagagtgtgcacgtaaaacaaatttgaatttataagcaaaagccgattgcagaggcaagccaaagagctgagcggcttccacgccagcttgcatttggcagctctctgctttagttagattagtagattaattagggggttttaaaagtccagacagattatggctgagatggtttaattagcaaagcaacccttaatattcaatttattttttcataactctggaatgtctttcacgtttgtttctacttcccatccctgaagccattaccttagttcaggcctcactgtgcctgatctggacttacagcgagttacagtgcctttgtaactccttcctactcctctaggtatccccgaccccagcacctcacctctgcatcctacctgcatgttgacacaaagttatctttcttaaaaatagaccaaatagaccatgtccctcccctgcatgacagtcttccccaactccaaaatgtctagagaataaataatatcctcagtggctctcaggccacccgaacctgctctgctgcagattcacgcccctctctctattcccgttgtgctgatggggagttggggggcagtcttcaatgtgcccagcacacccacacagggtaggcagataaaatacagggcacccaggtgaattcaaatttcagataaactacaaataatttgggggacatattcatactaaaacattaattgttgtttgtctgaatttcaaaattaattgaacatcctgtgtttgtattttctgaatctagcatccctcccagcatctctgtcttttcattctcattcctttttcttgggttgaagggcctgcttttgttttgcataggtggaaacctatgatgacaatatcatcttgtattcttctctcaatgattttttttttttttggtcatctgtactagaatgaaggtcataagaaggcgcagtctctgcctgattcattggcgtgtccctcgtaccactagagggtgtgactagttgatttctgtttgatgactgacatcttcctggaacaggaaggtataatccggagaacagaagggcaagggatatgatgttccagatctaggtgacttctgccctgctcctttgtcactgtgctgaggcctcacctgtcctactcattcttgggctgacagctggaactgtgagccctgggagatgagccagcatctctcctcatacctctgtacaaaatgcttagttattcatttctcaacaaagcatctcccacagtaaatcagggctgcaggaaggtgtcatttcccaaagactcaagtgagaaaacaaggatacaactaataaagagtaatgtcttagctccattgcaagaaactggtgactcctgacattgttgcagttgtctatgtgtgcacacttgtgtctgtgtacatgtacatgtgtgcatgtgctgcatgaatatgtgcatgtgtacatgtgtactcgtgtgtgaatgcctgtgtgtgtgcatatgtatgtgggtatacgtatgtgtgtgcacacacacacgtatggtgatcttcactttgagtcatggccctaagtttgaaatcatatttatctttgtacgacttccacttatatcgaagtgaagcagagctgaggcttgcttcaggatttccttgcgtacactcaaaatgtgaaggtgttcaatgacttcatttggaacaggcaaattgtgccttatttcacctttagaatgtgcatgtatgaaatattcttttctcccctatggttctgaaaaattgagctataatacatcagatggatatgtgtttattgtaaaatgtttgaaaagtttatagagaagcaggaaaaatttttgaggaagcaggaaaaaattcagttatctccaatatcaccaaccagaactaacatttcccaggctttttccagacagttttctgcacctagttgggttcacactgtatatgtaaatttccctctgttttaaaaaaatatttttatcataagcatttatccacatctttgaaagtactgttaatggctgctcaacatttcattaaatgaaagtaataacttcctggacctttctcctactttgcaagtttaaataatttctgctttttccccactataagtaatgctacagtgaatatatttatgttcagatgtgtgtccccactttgtcattgtgtcatctagaatcctagaattttaattgctaattcaaatctataaacacttgaaggcatctggatcccattgcctactatccttgctaagggtggtgcccacttaagctgcgactgagtgtggttgcctgagaggcctctgagccgaagacctgcagctttgtgagaataatcttcctgatgtgtttgcttgctttctgtctcctttgatttccacacactcattgttcacgtatgtgtcaacaggggcttttcgtgtaattggtactggaagaaactgtgcttctttcttgttgtaaaaggcaacccaaagcatcctcatgactgcacttgcgtgttcagacaggcaggagctgctagaggagaggctaaccagtgtgtagcttctggagccatcagctgcgcgtcactgggcaacccttgctgttcctccttttcttattgggaaggtagaggtgataattttacctgacatgttggtggtcacaggactgtgtgaattaatacaaccagataccctggacagtgcctggaacacagtgagtggaatgctggctgtgatatgacctgattatccagctgctactcatcctcttcctacagagggatggtttttgctttgcaaggttcttggaggacacctgcctgcattaattttctcagcctgccataacaaagtaccacaaactgggtggctcaaacaacaggaatgtgttgtctcacaatcctggaggctaaaagtctgagatcaaggtgtaggcctgtgtatgtgggtatatatatggactggtttctcccaaggccactctccttggcttgcagatggcattgtctccttgtgtcattcctgtgtatctgtgtccaaattttcttttatgaggacaccactcacattggattagtcctcgctcttgtgacttcattttgccttcattacctctttgaagaccgtgtctccaaatacagtcacattttgaagtacagggggttagaacttcaacatatgaaacctgcggagatacaactcagcccacaaagaaaagtcagtgctattcctcacagcagctgaacagcttcccttcactttatgtatttatttttttgtaacttttaagtgcaggggtacatgtgcaggtttgttacataggtaaatgtgtgtcatggaggtttattgtacagattattttgtcacccacgtattgagcctagtacccatcagttattttttctgatcctctcccttctctcacccttcaccctccaaaaggccccagtgcatgttgttccccgcagtgcatgttgttcatgtgttctcatcattcagctcccacttataagtgagaacatgcagtatttggttttctgttcctttgctaacgatgttagtttgctaaggataatggcctccagcttcatccatgtccctgcaaaggacatgatctcattcctttttatggctgcatagtagtagtccatggtgtatatgtaccacattttctttatccagtctattgttgatggccatttaggttgattccatgtctttgctattatgaatagtgccacaaagaacatacatgggcatgtgtctttataataagatgatatatattcctttgggtatatactcagtaatgggattactgggtcaaatggtatttctatctttaggtctttgaggaaccaccacctgtcttccacaatagttgaactaatttacactcccaccaacagtgtataagcattcctttttattcacaacctcaccagcatctgttattttttgaccttttaataatagacattctgactggtgtgagatggtatctcattgtggtttcgatttgcatttctctaattatcattgatgttgaggtttttccatatgattatcagccccatgtatgtcttcttttgagaagtgtctctttatatcccttgcccactttctaatggagtgtttgttttttgcttaatttatttaagttccttatagatgctggatactagacctttgtcagatgcatagttaagcattcctatacagcaacaacagtcaagcccagagttaaatcagtaacaaacttccattcacaactgccatacacacacaaaatatctaggaatacacctaacaaggtgaaagatctctacaaggagaactacaaaccactgctcacagaaatcagagatgacaagaacaaatggaaaacgtttcatgctcatggacaggaagaatcaatatcattaaaatagccatactgcccaaagcagtttgtagattcattgctattctcattaaactaccattgatattcttcacagaactagaaaaaaatgtttcaaaattcacatggaactaaaaaggagcccgaatagccaagacaatcctgagcgaaaagaacaaagctggagacatcacattacctgacttcaaactatgctacagggctacagtaaccataacagcatggttctggtacaagaacagacacatagactaacagaacagaatagagaacccagaaataagaatgcacacctacaactatgtgatcttcaacaaacctaaaaaacaagcaatggggaaaggattttatatttaataaatggtatggggataactggctagatatatgcagaaaattgaaactgaaccccttccttattgccatatacaaaaattaattcaagatggattaaagacttaaatgtaaaacccaaaactataaaaaccctggaagacaacctagttaatacaatttaggacatagtcacggacaaagatttcatgacaaagatgccaaaagcaattgcaacaaaagcaaaaattgactaatgggatctaactaaagagcttctgcacagcaaaagaaactattgacagagtaaacagacatgtctcccattctgtagaattggaggaaaattttgcagaccttccctttactttcaaaaggtaatggatacatgtgctctcctttgagtgcatgaacatctctttctattttttgattagaatgtgcgagggcttgcatatctctcttctgcttgatgatcaaagtgctataatagtctttatatcagcctttttaattctaatcagttgtagaatttaggcctttaggtaagttacgttcatcaaacttaaactagaatggatgtgttaaaagaaaattgggaaatgttaataatgaaatcccttttcatttcaacatgtaatgagggcaaagtgactgttaaatgggctgaaatgaatttggagaatacttttgaagaatggtaacgtgtttcatatggaaatgttagcattatgaattattcttctttatggaaatttcaattgattaatcccctcctacacttacctcatgctcttcctcttgtctaggaatccatgcaaacatcaaagataggcaaaagaagaacaatcacaaaatagaagggcagtgtggggcagggtgggactttactctgggaatattcagcaattatccaaaaagcatgtattgaacccctactctaaagataaagtcttgggggaagtggctgagagggggttttagcacatggctgtggatcaggccgagaagggagagttagggctccactgcaaaactaatagctgtgccctgggatatcacattttgtatatgggacatatattaaaaatattaacatgggatgacattttatattaattacttaagatattctaatacagtaccttcatctaaataaaaaattaaactaattttaattgtttcattttttaggaacatttggtttacggaaaccatggtatttcccctttactgcctcatattggaagagtgtgggtttcttggtggagaaaaggcaatactttctaagttctagtctgttcttcttcaatgagaactttgacaataaaggtttgtaaggagtagaattattagatgcatgtatttttcctttgatccattttgatttttttttgtttgtttttatggtccagccttttcaagtgtgtgctgattcctagagagacttacatttaggctgtcttgggctgggaaacagctgcaagcccaagatgtgggaaagtatgccatgacagtgtttgttctgtgaaacccaggaaacccagggagttcccattaattattatttagcgtcctcccctctgtgcattatgtgcatttgtgtgtatattacaatttagaaaaattgaagcgttagtcccaaaatgaatatgtgtaagaaataaaagcaaatatgggcagctaccctgtgtaaagcatttaaaaatttttaagtgttctcacccatgctggtttattcagtgttcctgtgtgagggagaatatcactgtcccttacaaatagggattgtggttctcaggagataggggcaggactgtccctgtgcctctgcactccagagtcatggcctgttcctgcaggtgcaggcacagggcacctctgccaaaggatgaatccataggccatctccatggaaatagagatgcatcactcagagataaacaagctcccatcgtggtgggtttagattacaagtcaacattctaatctaaacaatctaaatatttttctgaattatgaatcttttagaaaatgtggaacacatcaacaagcacctatccactctcacgtcctcaggagactatttctcatgaacattttatgtgtaactaatctgcctgttgtttttttctctacttaaacaaaaatacatgtgtgtgtttttattttttttattttttacaaaatggttatcataagggttcaaaactttgtaatcagtgatatcacttaatgtttgccattatatagtctgcttcttgttcttgctaaagaaagatttttgagttgatttgtgtgcttcacagagctggaattcaatttcaaagcagaatgctgaattaataaatatgagcattatttttagggcttttgaagtcttttcacaatgaattttcatctctctcacagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatgtgggtcccattttacccttatcaaacactgggcatttgattcttaaaacttcagtttacctgtgagacagaaggtttgatttcttttcctttttttaaaattttgagtctcaatacagagtttagagacacgggtgaaaggcagagcccctcatgagtgcccgtgtgagagaggccctatgtcttcaaccgcacaggtgcactgtaggcctggggctcagtcaaaggggtagtggtggatagctttttaaaaggcttaattcttgtattttctacaaataatttaccatgttgtactttagtctttgaaagtcctttggcactttcagcgtttgtcctactaagtatcatcttgcttgcatatctgtaggaagaggaatatcacagtggtacttgcaaattttttaaacacctgattatttttcttttccatgttctggtttttgtgtggttcttttctcattaagggtagatgtttggtttaggattcaatggctctagatttgattaaagaatcaaatcatgtgctcccagagaaacaatgaattcaaacattcacagccttgggctggctgtagaagtggaggtttaaggttaaactactaaaattatgaaatatctcttttgaacaaatcactttctcttttgttctttttctcactaaatatgtagtattaaagtgtgattagttaaaacaatgaagagggctttgcctcagacttaataagaaaggtagaaaaataacacatgaaacttcagaaatctcatactgaaaaaatagaaagaaagaatatggacagtttttatttgttccttggatacagaaatggacctggaaaagcgtgtgagtgttttttttagtgtttgaaaattgggaaaccacaagttgcacaaataatgactcagccagccagttcctctcaccctgcttttactaagacacatttcttacaaggaaaacctgggctgcttgtttagcagaatgatgagaattgcatttggagtttctagatgatttaaagttcaatgactgtgttgcttttagtgtacatttgtagtacattttgagtcatcctaagtggctgcctccacctggcaattcttagatgaaaggctgagaggtcagtcaaagacgggggggtcttcactatttaaaacaacagtctttgagacttctagggaatgtgtataaactattttatagtatcccccagataggtttgaaaataatatagcaaagagttttaagttcatcgaggtttaatttttgtgcagtaaacagtatctgttgatgtgtacagtttgatgagttttgacacatttggttagtgccggaacaagcaccacaaatacagaacctttctatgctgctccaaggtttcctgtgctctcctttgaccctggccttcatgtgaccactgatctgctctttgtcactaaaaactaggttacttattctagaatttcttgtaaatgggatcatgtctggcttcttgtactcagcagactgttttggggacccaggcatggtggtggtggcccagcagcctgctccttgggacagctgagtggtatccaccatatggaggcaacccagcttctttatgttttcatccatgggttgcaactgaggttgtttctctttgtcagtgattgtgaacacagctgctgtgaacatttgtgcatacagctttgtgtcggcacacatttaatttctcatgtgtaaatactaaggagtggatttgctaggtcctgtgtggtaggggcatgtttaacttttcagaaataagaaaccaatttaaaacttaaataataaacttcctgaaacaaggaagcagaactaggcaattctgaggcttctgttggtaaagtcggtcatgtgagcttgtggtggcaggctgcttgatttcttgtggttttaacacacacagactatcccgggagcagcggaaagaagactggctccagggttggggcctagctttgtatctctgttttgcttatatttaatgatgaggatttaggtatatatgtcatttctttagcatgtttcctcatctgtaaaaagttgaatgttatcatcttaaagtcccatacaactataatgctctatgattgcagttcagacttacaatggttcaacttaatgatattttgactttatgatggtgtgaaagtgatacatattaggtagaaaccatagtctgaggactcatacagccattctgctttttactttcagtacaatattcaataaattgcaagagatattcaacaccttattataaaatacgctttgtgatagatgattttgcccagctgtaggctaatgtaaatgttttgggtacacttaaggtaggctagactaagctgtgatgttaggtaggttagatgtaaatagatttttgacttacaatattttcaactttttatgggtttattgggacataacccaatcagaagtcaaggagcatttttatttcatgtggtagcataacatgttaaactcacattttcaacatcaaccagccaatgtaccctcaaactactcacaccttttaactgattgtgtaaaaaccaggtcagcagaaggtgagtgctcttggcaggatgcatgcgccatcctggagctgactggattgctgacgttcacagtatcagcaacgcgtattctccatgctgtcttattttctctggcagatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcagttagtaaacagttgtctctctgctcctcctgcctctgcccattgtgtaaggaagtgaagacaatagaaagagacacttaaaaaatcatctgtgtctacatttataagatgaaataattagcaaatggttgttaactatggaattatgacacagccaccaacactgagaatgtcagaaaaggcttctgtgggaaggcattgaatttgatttgatttgtctttgaaatgtggaagagatgagcacatgtaagcacagaggctgttgatggaaactttgtgtatctggagtaaaaggtccctaggggtgtcctgaaatgaaaagaattcaaaggcagcgggaaaactggttgtcaagaagctgattagtctgccttttctctccttgatccctagctcttcctcaactccttccttccttcctgtcacacacacacacaaagattaagaaaaaaagagccttattagtcatgctaaggagtttgaacttcactgagcaagtaggtgttcatgagtgggggactgtgattagcctgagatctggaagatctctcctgctagatcatagcaggtgccatgggagagactagatacagagtggccagtgtaggcaagaggtggtgacagcctgatttatggtcatgccactggggtgcatgggccaggaaggcctgtatttgaagactattcaaatttagaagaatcaggtcatgttgactaactggttgcacaaggcagggagcagagaactcccggtagggtcacaaacaattggtaggacattggttggtccacatggggggctgaaccctatatgaaagtggaatagcacaaggaagatctagagttgagaatatgtggggagaagtggaaaggaagtagggtatccaggatgggaagcaaggcaaaatccaggcagtgtgccctggctcattggacattgatagaagtttagaccagaggtaaaagggagagacagtaggttcctgattagagaacaaagtggtgtttgagggtgatgaccatggaagcatggattggaggggaagtggagcaatgaaagtcatggagagtagctggagatagaaacattaatccagtgctggggtcatcgattcagcaaacagtggtagttaagtgtgcaggccgtctgtcctgtgctgggctctgccccctcaggaagatgcatggctctggcctcctggggctagtgctgcatgcttggcaattccaatggatggactttgcaaagcagaacgtcaaccatggcgtgagtgtgtggggaaggggcccttggaggcaagcatgtaagtataactggtaatggactgcacattcctaagaagaaaatgtgaatgtcatgaattcttacagaatattgttattttacaatatttttgcaagctttacatttataaataagtatttacaatctgcatttaattaaggtgaaagctcacagggtttgggtgttgttttgtatggtgtaaccttatttctttaccactttttccgctatgtgcttcatgatggtggagctctaccttggtgtttctagccctggaacactgagaaaaagaagaatgagtcttaaagttgtcacacattccatgtgccgttggcgatatgaccagagaccaagtaaaacgtttgcaatgagaatgctccattccacccttccttttacttggcctctccaggtgccattgcttgcttctccatccctgccattgcaggtcacccctgcatcatgcctctgtagagatgccagggctgcagctggccttcctgcctgctgtcggcttcttctaccctttcctccagcccctttggctcacttctgcaaagcttatcttgtccccaaacccaacccccagctgttctccccagatcatggtctagcttcctgatgtcacgtgctttcagtactccacatggagtgctccttagaaatgtacccaggtcctggcccttctctgccaactgcccttcaaggactcacatcacttgaggtataatctaaaggtatggaggcctacaattgtgtaatttacattcttgtgcctattgtctcagatttattatgagtgcccccttccacctcaaaaccctcctcctttggaatataaatttataaagccctgccagcctctcttgctttacctgatccttcattgtgtggtgcctgctgcgctggtcttatggtggatccctgagcacactgaacaggcccttcgctgcgttcgtgttgtgatgggctccgtgtgtagcctgcctcactgccgtcctggctcttctcagacaccatcttaccagagcagacttcctgagcattctgtccagaacaacttcccactcactctcctgagtcccctctatttctctggctcttatttacgacatttatcatttcatgacagcctctgtgtattagtcttctgtttctttccaccagatagcaaaccccttgactacagggacgtagtctgtttggttcactatagtataataagcattctttgagttgaataactggatttttttttcaatttttatttttatattttttccataagttattggggtacaggtggtatttggttacatgagtaagttctttagtggtgatttgtgagattttggtgcacccatcgcttgagcagtatatactgcaccatatttgttttattttatccctcaacccccttgagttcagaaagaaacctcaggtgcaaacaatgaagctgaataagctctactggggggtgtgtgaagtgggtgcagggggtcagctgcccttggttgtatggtgaagggtcatagcagaggtaatgattgagcagcaggctacaggatgagtaaggatgaactggggttgactgcagtgggtgggctgcaatatgttacagcatgtgcagcttagagcgtccacaggcctctctcttgcaggcctgtgcacaggcacattacagaagcttcctaagccttgcaagattttaggttttgttccttaggctgtccatgggcatgaggcctctggagagtgctgagcacctgatacgatggccgtctaatgatggttcacacactctctccagttgcaggtggaggatggggtgggctggggtgagcccaagtcgcagggagagctgggggctcctgcactaagaacagattaggccaggagaggtccagtagggtgaggaggaaagggagatgcagacccaatggggaataagagaggagggggcgtccatggtattccccagatgtctggctcaggcaagcacagtgtttttcaacatacagttgactcttgaacaacacaggtttgaaccctgcaggtcttacttatattcaaatgttttcaatacaagtaacacccagtgtgcctacctcttctgctacctttccttctcctctgcctgacctgcctcaaccacctttgagatagcaagaccagctctccccttcctcctcctcctcctcagcctactcaacgtgaagatgacaaggataaagacctttatgatgatccacttctagttagacaatagtaaatatagtttctcttctttaagcttttttaaataacatttttttcctctagcttgcctcattgtaagcatacagcatgtaatgcatataacatacaaaagaggtgtcaactgactgtttacattattggcaaggcctccagtcaacagtagaatattagtaggtaagcttttggggagttgaaagttatacacagatttttgactgtgtacagtgtggtgctttaagtccctgcattgttcaagggtcagctgtgtgtatagagagagcctatttgagaagttggggagaggaaagtgatgagtttgtcttagagatgtgagttgaaggagtctggaggtttctgatgctgaggccagctgtggtgctaggctcccaccagggcactgccggcctgtgctcctgcccatgctggttttccttatttattaccctcccctccactgctacctcagtttccttggtgtgcccaaatcctgagatccttcaaggaccagatcccctcccaccatggccttgggatgttgtgcaggccatgtgggccagggcaggaaagaagccccttgtgggctctctcagatggccagaggggccttctgcttccagcctcacctctgcaatggctacctacattgtataaaggaggactttcatttgtttaacatcttttttttgtgccagccgctatggtggatatgtgccaggaacttacatgagtgatctcattcaagtgtcttttccctgggatatgggcagaggctccaggagatggtgccatgcagctcggagagggaagccaggatctgacctaggactctcagatgcaaagtgccttctgctgcctttctttcaagctggccactacgttgtagcatgtgggcatggtctctgcaaagacaaaacccactaggcggagagagggcagattctctagcacatttctagtgttgatgccctaatgggagtacggaccctcattggggattccatgagtctgagaagtgaaggtgatttgttaacagttgctctccctggggttagtgaatgcagtagctttaaaatgcactctcggaacttggcaggcagggcaggtgtgtcactagcaacccacagtggggaacgtgtggatgaaggatcgctggtgcattgtggaacctgcctctggggcatttctcttgaaggaatctcaccccagtaaggtcagattgcaaacacgggatcctagaggggctaaatgaggcagtattatgaacattcttttggagatacgaaacaaaacaagatcacaaacacagaatacggtagaggcttttctcttttcatagtgtctgtttttgtgtccttttatatttgaattattttaaatttgcttacctctatcagattgatggattagcttcagttcttgtgggttgagccctgctgggagtttgctgattcttgagtgtgatgagtgcactgtggccttgtattgatcaattctttgtagttttgaatcgcaaaattaggagacctggaggacatgagaatacagcatattgctagttccagagaaaatggggaaggggaacagatactccaagagatattgcctgagaattttgtagagttgaaatgcatcaatcctcagttttagggagcacagcaagttctgaacaagataagccaaatgaatggtttttttcttactgaattcttatactgcaaattgtaatttgcaatatatactcatttctttcaaagtgtcaaaaaactccttataataaaaaaaattaaaattgtaaaaaaaaaaaagaatatggtagaggcacatattacccaggggtcagggtctgaaaggagggcactggggaaaaccatgctcacattacccctgaaaatcttttagtggagagcagcattggaaaatgacaaagtggctctctagaaatgcaccactgcattgcacagttttatttttccatacttggatgggatcagtatttgtttagatgatctcaaattgaaattcgtgcctgtgtttagagaccagctatactataaatgcatgtgtggaaaaagccaaatctccttctggatggatgctgacactgtgagggccatgtgcaaattaagcctgaattgatggaaaaagtccttgagggaccgaagtccattgttaaagtgatggatgatactatacattttatttaaatcatcctttcttcttttgtcccccgctcagcattcacattattgtcataatctctactggagggcattctctactggaaggtggctggttcacatcttgtgctgtcttcagagaatggctggaaatagtaataatgttaatgacagtggacacttggatatacatggaaaatatttagtttgtactattgaaagctgtcttaaatttgagtgggtacttaacgagaaatagctaggtatcttatggactatatattatgagatagcaaattggctatgtccaacctgatttctttaaaacaagtcataggttacctattgtaattttttaaaatgcatctaccctagaccacagtaaactctattgtgattgagattgggagcttaaatcaaacacctaacaatgctacatttgcttcatctttttttgggtgccaggcaaccttaatgattatcagcgcacagagtgttacctagcaacaaagccaatttgcacaaaagcaaccagaataagatcatgttttaggatggtagtcttcaattagagaaagggaaaactgcaaacatctgatttagatccaacatgctccctattactctcctgtatcaccgcttggtttccttaatgtgtagcttcattaaaatgtgacttcaagggaggttgcatccctgctagaatctttagagtaaacatgtgtcaagattcagatcattactgttttgcccttaatttggcctaaagaagataagcatagtcaagagaggaactttgttagacctttaagtcagtgtgatgttgttatgtagttaacgttactacttagagttctggagttcaccatgcaactcaggttggaggtacatttgtttgatagtaatgagatcattgagggcataagtgaaggaagattagaagaggggacaaagcattgatccctggacactccaacatggagtgtatggagagatggggagaaaacagccaagcaggcaagaaagagaaatcagtagcaaaggtggaagacaaggaagtgaaccaagtccactaatggtgagggtgtgatcagaccgtaaatgctgttgagggtcaagtaaaatgaagacttaaaaaatggcctttggatttagtatgtggagggctctagtgacctctggaagagcaattttagtagtgtgaagggaatgaaggtcttattagagtcagttaaagaaagagcggaagaagagaaattggcagcagcacatcttaggagttttgctgcaaaaaaagcaaagaaatatgatagtgtcaaaaaggaaaagtgaggtcaagagaaaaaatgctcctcttccattcaaataattcaaagacaggaatcacagcagcatatctgtacacagatgagaatgccccagtagagaatgaataattggattgagctacagagcaggtggcttgctgggacactattctgtatgggacaggggaagggatttagacaagagacaaggggttgtctctcctgagagcacagcaggctcacttacaatagaaggaccaagagctgagtctgtgagtacttccattagcttcattgtttttcaaggtagagtgcatgcacagaagggattataaagttaactagtcagaagaggatgcatggaattgagagcctggagaagatgtgtttgttagaaattacaaggtctaggatgtaacttggttgtgagtaaatgggattggtggagtgaagggaggatatgctacaacaaatactaataaaatctctaagaataatgataagagtagagctgaagaaagagacagtgcacaagagcagattcagggatgggtagatgacaacagcaatgacaacaacacccaacagtggatgatatgctcagatgacctgagattcaaggctgggggcttcagcagaggtggggaaggtcacagtgagacaaaaggagacacctgccccacatggagacccagtgaaggaaagaaacagcagttatagaacaggatttatgatgggtatgtgttctggctcaagcctttctctcctgtcttatctgaggtcattgtatggttttccatgtatttcaaggacagaatctctttgttccttgcatatgctattctttctcccccaggtcctggcaagtgctttcctcttttttttttttttctggaacacactgttcaagcatccccacttcacttactctcactacccatctgactgatttcatatgccactgtctctggagtcagagggaatccctatagctcctgggactttatcattaccctacttacctatactcttattataatttcttgcctgtcttttccactagaccttgaatttcttgaatcaaggataagatttgatttatttctctagccctagcaggtggcaggtgccaggcattgtaggggttcagtaaacattccttgaataaatgaatggatgattaaagagcagcatctgaaacacattctctggtgcataattgggtcataataggagaaaatatcttttcctcctttccctgctgcctagcaatgttctcaattagaggattatcctgtccttttgagaaggaatttggaaatgtaactttgaaaaaattatttgcttctttttgatatgtataagatcaataactagaaaaacactagcctctaaataactttaaaattaaaaaaaattcaacagattaaaaacttctggccagtgtttacaaattgctgtcttctttaatttttaagtccactctaagcatatgaacaatgcccagaaaccagcagagtggaaatgactgggctttgcaatggggttctcttcctgctgcaatgataggtgttcagacattgttttgctgaccctggccaatgcctcagtggcttagagtcctaggaatgtgtcattctgtacaaaataagtcaaggacttttacttccattgaccttagtggatattatattcactgattaaaatgccatgagtgctaattatcttcagcctccatgcctggttctgggaaaacagacataataagtaaaggggcttgttcttggggaagccccagtccatgtggggggtgagacacttaacaggtacatatgatacgtgtcacagggacccagtggatgccagtgtgtattctggcttcagagtgctagtggttaaatgcagttcttccacttagaaagcttttaacaatatatgctatctctctcttgggttttccaaatacaatgtggttctaataatgagaagaccctcatttggaggttatgtggattataataatttatacacacaaagcacttagactagtagtacccagtgtatgatacatgtctaataaatgttaaatatgattatctaggcttggagctaacatttaaaaaataaaataaagtgactgggatttcctctgtaggaaagcgtttatgaaatgaatgaatgatattcttcagaattatagattctacagtattgtgatgtgatagaaagttctactttaagttggacctctccaagaccaataactcaccatctcctgtgagcttcccatagcatgttgattatacttcatctgtaacatttatctcattgtgtcctaattggatatatacacatgatttatctagataactctgatttcctgcagaaggacctgtgcttcgttgctctttgatgcccctacctttatacccaatatgcaaccagcacctatgatgctatagaccatttgtgcaatcttgcaagaatttataaaatacacatgaatgaaataccctcatcctcacttcctccaccctatcattattacctactgctcttggcttcaagaattttaaaacacacacacacacacacacacacacacacactatggggagcaaaattgtccataaaatgtgtttgtatattgaaattcaaagtgcatcaggaaaacaggcctccactaaaaacagaagtaaaaatacagagtgaaccagatcggtcagtttaatgctaaccagttgcataagatataatagagagcaggccccagcttctttgcataaatttgattgtagaagcatggttggtcccttttgcttacatcttgtttgacacctgtgtagtgaaggttctgtgaaggactgcacaggtggggacaaagtgcagggggccagaagcgttcctgaagttcaatgccaggtgtatgaagaggaggtaggcttccagcttgcttagggtgcacaatgaggcagcagcgtggggccaccccagagggtaccatagacatcccaagtagtaccaatggaagaaatgaagaaggaggggtttggggttgaacacagaaaggtaaccagaacatgcacgtttgagaacatctgacatcttactgacttgttttcttgtctatttgtcttctctgctgactgatctctggttaatgtgctaagtttaatagatcgacctcctctgctagattggaatctcgcagctgggaatgtgttgggagattgcagggctaggcagttacctggtgaaatggaaacatttgtcttcctccttccaatagggtgttgtccacactgggaacacatgaaaaacaggagcataaattattactataaatttaggttgagatttaaccagcagaaaatgcactataagacttggatgaaacattaagtgcacagagtgaacactaaaccctaagaagtgggcttgaactctttctagttcaggatgggaagtatttacattaaatatttacttagtcatcaggcagaaaatgggattcacccaattctttgcttggaattctggaatgttccaggccccaactattcttgaagctcaactgtctggaacatgtcaaatcctcttctgcctgtctagccttctctctggctgcaaaatggcaccatgacttcagctgctggctatcaggaaggtagaaacatgcctgcagctccgaggagacactccactttggtttgagtggtcaagggaaggtttcaggaaggcattgtttaaactgggtttgtaacaatgagtaagatggtaaataggtgatgagggcagtaagtattcctgtagagttaacagggccacagtggtgagggaagttatttgtgagaaaagagagtggatccctggaagaggggtaaagtttcacatggggaaggctttgcactgggtatctgagatctggaactcctaagactgaaagatccctgcaacggaacaggacacttgttcttacattaatagcaaatgataatttatactttgcacgtggcatttcactggaacatctgcattaatcaggaaggtcgggtgatccagatttagtggacagtggccagggagtgaagggcttctctgctgagcagtagagctgggcctgccttgcttcttctgaccacactggtacatcagccattccaccatactccataccctgtagagggatgcagggccctccctggcagaaggtatgagtgaaatgagagacatgcttctccagagaggagacaatgcaagcatttccaagcacaattctgggcagatattgctggtctgcatcacggttggtgtcccttggcgtggttccatctgaacctgaagaaagtcaatgctgctctggtgagactcacgtgtgtgtagcatccacacctctgtgatatatttgtggtttataacgatttcagccactgttagtcattatttctggagtgaaattagaagcaaagttttaaggtgttcagggagaagagtgatgttttcttctaatttcagaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtaggcactgggcctcattctgccttctcttcccacaatattgtgttgcaggaaatgcattgctactgtacagtagaatcaagttgtatcccagtgaggctacattatccttttcagaaaaatataaatttttaaaagcacttatagggatatattcgttagataacatctctatagtgcttagaattgcttactttgtgtttgaccttttaactcaataacagcaatgacatctatgtacattatacattatcatacatgatttcaaggaaaattgtcttcttctggaagcatagtttcttagaagaggcatcccagatcataggacaagcctcccttgtctcagatgaagaaatgaaggctcagagagacgggcatgtgatttacttgtagctacagagaaagtttcctgaactgagggtggatgttgaacctcttgtccatgtttctcacatctattattgtttctttccaatttaggacatttgatgggcagttactaatttccaacttctgattctttctgcaatcctgacagctaggaagcattgttctatgtattttctgtgagaatactcccttttggaaagaaacattgcaacagtaaaacacatcttggtgctggtaaataagtgtagaggcatcagtggcaggattaatacagattctcataaaatgttattttgctttttcttttgccttttgagtataaattttcttctgacttaacctaaagtctccatttccctggaggtgaactaggatttgcaaaggaagaaataaaggaaaaataacaagaaagagtccttctttttcttagcatatagagggctgaggccagaagtcttggaccatcaaattctatctttggagtagaaaaggtactccagtctgtcacttaaagcttaaccataggctggagtcagaaaggagaaaaataacaaaagggagcatagaagatcaatctgtttctttctgtcccacaattttgttggaattatggaaggagaagatagatagaagtgggaaaattgagcaagcagatgtgactttttgttccactctgggctttggcctggcctgggcaattgcactagaaaagtgcaggccacatctgcggtgctggctcctcaatcatggtgcagccacatcggagttcacgaggctcagcagaaatccaggtcccagtgaggcactgagggctggtattccctaccttttcatgcccatgaactttgacattgaaagacagggcttgctaggcatgctgccatggaagtaggggaccccttggagctagctggctggaagccagggcagagattcagccgtctgcagtcagcaggacctactgtgaggcctagacagcctgggagcactctgctctggcctgacccctttggagtccaagctacaaatgccaaggtggggaggcaggcagtgccatgtggttttggttgacacccagacaccagatgaccctgaccacattgcacccaaagattcgaacccttccccgttgccacaagatcaagaagactcctgactccatttacctaagtgtctcttggggaaagacatagaaagggcagacatgggatactgaccaccacttcaaaagattgattaaattttgagatgcaacgatttaaactggacgaaacaatttgcgcactaccctggctggggactgatgcggaagatcaatgggagatagacaaatagataacattgtctctgcacctgtgaattgtggtgcaaattaaataccacaagcccactactcttgtttagtttaaaaattagagctggagtctcaaaggtttagctgacagaacatttttgtaatgagcacaaaggttattttagacagaaaaatagatacaatgaaagtctcagaaacagacagttttcttcagtttctgttgttacaaaccaaatattttctcactgtccttcgttgtttagcaattttttttgtctttggaggacttttttgaaatcatccctgcactgactgaagtgcaaaatcaatagtatgtaagcgattagataggcggtattggaagaaaaatgtgttttcaagaatcaaaatgtatagccatttctgaagcagcccaaacctctaggtaatcatagagctctgtgagacagatctaaggactgtgcagaaacaaacacttccttctgagaagaaagagctcttctgtcggaataccagtgcagtgggggctcagtctacctggaattttgtgtgtgtttcttgcttagttatgtacagtgagggctcttgatcagccctggtaccagtatttctgtgtctcccatggaaaaataaataaggaagcaaaaaataccggtgaaaactggcacatctcaactaaatttctgttctggggtatgcacttgctctacaaatcccatgtgaccctgcagaaatgatcaaatgcttctgagcttcagtgttctcatttgcaaatagagacaattgtaccatctcataggatgtgagagggcacagttgtatgtgaaagtgcacagttctgtatataccatgtgtgcgctcaatcaatgacaggttatcattattattattaaaatagacaaggggcgaatgtgggaagcgcagcttttggaggaacatatcatctgaatcagagagagaaacagtcaaacagtgtcttggggaaaacagtagcattgctctttgaggccgggcatggtggctcatgcctataattccagcactttgggaggccaagatgggtggatcacttgaactcaggagttcgagaccatcctggccaatatgatgaaaccctgtctctactaaaaatacaaaaattagctgggcatggtggcgcatgcctgtagtcctagctacttgggaggctgaggcaggagaatcacttgaacccgggaggcagaggttgcagtgagttgagatcgtgccactgcactccagcctgggtgacagagcaaggctccatctcaaaaaataaataaataaataaataaaaataaaatatatgtatatatatatattgctctctgaggctttggatgtgtcttgaatttccttaacagccactaaaaagtcatcaagggtcaaatgcctgcaaacttaattgaaattctttggaagtttattcatttatttattttcccagcttcattaaagtataattgacaaatgaaaattgtgtatttgtggtgtatagagtgatgttttgatacactgttgactccttatatccatgggttctgcatctatgggttcaaacaacctcggatcaaaaatattcagggaaaggcctggcacagtggcttatgcctgtaataccagcactttgggcggccgagagaagtggatcacctgaggtcaggagttcgagaccagcctgaccaacatggcaaaaccctgtctctactaaaaatacaaaaaaattaaccaggtgtggtggtgcatgcctgtagtcccagctgcttgggaggctgagacatgagaatcacttgaacccaggaggtggaggttgcagtgagctgagactgtgccactgcactccagcctgggtgacaaagtgagactgtgtcaaaaaaaaaaaattttcagggaaagaaagccaataagaaataataatacagcaataaaaataatacaaataaaaataatagagtataacaactttttttttgagatggagtcttgctctgtctcttaggctggagcccaatggtgcaatctcagctcactgcaacctctgcctcctgggctcaagcaattctcctgcctcagcctcccaagtagctgggattacaggtgtgcaccaccaagcccagctaatttttatattttttagtagagatggggtttctgcatgttggccaggctactctctaactcttgacctcgggtgatccaccacctcggcctcccaatataacaactatttaaatggtatgtacattatattattaataggtattatatgtaatccagagatgatttaaagtatatgggaggatgtacttaggttatgtgcaaatactaccccattttacatagggattttggtatcttcaggggtcttagaaccaatgctccacagataccaagggacaaatgtatgtatacattgtggaatgattaaatcaagctaatttacatgtgcatcacctcacatatttacccttttgttgttgagggcacttaagatctaatctcagcaattttctggtatataatgcattattactaactgtagtcaccatgctgtacaatagatctctagaatttgttcatcttgtgtcactgaaactttgtatcccttaactaacatctccctccttctcctccctccctgctccctgccccgccagctcctggcaacaaccattctactctttgcttctcttttgggaatttagattctagttgacttttatttttagacttcattgtatgggaatgtatcatctgaactacatgatagctctagtcagatgatctaaactgcctttaatcctagatcagggattaagcaaattttcttagcctcaaaggtctaacatgcaaggagcttggccttgggtgtggggacagggacatacatgtgcaagaactggtcattgtggaccttcaagctctattgcttttgtgtctacgttccatagtttatttgtaaatgcatcttttttttaatgtattgaaagtcttagtcttttaaggtgtctcctctattattgttattttttctacttgcattttgtttttaattgacacatgataattgcatatgtttattgttttgatttttttacttacattttaaattcaggggtacatgtgcaggtttgttatgtaggtaaacttgtttcttaggggtttgttgtacagattattgcattgctccggtattaagcctagtacccattcattatttttcctgatcctctccctcccggctccctccaccatctggtagacctcagtgtgtgttgttccctctatgtctccatgtgttctcatcacttaactcccacttgtaagtgagaacatgcggtgtttggttttctgttcctgcattagtttgctaagcatgatggccttgagctccatctacattccaattatgggttacagtgtgatgttttgacacatgaacacgttgtgtaatgatcaaatcagggtaattagcatattcacaacctcaaacatttacttgagtagagttaaagacatgtttagccttctctctttgaaaatttacctttggaacaagaatcagtcaatgagtttctttctatttaataaaacggaacaggttgaatggggctcagtgaaagccaatagggagtgtcgaagctaaaagcagcaacatctttttacataactgaatcaacttcaccaaaatatcttctagtttctttggcctctgctctgctaaagctaaatctgaggcttcttctttacaagcaaaagtcgtaaaacttgacaagatgctagaatgcttagagaaaacatttgaatttaatattggtttctgccaaaggaagccatgcccactgggctcactgatgactttcctgccaggaacacccaagtccccctccaccctggctccctgtgtccatcacccacaacatactctcctctctgtggttcatggctactgtgagcttttccaggaaggcattgcatgttctgatgctgctacttggaataatgaatacatgtggttacatcatccctgattccaaagggtatcaatgtataccatggccatttcagacctcttttttatcactgatttctgccttaactcagtgctatgattttcttattcaattgcgcttccataaaatatagccttctccctacatacatctcccttgtcatccaaagaagaatgaggagggccaggcatggagggttcacacttgtaatgccaacactttgggtggccgaggtgggtggaccatcggaggtcagaagttcaagaccagcctggccaacatgatgaaatcccatgtctactaaaaataccaaaaaaaaaaaaaaaaaattagccagacatggtggcatgcgcctgtagtcctagctactctggaggctgaggtgggagaatcgcttgaacccgggaggtggagtttgcagtgagccaagttggtgccactgcactccagcctgggagacagagcaagactccatctcaaaaaaaaaaaaaaaaaaggatgaggaagaggactttagtatctgaggagagagataaccacccagcttttttttttttaatttattctctccgttcattcagtgatctgcttcaaagacagagagaacagggggctgtgcacaagcactctgttttgccccccagtttcactctccgtgcctggcagagcacccacttttgttcatgggggtggggatgggagatccgtggaaactactgtagaggaaagagtttcagggcctcgaattggcaaagtggccaggacgcatttcaatttttttcagtttgaaaattggtgaggatctttaaattgtgccctggatctaccatcctgaggaaaggagggaaggtcctcctggggcctttgtcctcctggtgctgatgcaccctgtgcttggacccaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcaggtaaggagtgcaaccattctatctcactgaagtcccatttctgtctgtggcataagaaacaagtggtgacagttacatagtaataacgtctcagtggaggccttctgtgcacaatggcccacatgccaaaataagtggccccaggcctgtgcagggagcaagcctctgggaacccaagcatgcattttgaccgccaggagaaaatacatgaggagtcagaattacctgatagataacaggagctgctgtgagtgtcagggccaggaagtatatgacctatgtattctagaaattcttttctctttctttctttctttctttctttctttctttctttctttctttctttctttctttctttctttctttctttttctttctttctttctttctttttctttctttctctcctttcctttcctttccttttctttttctttctctcctttcctttcctttcctttccttttctttctccccttcccttctctttctttctttctttctctttctttccttttcttttctttctccccttcccttctctttctctttctttctttctctttctgtttctctttccttcctttcctccctccctcctccttccttccttcttttcttttcttttcttttcttttcttttctttcaatggagtcttgctctgttgcccaggctggagtgcagtggtacaacctctgttcactgcaacctcccgttccaggttcaagcaattctcctgcctcagcctcccgagtagctgggactacagacacatgccaccaggcccagctaatttttgtgtttttagtaaagatggggttttaccatgttggccaggctggtcttgaactcctgacctcaggtgatccaccaacctcggcctcccaaagtgttgggattacaggcgtaagccaccatgcccagcctagaaatatttttttgacaacgatattaccctcctagaggctaaaactttgccagaatacaagagagtagtgagggtatagagcaagtggagtctggcccgagaggctgaacttgggtcacatctgtagtcatcattgcctgtgtcaaccgggggcaggaagtggtgactctggggctgggattcagggtgtgtgggaaatcacctctccactcttgatgactgtatttgacccttggtggcccacgaaaagtcttccctcacctctgagccaaggttcctgtttgcttcctctctcattcagcgtgaatgtcattatccccaggtggctcctttcttctttggctgagaattcttgtctcccttttaagactccttcaacccagttttctgctgttcaatgctaggcccaggatctctctgtgactctcccagtggacggggggcacttcatgaatacaaacctctggaggctggccatggcaggcccagtagctaagacgggcatgttggggggcatgtgggtgtggcctcacaaggtttatcactgcagatttatattttttaaaaagaaagaaaaaaatacgagatgtcattgagatgcctattgcttaagtgtgatatttcatttaagctttgaaatggagttttgaaataatttgcttatggatatacatgaaatcaattgatgtatatatggattaacattccttactggcttcttttttccttttttttatggatagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtactgagaaaactgaagcgtgctttaattatttatgcctttttgaccagtccacattaaatgaagagatgtgggtaaagggggggagatgtgggtaagggggaggagtgtgcacttttatttacatttgatttctgattggtagcatactagatgccaataactgaacttaacaggcctgacaggtggcaattgccctttaagtgaaatggcattcttttagcattctttttttttgttttgttttgtttttgtttttgagacgtagtgcaggctggagtgcagtggcgctatctcggctcactgcaagctctgcctcccgggttcacgccagtctcctgcctcagcctcctgagtagctgggaatacaggcgcccgccaccacgcctggctaattttttgtatttttagtagagatggggtttcaccatgttagccaggatggtctcgatcccctgacctcatgatccgcccgcctcagcctcccaaagtgctgggattacaggtgtgagcccatgcacccggcctcttttagcattcttgtatttgagaagcttggtgtctttaattcagaatcatgaggtgtttaaacagttgtcagtagtggttgattgctggttgtaattcttcatgtagagatgccctcctctttctgcttctgtctgggagtctctggccccatgctgggtatccgtgatgtgagagggtttagcacgggaacactgcagacgcctggtgagctcccatcccccaggtcccacttttctctacctggatctgaggtggatgagaccactccatgtgggttcttcatagagtacacttaacaacaggcagaaataggcgtttcctccaggaggacattgctacgttgtgtgacccaacctgaggcatgccttgtttggggttcttgaggttggctctctgtgtgggcagtatttgagccctaattttacattgctattatttatataaaatgtcacgggttttcaaaaaatcaagtgctgcaagttaaaatttttaaaaatctgcaaaagtcaaagtctgaacattcagttgtgttttggaattgattccttgggttagtgatgcaggaggaaaggcaatcttttgtgtgataaatcagtgtggtcccaagtagatagcctccatcacaagttttgtctggaataaatagtcataaaagattgtgaaacataaaaaatattacaaaatgcttttatacatagaatgtatttggttcccctgaaactccgtaacttattattcctattttaaggttgagtaagctgaggctcacataggccaatttctttaccccaaatcacgaaggtcgtaaatggtgagctctacttagacctagggtttctgatagttagtcaagttctctaaattagcccatacctttgtggttgatgctctgtattccatgcatcatcaggactggagtccatccattcccactgcgttttaatagagcaagttacagtgcaagagacaaacaaaaagcagcctaataaacacacatgatgaataggagctgttttctaaagccaaaggatgcggtcactacatcttttcttgtctggctgtctcctattttcattcttcaagtcttgacatgaacggcgcctctgcagcggattcccagattcctcagcatcaattctgttccgtgttctccccacccgccctcactgcactctgaagcttttcttcgtgacacttctcccaacttgttatgcatgcttctctgtctctcccatggacgctgagatctgtgagtgcttgtatcttttctgcccacctctatagcagcagtgcccaggacagttactggcactcatggttgcttaataaatattttctaagtgaacaatgtgctgaacctttccaaagattcatccagctatatttttaatataaaatgaatattttattatttaataaaataatacatatatattacacataatatacatatgtatacatatgtaacatataatatacatacatatacatatattacatgtaataatacatagatatttaataaaacatatatatatgttcagggtttcgttgtgttgctcaggctggtctggaactcctgggctcaagtgatcctcccaccttagcctcccaagtagctgagactataggtgtgtgccactgcatctggcaccaagattttgatctttaaaatggaaaaatcagaacagtttgcctggtttcccaaggagtaacaatcatgattaaatgcctggaacaagtctgtcaaaaatggtaatggcttttctcacttacagtgggattgcatgagacgttgctgccgtagctttggagtgaccacggagctaaataacatctatacccccaaaagtcacctttcctccaggaatttttgggagacagcagtcttccctgggccaatgtagaacaagaaggaatttcctaagccccttttccccagattgcatgagtcagaatgcaggtttacagacgtgctgctaactaaagcaccatacttgaatgcagctatgtcagacaccacagttgtcactatcttcttaaatgtgaataacaagtccaaatattatattggaagctaatcatttggacagttgagagctgtcagctggcatgagtcagtttccctacagacagaaggaggcgctgcttccaggggtagttttgccatcctgggtcacttggaaaagaaaaataaaataatttttttggggggttatcgagagaaattgtcaaaaaagcccagacttcttatgttcatgtctgtctctctaatcattcaccgggttaatccggttgtttactagttgtatggtgtcttgtacagataaattgaacatattcataagctcactggactctcagggcagggaggaagatgctgtaggaatatggaccaagcacacttatcagtgaaataatgagtgttcacccccaatgtatttactgatttgcaattaaacacatgcgacaggaagagtgggtgttccctttacgtaagtggcattttgcttgttgttaacaaaagagaaatccttggtaatacttttaatttttattattaagaagagtgaaattttgtggaacattttgcttcaatattttatgaatttaaatatcacagaaaaaaaaactggtgaggaaagcctttatatcacgggtggatgcttagctcttaattgttttgttaattattgtggcatatatgaccaatcaataatatctccaggtaaaacatacatttagggagaggcttattcataaccatagcacatgtgaataagatacttcagtattctttttagtaattcccttccttcctgccttccttccctacctctctctttttgcctcccttcctccttcctgcctacatccttctttcctccctaattttcaggtctgtctgaatttttagtcacatctgagactaaaatgaagatcccacaggagtaagaaagtgtcagctgtgctgtttcatgtttgctgtgcttgtgttgctcgtattatcttcagaatcttttaaagccactatctcctttataagtgttattttagtaaaaactagataaatcaatgtaaaaatctacttagacaggcctctacaaagctgcaacctgttgaaacttgaagaactgtcactgtggccacagaggccaccagtgctcctatcagtcttaaataggaggaattctttatgtctgataggttccgcctaggaatagaaactgagatttccatgtttccttctgcaccccctggggtgctgagagagctgggcctcgacagagcctgcagggccacggggagtggtttgcattcttgaccatgcatggtgctccctcactgcactcactgcagaatgactcccctaccttggcacccttacctgtaggttgggaatcatggaaggaaccacaacatagggttgaagggaagaaacttctagtgcagcgcgtgacacacagacagacgacatttgttctgcttgatagggacttgcatgagatgccctgggaggatccccagtcggagagtgccccgggaccaagggaagcctcctgcaggcgctcccagaggacaaggctggagctgcaacctgggtgtgtcttggggtttagaggctgcaccttttgcttcctcaccctccaggtccagcctcccacctgccccagacccatgtccatgcttctccttctgatgtctgccccttccccactctcttccctacagagctcgggcctgttaagagcttgctgtacttcagtccttccatgctcagaattctaaaccagtcttggaatctcactgcatcactgcatatacctttttttttttttaaacaggagttacccatttcacaatatttatcttgaacagtttttatttttcccatagtcatgatgttcatggtgacataatttcttttacaaaaatgtgtccttatgtagttcctcccctccctgctttaaggcactttggttgtttctaaagttttgattttaccattgagactgtacaagtccgaagaacaggatcccccagcttttccatagactgattcctagaaatgcaattactgggtccaggggataaccctcaagatctgtgacggggtcaaatgacagaatccccaaatgatgacatgcatttgtgtcctagatgcttttttttcatatgcctcaatcttttcaacatttcaaaagaaacccagtgccttctagtcacatttaggatttcctaactggcctgctgccccatatcttcttcaacccatggttgccatgggaagggcctgggaatcaggacaagaacattgacacttgcatttatgtttcatcacttcctgtcggggacaatctggacaaatcacttagactggaaccacatttattcatttattttaattttaaaaaccttttaaagagcagttttagattctcagcaaaattgagcagaatgcacaaattgtgcattctgtgtccctctgcctcccttgcccccagcctcctccactatcaacatccctgcagaatggctcatttgttacaattgatgaaccgacatggacacatcaccatccagcccattaggcttcactcttgctgttgtacattccatgggtttggatgagtatataattccatgtatctgccattatagtatgatatggaacagtttcactgccctgaaaatctcttgtgctctgcctagccattcctccctgcccgaagccccagccctcagcaaccactgatctttttactgtcatcgtagttttaccttttcctgaatgttgcagagttgggaatcatacaacccttgtagcctttccattttggcttctttatcttagtaacatggatttaaattttctctgtgtcttttcatggcttgatagcttatttcattgtaccgctgaataatatttcagtggctgaatgtaccatagtctatttatctattcatctactgaaagacatcttggttgcttccaagttttagcaattatgaacaaagctgctataaatatctgtgtgcagatttttgtgtggacataagttttcaacttacttgggtaaatacctaagactgcaactgctgtatcttacagtaagagtgtctttagttttgtaagaaactgccaaactgtcatccaaagtacctgcaccattttgtgtttccaccagcaatgaatgggagtttctgttgttccatattcttgccaacatttggtgctgttagagctctggattttagccattctaataggtgtgtagaggtatctcactgctgccttaatttgcattttcctgatgacatatgatgtggagcaacttttcatattcttatttgccatttgaatatattctttaatgaggtgtctgtttaggtctctggcccactttttaaaaattgggctgtttgctttcttattgttgagttttaagagctctttgttaacttcatttttctcatccctacggtaggtttatcttccctatcttccacacacagtttttgtttaggtcaaatcatataattaaactgagtgcaggttacatattgctggattgtggcataaatatgaggaattatcaatattttttctactatttatatccaaaacacatatgcagtggtgtattttcagattagacactgttatattttaatctgtctatattttaatgttacagaataccttgcattatagaataacttctaaaaattctttttatgttatgtattagtccattctcacattgctgtaaagaaatacctgagactgggtaatttataaagaaaagaggtttaattggctcaaggttctgcaggctgtacaggaaacatagcagcatctgcttctggggatggaaggtggaaggcaaagagggagcaggcatcttatgtggcaggagcaggaccaagagagagtggggaggtgtcacacacttttaaacaaccagatctcacaagaactcactcactcgctatacactaccaaagggggatggggctaaaccattcatgaaaactccacccccatgatccagtcacctcccaccaggccctaccttggacattagggattgcaatttgacatgagatttgggtgacgacacagatccaaaccatattatgctatattccttaaatatctctgtttctgtttagtagtcacctttcttttacaaaatatttgtatttgtactttacccattcatattccttttggaaatttctcagtcttcctcctctttgccctcttttcttaaaaaatttatatttatgtacttcatatgtaaaattcctacagtaaaattcactatgagtttgacaaatgtatagagttgtagaaccaccactccaatcaaagtacagaggagtttcatccccaccaccttctgaaaagagtaattcttccacgtaacatgcctctgcaattttttaaatccaggattcatgttcttgctgttagtcaccccagaacagcaagaactcctcattagtcagtgaggagcaacagaacaagttgttcaattactttggagatgtagtacatgtttcttcaatttcttacagtaatttctactttctacatttagtatgtgctttgcacataataggtcttaaataaatattgatttactagattttacgtatctctctttttccacatctctcacacacacggacgctaagaaagaaattatctctctaagggcaaccatgggcaaagaatctggaatatatatacaatgtatatgagatctaacaaaatataaatggtatatttagagccgtttgagaaaggtatcttaaattggaaaaagattggggcttttggagaaccttcttttgtttggtagaggctataaaatgtctgtctcaaccaattttgtctcttgacacttggcgagcattgactttcctttcttatgtctgatacacagttagcatggctgttgtagcgctgagggtgcttttctcttccttcatctgcattttgcctgatgactttacaggagtgaggaggacctgccaattaactctccagttgagctcttcagctaaaaagcatattttatttctaaactggaatacacttactataaattatgatctccaactttacctacaagctagtgaaattaagatttaaaatgaaatcatgatagtcaccagtttcattaaggcatctgtactttctactccaatgcttggacctaaggacaatcctggcaagttacaatgtttactttgtgtgggatgggaccatagagagttagaagacttggctttgcatatggaatatattttcggcaatctctgaagccaagacaaaactttctggcataatgcaaacagagtaaatttttgcagtgtattttttaatagttttgaagtttttagtaatgttttagaaatgctggtgagcctgcctgagatgtgaagtttctttccttccagcttgctaaatactgattagtgggttccctttgtacctttgccaaggaggttctggatgctagttccttgggtgcatgaactcagctgccccatcctacacagcattaagaggtaaagcctgggcctcagatgtagggcttgatctttttttttttttttgacttttttttagaacaatttttaagaaaaaagaattgctgtaaaatctttgcccatttaagtttcaattgtgcccctcatgtccctaagagcaaaaggatccagtccaggatcacgagctgcactcagttgcaggcctctttagtcactgtcaatctgcaagaattcctcagtttccttgactttcatgacctcaatatttttgaagagtccagaccacgtattttgcacaatgagcctcaatatgggtttgccctattttgctgtgattggtcaggttatgcatttttagttggcatattccaggggtgatgctgtgtcccactgctcctggctgcctgctacacaaggctgatctgtcccatggctagtgaggtgatcttttttcccaggtaaagtggaaagtggtgtctgccaggctttcccactcttaagttaatttccttttctctctctttttttttttgaggatatattttgagaatctgtaaattccacttttcttacccacctgtttttgcatcttctgatgttccttgccagaattaaaaattattactatggcacttgccaagtggcgatttttctaattccatcattccttccatgtgttttagttggcattgtccagtaagaaagaactctctctttaccccattgacctatttatataaggaaccactcatagcattctattctactcaatgagttacaattcagtagggtcattatttactttgaggctcatgtcataccaagttgagccagtgggaggtccttcaagctggtttttgtgccttttaactcatgcctcccattctttgagcattttcctgcttcctgacaaaacaagatgttctaggattgccattctttcccagccctggctctagaatcagccatttctccaagaaatcctggctgctcaatacgctcatggtgattggggtgttgctgctctgaggttccctcatggataaagtaaaagatccacctctatttttgcttctctttctgcctataaatacaaaactaggagttcaactccacatctctaattccaatccaattacacagcattcatttagtgtttcctcttgccttatttgtaccgcccttcactgataatgagaaactcgacttactcattcttatgctaccttttcccttagtcctcctgtgtgcagctcatcttccaaggcctccacactgctttgctgctctgctcacatgctgtcttgtgtgaacctgccccacttcagctgccactttctgttggccccaaaccctaatctggtgtctttcttacaaaaaaaaaaaaaaaaaaaaaaaaaaaaagaaaaaaggaaagaaggaagaaagagggaggaaggaagagaaggaagcaggtacttttttgagagaccctgttccctttttctttcatgtgacatcctgtttgttgttgtttttttcttttttttcttttttcctaaagaacaatacattcagtattttgaggattcttcatttgggggctaaggtcttcttaacttagaacagtctcatggtctaagcatttatgcagacagcctgctgtcttgttaacactgactgtgctatcagccctttgactggagtgctgtgacccattctttgcattctgtttataacaaggtgttataggatgtcacagagcctgagtgtgaactagaattgactttttataacttatgtcttttaatcttccccttgtacgaataagcaaactgagagaccaagagaccaaaaaggtaatgagctgaccaaaatcagacattgaattttttttcattttgtgttggactccaaaattttctactctacttaccaacgtctcctgttctgtagtctccagggacacctcaaatcaacagcccttgtttcaaaggtgtgttgatggtgtgatagttctaggacaggctggataatggtcccccagcgacgtccacgtccttatcactgaagcctgtaagtgttacccatatgggactgtggcaggagatatcccaaattatctgggtggacttgatgtaatcaaaaggatacatcaaagggggatcgaggaaggtcagagaggaagaaggtgatgttatgatgaggcagcagttggagagatgagctttaaagatggaggctggggccattggccaaacaatattggcagccactagaagttgggaaagtccagggagtatattatcccttgattttagcccaggaaggcccatattaggcttctgacccccagaactgtaagatactaaatacattgtcttaagccaccacatttgtggtaatttgttacagcagtgataggaaattcatacaagctcctgtaaaataacaaatcttgctgcatgcattgtgttagcatgtcaggggacagccctgcccaagatcccatatttagagagcagttgctagtacctctagtgtttcgtatcatctaagttgtccatgtgttttcatcttctgcttccttaaaaaacaatcactttggggaaacagaaagagtacatcttatgtgacatgtaggtcaagtttggaaattcttcctctgctcaagtcatcactcagctgggttccattgtccttgtcttacaaaaatttggtcagcttcaaaaatttctctagcatctaagcaaaaaagtaccttgcactgaccatctccaggacacaatccatcaaactgacactttaagtgtagatcatatctggggtctcatgctgcttgacaacaccctttaaacagagaacccaaaaggatggggcataggactcatggctgagggactgatagcacaatcagtgtagagatgacactgggctgtcataaatgcctagacctcaaagctcttttaaattaaggagatgtagatccccaaatgaagaatcccaaaacttttgaatttactgtcccttgaaaagaaagagtggatacaccataggcattgcttttaaagcatatttttgttacattttaaattactttcatgctagttagtgtcctttagacataatttcatcatgtcttattttattcttatttactttgtgtgatgaatttacctaaaaattaatgactagtttgaccaacttgattgtcctttgacttgagaagcttgtaatttcagtgaaattcaaaacattagataagattgaaaagaatattctacttcttttgtatgaaagtgggaaggtgtaggtcttatttggtccatttgaattggcttatggcctatattcagttacaatgatagaaaataccaccaaaagaggaggaagacatatgtataaataatgtcattccatactaaatgcacaaacgcagcattcttcttaaattggaaagtgtagccaggacattagatgtttagcctgcattcacttcctgtgcagttgcctaacctttatttctatctcttttggaagattgtttatatgttttgatcaggacttttatactcttaataagaatatttttgcagtattttgcatctcctcataattgttgaaatgaaagagagtttacgtttctttatttgaattactttaaaaaacttgaagaacacctttcggtataaatagtgatttaaatattgctggaaagtatgtatcagataagaaggaatacagtgagaactcagttaacattgttgatgggttcttggaaactaagactttaagcaaaacaactttttttccctcatcaacattataacaaaatggcgttgaatgagatgacattatttgaggacctgctgtatgtccttttgctgaaagttgcagttgtgaacaacaacttactgatgacgctaagtgaggacttactgtaaaatgatgtaatgtggaaattctatgtccagaattcagtgaaatgttaggagccttcttgtaagttttctttcattaaatccctgggtaatgttctattctggatgttagggttacctgaaatacttgccaaggggagttttacagttgctgtctgtgtgattcagtgtgagaattataatgcaaaataacaaaggcaaagtctgccatcaagactccaaatctttgattacagtgatcagtgtcatattgcttttgaaaagagtaacctttatttgccctctctgttaattgggctactttgacattttgtcaaaatctcagagcctcccggacagcctgcctgcagttaaggtgagttgccacttgatggcacgcataacattctgatggtcttaggcttgcctttcactgttcataggcaaagttccagaattttcagacacattgtacccagatacttagtgccgtaccataattgattgtatctcctgctgatctgtgagattattgagggcaaaaactctgtccttattctgtttcctcctctaacacacacatgcccacaaatgtgtgcattcaaacatgtgcatatacattcacacatgttcatacacactcacacacacacaccctcctccccgccacatacaactatggccttttatgagaggggctagaaaaggaaaatttaaaaaggacagatgaatattgttatcaataatgccttagttatcaaggtatgcttcatataatcatagttaaatatgaccattaaatgaaaattccatttagaataagatataaaggaaaatctttagtcaatgaataattcttgattttcactatttctattgtttcctatttaattccctataaatgcactaggtgaagacttactgcactaagcctcagtgccctcatcttaagcaaggataatagtactcatctcatcagattgatctgagaattacatgatgaaacatagcacatacaccctactacacttactcatccttatctagctactgttgagaccagacattgccagcatgctacatgccaggcatcgtttttataactttatatataaatgcatttattgcttgcaacaatcctataatatgtcttatttatttatttatttatttattttttcgagatggagtctcgctgtcgcccaggttggagtgcagtggcgcaatctcggctcactgcaggctccgccccctggggttcacgccattctcctgcctcagcctccggagtagctgggactacaggcgcccgccacctcgcccggctaattttttgtatttttagtagagacgaggtttcactgtgttagccaggatggtctcgatctcctgacctcgtgatccgcccgcctcggcctcccaaagtgctgggattacaggcgtgagccaccgcgcccggcctcttatttattaccatttatcatgtgaggaaactaagttaaagagtggtaaaataatgtgttcaaggtcacatggctggcgcacactcagaaatgttattaatcattcttcttcttattattatttgcaatagtagtgaggtttacagcttttccttggagtcttactgagaatcagcaaagtgttatctttcacatgaaggtagctgcatctgacctttcactagtgctactcatgcagattttgctcagtaggattccatgcaaactaattaaccacgtgcggagatattgcatgcctctcctgaaggcttgcttgctcatggcttcttctttctggtgccttcccccatctttccctgtggttaggggctcctcaggaacatctagagacagtcaatccctttttgcttgtttagaggaatcagaatggtgaggttgtgtagagaaatcagaagtgaggcagggtgctcagtgtgggctgagatctgtatatgcaggtataggacttcactacccagggcattgggtgggaggtaccagctggatggacagtgacgctggcccagcaggagtcacttggagaggggccagggccagggaccaatatctctatggatacgtgcagaggaaggggtgatggaagcacctgcacagatgatgctaagggagagagtggcaatgcacagtgcctagctttgtgcatggcccacagagaacgttcaggaaaccttggctaaccacatgaataatagaagacttactgcatgcttccagagtctgtgcctggcactttacagccatcatctactgaactttaaatactgtgatcatcatctctgttttattaatacaacgaggcagccaacactctgcgtggtgcagtcctatgcctgcagacagagccggcccacatcttgccaagagtggaactccagcagttaggactgtgctgctgcagggcgatgtctccttgacttgtatgcttctcgtgaattgcccaatgtttattttagagattctctttccatcactccataaatccctgccagcgatccaggtgcagctcaaggccctcgatgtctccaccccacctcatttccctttgtgtctgcttgcacttctgctttctcaccttatttttgctactttagtcatagtatttggctttgaataaactgaggttggacttctgcctccactactaaccaagaaatgacttcaagcaagttatttgattaactaccttagtgacatcatatatcatagcccatggaaagcatacatttaatggggatttttatgtatgagatcccatctactgtaagtaaactgagcattgcaattttattgtctgattcacctctgaattcctaagatgctggtacagtgagtcacaaacttaagttgaattggatacactgtgttgctatctgtcccctccctgcctaccactgcctatgcatttgaccagcctccactagcccgtgagggtctgggagttcacagtcaagtttcattcatctttgcatcctatgggtagcctgttttgctgagacctaggtagtcttagagttatgccaattaaatggatggctaaatgaaatatatggggtgtgtttggcatatgttgtcacaaccggattaggcaattgaggcagaagaaaagaaatgcgatgtgtatagaaacataaaataatacatggcgtttttttttctccgaaaggtgtttttgatgcttttgcaagattccaacaagaaatctcacattgccctggggactgagtcagagctgcagaaccacaggcctacaggacatctgtctggctactgtaagtacagaatggcttcctgcatttctgctggaggaacaatgacaccagccttattcaacatcccttgttttaaaagttgtatagcaaggttctgaagttagtgaggagatgtgagtgtatagtgagggggcaagtaaatacaggtcagaggcaaaaaaaacgttgagttttatcctggcttgaaaaaaaaaaactgtgtgtttatgggacacatttatcttttcttcaggacttgacttagtatataaaaaatttctcaatgtatacagttagaataatgaccatcattcatcttattttaccttcatcacaaacaaactgatctggcctacctgcgtggtgtgcctcttatgtgcaggcaccctcctggtaatggatttgcatggtttaacaaagccccggatgtgggctttgccttcatgcgacctctgtccctttgggaccaaatcatggcttcagcttttgtatgcagcctcctttataggctttaatgattgaacagaatccagatttggtatctaggtgtgtgactgaagctccagttcagtccaattcctggcatatttattagcagcaactcagcaaggatccctgagctgagctctagggatgtggagggtaataaatctaagagctttccttcagagatttcagtctactaggcacatgaacccatgaataagtaactagaattaaatatgttataaccttttatgatgtttcccaaattgcatccttaccagcaactgtaggaattgctattgctgtacttcctcttcagctcttagtagtatcagatttgaaaaacatataatttagctattaaaatagatgtgtagtagtttctcattgtggttttaatttgcattctcctaatgattatgttaggcatatatttttatttcccacagctttattgagatataattcacataacacacaattcactcatataaatgggaccattcagtggcttttagcttcttcagagttctgcattcatcaccacaatcaaccttataccattttcattactctgaaaactggtgtcacttagcaatcactcctcaaaatccccatctcttcagccataggcaacccctaatgtactttcaatctctaatagatgtgcctattttggacattttatatacatggaatcatagtatgtgtggccctctgtgactagcttctttcactcagcacaatgtttttgaggttcatccatgttacagcgtgccagtactcaacttattttgattaccaaatatttcattgtataaatataccacatttttgtttgtccattcaccagttgatgggcatttggggttgtttccagttttttactattgcaaatatactattatgaacatttatatacacaatttttgtggatatgttttctcttacatgtatacctaggagtgaaattgctgaatcatatgtttcaatcatttgagaaactgctagactgtcatctaaagtgatcacaccttacattcccaccagtagtatatgaagtttctaatttctccacattctcccaacccttgttattatctgctgttttgattacagacactttagtggatgtgacacacaccttagtgtgtatctcattgtgggttttatttacatttcactggtggctaatgatgttgaatatcttttcataggcttcatggccacttgtatattttctttggagaagtcatattcagattttttgtccattattaaaattgggcagattttatttctagagctggaagaatttctaattatggaattgtgtgagttaagtggaatggtaactaggttttcataaatgccgtttatgaagttgaagaagtttctatctgttcttaattgtggagtgtttttaatcatgaaaggtgttggatgttgccaaatgctttctctgcatctattgagatgatcatttgttttttgtttatttatttatttatatggtatatttttggtttttggtagttaaaacaacattgcattcctgggacaaattctacccggtcatgtcatatattgctggattttattgtgctagtattttgtggagcatttttgtatctttatagcaggtattggtctgcaattttcttttcttgcagtgtctttggcgctgttatcatggttatcttcacctcatagaatgagttgagaggtgatcccttctcttctattttgtggacatgtttgtgaataattggtattagctcttctttcaatgttttgtggaattcaccagtgaaggcttctgggtctgggcttttctttgtgggtaggttttttaattatgattaattcaaatatttaattgatgtagggctattagattatctatatttttctcaaatcagtttcagtgttttatgtctttctaggaatctgtccatttcatttcagtcgttatgctattttatgttattggcatacaattgttcatagtaatcagttataattccttttgttttttaaaagtctgtagtgatgtttgtcaggcgtggtggctcacgcctgtaatcccagcactttgggaagctgagctgggtggatcatgaggtcaggagatcaagaccagcctggccaacatggtgaaaccccgtctccactaaaaatacaaaaaattagctgagcatggtggcaggtgcctgtaatcccaattacttgggaggcggaggcagagaattgcttggacccgggaggcggaggttgcagtgagctgagattgtgccactgtactctaccctgggcgacagagcaagactccgtctaaaaaaaaaaaaaaaaaagcctgtagtgatgtttcacctttcatttccacttctaataatttgagtcttctccgttttcttggttaatctagctgaagtgttgtcaattttggtaatgttttcacagaatcagcttttggttttattgatttttctcttttcaatttcatgaaattcagctctaatttttattattttgtttcttttacttaccttagatttagtttgctctgtttttccagtgtcttcaggtggaagtttgcatgaatttgagatctgttttttataattataaacatttactgctataaatttttctctaagcattgcttcagctgtaccctgtaaattttgatatgttgtatcttcatttttcattcatctcaaagtattttttaacttctcttttgatttctttcatttcttatttaggttgtgttgatttccacatatttgtgagtttctaaattcccttttgttattaaagtcccatttcattttattgtaatctgaaagaaaccagaatgggttcatatttttaatagagatgggatttcaccatgttggccaggctggtctcaaacttctgaacgtgggaggtggaggttgccttgagcctagatcatgccactgcactccagcctgggcaacagagggagattctgtctcaaacaacaacaacaacaacaacaacaacaacaacaacaacaacaacaaatctcttttcaacttattaaggcttgttttatggtctatgctggagaaagttccatgcctcttgaaaagaatgttcatctgttgtgataggtggtgtgttctatagacatctgtaatatttagtttgtgtgtagtggttgttcaagtcttttgttttcttgttgatattcttgtaaattattttatctgttaataaaatttgggtattgatatttctgattattattgtagaattgcctatttctccctttaaatctgttgacttctgtttttatgtctttgcgggctctgttaggtacataaatcatcacaattttatatcttccagatgtaagccttatttcatatcttttatagtcttctttccttcttgtattcttcctggtctttttagacagtgctggcactatacctgatgaagcagttttcgcaaacactttgtgaaaccttcttaggtttcaataatattcatccattagacaaaagccaggtgtttttgaaataacctcttctgtattttttggcttctacatagatggcagaggggaccacaccacaaagcttcctagaggtcctctggtttggttgagtagacctgtgagacacacttgatcttttttaaaattttttaattttacatacgtaacaaacctgcacgttgtgcacatgtaccctagaacttaaagtataataataataaaatatgtgtatacattatatataacccagttaaagaaaacaagtaatgcagttaaaaaatgatcaaatgacctgaatagatagacatttctcaaaggaagacatgcaaatggccaacaggtatatgaaaaaatactaaattaatagtcagcagagaaatgcaaatgaaaaccacaatgagatataaccttatatctgttagaataattaatattaaaaagacaaaagataacacatgctggtgaggttgtcaagaaaaaggaactcttccatactgttggtgggaatgtgaataagtatagccattatagaaaatagtatgaaagttctttaaaaaattaaaaataaaaccaccatatgatcaaggaatcccattacttggtatatatccaaggaaatgaaatcagtatattaaagaaatatctacactctaatgtttattgcagcaccattcataatagccaagacatggaatcaacctaagtgttcatcaacagatgaatggataaagaaaatatggcatatgtacatagtagaatactattcagtcttaaaaaagaagcaaattctgtcatttgtgacaacatggatgaacctggagaacattattttaagtgaaataagctaggaacagaaaggcaaatgctacataatgtcacatatatgcagaatttttaaaagttgaaatcatagaaatggagagtagaattgtggttactaggggctgggaggggatgtggtgaggagatgttggtaaatggatacaatatttcagttatataggagaaataagttcaagagatctattgtacaacatggtgactgtagttaataacgttttgtattgttgaaaatctctaaaagaatagatgagttttctcatcacaaaaaactatgtgaggtattgcatatgttgattagctcggtttagccgcttcacaaggtatacatatttcaggacatcatgttgtatatgataaatataatttttatttgtcaactataataataaacaaataatagtttatgacaggttaaaaaaaaaagaaataaaatctaccaagtgtgcattcaaacacatacatgtaaaatatctttggaagggtaaaaagatgctggtaatggagtttgcctctaggggaggaaactgagtagctgaaggattctatagcccccttgagatctttggtagatttgcactatgtgaattttagcaactgaaaataattaaaaaacaaagaaaaataaaaataagtacagtactcaaaaaatatttttttcatctaggacgttttttggtaatagaaaatatcaaatggaaaattaactagcaaatgtgtttttatatatgataaatatataatataagtacatatatttatatacatatatatttatgtattatatatgatatatatttttactgtggtaaaatatacataatataaattttaccattttaaccatatttaagtatacagctcagtggcattacgcacattcacattattgtgcaaccatcatcatcatccatttccagaacttttttatcttctcaaattgaaactctgtaccaattagacaacaactcctcatttctccctcccccagctcctggaaaccaccattctagcctgtgtggctgtgaatttaactacctcatataaatggtatcatacagtatttgcccttttgtgactggcttatttcacttagagtaagagtttcagggtttatccatgttgaagcaagtgacagaaattcattcttttataaggctgaataatattccattatatgtatgtatcacattttgtttatccatttatctgttgatggacatttgtgttgctttcatctttaagttactgtaataatgctgctatgaaaattgatgtacaaatatctgttcaagccccctgcttttactttttttgagcatataacaagaaatggaattactggatcctatggtatgtttgattttttgagaaattgctgtatcattttccacagtggttgcaccattttacattcccaccagcctgaactagggctccagttcctccatatcttcaccaatgcttgttattccaccttttaaataataatcatcctaatgggtgtgaagtggtatctcactgtggttttgatttgcatttccctaaggactagtaatgttaagcaccttttcatgtgcttattggccattagcatatcttctttggagaatcctctagtaaggcctttgcccatttttgaatggggttggtttttgttgtggtggtgacttgtagaagttcgttgttttctggatattaatctcatattagaaatataatctgcaatttttttctctttccatgggctacctttttactctattaattgtagtttttcttgtactaaagtttttaattttgatggaatttagcttacctattttgttgttgttgttgcctgtgcttatggtggcaaacccaaaaaatcactggcaactgcaatatcctgaagttttttcctgtgttttcttccaagaagtttatagttttagcttttacattaaggtctttgatttattttgagttaattttctatactgtgtatggtaggtgtccatttttattctcttgcatatggatatccagtattccccacatcagttatggaaatgactttttctcactgaatggttttggctcatttgttgaaaaccaattgaccatatatgtgaacattttcttctgagttctctattttattccattggtctttacgtctgtttttgtgccagttccacactgttttgattaccatggctttgtagtaacctttgaaatcagaaagtgggaattctccaaatttcttcatatttatcaatattgttttagctattcagggcctcttgggattctgtatggattttaagattaatatttctttttctccaaaatgtcattagaaactttagaagaattgtattgattagtttagatagttttgggtggtattgatatctcaaaaatattaagttttccaatccatgaacatagactatccttccacctgtttgtgtctttttcattttcttcagtaacattttgtagtgttgagtgtacaagttgcttgccctcatgattaagttaattctttagtattttattctcttttatgttattgtaaatgaaatgattttcttaatttctgttttcagattgttcattgctaatggaagaagtgcaactaatatttgtgtattgattttgtatcctgaaactttggtgaatttgtttatgagtactaacattttgtgtttatgtgtatgtatgtgtattttttagagttttatacatgtaagactgtcatctgcaaacaaagataattttacttcatccttttcaatttggatgacttttatttctttttttgcctaattgagctggctaggacttccagtgctatcttgaatagaagtggtgaaagtgagcatctttgtcatattcctgatcttagaggaaacatttttagtctttcaatattgagtacaatattgggtgtgggtttttcatagatggcctttattatgtttaggtagtttccttttatttctagtttgttaagtgtttttatcataacaaagtgctgaattttgtaaaagttctttatgtgtcaattgaaatgaccataggttttaaaaattttatccttttaatgtgtggtattaacttgacttttttttgtatgttgactcatccttgcctttcaggaataaatcctcccttgtcatgatgtgtaatcattttaatatactgtcaaatttggtatgccagtatttgttgagagtttttgtatcaatattcataaggaatattagttggtaaggttttttttttttttggtagttcctttggcttcataactcattctgtgaggctagcattgcctcatacaatgaattaggaagtttattctcctcttcaattttttcaaagagttctaggaggcttgttgctaattctttataggtttggtagaatttaccagtgaagacatctgagctttatttttatttttattttttggtgggaatattttaattattgattctatctcctcactagttataggtttactcagattttcaattgctttttgattcagtcttaaaagtttgtgtgttttaggaatttatccatcttatctaggtcatcaaatatgttggtacacattgttcatactattgttataatctttttgtttccgtaaaattggcagtaacactttcttttctgacttcagttatttgaaccttctttctttttttcttagtcaatctagctaaaggtttatctattccgtttatcttttttaaagaacaaattattgacttcattgatttttccctattgtttttcaactttgtattttattcatctctgctttagtatttactccattatttctgctagggttaggtttagcttttttcttcttttcttattttttaaggaatcatgttagaatgtttacttgaagtctttcttctcatataagagaagaatttagagctatacatttccttcttagtgctgcttttactgcaacccagaaattttggtatgttgtgttttcacttcattcgtttcaagatattttctaacttttcttgtgatttactatttgatccatttgttattttgactgtgttttaaatttccacatatttgtgaatttttctgttttttttttctgttgttgatttctaatttctttccactatgttcagaaaatacattttgtgtgatttcaatcttatttaaaatgtattaagacttgttatgtagtataacatgtgatctatccttgagaatgtttcgtatacacttaagaaaaatgtatattctgctgttgttgagtagagtgatctgtttatgtcatttacgtacaatagttctatagtgttgttcaattctctgtgtctttgttgatagtctatctggttattctatccattattgagagtgaggtattgaggtttcctactattactatagtgctatttttcccttcatttctgccagtatttgcttcatatgttatgagctctcatgatgggtatctatgcatctctaattggtacgtcttcttagtgaattgactctttttttaaagggtcaacataatgttctttgtcttttgcatttactttctacttaaagtttattctatctgatattagaatagccacccttctgccttttggttactatttgcatgaaatggcttttccatcattttacttctaatctatgtgtatccatagacttaaaatgtgtctcttgtagaaggcatgcatttggatcctgatttttagtcaatgctgccaatctatgtctttggtttatatattatttatatattgctttcctgattttctttagttctttatccatgttttcctttagcttttggagattatttgacagttgctttaaaatctttatgtagtatgtgtttcttcagagactgtttctagaaactatttctccttttaatgggtaagatttccctgtttttctttgtctaaataatcgtttgttgggaactgtgcacttgataaaatagccacttctcctaatttttgcaaattggtgtggaatacttctgctaattagtgatcccctgggtcttgagatcagcctggggtaacggcttatggtcttcatagttattttctgggcatgtagcctatctgagcctgtgtaagtgtgtgcttttgcctctttcttctgatgttccttggccactttcaaatgccttagtttttcagaaagtctcacctttttatcccagtgcctcaaatgttctaatgtattcccctatctataatcttttgcctcaggcacccatacgcctgcactcctcctttagttttcatgtgctctgttgcccaccaaatgccttccatggtttccaatcttagatctaaactatgctcttattcttgtgtgcttgctgaatcaggtaaaacagacactagtcctttgggcactctacaaccaggcaagaattttgaaaacgatttgcactttgctctttctgccctgaaggagagatcaggaattgagccatttctttgaccccaccaatatgggaagaggtgagcaaagtcaagtaaaacaccacagaatttttcctaccatttcaatgtgttttgtttgtttgtttttgattgggagtttggttggttgctatagatcttagactaatttccagagctcttgtaaagttgttttagtcagtctgtagttgtttatttagtgtttccatagggacaggggagtttggacttcctaatcagacatcttgctgatgtcactctatcctcttaatctttttagggggccaattttctgactaaatactggcattttgtgagctttttgacgtttgagcagaaggttctgtaatcacatactcagcctttttttttttctgccatgttatcaatagcttttcttgacttttgctaccttttcttttttttaacctgttgaggctgaaacttatcaaaattttaccagtttctttactgattttttgtttacttgtttgcttaacatttctttcctcattttatcgctctcctctctcattttactggaagttccagtagaaaccaggcagcaccttcaattcttttttggaaatctccttagctaaatatccaactttgttgctaacaaattctgttttccacataaccacataactgcagaagacaattttgctaaggtttttttttttttttaaaaaactaatgatctaaccaaggaaatttaagtttcctctagcgtgattccaaaaactctttcatccaaacccattccatgatttcaagttacccttacttttttaatatttgttatgtcacttctccatttccagtttccaaaatttattttagttttctattgctattaataaattaccatcaacagaacagattaaaacaatacctatttattttctcacagtttcttttggtcaaggggctgggcacagcccaacaagttctctgcttaggatctcataaagctgaataaatgtattattaagagtgcatttttatctagagctcaggggtctcttccaagcttgtttaggtctttggcagaatcagttccttgaggtgcccattttttggctggctgtcagctgggggctgctctcaattctgagaagtcaccctcaggtcttagctatgtgataaaatgtttacaagaatctaataatcatattttctttaaattctctcttacatataaaagttattaaaaaatgtatctcaaaggaaatgaatgctagaaattaaacttaggcaaaatgctaataaccgaaagagaaaataatgtgtatgtccagttaaaataaatcttgacataaacagtatcccaattatgatatatgcaggaggatattactacatagaaattagataagcaaaaaatacatttatagaattaacaaacttttgtaatactatataattccttttacataaagctcaaaaacaggcacaatcatactaaagtgatagaattaccctttggcataaaaaattttataagagctctgtcagaagtaaactggaagtttacttcttcaaagtgagcaggataatctgttttgattaatttaaaggcaactgattagcgttcttaatgagatctgtaaaatgtcttcacctttgtcatatgacgtagtttaattgtgggagtgacagtgtgtattcagggtctcactcacactcaaggggaggggattgtacatgggtttgagtcattgggggccactttagacttcttcctaccaaaacagtattataacaagctaaactgaatttccgcaacttgagcctctcttcatatttattagccatttgcattttctctttggtaacaatgtttttccttacctttacatataaattacatatttatttaagaatagtgttctaaatttattttcactaacataaactgcatacatcttatagtaaatggcacagatgttaattgtacaaccagatggatttttccatggtacatacctgcgtaaccaccacccagattgagctagaactttcccagtacttcagcaggcaccctcacatcctctccaggtcaaatccctcctcacaagggtaattgaattactttagaataattgtgcctgtttctgaactttatataaaaggaatcatacagtatatatagaagtctgtgtttttttctaagtattattttgtctctgaaattcatctatgtaattgcttgtgtaatttctatgtagtaatattccctgcatatatcataattggtctctacattctaccgtttatgtcaaaatttatttaaactggacatacacattatttcttttttgattattagcattttgcctaaaggtttaatttctgagcattcagttttaaaaaatattagttaacttttatatgtaagatcgaatttaatgaaactatgattattaggttctcataaacattttgttatcgtgagaagttagaataatttatgttgaagatgtattgcctatatatatcctctatataggatatatatatcctctttattatgcttatacatctgttttagaaacgataattttatgttctgaatttggagaacattattaaaaaacccatgtaaataatttggaaataaaacacgtgcaataaaagctaatgctatatgaaaaagagtgatgttttgaatttaagaaagaaccctgaagaaagaaaacttatgtttttattgccattataaaatatgacataaaaatgtaattttagttatcattcaaattataaatctgggaactgaaatgtatattatttaagaatcaatttaagtatttcattaccaaataagaagtaagtctaggatgcattaaaacaaatttgatatgagattgcctacatttgccaattttattatattcttcaaattcctcctataaaactccacatgaggcctcaacctaagtccagtttatgttacttagtagatgtaacttaatcacaacattagctcaggatattggacacagtgtgcattaatgtcttctaagtaaagtgatttagttgctttttgtgttgtgtgtgtatgtgatctacactagagaaattcaatttctagaatagccatttacaaaagcctttctcctcctattggtgccctcaaagattactcttttgttattgattcctactcctgggctgcacctgcctatgggcaccccttctctctacagatgccatatgtcttcagaaatagttttttaagggatagctctgaaataactcactccttgcttttctgagggattgatgaagacaaaataaaatataaaatatatactttttaatcatagggaccctagtagctccgtagaaatgagttatgaagaccgatgcctgcaactgcacttttgtccttgtctctgcaccgcagagtgtggaagtcacttcttcatggagaaagaaactatttattagctgcctgaagtggatcggacactatgataggcactttacatgatttggattttctcacttcatcattacaaccagtttgcaaacagactttcatatctctgttactggatgttatagagatgtgatttggatttctgggcagtgttgagagccctgttactaagaatctactatagagactgcgaactctaaatgataaaaatgctaaccttactgcgaaaaaaatgaaaactgtgcgatgagtaacaacaaattagcatggtgaaacctacaaaagaactgtgtgctaaatgttggaggaacatgtagcacagagtaaataactgctcagaagagctgagaggcttccagaggagagactgtgtaaacagaggctgtgtgagtgctgtaccatggccagtgcccatggggccagcttttactctagatcaagtcaagtggcatgaacacacagagtgtcccatcccactgccgagctgctgggttgaggaatcaaccagtcaaactctcacgttgcccatgtgtaagcgcttcaagaaaatgacttccccagttgtattatgacttccccaagttgtagttgtattggcagcttgggctgccaaactgccacagactgagcggcttaaacaacagacattcatttctcacagttattttctaaacctctaaactgaggtttagagatgttatctgatttgcccaaaccctcacgaggttcagcatgaaactctcatccaggcacaatgcctatatttatcctctttcttatggttatacatctgccattgcagtccctttgggtccttttttaaaataattttaataatttttattttttgaaaaggcttttccaaggctcaatatacataaatcattgaatttataatgtttagtatatattaactgcttagtgtaatgtttagaatatacataaatcactgaattaactagtcagcttcctgagaaatttagtgatctcacaactgaatgatgacctggagagtttgttacaacacagattattgggtttcacccccaaatcttctgactcaggaggtccaggatggggcctgagaacttgcatttctaacgagttctcaggagacgctgctagtccatgcatcacatctggagatacactgccttggtgtgatggaaaaagaattctacttacaatcataagttatggggctattctctcttttattggccttctagctgtgcgctggtggtacggactgaactgtgttccctgtttgttgaagtcttaaccctcagtacctcagcatgtgactatagctaggactttaaaaaaggcaatgaggactaaatgacatcaaatgggtggatccttataagaacaggaaatgtacgcataaaaagagacaccagggatgcacacacatagagataaaaccatgtgagggagaagaaagccgtcggcaaaccaaggagagaggcctcaggagaaaccaaccctgcccacaccttgctcttcttggtgctgacaactgtgagataatgattgtctgttgtttcagcagctcagtctgtggtagtttgtttggcagcctgagctgactaatacaactggggaagtcacttccttgctgagcttacacatgggcaatgtgagagttcggctggttgattcctcaggccagccacttgacaatgagatggggctttctgtgtgttcatgccacttgacttgatctagtgtaaaagctggcccccacgggcactggccatggcacagcactcacgcatcctctgtttacaccatccctcctctggaagcctctcagctcttctgagtagttatttactgtgtcctacatgttcctccaatatttagtacatgcttctctcacaggtttcactttgctgatttgttgttactcatcgcatggttttcagtttttcccagtaggtttagcatttttatcatttggagtctgcaggctctatagtagattcttagtaacaggactgtcaacactgcccagaaatttaaccatgtttccctggccaactctcacttcttgtgccaagtcaatttcaaatgtcccctctcctcgtgcctccggttcctcctcctcccactcccattggaggagggagttcctgcctcagaaagaaaataagagtgaataaatccatccacctcccaccctctcccacctgcatcctctttccttcctgttacaggaggaaacaccctctttccttcctgttacaggaggaaacaccctctttccttcctgttacaggaggaaacaccctctttccttcctgttacaggaggaaacaccctctttccttcctgttacaggaggaaacatcctctttccttcctgttacagagtagggccctcttcctaggtgaggctgatttctttgccaagatgaatcctttcccacctttgaaggaagaattcattgctctctgttttcaatgcctccccctgtcctgaatctttctcactatggattatacatgctcatggctcttcttttgctaaagacaaagcagcataagagaaacaaaacccttccttcaaatcatttccctccagttgcctccatagctctctcccctttacagccaaacttctttctcaagagttgtggagacaagctgtgacttgcatcgtcgtctctcacttgagcctcggtcaactcagatatgtgccattttcccaccatcccactcaaaaggcctgttttaatttcactggtgaccagcacatcactagtttcaaaaggcatcatcctttatctctaagctgtatccagcatcctctttttgggcaaaactttatttctttggaccctatgacacatcacttgttttcccctgagtacttgtcttcacctcacctcctgcttcatcctgaccttcatctgttagagttctaccatgctcaggcagtccctgagctctcttctctctttattcttctgaggggtcattttgtccctaactgaggtttccttgttcccatactgctgctcatacatctggggtcagctcagatcacctctcttggctcttggctataactgcctgctgagcaactccattctaacgcatcccaggtacctccatctcaacacgtttaagtccaactcatgattttaacccagaaaactttcctctggctcattcttggtcttagagaatattgctgctctctacctagtttacaaaccagaatgtcagagttattcatgagccttttcctcttgccctccatatgtagccatccctagattccatcagggcatgctctacactgcagccaagtctttctttctttctctctttctttctttcttttttttttttttgagacagagtttcactcttgtcacccaggctggagtgcaatggcgagatctcagctcactgcaacctccagctcctaggttcaagcgattctcctgcctcagcctcctgagtagctggaattacaggtgcccaccaccatgcccagctaatttttgtatttttagtagagatggggtttcaccatgttgatcaggctggtcttgaactcctgacctcaggtgatccacccacctcagtctcccaaagtgctgggattacaggcatgagccactgtgcccggcctagccaagtcttaagaataagtatttgatcacattattctcactcccaaatatttaatggtttttcatcttctgggactcaaattctgctcatggactcctaagatgatagaaggattggatcctgactgcaccttgtctatgccagttggactcctttcagtttcttaaacagatcaagctccttcttgcccccagaatctttacaacagctcttctccctgcctggaatgctgtctactctttcccccttctctgagctaatctttgttcattcttcagtacgtgatttatttgactcttctgcagagtcttcttcaacttgccagaccaagttacttccctcctgataaatgctcatgctcccctcttatgcttcacagaacctgtggcaggttgtatttaaatagctaattgcaagtgtttaacatctttgcccagtgaaagaatgcaaattcagtggagctatctcgtgtgtggctgtatttctggcagggaatgcagtgtctgtcataataaacctggaatataggtttcttgcctgactaacagaccagctgaatgagaagggacacctgcatatcaaggcaagtggtaaccacttggccttacctgggttctactctagggcttctggaatccatgtatcactgcacatatctggcctttgcgggctctgtcccacctacagagtgaacagtcccacagtgttggccacactgatgtggccaactgatgtggtcccactgatgtaccattgctttggttactttgttcggaatgtagttttaagagaaggggcctttttaaagaaagtttaaaaatcacctgggtacttagtaagatggcatattcttaggcctaactttcacaaatttggattctaaagacctagacatttacattaaggagcaccccaagttccttgatttagatggtctgtggccactactatgagaaacatcctgttagagtatctttaagctcaaagtttatgtgaaagatcacaaatctatctaatactgagtgatttggggagacatgattgttttctttatataatgctttgtcatgccctttaaaaaaaaaaaaaaaaaagaaaccttattccctgatgtgagacctgagattgcatttacattttcagctctatgatctgccactaccactttacatacagttctgttccttttttctcccacaatttaattctctgtatttcatttctaattactgcttcttctgatgatggaaagcaattttggcagtgattaatttgaagggtctgcaacctctcctttgctttttaagacaattctatttgcacagcccatcctatgaagggctagtagaactctgcctcttcagagggctgttccaaattttttgggtgtctccaggcttaaccatgatgctaatcctagagtgctgtcttttcttctttaaccaaatttcctcaaatttcaaaaaccaccttccctggaagcaaggtgggaagggacatggctgctgccaattatgcaggccaaagaaagtttgtgttccacattagctaaaagcagcagaaagctaatggcagggtgctttgcagaaaagagtctgccaaaataaaatggaattgaaatagatttgggcaggataaatgctggtggcaggtgccagaaagcagcaacttctgtcagaagcagtgaaaagagaagaaagtgtgtgtaattcttgcagccatgcagatcagagctactaaataaacctcctgaggttaatgataaatagttccaaacctcatctcctgtactggaatatcatattcctgtgagatatttaacaaaagatgagattaactcatcttaaatgcagtcattgcctcaaaagtgggtaatgcagacaggactagctctgagcaactttcactaacatatctacctccaggaagctaaggataaataggcccttgaaagcatcttcaatcctgtttcaacacccacctcctcacgggagcctaggagagttgggtagggcatcttgaactggctccttcaattccatcttcctccctactcccataatccatttctttctccctagtggatagagatacttgggaatactgtgagtagctgcatttatctctctttgaaccatggtacaaaatcatgactttactttgttaactactttaactttgttgtttttaactctgaaaatcatgttgcaatgaagccccattaatgacttgaaaactgctcctgaatgaggcccactaggcatggctgtcaaagttgagagtgaaatcaagaggttaaaggaactgcagaggtggtattaggttttctgaggaggggaagaatggacccaggagagagagaagcctcacctcaggaaggcaatacatagatagggatgctgaatacaatatttggtcaatatccatccattcaatcacccatcagaccttactgagcatctcatttgggctggggagtgagattaaagctgaagatattgagatgaatttaaattaagctccactctttctggtttcaaggacctcagcgcatatgaagaagacaggtaagtggaaggtgataggaacagtgagggagatgaacattgggctcaggttgaagagaagatttgatagtagggaaatttttcttctttttttcagctatatttattgaccctcacttgtgccagatgccaccgtaagggctcctacttgcattatcatcactaacttttccaagaggagctgtctgagccagacttccaatgggcagatgcctgacaacagagtccacatgcctgcctgcatagaaccttgcctcccaaatgtgaccaaaatagaaatcagagagcagggttaaggctgagatcataattatggtgcagcaaaattatctctcgccctaaccatcaatgacaaccgcaaaggaagctcaggtttggaaactcaagtgtgaagctgtttagagactgcaggaagacctgtctttggtgcatatttagagtttaggtgccttgaccaggtagtataagccctttagtgatactgatgggttcataccacccattcaatatccctgattccctgaatgtcaactcactgtcttttcagtataggtttaatcaaaagtgtttcagcaacctttattcaaaaatgtggctgggtttaaggtatgaccttattcacaagtgaaatactaatttgatcttttgacattttggctattacaatcatagggcattgcaaagaaccaaatcaatgatgaattagccacataggaattggaaattttaatggcatgacatgtagcatttttcttttacctatattgtgtttttttaagaaaaattacatttgaaaaagcagtatggttgttataagaaataaacagataaagtatcacataaattgataattatgagattatcaataaaacagtttagataaatattgcctccacttattagcttctttaaagaattaggcttaatattgattttactttttaagaatatatttaattaacctagctttatttatttatttgagacagagtcttgctctgtctcccagactggactgtagtggcgtgatcttggctcacggtaacctctacctcccaggttcaagcaattctcctgtctcagcctcctgagtagctgggattacaggcacccacaaccacgcccagctaatttttgtatttttagtagagatgggatttcaccatgttggccaggctggtctcgaactcttgacctccagtgattcgcccaccttggcctcccaaagtgctgggattacaggcatgagccactgtgtccggctcctagctgtctgtactgccatgtttaataaataattgtttttcaggttttatgttttgttagtaagcacccacatgccacaaaaacattcttttattttcttttccttttgatttctctctattccctttcctatttcctctctccttccttccttcctttttcttctctcctctcctcttcccttttctattcttctttaaaaataagatgtttgattttattggctctctacttggggaaacaaaaatgttttgaataagacaattcagtaatggtttggataaatatcatacagctttatatataccagaacaaagattgaagagtaccctatctaacagggaagaaaattacctgtccaaaatgttcagtgtattcagggttagccagggctggaattcaggcatcctgatgctagagtgtgtgacttcccctgtgagacatttacaaagttagtacccatcttaatggtgtctgcctattgaattagaagtatatttcccaaggaaacctgtagcactgttaaggtttccatgcagctcacctgattctatttccctgacttggtgagacagatgcaatgatttatgtcttttcatgtctgccaattattctgaaatccagcattatgactggggtcagcagaaaatagtcctcataccatttctgtaaccagcttagcatatttctgtcccataatccatgtctttgcatgagattccttctatttcttcacactctggttaccctccctacctgtcacaaacatgtttttatttttgaattgctggcattggctgactccttgaagaaacttcctctaatctgacattatgtatatttcactgtgctgttcaggtttcactgacacgttttgtttacttgtttgactctattacaagaccaagaacttctcgaaacccttcttcaaatagataacccagcacctagcatagcacttgcactagtaaatactcactgaatttaattccccaaatttaactcatttcacaacctctcttgaactggatttatttataaataaatgaaccttttgatctacattagttcagagagccatttcagcactagaattctgtaactcactgaacagagaattttactgtttctatctcataaaatcatgctttatttcctgaataagtgtacagtctttacaaagtaatttatcgtttacaagatgattaagtgttcagtgctgagaaaacccagaaaattgtgaagaagaataaaagagtcataatctcaccacaagaatataaatttttaagtaggttaaaaaatgcttataccaccttcgctttttaaattaaaaccttccattttatcaaatggcatgtagggtttatgaattattggataaaatgcaacttttcactaaaagcatatcaaaatattattttttatagtttaatattagtagttttagcaaattatcttcattctatatgtattactttgcaacatttttcatctgatatatgatgagtgtcttcctataatttcatatgtgatgttttaaccctccctcattttttggttaatacacgctgttaatacttgggtcatattccctctcccactcattttactgagtcacctttcatgttcatttttcaaaagactgtataatttcatcttaaattgctttattcacttacaaaatgtaataaacattctctatgagtatttacctatactattaccttaagcagattaatgtattttactacatccttgtattgtaatttgttcagttaatacctacacattaaatacttgtttcttgcctcttgttattatattcttttttttttttcttttctttttctttttcttttttttttttggagatggagtctcactctgtcacccaggctggagtgcagtggcgtgatcttggctcactgcaacctccgcctccctgtttcaagtgattctcctgcctcagcctcccaagtagctgggattacaggcatacaccaccatgcctggctaatttttgtatttttagtagacacagggtttcaccatgttggacacgctggtcttgaactcctgacctcaggtaatctgctccaccttggcctcccaaagtgctgggattataggtgtgagccatcgcgcccagcaagatgttataaatcacctggtttatgtatgtgatgaaattttattttattatttataataaaactcttgtattgagataaagcagatcaaaggcgatctgtatttgtctccaacagaaagactatatggacctgttctcccaccaggaatgtataagaagatccgtttccttaaccctcaataatattagatgttaacattatctttaatctttactatattgattagtttaaaaactaaattattgccttggattacaatatttacatattggctattttgtaaatcttttattaactgtatattcctgaacgttgtgtgcccattttcttttggagttttcatcttaattttactgacttgaaagcattatgtttgtaaagctttattataaaatcttcaagaacacttggatgaactgggtagtgtggagatcatattcttggatgcttgctgagactttgatatttaagctatttctcataggtgttaatgtttgaacaattgcagccaagtgaccaaaagaaaaattctttggacatttttcccaagcaatttgatggtcaggataaatgggaatgcatgattatggatgaaactagagtccttgaatataattgcactcataagtcaaagaaggcaattcataacaatttggcccagcattttaattttgtctgttaaattattcatgcgaatactttcatgagttaagccatgaatatttgattggtggttgattcataaccataaactatattagccctttatttttctcatttatgtccaattaacatatacgggaaggtggagaaaatttattcttcttaatatgagaaacatctttccccacagacttatcgaggctgtctgatgaacatttactatgactccgggtcaacattacgtttattctggcagtttaataactgttctaataataattctcattacatagagggaaaatattacaaatctctactttacaagtgaggagatgacattcagagaggttaaataatgttccagaatccacacgatatgttggtggctgagattagattcaaatccaggattaaaaaattgaatgttccccaccccacagtggctctgatgattgttctcaatgaacccaggccagtgtgcacataaatcaccactctctgagtctactctattccttttctgttaccagagctaattgctaagtagatatccaatacttgtttagtcatgtcagttttgtatcacttaacaaatatctcttctgccaactaagcaggtatttacagccatttccctgctgtacacaaatatgagaaggtgcacagtttggcaggtggctaagaatgggtggctagatgtgaatgtcaaaagctgctacgtaaaggctaatttgtaggttgtgacatttggtgaactgtggctattcagttccttttaagcctgaacaaagtatggcattttaccttgtcagagaaagagcttcttggtcaaagggctgtgaagatatcaagtaattatttcagtaattacttttagaaatccagggatgggcacccaaaaacatcccagttattttagcttgagttagagaattcaaatacttatcctaataaatatgcagacttaatagaattggtgttatccagcactataacctcataaaatcatcaagaagagtgtatatacttgtatgtgtgtatatatatagatagatagataggtagagatataaaatttagtttaatgacatacttttttcctagcaatataatctgtctatatgctgacttaataactgctttatgagagctgtatatggatcaccattgataaatgcattaaatcagtggttccatagactggctgagaatttcaatcttctgggaagttataaaaacacacttttaactctgagtctctggagattgggatttttttttttttttctgagatagggcctggcaaccagcatttaaaatgttcccaggttaatctgatatgcagcctggtttagaaaccactgctttaactacctaatgcctcatcctcattagaactttattcattaaaattaaatactaatttgccttataatttggaagtctaacatgtgactcagcccaagtgactactgggtttggaagtcttctgtccagcacaaaccctgaaatccttaaaaatgggtgtgcaggtctttcttgtcttggtttctgatcacttttaactctcatctcctgccacttgctacacggatgtgccacattctgtttccttgctattcacagagaatgccaggcctatttatacctcctgttttgatctttagacttccacattttcttgtctgcctgtaaactcccagggatctcaaggattctacctgaacgtccgggccgcttggcctgtttctcactttttcctcagcatcccaaggactcactccttggtaccgactctttccagcctgacactttgttacagtgtgctgggttatttctttacatttttatctcaacccgtatgttggggacagaaaccaaagagcccagcgcctgcacacactgggcactcagtaaatatcccaaatgaagttttctcagatatgcatttttatccccatgacccctctacaattctgttctcaatgctgtgacaaatgatgtctctttcacatggtacagcttctttaaaaatgttctcttttgggtcttcaaacttgtttgctgctctctattaactgtatttcagtttggtgtttgtgagcagtacaatccgtttagtacatctgttctttataagactgcctttcttgtgaaatacttcatattggattttctggagtactttagagtcaatcactgggaaaaactatcaccacagctgattgatccggctgagtcctgctttggacgtcgtttaagactgcagtccatgggctacctctgtctctgctcccagcttctcatccacccagtggacagaaaagctgctctccacagcttgtttggaacgtgcaacctcaactccaggagatttactgagattcgttggtagaggctccaaaggatcactcttgagggagcgtggccggatgatcagtagatgaatgatgcacagctcacgctttcctttcgaattttgcttgtggatcgctctgatagctgaggatgttttcacattcgctgcgtcccccagagcagggaagcgggagcagggaggcgcagtgggcaggcgccgggctctcctatgccctgcggggaagtggaaggcgccgggaggagcgggggcggggtgcagggacggtggaactgaggaaaagcaggccgtggggttattccctgaatgaatcccgacccacacataagctggggttttcccaggagagacctggagttaagaacagagaggaaaaggatggtgggagagaggaggaggaagcaaaggagcagcccaggtgtgtcgtccgctctaagcgcagcggagctcacacgccctgctcctgccacgcgttgccacgaggcttcctcttgcattgcagccttccggcccaaggcccagcttccgcactttaggtgcataaaggggacactcaagggagtcctcatggggtgggcctgcgtcgcattcccatggctgcgagatgccgcagggtcaccgagagggcaaacgaggcaaagcgctgtcacctccgcagagctgacccagccgcccttcctcccgcccgtcctgcaggtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcaggtaagttgtttttgttcctttgatttcgaaattatgtcgaggcagattatgaattgcaatagcttcgatacttttgagaattctagataaaaactggaaatataaatgttttcattatttccgaggtctgaattcacgaggagatccttggagaagctcttgctcctctcaggctgtctcagggcaggcgcttaaggctaatgaggctgcctggtctccgaatcctgagcccctgacccctcctcatggtggccgagtccctgcgcgaaagggcgcaagctgtcacccgccgacctgcagagggcccagcacgccctgccccacaggagggcgggatagactccgggatttgtaggattctagaacgtattagatatatgtggtattttcacaaagccctccacagttgtttctgggacaacagccccacagttgcacacacctctctgcggagaaacgtatgacagcacggaagggatggaagccctgagcctccccaggctggggtcaattgagcaggatctgttgccggtgcgttcagaagagcctgggtttttgccaccaaatgaatttacgcaagaactcagagctttctgggttgcagattcatacacaagggttgggaacctaagatagaaaccgatcccctaagttcctttgccttagtttagcgggctcctctctagattcaggagaatctgtgcagagtcagggaggcccggcccttgccgggcacggccatggctgtgatccagacatcattacattgaacatgcaaaatcgtcttcaaggtggctacaatttttcacatttgggatggggagacaaatgactggaactcagtgatactagtttacaactgcacaagcatactggctaggcttttcaacatgaagacaactaagaggacagtgtcagttctgcttttgtcaaatatatatgcttactaaaataagcagcttaaccagctaatctctaagagcctactaatatgtgtgtaatttttgtagtgatgtgtaatttggaattagatttaaacaaatacatggacaaagtaaaaatctatggtaaactcttcagtttgttccctccttgtcacactcctcaactataaaagggctatcactattttgagtcttttgattataaaatatgtttcttgaagaaaataatacaaagcacaggctagccaaaaaataaaataaaaaacaatcacatgtaattttaccagagatatctacagtaaacctactgggataatctgccacatgatatacataatacttgtatctacatgcatttgtatttgttatcacaatgagattacactgtaatactctctgtaactcttttacactccataatatctttgtatctcttcttataaatcagtacaaccactttactcatgaaaactacagtaccctgactactgaatggctctttagtagtatgttgttggaggcacattaatttatttagacagtctctttttgggggcatataaaggtttatttatttgttttttttttcctattataggcaatgctgtataacaatctttatttagttagatttaggtgactatctacttattcttaccatcagacatttctattagaattttggggggcaaaggcatcagtatttttatggtagatagtgccaaattacccttataaatgtgtgccaattaacagtcttataaagtcattgattcttttcttcaacaaatatttatggtgtacttactatatgctagctactgttctaggtggtagttatatgtataattagaacaaaccaaaacccctagttttgtgggagaaaggaagttcagttctctaaactctaaaagttttgatagttcagacctgatatttcattgcttaataggcagctctttgattactattgaagttgaatattttcaaagttttttggttatttaaaattttactttacatattgaatatattaagcatcatctatatatatataagtgtatttccacatcatattttgcttctaactgacttcttcaccctcctcccctctctcaactttaccgcttatctttttcttctgagaccgctgagaatttcccttcatggtgtttatttcactgataccattttcagttgactccagatagccattcactttctctactgcattgttaatttggcgattatgtttttcatttgaaagcatttttcctactctcccagtattcatttgttatagaagtgatgcacttcaaaattattttgagtctgagaattaagatattttaatattttcttctatttctaagagttactattttaaattgagatattggtttgttctcatttttcataatgttacttaacttatgaaacagagacattcacatgtctggaggtttattttctcatccttacaaaggagtcctgcctacacaggctatcgtacctgttccatcagtgattgcaagtgccccacttctcatggttaatttctgtctaaagagaaaagaacaagcttacattttctcagtttttattttagtagagtggtagtttagttagttatgaggaaaaagtaaaaagctaccaggaagcatccacattgatggaacattttcttgcttttttgttattatctctaatgtttgcagtgatagtcaaaaattagtgggcgagaagaataactatcatcatttgatcattttatgggtgctataactgctcttgttaggaattctccactgacattcattacttttcttctgcatactggatcctctctgagtgtgtaccttgatttctctgaagacaacccctgttgttttgcatttgtattaaacttgcctctttccactctcaaaagtgccctcttatgagtgataaatgatgtggccattccttcgttattgaatctgagcaccatgatctaaatcttggcacaggaatgattcaaaaggggcccagattttcacatcttatagtcctcctgactccctgtgtacacaggccacccgtggtaacccagcacccatccttgctgctccaaatgtgggacaaccccattttataacatctgtgagcagtctccttgggaaggcatataagattgccattacactccctctctttctccttagggtaactccctgttgatagatgcataattcaggcctgcatgtggctttcaaaaatcatgaatgcattagctttgtgctgatttggaagatacatataaatcttatcttattagtgttctgacaattctcaatagagccccatgcttctaaaattttagagttgagaaaatgcaattatatatctacattaaattcactgaaaatttcttgcagaatacaaatcttcataaaagcacaaaccagaagaaatgcactagagaggttcttttctacctgaatccttctacaaatgaagggaacagatgacacccccacagctcatagagggtttgagcttcttgggcccaaacaaacctggggctttggcaactcagtctgcagtgttctccaactcacatgctttggtggccaggtagggagtgaacgcatgacatccacagggctgtaaagatgcttgttttgtaaccagacctccacagcacattgactttatagactgtgagggaggaggagaagtatggagcatgtctgtgttggtttggggtctggtcagccattcatgacccaggcttctgactcagttttgttctgaatcaacttgctctgattgctgttttgagagtgctccagaaattctccctccccactaagaagtgtgagaaaagggtggcagggcctctgtgcctgtttagggtggaggcgagcagcacagagcagccccagagaaattagaggagggtggtgcatctctgagagatatagtgtgaacacagctgcacctgcttgcagacatctgaggctggtaagacctgacggacctgctcaaaaccttgagcagctccatattgcccaagggatgatattgccacatcttagcatatcctacaggtcctcctggtgcctctgcagcctctgccactccctttatctcatgctctgaacttcagaatgacacaatcatacatgatgttgctgcatctctccctgtttaaggaaatggaaactaccttcctctcctcagtcctctgccactcccactctatacactctaatgttcccagcaaaataagaatacttcaaaacccggctcagatgcccccttccaaggatcctctgtgcttgctctctcatctgaatgtctgtcattcctgtgtggatgtcactgtggcttaacttagtgcgggagattcttgcctttcttcctacagggagacttcctggagcttaaggatcaagccttctttatatctgtacctttagttcctgccaacatgtctataaatgattactttcattaaatccttgttaaattgaaataatgaaaatgaaatgtatcaaaaatgtcttccagaaattaacttggacaggcagcagacaaacaaatggagcatagaaagacagctctctacacattaaaaatataaaatatttaggctccatgacctcatcttctgggatggggctcttagtccttactagaggagatggtcctaaatataccactagttcactgcattagaaaaacccgtgagccctccttgaacatggacctgaccctggcccactgtctgctgagtttgttcctacccccaaactctctctctttttctcctagttctccaactaggagacctagaaaaagacctagaaggagcaagtgtaggactcccaagtcctggttgctacaccagttctttaagaacccaagagggccagtggatgtatgtggccagtcggtgcccactgtcaccatccccttctcctgttagcatgccagcagaaactgggtgcgttttttagttttctagggctgctatagcaaagaaccacaaactgggttacttaacagaaatgtattttctcactgttctggaggccagaagtctgaaatcaaagggtcagcaggaccatgtcctctctgaaggctccaggggagaatccttccttgtgtctctagcttcagtggctgccagcgatccctgacatgccttgacttgtggcagcatcactccagtctcagcctcctgtcttcatgtggccttcctcctgcatgtctctgtgtccacatttccctcttagaaggacaccggtcatattggatatggtacccactctaatcctgtatgaactcatctaattatatctggacaaactcattccgaataagatcactttctgaggttctgagtgggcatgaaatttggagggaaatcattcaacccacaacatttcctacaacatcttccttaacaaataccactaaatttgaccaatctcttggccacttgcctacagtagaatcacttggtgttctgtaaaactcaagcttttctgctatatgcagaaggataacagaaattaaattaactgaagactgacagtgattgttggtgtatatttgttggtgttctgtcatctcaaaaacatccaccaggttttgcaaaatggtcaccgggatgtgataaatgtatacttcatgatccagtgatgttaacattcatagagaacatcttcaattatttatattcttctcctcatatatgtacaacttccttctatgtatgtggcatctttatcacatgagatagtagtgattgcttcactttgtttcagtaattcagtgagaggacgaatggaaagtaattggacaattgtttggaagaaatataatgaaagttatttttcttcttattcttagtaaatactaggatggacctaatatatcatctgtgcttttgagcgggatggagaggatgtagcacactcaccagcaggctcttggaagccttttttctggcagaataacatacaaagtgctggctgcccctctgatctcatttcctggtttcccttcccttgtctgcaaggtccgccttcacaccaggcttcgtccaggtcatagaacatccaaactctggaccgactttgcatgtccagttggataccccaagagcattcttcctctcagtcatggcacagaagctgctttctcaatgtaactcgcccatggtccttttacagtccagtgggaaaaaacagatggtaaatgaaatagctgaaactatttgcttgacttaattatgtatacattgtatggggacaaagtccagcactgagtaggcatttttaaaatgtttacccatgagtgaatatatatccttcatgctctacccaaccatgaatttaggatgtacttcatggcccctcaccctgggtgaactgttcttcagctcagcccacctgagattcagtaatttgtgaattgctggtagtcgtacctcttagtgggttgaaatttaagaaaaaagagagagaatccctgatgacgacattctcattgtggacagtgaactcacagatgttgggtgaactcctcagttggcacaacctagccaactagccaacaggactgagaatccatttcaggcctcctggctctaattctcattccacaaacacttacaaggccataagttctaccctgagaaagtttacagtcaagcagagaaatgatccctacaaacagatgggaaagtcttataggtagatacttggtgcaggggttgtgcataagccacatggggagatatttaggggtgtcaaagaaggttttttaaggctatgccccctaaattgcttcttctgagataacaggtgttttccagacgtggagaagagaaagtttcttctcttgtactctctctaaaggaagagtgtgagtaaatgtgaaaagtaaggcaggaagtctagcagaagccttgatggtttctggcaggtattacggtattataaggcattctgaggagaattgacattatcttgcaaacacaatgcagggaggcattaagaagttctaaagtctggggagtgatatgagggggattatttttgtagcttccaggtatgaagtcttatttggagcagtctatctgagtctcttcccctcataggtaactttttctgtctggaattgtgcaagatttcttctttatccttggagtaaaggattcccccccccctactgtttccttatcaaaactgcagatttaagtctttttttcagttcagggtaatttttttggggggtgggggagtacagggtctcactctgttgaccaggctggagtgcagtggcgtgatcttggctcactacaacctccacctcctgggttccagtgattctcctgcctcagcctcccgagtagctaggattacaagcatgcagcaccacatctggctcatttttgtatttttaatagagacagggtttcaccatgctggccaggctggtcgcgaactcctgaccttaggttatctgccggccttggcctcccaaagtgctgggattacaggcgtgagccaccgcatcctgccagttcagggtaattttcttctattattaatctaatttcttcacacccatttttcctttacctccttttagaactcctagcacatctcatgttagggtcttccaaatccatcttttaattctttatctttccttaaggatttctttttcctttttgtcctccttctgtgtggatttttcttatacatcactgtttgtatctaaacagtggctatcctcttactcaatttatacctctaatattatcttcaggaaaccattcttcttggtttgagaaagtcctgtgtaggcatgtgcttctctgtttttttgttttgttttgttttgtttttaattttaaagtgtgtattcctgcagcacctttatttttcataaatattggcactgtttgggtttttctctggttgctgggaccccaggacatgtgtttgttattgctgttttgacagatcagataagtatgttgcctatcaactggacgaagttccgaatcaaagcacattctgcctctgtagggcagcagctgggctgccagtactttctgtttttttcagggaggtggggacctttgcttcctatactctctctcatttaggaatagaaggcatcagctcctttaattaagctttttcttgactattggggtccagcgagagaggggaggctgaggtctctggagatttgcaggtctctgagggccacacctcccaggatgggtcctttctggtccttttccctggatgctctgctcctgttcttcacattgcattcatatgtggcctggcctgtagagatgatggccctgaatttgcttggctagtagcaaatcccatagagcccaagacctcacctggaaccagaaatttatcaacaccaaaagctggttggatcaggagaggtcgaaagactggagctgagagtgtagggaaggaaggaataaagaaaggaaaggaaaggaagggaaaagaacggaatggaatggaatggaatggaatggaatggaaaggaatggaactgaacggaacggaacggaaaggaaaggaggaagggaggaagggaggaatggaggaaggaaggggagagtgtaggctgctgtcttcccagatgccccagtgtttctcaaggttggtttgatccttgtctaaatcagaaccactggggggacttgttaaccaggaaggcccattaggagtgtgtatttgttcagccaagctccttgggtcactctggtgcacaataaattttaagagatgattattagagagagtgattccatttatgaagttcctcgagaatcataggtagtaattttcaatttctagagtctagtaaggacagatgtcaaatgtttctaacatagagatttactttaaaatatagccaggagtttgaaggcaacaaaagagggatagtttaggaaaaagcatttgaagtttgtggtgacaaagatacttttaaaagaagcttgcatttcctaatttgttagaaacctgaaggctgtttatacagaggtcacactgcctacttatgagacataactttgttgtaaatttcagcaagttccatcattgtgtgtttctggccacagctgtagggaattatattaggacagttgtaaaccatacgaatattttaaaatctttattaaattttatgcagtggggaagatagtgtttttctgtaaacatttatttctggatttggatgccacagaggtgtttgcattttaagttgctctggaaacaaagtcctcctcagcagaaatataatactaatttaatgtaatgagttgcatttcttctcaattaaattttgtttttgtttgaatggtaaaagttcagaaagggccagatttagggaagtaaaataattggatggagattaaggatgaggccaatgaattcagtgcattgttaacatatcacaacttggttcgacacatcatttatgagaccctgagttccaacacctatcctaagcattgtgccctttcctcaaggattgcttcattccagtaatgagaacaagggtaagcctccagttaaactccagtgaagatgtatactaaggccaccaggcaggacaaatggagcagaggaggcagggaggacttattatggaatcggtgttccaaccaaggtttccaggccaggctggagatggcttccaatcaagtgtccaggatattggagataccgagacagagggatcagcaccctcaaaagcagatctgcccaatcaaacagtggttctcctggtctgggctgcgctggctaggctgggctgggtgccgtgctcaggaagaaatggtgagcaacaggccctaggattgtggagggattcaaatactatttcaaaacgcataggtaacaagaagccattgatacattttgagcaaagaaaatgtcagattggtatgttagaagagctcactaaaggaattagagaaattgggagtctgtaatgttccattctatgtgtacggtcacactgaacagtagcctaatgagaagtttcttctcattctgagcttacgtttgttctgcaggatgtggttggaaattcctacatttccacctcagacctttctacattttaatgctaatagcaattcagaaaaatattttggactcaattatttcttgtctgagaacaaaaaattaattagagaaatcagtggttacagattgctctgtggttgcttacatttcttctttctttttttttttttttgcattttctgttttaaagcttttttattgctcataataattatacatatttatggggtacatgtgatattttgatacatgcgtacgatgtataataaccaaagcagggtatttaggatatctatcacctcaaatatttataatgtcttactttgggaacatttcaaatcttctagctgttttgaaaataggataaattgttgttaactacagtcaccctgctgtgctatcgaacactagtacctatttttttttataactgtatgtttgtacctattaaccaacctctttctctcccctattcttcccagcttctggtgtttgcatttcttcaatgtagctaatgttttaagttctttaaaaggagtcacttatgtatatttgttaatttatataataattctttccaaaaagaattgaggtcaccaggtatatctatataatctataatgctgattatataccatttttgaaatttttgagacaagtgtttgcaaagattcttactcaaaaagtattttataaataatgcaatgtaagttctgaaaagtaagaaatctatactcttttctaaatactaatttagaattttaattaattaaatgagctcattctcattcagtccaatttagaaaatcttaaaatgtctttttctctacattttctcaagattgtcttataattgaggtataaaatttaatacagggtttgtttctacaactccccacagtgacatgaatagtgtcttattgctgatggtgtcttcagtaaggaaattcagtattggtggttttggctttcagtaatgctgcttgaactacaaatagacttctgagatgtgtgccagtaaaatttaatgtgtacttaaagcacacataggattctgtgttgaggacctctgttaagaaaatgtagctcaatgtagctcacatatagaaaccaaatgatatttcttacattagaaattgttttatttcaggactatgttaatagaacaaatattcagaccaaactggagctccaactttaagagcatagttttgcagattttaatatattaacacaatatgatattatgtagcctttaaaatttgtttttaaaaaccatgtaaatatgtgaaaaatggtggtgttatattaagtgaaaatgttgaggaaaataatgtactgtgaatgtgagtctataaaaatgcatatctgatggcaaaactatacttgtaataaattttccaattttattgcttgtttggcattatcataaaaacagtggaaaattagctgtatctcacttactaggaatcattagatggatcagcctgactagggcacaatgtgaggtcagcagctggttctccattctctgttgggagccactaataatcccactttgtttcctttgtctcacaatgaacagcagcagtgggggcgacaacttggacctcacccgtgtgcttctgcggaagtttagagatcaagatttgccctgtgcagatttaaacccacgccagtaagtgtcaggtgctctctgcaaaagtgaacactcccaactggtaatattgtagcctgggaggactgtttttcttcatgattggttatttcatgtcacaagtttatgttataaaaaatgaaaattagcctaatgactaggttattactgaatgggccttatgggtatcaccatataaaatgatccgaaataagcttcataattaccccctttctcccttcgtacatgcatgctttatattattgcaaaataaattaataattaacagcattcaatttgtttaataaaacccaaagctgaaaagaatgaagtaggaattaagtctgaattatgtcttagctattatttacttttagagaatccttgtacatataaaaaattaattatatatttttttaacttaaaagacttaaaggtcagtactgtacatcaatctggggtgaattactttgaaaatgatctttttggtatttaatcatggttattgtgatgatctttctatgaaacctggataggggaggcctttctttataaacacttatttccctcttattttgctcaattgttatatattgaagatctactacaagcaaagtgctgctgtaggaaccaaaattaatacggaatatggccctggtctcaaggaatttacagttctgggtagagcaaatgaggcaaatgataaaagccataatgatttattaagtgccagaagtgtatgtttttaagtagtaaatataaaaatctaacaataatacaatattggcaatttgttttctaatttgcgatgacatattttgcccattagtcatattggtaattagtgtgagactgaaaaactattaatgttctcagtaagaaagaattaatagataattatgctgcttcactctagtctttgcaaaacaaagtaatttatttaactaaaacttcaatggtaatgtttctatttttctcctctctgatggaatacacagggtgtaaaatatgtctacctttgaaaaattgaaatgtaacctagggccccatggggtccagccctggtccaagctgggatcaaagaagaaccagttagaaaaaaaaaaatcttttatctagtccttctccttccagaggaaaaaaacaaaaggtagaatcaataattaaaggacagcagaacgtattggacattttgtttggacacgtattttacttccagttccttttacatgggttgcagtagagccccaaactctcctcctctcctctctctgttccatgagctcctgccctccagcccagcctgcagatcagcctcatagcttttctcctctgtccgttcttcttctaccttcctggatttatgtttttgtgttctcccttttctttgtgaaatctacctaatctatccttaactcatttctatatttaatcatttctatctatttttgtggtcagcataacaaaagggtaggaggagaggtacatgaaaagatgctgtgaacacttgtattaataataatttatgtccatgttatacaaatagggcttgattcactaggacctcaaatcagagcaaaaagttttacttaaaacctgtagatttccttctgtaagtgtaaaatattgttgaatttgatgatatctacattttacctccttggaagacttgggcaatcacttgataattaactagaggaaacattttaaaataatacattagattctactgataggttgcttttctgttgagatactcagctctgagtgtcaactcaatggtgctatgttgaacttctgatttgtacctccctctcatacgaagacaatgaagagctctagaaaaatccactgttgtctaaatccgatctaaaatatgagttttctcacagtagtaggtgatgcataatttaaaatttaaaatgtgttaaagtagtcaacttttagtagctgacgggtagatatagatatttagctttattttacaaggcttatatctggtggcacttcagtgttgaattctcctactatttctaacacaaaatggtcactttcctcacccattcttgttaatggtttagtacagaacaaaagtcatagcaaatcttatatttctatcaaacttaaaacgccaagtggggagatggataaggtttatttttgtaattaaaaagaaagttattagatagcagtgatacaataaatcatctcagtactcaggaaaatctagaaggctcattattagccaaaaggtgggatcttcagagcctgtcatggctggtgacagattccctcttaggggcctgtaaagaggaaagttgaggccatggatcagcagtgtagagaatgtgcataccagggatcatgatagaggggtaatataggaccagtcttcctgaatccaaatctcagctccactcttactgactgtgtgacccacgcaacttgctgaacctctctctgcttttcttcatttgcatcagtgtgctctcagttctatagaaagaacagtcacctcaatggcagggtagttcttgtagagagcttttgttctcttaaggcaagttcctgcctcagaaagcaactctcaagacaggaggtccttagagcttctgcctctgtcttcgagatttaaaatgcaccttagcactttggggaggccgaggtgggcggatcacgaggtcaggagtttgagaccagcctggccaacatggtgaaaccccgtctctactaaagatacaaaaaattagctgggtaaggtggtgcgcacccataatcccagctactcgggaggctgaggcaggagaatcacttgagcccaggaggcggaggttgtagtgagccgagattgtgccattgcattccagcctgggcaacagggtgagactccatctcaaaaaaaaaaaaaatgcaccttaggtgattgaaaactccaggcagccctgtagtagagagaactatttcacccagtgtgtccaaacctgaaggaccaaatgaccctcctccagcagcctctctgcagctgtgtcctgtaggccactttagggaaatgctttgctaagtcaaagtgtatttttcgattcttaaactttaaaagaaaaattatgtagaaacttctgatttctcatagatcatcccctctgtctctcccttttatgaacattcacacagcttcttagtgaatctgtttgaacacaaaacttgttggaggctgagaagtgctcaaaaaactacctgtcatgggtcattatgtacctctcatggacacctagttttactctataaaagggagctaggagaagaataagggaggatttggaagagaaaaagaagactttttgaagtcatatattaaattataaacacttgttaaccatcatctaaggcatctgaaggaagaaaggcctgctgagtttcagaagtataaatggaattttttttaaaagtacatatcagatacagtactctgattaaatacgtaactctcttaggtgttatttccatgtaaactcttaagtttcaaactggagtccctataagctagtcagccaacaaagtgtggagaaatctttacgttatttttgttgtttcaaaaattacgtagacattgtactttgctaacctggttaatagaaatggcaagtttcttttcactgggcaaggctttcttcaattggtgttatcatactggctttctcattggagcagcacacactttgcatagagctgggatctcgacagctgcttcacctctctggaccccacctcttcttctgaaaagcagggctagtaaggatggtggtaaaaatatctagccggtgcttgtaattcggtaaatgctagttttcttcctccttttccaatttttgagtaattaagagtaattatcattactgaaacaaagtttgatttccaaatgctagaaaaaatattttaaagtatgggactcataaggaaatagaaatgatagggaaactgtggaatacaaatgtgtttttgaaccactgctacaaatggttttcataactgtttctgttgcacaatctttctgcaacagaaagtttaaccaaaaaggtttaaagaggaaatttaaaaattgtttttccttaagtgattattgaattactgtgtcatgccacaaaaaggaattgacgtcttgctgtttattaattgcttcttggtacctgtttatgagactgcaagcctcagtttccaccaggagccccagccgcaccgtgaaagtcctagggagccctgtgatacactcagtacagtaagaaaagtgagccccatgtaatataatggaaatgctggcgttgtaataaaacattgtcatcagattaacagctcaagctgtgaaaacaaatgtaagagctctgccttctcggcagtgggagatgattatcttgtgaactctgttctagtctgatgaaactctcttttatggaaatacaatggctttgtaaatctaaaagatcattccaattctctcctttgttttttaggaagaattcttcatgctggcgcacagatcccttttctcacccagaattccaggattcatgtggctgcctggtaggtttctgcagcatttttgatctttttaagtctaaaattcaagtgacaaaaatgagtttaccctatctataaaattttcatatttgtaactgtgtctttataactttttggtttcctggattagctgtttctgggaaaagttttgtcacataaagtgaatatttatagaacacagatgctgtatagattgacagtgcccctctccttcattgccttctgcctttggtctttaacattcccctggcattcattaagaaaatgactattcttcaagtaatgataaagaagctagaattgccctaaggaaggaaatttttctaaatttcaaggcagcatgacctcaaggttcttgccatatttttatttgggctagatattaacagctaagatgccccttagctctctgactatggttgattcttacaaaaacatgtggaagtaggtgtgccactattgaggtgagagacatcactgtctaatctgtgaaggagaataaattgaaatttatttggaaaactgattggaactcatctcaaagaaaatctcagactctaattaataaaaggcatagacctgctagccacaatcaataagcaagtatgatgacaggtctaatttataggaaaaagggaaaagaaaaaaaatattgaagttaattgagcatctgtaatggaaatggctatttggagaacgtgtttacagggccttcctagttagtggatgatgagatgcaattctccttaatagttgtcaacctaagggaagaaactgagacaaattaatataggtagagagtttatttgagccaaagttgagaacagctatgtgggacacacttccaagttatctttggaagtactctagagaacaaaaaagaagctcaagtgaaatggccttattgtctagggtgtcaaatgaagttatttgtctcatggccaaggaagtcaaggatgtggacacaccaagagtgagcttagagcagaaatgtaataagtgaaagaaagagagaaaactctctgctgcagagagggatctcaaaaaagcgttgtcattttgcagtgaagtgcaatagttttaataaaaaaagctagcagggaagggtgctccatttatatagggctcaaaaaaccggttaggactaggtgtgtcatttccataaggcacgaatccctggcagtccccaccccatctgtttagtgtacatgcaggtccttagcctaagttactccatattgcttatctcctcctactgtgcatgcattaggggcggaaccctttttattaatccattttcatgctgctgataaaggtgtacccaagactgggcaattaacagaagaaagaggtttattggacttacagctctacatggctggggaggcctcacaatcatggtggaaggtgaaaggcacttcttacatggcagcagcaagagagagaatgagaaccaagggaaatgggtttccccttatcaaaccatcatatctcatgggacttagtcactaccatgagaacaataagggggaaccacccccgtgttcagttatctcccattggggtccctcccacaacatgtgggagtacaaatcaagatgagatttgggtggagacatagagtcaaacaatattacccttcaaggtggatgtgcctggcccaggctagctcttcttatctatagtgttgcagccatgttccaagcaagctccccgtgcaagcttccttatgtgagtatgtcgaaaaaggaaaggaatgtgctcactggggcccactgtatgtcagtgaaacttgctgactacacaggaggcccctttctgtgagggaattcatctccccatctatgtttgcagcccgaactttcaggctgctctttgttagaaaataaatgccgctgaggaccttgccctaactatctgcctagccagtttcttccttccttctctctcataatttattaaagaaaaaagaatgaatcaggagagtgggtggttacaaaagtcgtttgtcagggattctcactggcattgttaggttactttatagctctggtggtggcactcagcctagggtccatatagcgagctgcttagaaatgattgcttagcccaagggggatggggtggagtgtgactgctatctcactccagtgcctctctgggcctgattatttaaagggagctcacattcctcagataaaaagtttttttgtttgtcttttttctagagattttagaagccttgcttttggaggaactagtctgctttcttctcttagacgaaagatacacatgtaagcgggaatagtgacacagtacgcttagtgagcactcagagtgttggttgatatgggagaggttttggaactctccatgtttccctcttggccccagctgtcaataaactcagctacatttggtgatcctttgcagtgatcagttatctttttttttaaatacataattattgttttttttcccctggtcttgtttttccatttattcactttaggggcaaagggcaaatttccctttcaccctctgaagcttcactgaaaatcagttgacaaaaggcaggttaactggggaaataccatacaaatgtgtgaatttgcatgggaggatcacatcacagagtaattaccccaaacccccaaagaggtgcagaaatttctatacccttttcataggggaaggaggagatgggaaatgtggataattcttttagggacaggaaatgattgttatagagaaagaatgggccagggagagagaaattaggttctctctaattagatgattagatgattagaaattagatgattctcctggaatttgagtgagcccgaaagtcaggcattatcttgtgaaaaagtccatccaagcatggttgcattcttcacacttcttttctgaaatagataatgagatttcagggaggggattgaggacttatgtgtttcctttggtaaggagttttttggtcagatatggaaattccaaagagaattggaatggaggaggaacaagacaaggtttcagggaccttgattctgaggcttatttctgaggcctttcaattgataaaaatgcccagcatgcacaaatgccatattttgggggattgttttctatgcctcagcactcatgagatctctgattttttacaccacgctcttattctctagccttgatttgatcattctattatagtagtggcttttagtaccaccagctacctaaggcctattgggattagagtgggtaaatatcagaatgattggtgtttatgttcctaaattcacttcaactcacataaactatgagatttcagtaatatgtaagaaaaaaggttttatctgaaaaagttccatagtcaaatacgttttgcaaatgctggataaagcagtattaagcaggtatctttgccacagctcttctaagaagctatttggtgataatgaaattgtccttgaattgacagtggagtagatgcagcattttctgcaaatttgactgcaagagtccttcccttttgtggcagcagtgtgtttcgggatgcactttgagaaatgttggaccacacgttagaaatcagagaacctcaggagacagggagttgaggtggaattaatgaaagtcctaagcaatgggtgtggctactctttggggttgtctcaaaggagacgtacacaaagctgtgtggaaggaaggcctatagacccaaggccagttctctggtctttagtgttcatgttgagccaagttgactgtgttttgttagaaggaaaaatatttctcttcccttaaatacatgtgtgctatccagcagccctgggtctgcaagagcatgtcaatttaatttttttttttttttttttttttttgagacagagtctcgctctgtcacccaggctagagggcagtggcgtgatctcgactcactgccacctccgccttctgggttcaagtgattcttctgcctcagcctcctgagtagctgggattacaggcatgcgccactgtgcccggctaatttttgtatttttagtagagatggggtttcaccatcttggccaggctggtctcgaactcctgaccttgtcatccacctgcctcggcctcccaaagtgctggggttgcaggtgtgagccaccacgcccaacctgtttcctcatgttttatcaaatatgctgtggctgtctccaaacctacaaaaaggttccatggttagtccttctgaggatgaaaacatgatttggaagcgacaccgttagaaaaggcttaaaggggaacaggaattgagctaactctaaagaacaaacagggatttttagggtctgagctccagtggataacaacactatgacccaaaacatgtcatcgggactgagtgtggctttatacagaataggtggagggcatatttgtttcttgtcgctgagataataaattatcacacagttggtggcttaagaaaacatgagtttattctcacacagttctggaggctggaagtctgaagtcagtgtgactggagtgaaattaaggtgtctgaagactcttgaggacaatctgtccttttcctcctccagcttctcttgtttctggccttccttggcctctggtgacattacacacatctctatctccattgtcacagtgcctcctccccttctttctctgtctagtcctcctctgcctccctctcacagtggcacaggttgtaaccagcaaaagggcctggctgctcgctgcttgtagaaagaggccaaaataataacgagctgattaaaagtgagcaagacttttttatatgtgccagcaaggggaagagcagaaagcaattccgctgtaatttgtggagggaacacagggttttttaaagaaagggtttggaatgcagaagaggcaggggtggtaggttgggggttggggagcggggagctaggaggtcccaggaggggttacttactccaatggttcatcttgaattattgtttcatttggtgaagaggctgaccccatcgtggatcctgccaggttataaactaatcacaatcttgtagttagtcttcagccgggaatgggttctggccttgaagtaatcttttgttggggacagattttcagaggtgtctagtcctctgaaacttctaaggaaatatatgaccaggtaagtgagcatggcatgtgcttaacaagcatctaggtaaataaatatgcataaggcatgggggcatgaagtgggaaaggaaagagaaagaaaacatttcgaggctataagtttatctcagagctacatcttgaaactcggaggggaaagaggaaaagggaaaggataaaacattttaaaatgttgtttgaggctaaactgctaagcagctcagttacaaggtgagtgcatgagggtgcactgtcacaatccaggataatcttctggactcaagatctgtaacttaataacatcgtcaagatacaaagtagcatttaaagagtccagagatgagggcctgatattttggtgggggggcggtcaatattcagtttaatacagagggtgtatttggggacacctacacggataatggttagaatgagaccaaggatattttctcatgatcattaaaaagtcaggaaacaacaggtgctggagaggatgtggagaaataggaacacttttacactgttggtgggactgtaaactagttcaaccattgtggaagtcagtatggcgattcctcagggatctagaactagaaataccatttgagccagccatcccattactaggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaataatgagttcatgtcttttgtagggacatggatgaaactggaaatcatcattctcagcaaactatcgcaaggacaaaaaaccaaacactgcatgttctcactcataggtgggaattgaacaatgagaacacatggacacaggaaggggaacatcacactccggggactgttgtggggtggggggaggggggagggatagcattaggagatatacttaatgctaaatgacgagttaatgggtgcagtacaccaacatggcacatgtatacatatgtaacaaacctgcacattgtgcacatgtaccctaaaacttaaagtataataataataaaaaaaagaatgagaccaaggatattttctagtagacctgaattcttgataataattggaattttttttagcaagaaaatcatctaatggaaaacaccattttagaaggatgtatcttgataagtatggggggtggtgaagtgaattggagagaggaaagctggaggtagggaaactttggaggttgttatgttcatcaaggttggctgatttatttatttattttaattgagaagcagaagttatatatatttgtggttacagcatatcatatatcatgatatatatataatacataaaatgatatgatatatatacatatatcattatatatacatatataatatttcatttatatatagtatttcatttttatatatatcatatatatcattttatatatatatatatataatcacacacacccattatggaaaggctaaatccagctttttaatatatgcattacctcatgtacttattgtaggggcacaggaaaacttgcccttcatcctctgtaagtttgctaaaaaatcaactctaaaagcagattaattggagaaaaggcatatgaattcttttaacatgtacagggggagaattacagagtgattatctatcccccaatgaagttcagaagtttatatatcatctcaagtttaccaaaagaatagggctttggatcctggcaaatcaggttatggcgggagaagacgcattctgtactgggacaataaaagattgcaatagagaataaatggatcttggaacagacactctctgtttaggtatggttacattcttggtcttacagggaggagaagaaataaaacattctccttggtgagtctagattttagttaggtaaagaatttcaacttcatcctgtgctttgggagagatggtgggtaggagggaggtcagagagaccttgaagcttctttagctcagcatgtgaaagcaccacattttggggtattgttttctgagccccaacgttactatttgtgtgcatgtgtttgtgtgtgttgaggatacttaaaatctactctttttttttttttttttgagatgtagtctcgctctgtcgcccaggctggagtgcagtggcgcgatcttggctcactgcaagctccgcctcctgggttcacgccattctcctgcctcagcctcccaagtagctgggactacaggtggccgccactacgcccggctaatttttttttgtatttttagtagtgacggggtttcaccgtgttagccaggatggtctcgatctcctgacctcgtgatctgcccgcctcagcctcccaaagttaaaatctactcttttagcaattttcctttttcctttttttgagacagagtctcgctctgtggcccaggctggagtgcagtggtgccatcttggctcactgcaacctccgcctcccaggttcaagcaattcttctgcctcagcctcccgagtagctgggaccacaggattgtgctaccacgccctgctaatttttgcatttttattagagatggggtttcatcatgttgcctaggctggtctcaaactcctgacctcaagcgatccacccacctccgcctcccaatgtgctgggattacaggtgtgagcccctcgactggctcttttagcaattttcaaggtacaatacattgtcactaattgtagtcattatgttgtacaatagatctcttgtacttttgcctcctgtttagctgaaattttgtatccattgaccaacatcctctctgccaatcaccattttactctctgttcctatgagtttgacttttttagattccacaaataagtgagagtcttgctgaattattatgtacaacaattattattctttttagtatctttcctcaagcctttctttcaagaccctgaaagtagtatcttaaatgcatatcgcccttcttactttgctgtagttctttcatgtgtatctgaacctaacagcaaatccatgcatttaggtaagcctgttttcattttcattttgcaaataagcagacaagcttccaaagctgtaatgaatgtgaaactggcccaaatgtctcttagaagtaatatttatggattttcgaataaacatagaaatggaccctccctggtcttaaaagttgaaacttacatttctctcacctgagtttcttcctcaagaaactgatcctcaggcaagggactgaaatacgttagatctctgagttcagaaaatgagactccagacgtcttatccatcatgattgcttccttacccctccttctttcctgttttcccattttcccctccatataacccccaccagttttagatggttgaggagatggatttgagactttctctttcattctcctcagctgcagaactcagctaaaagcttcctccctggcaacactcattgtttcagtgattggctttctgtgcagcaagaccaaacccctggcattttgataacaaaagactcagagacagagtcgtttcctattttaatatatcatcttttctgaaagtgtttgagaaatggaaacaaagcacattaactctaaagccggtctgtggcagggcagagcacatcattgcgcagcctccagtggcctgggttttgcgttgtgttgatcacctcctcctaccttgttaggtgattattccatgatgcagagctggtgttggcatgctggtgagtcgctggagaaaagctgtttgatttctactttagacccttatgaaagagacacacgcctttgaattatcctgcttatcttcctcccactagttgtttctgactctctttcaggttcgtcaaatgcaagatcaccccagtgaaaacattttttttctttttagtttttataaatctgcccaaacttacatacagaaaaggatttgaagttctcagatataattgactgcataagtcacagtggtattctggcataattctcaaatacatgtgactgaaagagattttagaaattagaacatataaagggctgcagataatttattaaaaattgaaagctagagaacaatcacatgtagtttcaagtaatgtcagtgaaccagtttgtgaattataaaaaagtttgtttttatctttttgaaaacaatttcagaagtgtccaaatagaagtgctagtgctccctacctgaccaaccacctgggccacacactgttgaatctctcaggcttcaatatggaggagtacttgctggcaccatctgaaaaaccaaggtgtgttcaatactcttgttgggtctttacttgtttggattactatggaaaacttattgttttaaatgctaatgttcttaaaaagtcaaaaatctaagactgaccttggtgctcataaaaattccacagtgtgtgatgttccccttcctgtgtccatgtttttacattgaaagtagacaaatagttttgtcatctgtttctcatccatttctaatatttaaatataataaagtctaattgaatacaaaaacaaacaaaaaaaattccacatagatgccatggaccttaataagattccttactgctgactttcactcttttaagtgctgggggaaatcctatcaattgagatttgtcagtggcagaagcacgagagccagaagctgttttactgctttaggaaataagagcagataagtttacagcatgcaagctccacctcccaggttcaagagattctcgtgcctcagcctcccgagtagctgggtctacaggcacctgccaccacacctggctaatttttttgtatttttagtagagatgggatttcaccatattggtcaggctggtcttgaactcctgacctcaggtgatcctcccgcctcaggctcccaaagtgctaggattacaggcatgagccgatagctttttgaaggtgggaacttgtgtgcccagaacttagaatattatctggcacatcaaagatgttcaaccagtatctgttgaatgaatgagtgtattcagttgagccagttgggaatgtgtacttattcctttgcctgaatttttgctgagagtagaacactgtgatagaagagaagactattcttcagtctccttttatctagtgagtggaagacaaaatttatttagataatagttaacattatatttttttaaatgttaaccctttttttgaagtttaatagatacaagatactgtgcaactcatggagatattaaaaaaagatataattcccacccaggaaaaattcacagagctacataaagataaaccagcaaatagacaataaaacccagtgtggtaattgataacaatggatggaaatacagggtattgtgggaactcaaaagacaaggaacatctaacccacttgaaattgtctggaatgctttcctaaaccagacaagatttgagtgaaagattaaagaaatagagtagggaagacaaaccagagtggctcaaaagattatgaccactattaagaaattttttttttttttgaaatggagtcttgctctgttgcctaggctggagtgcagtggcacgatgtccactgtaacctccgcctcccaggttcaagcgattctcttgcctcagcctcctgagtagctgggattacaggtgcctgccaccatgcccagctaatttttttttttgtatttttacaaaatacagaaaaagacagggtttcaccatgttggccaggctggtctcaaactcctgacctcaggtggtccatctgcctcggcctcccaacgtgctgggattacaggtgtgagccaccacacctagcccaagaaattctgaataatggatttgtagagggaatgaccattaattaaaataataacagtgctgatgatcaagccctacctgttacatggcatgtatttcctaacaagacagtaaggtgtgacaagtacactttctaatgtggccagccttatccacaccttctcaattatcagtgccttccgttttgcctggcttgggagccaggaaacttgcatcagcacagcacctgtctgcctgtgtgttcatgtcacagaccacagatgctcagttggctactgtcctaagactgctgtacctggtggggttagtaatgaataccctctgattagaagtcctggtgctctgtggttgaagcactaacacaatgttcattgttaacaggcttggaggttggtcttttggattaaaaatccccagtgaagctggaggtgcaaatggaaacatatcaaaacccccaactctggcaaaggtaatcatatttttttatttttttcctgttttagaaagtatttaggaaaactcaacattcaaatataattttgagcacagggttcagaaggaccagattaaatccaatcatttgttactaagcatcaaggaaaattatatgtaaacattgtcttgaaaaaaaatggcttgtttttctttagaaatcgaggaaataggtttttgctttttgttaagacaggacttcacctagtaaatataaagtggaggaaaaaatctattttcaaagatacccacagttgtcataattggaaatatcactagtttctttgctggccaaggagtacttccattcatgaatgtaaatgccttatcttccagaaggctggatagataggcctggagatgacacaaagaaagcagcagttacacagagctactcttaggagtcctggattttcaagccctgccaggactatacctgtgaattaggaatggtccccttagaattaaagagactaggtgggagattcttcagctttgagagaatgaggactgggatagaggaaagatgccttgatccatcagtaggaatagagaagtggtgaacccaacagtgagttgttatttaaggaaaaaagtcaacactaccttaaaatggggaaagcagaaagattcaaagcattcagtctccatgactggagaaatagtattgtgtttgattgagagagaaatcagaaaagggtagattgtgggaggaagttaagtccactgcgggagagtgagtgtgagttcttattaggatatcagtatagacatttcattctgtagtgtgtggatgttgtgtctactcatgagccaattgtggagctatgagaacaagaacaatctccatgagcccaggaaggcactctctctcttctgtagtggggacttgcatggttcatgtgaacctgaaggagcttattgggataaagacatgcacatgttggaggtttattcagtgaaataaaagttcttacaggtgcttcacaatgtcatccctgatgagacagtcatacttcacaatgtaatccctaaacaaaattttaacagtcatgtattacgatgtaatctgggaaaaatttccagtcatagtgtggacgattcaggaatctctccaacagctgaggtttgttcaaatctcttttccttctaaagacaacacacattcatgaagatttaaagcttgatatgaaaatatcattattaataacttgatagaaaaataaaatgtatttgctgacatatattggaatacattatgtggccattatgaaaatatacctaattagtagaaggaatctgttcatttcctctacaaatattccgactttttagtctatcccaatctaaacccttcttacgtattcataggagatggttgtgtctttgctttgaagtgtctgaggcacggacctcttgttcagtgatgagtggctggggatttgtgtgttctcctcacatctctaactttttgtctttgtttagatgagtcttctgtactgacatgtttgagtggtgattgctgaagtttttaatgttatttacgtgtccttcaccaggcacaagcatgcaggtgaattatacttgaccctttggggactgagctcctctccagcaagccaaggaactcaacattgttgtggggtgtaaagggcaatctattatttgaaataccagaactgctggcggctgatactgcttcaaatgattgcatttatctttctgtaatgaccggctttttctttcagcccttaggctacattcatcgacatagatgatatgatttcatagtccttctgaaggaaaacatgaaaaatttgcatatgaataggcttaatgtatggttcaatatcttgtagaatgtctcttgtgtgacctttatgagttctatcattcacatcttgagtgtttagcttgtttaatcaaaacactctttagaacttacacacttcagttaaagaagccaaacacattttcactttcgtttttttcatagttctgttctcccatggaattttatatatttgaatatccactgagagttttttttttcttatagctgcttagttactttttggaggggctgttattcctgagatgaaaggtctgttttgaggtgtcatagtatgttcctaaaagaagattaatttcctatttcattattggactttatcacttcgtgacttatggactggtagggaaggaaatcccacagcttatttccagaacacagcctagttttagaaaaccattcttgggagaaaaagaaaaagaaaaagaaagaaataaaagctttttctttgatctctgttaagtcctgaatggtaactttaagatcatcacaaagtatgcatttattacttaaagaatctataaaacctttctcaagtaaaggccagtttataaaggaaccgatcaggagttccagaacattttaaaatctgttccttggaactctgcaagtcaatcatttattgccaaaatgatgctatgtagcaaacaactgcaaaccgttagtagcatcaagagtaaacatgcatttcgctcatgagtctgtgggattgtgctgctgtgggctgtgcataacagatggtgccaggccccactatctgtggggaatttgggatgctctttatccaggccctggttctacatccttggaatgttccccagctcatcatctgcaatgacccttaactctactctgccaggtgcttccccttccattgccctccatagctatgtgtgaagatactttaaaatatgccttttgagtagctctcagcctgcttcctgcctgtggacagctgggttcttagagctatttacattttacatgtattccagcctggggtaccttcttgatatagcttcctataaagcaccctaggctttctagttttctaactgagatccacaagctactctcacgatcttgttgagatatgctgctctctctaaaattaattagtggcatttggggaatgccagaatactagaggacaacaccctttaggttcctaaaagccctgtgtctccctgagagagtctcttagcagcatcattctttgaagatctcaacaaagttcttacaattgcacccttgacttgatctttcttctgaggccatgtctttcaacattctctcaagagagctccgtacccaggtcaagatgtttattgggcaccatttccatctttgaagttaatacaggtgacattacccactgttttcacactgtaatatgcgtcacccttttttcaattatttatagcagtttgttttttattatttttccccagtattcctaaatactttatcatgtatttccaggcttctcaattgtctctttgtcccccaacttgctagtatcaaaagcaacgccaactattttcggtttttggtacagtaacaccccattccagtgtaaatcactatattggtactctattgccacaataatgctctataacaacaatttcaaagctcagtggcctccacaatggatgttcatttagctcacgggtctgtgaggttttgctaatgcagactgggctgggctgatcttggccaggaatgaacatgtgtgtggtattggcttcagctgggatgacagtggaggtctcagctccactgttgcatctgatgatagcagaggcataagggagacttcaggaacatacatgtgcctctcaattgtgccacattctattggccatagcaagtcacatggccaagcacagcatcagaatgggagggcatgaaagtcatatagcaaagcatgtggatacagggatggtgaagaactagggcccttaatacaatcatgaacagaagttttggcccggtgcagcggctcatgcctgtaatcccagcactttgggagtccaaagtgggcggatcacctgaggtcaggagttcgagaccagcctgaccaacatggagataccccatctctactaaaaatacaaaattagccgggcgtggtggcacatgcctgtaatgccagctactcaggaggctaaggcaagagaattgcttgaactcgggaggcagatgttgcagtgagctgagatcatgccattgcattccagcctgggcaacgagcaaaactgtgtctcaaaaaaaaaacaaaacaaaacaaaacaaaaaaaacaaacaaacacaaacagaagtctcagaatctacaaagggtgaaactagggaggctgagcaggcagcctcctgtctttccagctccattcagccaaagaagctctgtttttgtttctgtactgtagtgtggtgtcatttttaagttttttttttaatcactctacttttaaaacaaaaattaaaataataaaacaaatcaaaacaaaatttaaaaaaccttaattcagggcagggactatccttgtgtcttctattttttccctaaatttgaacagttaagggaatcaagacttgggggagaaggaggtcacagaccaggctagtgggaggttccactttccataggcagtgggcttttctaccagattagcctgtcccttaacttcaacagaatcctgagtttctatcatttccagaaatctggctagtgcctgtgtaggtgtctgtgtgtgagggggcagggtggcatgggggagaccccaaagggtgacagtacagagttgtgtgggtggatgacatggacacacctctgatatatgacataaactccttcagttcacttttgacttttccatcaaaggaacttggaatttaccctactttggagaattgtgtctatgttgctgtagtttttttgtttgtttgttttggtcacaaaatcccactctgtttagacatagctttgaacactcacagttctgtagttagtgggtctcaagctgcacttcttctccttggggtttaaaaaaatgattggcaaggatttctctgtgaacttaagaaaatattttaaaatgagtggtgtgaaagatgagatctgcattctgaattgcctgaagaggtaggctatttgagaaggaattggggaacattgtcttgtgtagtagggttttgttttttttttttctctttttggttttttaactatatgatcaatattttattacttagctgtttccacaaacacaatagctgccacacaagtctctggttaaaaaataattagttatagcatgaaggggtggaaagaaaagagattggaagccctcaagttggaagggatttgagatctggtccaaagtttgcataaactacgataacttgaataggttcccccaagccttaacttgctgtgaggcagcggtaattctaccaagcggattatctgtcacaaaaggcagcctcttctagagaaatgagctgttcagtcaattgaattaagaccaaaatgcatcagttggagtcatcatacttcttgaagacactcacttgcttttcaaattaataatatattttcatttttattaaaatattgatactttgaaatatagatactgatggtttgattagtgttttttatgatgcttctcattccagctttaataacattgtctttctcttattttcacctttctcttgacaggcatgctactttattctccatgctcagcaaatgttcagttcagtttattttgagaaataatgttccatgttcagttattaatttgaaagtaatcattttttttctgataatcttccacacatttaatttgcaggtcaaatttcagtagcttactaactgagaaagaaaaaaaaatgatagggtttggttcctttattcttataagaaaataattatagagcaacattcacatttgttctggggaaaattaatctatttttagctgtaaattatatgctggagataaatataaaattagcagactagaattgactgctcactgtcagccatgcaggaacattactttgaatcctgcactcaggtgccttggaagttaattgacacatacgttccttaaatcccagaatagttgacaaacagacttacgagctaatttcgtgagagccattaaattatctttctttttttaggtgtggtataatcagaagggttttcattccctaccttcctacttaaatcatctaaacaaccttattttgtggcagcacctaccccctactgtggactggagacaatacggtaatgttatttttcatgcattgtaattcactactttcaaaagacaatgtttttaaaagtgaaagaaacagaaaagtttctgaatagaaatgtgaggggcaatgagaaggtttctacttggcaaccaatccgtgtctaaacacaataccaagttgtaggctgtctttccctttgtgtgtcattaaatgtctttattttcttgaacctgtaacctcatctgtaggatgaggggaacaaaatgtgactggagagttctctcctaaaattattttattctgtgacttaatatcttacagaagcaagaaaaattttaccttttaaagacaatattatatggaatactgtaatagagaatacagactgtccctcctccttatcactgggaagatgaacatcacattttgatttatgctgagccctcaattcatcagttatttatgttgatcattgattcattatctatgctttcttattttggtaaatggcacaggtccatttctggtatccagagttaacttactggtttaagtgaatatttatttatttcacttaggtgggataaattataatttgttaatttaatttagcttcttttttaaagaaaggaaagaaacaagaagtataagcaacaggccatgtccaccacaatttattcacaaaatgtatttgttgaaacattaattcacatagacatcaacactaaacaatttttctaatatgctctcactttatttcaatcatactttatttttccatatttatttttccttctacaccagttttttaacaaagtaaatttaattattttgtggcattgtaattattttggaatgctaataggtaatgtaaaagttaaaaatgtacgtgactaagagaagtacaaaaatagtacaatagtcatacagagtagggacagcagaataacatttctaacatatttgaagtgtatcaagaacttcattagatatttaacatccatggtcttatctgatttttatgtcaattttgtaagatagacaatatttgcctactttactgattagaaaactgattttcagaaaacatcgcctatcagctgtggctctgagcaaggtaataatggggccatgactggattctaggtctagctgataacaaactcttgcttttctactacatcaaactgagatgtcattctggtgggcatgaatacagcatggttcacagaggggaagtcattaacactggatcttgaacaatgagcagaagtttgactgaggtcagaaagccattctaggtcttagcaatgcaataacaattatagtgtatgttcagcttatatggaacagtccagtttcacctcatcataaagctgaatgtagagggataattgttgatctctttggaaagattgtttaagatcaaatgctgcttggctttgactgacatgatgaagagtatggactttagtaagcaatggacaggctttaccaatatgtgagaataagaatgacataatctatgtaatatgttaggaagaatgatctggaagccactgattaaagggagaagactggttgtaatttaatgacctattggaaggatactgctcacaattttgaggttaaggccaggatgaatccagaggaaaaaaatgataaatttcagacagatgggagaaaagattgaggcactagggatgggaataaaaaagattttaagaaactaaaatataaacctgagcattttagagttcagtactgatgacattataagaaatggcagggagaagagatgttttcaaggaaggggcgaggtgatttgtgcaggattagagatgctagtttggttcacatacatagatgaaaatgtgcgtaggattcagaaaactggagagaaaagtttggtagagcagtcataggtaacctaagttctaacattaataacaaatgatagataaaggtgttggtaaagtgagatcctgcacgggtcagacacaggctcagaacagaagaaggctatgggtagaacagagggaagaggacaaaggttctgtagcccttgaggtaagaagatcttgcacagaggccagtggagggcagaatttcacatggatgggcaggaaaaatgaaatatttcagggtcatccagaagaagtagaatgcagacgttttgctggtgacttccagagggctagttcaatggtgtttcagaaatggaaaattaaagtagaaggaattaagcagagagaggttgttttaaaaacttgagactaaacagataaattctaatttgacttgttgatgcatcatcatgggaaaggaaggtttgtgcaataaattgggaatatacaatacatagcaccacaggaaggtgtgttggcagttattatcaaaatattgataaagaactcccacgagcagggttctgatgaaaatatttcatcacatcccttgatgcttgcttgttcctgtgggaaatggacagagctagaactattagcttaatacttagagtgaaacaaaccttgccccaatgtggaacttcagtaaatcccatgaaaacagaagctgtgtcttgctccctgttcgtctcagcagtcgcacagcaccaggctcaggggacattcaggctataacaagtgaatgaacggatcattatactacacggacaatatatcacacttctcatgacaatggtttttgatgaggtttcagcagatgtacacattctaatattagagatttctgaaccctgatgcaggccgcttgataagaagctattttcttagaacccaggctggccctttctctctaggagacagctagctgctcctgacctatcttctcagcctcatgtctcgcttatggcccctcactttcccctccgtgtagctggcctttgcatcactgccctgccatccctgtgagcctggtagctgcattgcctctgctgagactgcctgtcttctcctgcatcaccttaagcatttctgcttaactttctaggcccatctcagacatcacctctgttggaatactcaccacccctgcaggatgagttagtggcttctctttcttctcccacagttatttgcttatgaaattcatccatatatttatttctatcaagcattcatataatgacagatatttcccagacactgtgttaggtcattgctgtattttaaatgtgtctcccaaaagtctgtgtgttggaaacttggtccgcagtgtaacagtgttgggaggaggaacctttgagaggtgcttgggtcatgaggcctcctctgtcatgaatgaattaatgtcagtgtctcaggagtgggctacttattgctgttgccatgcccttggacttcccagactccaaacactgtaagaaataacttttttcctttataaattacccagtctcatagctgggcatggtggctcattcctgtaaccccagaactttgggaggctgaggcaggtgtatcacctgaactcaggagttcgagaccagcctggccaacatggtgaaaccctgtctgtactaaaaataaaaaaattagctgggcgtgttggtgggcacctgtaatcccagctacttgggaggctgaggcaggagaattgcttgaacccgggaggcagaggttgcagtgagctaatatcactgcactccagcctgagtgacagtctcaataaataaataaataaataacccagtctcaggtattctattatagcaacagaaaacagactaagacagtcattagagcagttgatacttcacattatcattatttgtttacattcctttgttaataaaagtgtaaacacttcatggaaggtgtttatactactgatgtttgtgttttctaaagtctttattcataggtattcaataaataggtcatttaagtgaatttgcttttgcactatattttagggttactatagtacattccattatgataattacattctaaaataaagataaatatgcagcaaaatatgtacttgcttctttcgttattaggaccttttaagttggcataattttgttaaattaaaatattaaataaagatataaaataatgaacctaagaggaaatttcttttaataagattaacagaataagtgaaaacagaagattaaatagaagtgcttaagtagataggaaggtatcttcctctgatagagtaaaaatgaaaagggataaagtattattttattttgtgttattgggggtggttgtgggtggtgatgatagcagttgtaaaggttaaacttcttcaactacttattgaaatttcatccaaaccttggcatgccagtaatgaaatgccaccatgtgggaggaattaacctcagcaatgtcatgaacaagccagatccatggtcattaaactgtctgtacattggaatcacttaagcatttaaaaaatattgatttatgttgcttatccaaagattctgatttggttgatttggagtaagtctttaacagcaggcatttttaatgtttttgggtgattctaatggtaaccaagtttgagaaccactgggttaaactgataaacttcccagctgattcatattctgaccactgaagcaggaaaacagacagaagtgtaagttaggagtcagtttagagatatccacactcaccttctcactgctaggaaggaacctgatggatacctggctactgggtgtcaggggaggactgttctgtattagaacaagaaagagctcttgactttcttttctccccatttgtatatctcttttggaatcccctggagggccacaactcattagtatgctgcaaaccccagggaggaaggagaagggtggtgcatgttgcatgctaggatgatgggacagagatgaaatgaacctgggagcagtggatgacatgcatggtagattttcctgctttgcttttgatgaaatgagaaacctgctaaaatctccaaatcacaatgagagagtatgagcatgagaacaggggaaaatctctgatctgtaatagagctactgaatgaacagcattggctgttggaattcggctggcatccataaccttcaacatgcccttgagagctttgggtatatttgagatatttgagagagaagatctggtggtacccgagtgaaggtaaaggggcaccctggtaagggaggattctgagcaatgcaaagcaccagtactagcttgcccttgctggaatcagggagtaagaaacaaaaggacagcaaagccagttatcaaacccagtatggaacaaggactgatcccccaaccacagagaggaggacattgcataccttgagagggtgttttcatggggagcatctcatgatgtgtttatatctgcataaatagaggaaaatgtgtgaaccctatgaaagagaggataaaagataagaagaaaatgccaggctgagctgcagtgtgttacaaaaacggagctagctaagatgaagatagaaatatgaattttcattggatgcagtgaataacattattgattgattacaaacctctctccttcacttagaattattgacttaaagaacaaacatgcagtattctctaagaacacacagggaaaaggtgacacagtaaaactgatcagaggggaaaagctagaggaatcgggtatagaaaaaaagcagatgaataagaaagtaagaaggaatgatgtaagaagaaaatgaatcgaacacaaaacaaaacaacaaaataattctgtaccaatagattggaagagtttgtcatgattctatcaaaatttatgaattaggtattatggcagtagcaatgattgatgcacaaatttgatgaattttctaaagttcaaggataaagaaaaaagtttttacaaagctatgagtcaaagcacattagtttcaaaggaataaaaataagactggcctctgacattttttataatttctcttgagacttcatctttgacccagggattatttcaaaacatgttgtttaaattctaagtttttgagattttcctgtggtctttctgttactgatttctggtttggttcatcacggtcagtgaccatactctgcattatttcaattattttaaattggttgaagttcattttatggtcaggatattgtttatcttgaagcttccatgggtgattaaaaaaaagtattctactcttgttgttagaaatgtacattatatgtcaattagatcctgttggttgattgtgtggttttgttcttccatatcttcactgatcattgaagattactgaaccttcactgaagatcatcactgacacatttcgtttgctgagaggcgagtagtaaagtctccaaattgtggctttgtttcttttttcagtttcatcagttttttcttcatgtattttgaagctctgaggtacacgtcaaatgtgtgtacacatttggcatggtcacatatttctggtggattgagccttttatcatttgggatgattatattttcctggtagattaatcctttgcatatatgtagtgttcctctttgtcactagtaaatgtagttgctgtgaaatctattttatctgatctcaacatagtcactccttctctttttcttttgattaatgtttacataatatatctttcccgttattttatttccaacctatctcattgtgtaaagtgagttttgtgtagagtgtatattgttaggtcatattttttaagctgcactgcctatctctgccttttaattggtgtttgggaaccattgcatttaaggtaattactaatatatttgggtgtaagtctgacattatcatttgttttatgtttcctctgtttctcttttcttgctttccatgagttacttgagcattttttttgattctattatgatttatttatagtatttttaagtatatacattcatttagttttcttagtggttcttctaggtgttataatacatatatatgacttatcacagtctactgatattgttatttactaccttgggtgaagtgtagaaagcttacttcaatttacttttaccctgtttacctttaaaatattattgtcttaagtgtttcctatacacaccacatcagatggtgttctaattcttagttaagtcaccaaatatgacttaggaaactcatgagatgaacaatagtctattatatttacttctatttttaacgtatcttgatgttcatctttccttttgtaagttctaagccttttcctgttatgatttcctttgtgcttatgtaacttctttttgctattctttaagagtaggtttgctaatgaaaaatttgcttatttttttcaactgatacgatctttatttcaccttgattcttgaaagatattttcactgaatatagaattcatggttgacaattaaagaaaagctcagcacttgaaaaatgtgctacttccttttggcttccatggtttcaaattagaaatccattactattctagttggtattttcttccttctctctttgtgacggctttaaagaattttttttgttgacttattagtttctagaaatttaattatgatgtatcttggtgtggctttctttggttttatcctatttgggatttatttagctcttggatttttaggtttatggtttttttttgccaaacttgggaagttttcagctgttatgtctttgaacactttttcagccccactctctctttcccttttctctaagatcaggtaataagattattagctcttgtattgttttcccagaggtctctttcctgagtctcattttttaaaaagtttatttctctatgttatttagattggataagttttatttttttcatctcgagtccatgcagtctcttcttttttagctgcactcaactgtggagcatgtccagtgggttttaatttctgtcattgtatattttagttctagaattttcattcattttttaatcatttatattttctaatgagattttaatttgtttttcatatttaaggaaaattcaaaattactttttgaagcatctttatgatacatattgtcagataatttcaacattcagttcattttgacattaccattttttattgcctttttcaactggtaatattctggctcttgttgtgaaggattattttcagttgtatcctaggcattttggaaactgtaatatgtgactctggattccttttcctagcaggcaagccctctgttgaggaatcatatgagagccacctagatgtatatgttttgattccctgtgggcctgatgacaccaccctggctaggcaaaggtagagaactgacttacactgcttttgtgcagatgagtgggaccagatcgcccaccagcctcactgacacattcatggcaaatgaggcactgactcatgctgtctcattgtctctaagtgagtgggggagtagagtctgctccccattgggccctgatgacgctggggacaggtagtgaagtaccagctggctcactttgaaagtattctttagtctcatcgaagccagatgggaatggatgcttggcatccctctgtgccctgctgccactggggtgggggcagtggtggaaccagggtactgagtagccgtattctgcacttctgggttcagtctcattgctgtcaggtagatatggaggctcagctctttgttggtccctcatgacatgagaagtagagtggcggctagccctgtctcactctgctttgtgaagtctcattgctaccaggtggggatggagtctcaacttgcctcaggaccccagtgagaaaaccactgtgccccttgtctctgtcaggtggggagtggaagattcactacccaatgggccctgctgaaacctgagatggtggggacagttttgctggtggtgtttgcctagagtaaggcagatattgctaaaaagtagttcttttgttagaccactcttttccgggtccttgggttttttatttttgggagcctttcttatttgtacttgttgagtttcaatttggagactttggcaatgccttgttcaggatatatgtgaggtgataaggaagccagaatatttactgttgtattgttgaagtcttatagtctcagggcaccatcatcttgtttgcaccccagaatcttcctatttctgtttgttgtgttatgtccagcagttttttattgtaaaaatgaggacttggcagaactggggctgctccatctaggaggactatctctgacatattagccacaacctcaaaggcaaagaataatagaatagcacctatggaatatggaaagaaaaggctatactccccacattctgtacctagtgaagatgtttccataaagtacacaggccacagagatatgctcatatagaatgtggctcaaaaatatactgtagacatattgtccattagaaagaatgccaggaggtagttatttgagatattaactgaaaggaagatcatgaaaatattgaatgcacacaatgaagaaaagaacttgggtgagcaccggttgtagtgaaggacatagattatgcaaatgtttgcatgcatgtggtgaaaaattaatggaagatcaagaattacccattaaactgaagatatgtaatataaaacttaataataatgcatacatgtagagaaaattctcaacagaattaagatccaaatgcaaacagtgattacttctgattggttttggataggattataagttattttaattttattctttaccctatttaaaaatgtaaaacccttctacaattggcatctattactcatagagtaataattaatattgagaaaaatacattttttcaggatagattgatgaggaagagagagagaaagtcatcaaaacgccttgtagtcagaagaacgcatatatttcttttaatagtttgttagattgaattaactttttactcttacatatttcactgatatctcataatgaattaattaaaacaacgtaaactttccacatatattgatgataagacaagtttttccttttggtagatgcttacagacatctgggcattaatacttctaaagatatacattttataggagtaatgaacccgaaagtgagtacttgaattggagacatcttaagtatcttgctatcataatggatattggacaaaagcacagatgtgcatttttaccaatgacaaataaacagagtctggaaaccataacagatgtagccataatgagaacactaaatgagaaaactaattttgtacattcatacattgctgtgggccaattcctggaaagaaaagccggaatataaatgataataacaatcaaacaaagaaaaattattcaaatgtactcaacatgtacattttgaaacgtcatttctgaaaacttgtgaagtaatgtcgtaaagacttcagtgagattcttctactcaattctggtgttgaaactatgccccttttacttaggagccttggaccttttaccaacatcattgtctcaagattctatcacaatacaattgttacctacctagagtactgagtgctcaacatacaatgaaatctacaacccaattacagagattgtccattgcaataatgtgttttttacagcaagggtatcaaagactacaaatgattttcctagtctcataggaaattgatcagactggtatccagaaaatcagggttgtagttctcactctggtaccaattatgcttgacctcagataagttagtagagtaagcttatgcctcagtttccttacctgcacccactcaccaaccttggctacacttcctctacagtaggctccatcacgtctcgtaggattcctctttatgagacagggcatagctatcctctctttctttggatccatgaagagagttctgctttctaacgttttacaattttaaagaacaaggggtatcatgggaaggtgcagggtagtgtgagggtgagcccatgccgttgcaattgctcctacctgctgctttttgctcagggatctaggacaaccaaggaccttaggtaggagagtaagcttccacctgtgtcttgtttgttctttctttattcattactcttatttttgagaaaatatccattatttatttaagtaactccaagtccatcttcctttttgaaaaataagagtaaaatctttttagcaccaatttaaagatatatttgcttgatttttaatgtatgtttaattctatgcagctgctttcaacgaatgactatgattctaaaaacatctaatgtagtgattgataagctaaattgcaagataaaaatgaaaagttcacccagtgttcctaaaccaaaacattgcatgggtttcaccctgcacctctctgccacccctccagtcttcccactgaagctccagggcagccctgtaggactgtactttccttgcactccagccctgtgctggggtatcctgtgcatctggaatctacctttccttagaaagctccccgacttcctcccaccctgctgcacccaacctcttaggtgaccttacacaggacatagtcctgtgagtgggctatagtaccctcaccatggtgtgtccctcccatcagactgctgcggcataatgggcagagaaaagatgcgtgttgaatgaattctccgttctgtgaaggaagaggaatcaaatctctatttgacccttggtgaaactcaattactgtccagtgccccggttttcaccaccaaaatcataacaaagtcagaacattctttaacccttggcctgacaggggcaggctgttgtcttataaaagctggtggtcaatgtccagtggagggaggtggggagtgaactcaagactgacagcaggtccagggttttctctacttacttgatgacattattttcctaaacactgtggtctaagccctctcattctctgtgtattagctttgaaagataattttttaatttcagagtaaaaacatgggaatgttaagccccaaaatgcttaggaattgtccaagagctctgagcactaagcagaaaggccccattccaaggccatgaggattccctagagcgccccatgagaggaactgtagatcagtgtgttctttaatagagtctttaaatatttactctatgacaatcatgtaaattataggactctaaagcctgtgccaaatgaaaatctgtggcccctctgaattatttatgagtaagggacctaggaagagagaggcagccactgtagtttgtgggggttcaggtatttgcaccagtggttttttacttctaagacctaagtagagacagagctcatggaagattacagctatgtgcaaaaaatcggaaaaggcaggatggctgccatcagtgggctgtctcctgaagttcattacgtgaaatttatcagctgctctcttctgctgtcatagttgaggttttcatttctatgttatgctgtcattgggatccattgcggctcattgtagaggcaggattttcagtgctctgtatgttagtaggtgatttgatgagagagacacatacctgtgactccagacatgtgggttctgcctgtgtcaggagcaggttctaaactccaggaaaagtcacaacattcctctgattctgtttctgcttctggaacacaagggcctgtccaagctagaccacttcatgggatttcattttcctaaaagaatctataattctaaaatgctgaaagctgacttacaaagaactgtgcatagcatactagcttccttaacacaatttcaccatcagattactgaatgagaaaatgtattatgaaaacttccaggagagggtctggcacgttggggaattactaactacaggagcagtcaatcatttcaccagcgagatgggagaccagatgtactctcgcctcctagatgaaaaccctaaaagaatgacacaaatccaggaaatgtgctaaaatgaagggcaataaattcataacagaagaactaggatacagaaagcaaatatgagaacactgtttttaatctttcagcagtgactgtcatggtttaaggtaagaaaaggtatttatgcgacttgatcaaataaagatccaaccttggtagtttaatattttattattgagctccccacagaaacagcagtgttcttttggcagcttttcactgaagaatgaatagaacagaggccttcaacttccagccctgtatccttcccactgtatggctatagtcttaggaaaaccagacacgtgtgctgaagaagggtgtatgatatgctggcagggaaatagttgtggtgtctgcagactaaggcctgaatctcagctgtgtcatagctgtcagtctataggaacatttcctaaatatctgtgcttcagatactgcttctgtaaacaggcataataattctgatgtgacatagttgctctatcagaatttatacaaatagtctaatgtcctaaatagcatacagcacatggctacaggctaatttttgtgtatttctggctaccaactctttctctctgctcacaagtttgaaaggacttagagtttgagattttcctctcctcctttttgcccatcttcatactcctgaaaatttaattaatcctttttttgtgaggataactaagatctaatttctcagcaaatgtttagtatgcaaaacattattaactgtagttgccatgctatacattaggtctccagaacttatttacatatttacttatgtatgtatttatttattgagagagatgaggtctcactctgttgcccaggctggaatgcagtggcgcaatcatggttcactgcagcctcagactcctgggctcaagcagtcctcccacctcagcctttcaagtagctgccactacagttgcatgccaccatgccctgataattaaaacaatttgtttggtagaaatggggtctctccatgttgtccaggctggcctcaaactcttgggcttaagcaatcttccttccttggcctcccaaagggctgagattacaggtgtgagctaccatgcccaggctttatttatcttatgtctggaattttgtatcctttgactaacatctccccattgcctctttcccctggcctgaggtgacagccttctactctctctttctgtgaatttgacttttaaaagttccacacataaatgagattttgcagtgtttgtctttctttgcctgacttatttctcttaacataatgtctttcatgttcattcatgttgtctccaagacaggatttccttctcttttgaagctgagtaatgttccattatgtgcatgaatatctatcttatattttctgtatccactcatttatcaacagacacaggttattttcatatcttggctattgtgaataatgctgcaatgcacatgggcctgcagatatctcttcaagataatattttattttactttattttttgacatacatctagaaatgggtttgctggagcatatggtagatctatttttaattttctgaggcacccctatagtgttttccataagggctgtactaatttacattcccaccagcaggataaaaattgtgataatcattttgtaatgtatacatatatcaaaacattacatagtacaccttaaatgtttgcaattattatttgtcagttatacctgaataaagctggaaacaaaacaaacaaaatgaaagcaataataattgaaaaccaaggaaattaaattcagcgttggacagacatgaggcaggagtggggtgtcagcagggttggacaggaagcataagcaaatgacaacatatgcctgcagccatagagtttggggaaatgatagcaatccagcttttcaaatgggagcagtgggagaatacaaagattgggtttcactttaaaggagatctgtgtctaggtaaagaatatgggctctatatttttctatttctttctggaagttctctaggctttctgggtgagggattcatgagtgtgcggagaggtgagctgagcagggatgcacatgtttgtgagtgaggcctggcactgcgaggatggagttcacgtgaaagtaacaggactcggtaacttcttggatgtgtggggtgaagaagagcagggagatggggagggcttagtgttttttgagcctgggtgactgggaagatgatggggatatttgccccagggtgtgtgtgtgtatatttaggttaaacaatttcagtattctactgtgttcctcaaataatataattccaagacatgtactcagctaaccacatttctctggatcctcttaatccagagtgttctcattcttacgtagagtctagaagagcacacaacattgcaaatatactccacagcaccagtggtccacgggccatactttggcaggatctgatactttataaacactgtctaatgtcgcttggctttttctgacctcctgataaggttggttgacattgggctgcacatcaagtgagaagctccctgtgagtcaacactttagctaggaaggacaggactggcaggccccatgaggtgtaggctagaaataaagcttggtgaaagaaagacacataggagaaagactggtgggtgttattggtccagacaggtgagggatcaagaccacacaattcagttcatgatgaatgtggtaagtccaggatccaggaagcgatgcagcaggtgtcaggcacacacactgcgagcctggaccagaatatctggacagtattaatttataatcaaaatttattctggaaaactgtacagtggatttgctgaaccaacagctcctactgttgttgcttttatgagccggaacttgccttagtacgtggctgagttcccaatagaaggaaaaaaaaggctggcatagctggggagaagagcaggtggcaaagggacagaagtccagatgcctggtcgcaaagctgttggaagtttggagcactgtagcctgttccaactctgtaccttttttgtaggcttacttataccccatgatgtttcagtaaggatttaatgtgctctcataaagcagtgccgataagataataccgataagatgaattaaaatacaggtgatagtataaattaaaatacagatgatagggtaaattaaaggcgagccaaaagaaaaataagcaaaatctaggactggcaacatgaaatggagcaaggatttgtgcctttggtaatggcctccacatacaagccacacatttgactccaatcactgacacaaccaattaggcaaaggaaatctgattactctcacagtccacaatgtccaagataaaacacgaaccaactttatttatggagttcttcttaacacaatattgactagaatttctggggaagcactgtcccactctgtgatattataaacagctcttataataaaatgcttttaattgataagctgatggcagtttcttcattttggccgctggcatcacacacatgcgcaagcccaagaaagcaaacaaagcaaaacaaaacaaacaactccaaaaccaaaattggttcagtgaaacagtcgttatctatctatctagatgtggcttgatctagaggtgaatattgatctgattcatatcagatagtcttctttgcatattgttacttagcctgagtatgtttcctctctgcaaacataggctatgggatacttatgaggattacacaataaaacatgagaacctatgaacatagggcctgtcatgtaaagcatgaacaattcatgctggttatgtttgacaacaacagcaatgacagaaatcccagcacatatttgctgaatttcacaatggaatttgccatttttttctgctaattgaccagggcctgggcaaagcaagcaggatacattgtgatggcacagggaatctgcgtagcctgtagatgagctgcgattcaccatgcaggagcaggctgaaggctcacttttcaatttgtctttcacaggaataacactctacagccacccatatggaggggccttgctgaacaaggacaagatgtgagttgatggaatgctgaggggtgtgtgaccctgactatggaagaaaatctttgtgttacttagggatgactttggtctctcttttgcatttgccccaagagatggcttatagagttagcaggaaatgcccacaggacttgggcatttctttgcaaagtgtgagaaaaacgactattaagagagtcagtacattgactgagcttaaaacagatgagtttgtcatgcaactgtacttctaagcagaaattcttctaagggaatgatttaccagaaacttatgggactgtacatcttctgaagagttttcggggttaaaatcataaacattgcattcatgtacataaacatagtaacgcctccttgaatatttctcatgcaagattttcctcctgatccagatggagacatgggtggggataaggccagagctcttcaggtacagaattctgtgtcagttctcactgtctttgtaaagggtagcatgcttccacctgtcttctctttttctcccccatctcccttctctattatatggtcgacaaacttttaattaaaagtcgataataaaagtgggtatttttgaaaaactttttatgacctaccaaattaagtcgcagaatgcaaatctgcttaatgggcattctctgctcaagttgttaatctggcaggaaccggcaggaagcaccggttgggttgcagcttgtcctcacgttcacttaatgattttcagggttctagctttaacagtgtctgacacctgccagaattccaagagtaggctagctgacatctgttgtagaatgcgacacgatggagcagaaggcatggcacagcagatgacttgtgctgaggagttccatcgtgtcggcctcctgaaagaccatctgtggtctgactgttcctaaaggagttgagaggaggcagcaattgacttgagtaaaagtagtagtgttccaggtaaaacaattactaagaaaatgtacagtgtataatattacagagcacctcaatctattgcaaaatcttgttggtatttcatgtgactaaattcagagatgggccagtgcagtgtggagctgtagtgaaggctcctctctggcaggtgctactgtattgcaaagcagtccctgtgtgggcaaaggtcacagcttacccggatgctgctcagaggatatctttcatcttaattgggagtcaggctcaatggtgaagagcagattttgacacaagaagactccgaaatgccctcaaactgtgctcctcagttttgtcttctgtaaactgagcttagtcatccatgtctcaaaaggtggctgaggggatttaatgagggaatccatgcccttagccaacatgcctggctgattatgaatttttaattagcagttttcactgctgtcatcattgctgattgttattagcaaagaaggcttgtgttcttcgtcaggtgcctgagagctgctctgttccacccgcagcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatggtaggatttgggaatgagattctgtgtgcctccacaatagtgatctaaatagtgcgtgtatggagggatggaggggggcattggggccctggctgccttggagtgtccacaaaaaggggtcatcttattgataagagcatttcagattaagtcacctttactgatcaccatagaattggttcataaggggaagactgataagcttcaggctggagaactgggaaattatagaactttacaaagatgcaaagtttcttattgagaagatgagaaaattattacctttactatgctcttttcaatggggtagcagatgaggtgataaaaatcattagaaatgatctttcatctgcatgcttaacaccccctcctgtgagacctgtgcctcattgcctaataggtatggcgggtattattagcatttttggaatgcactcagtttcccaatggaaaccctccagatcagtgtctgccatcctgggggacaataacagatgctttgtctaggtgttccctattcttcaggacatttatcttaagtaaaaaaaagcatcttatatgataagttgttcttagtggtcaatatctactgtcattgttctctggtggagctgtctttattttgtaggaaagtgatatccttgccctcatacatatgattcatcttgtgatacagaaaatcatacataagtcagtggaaggccggaggtcaaccatttactgagcaccttccatgcactaggtgctgtctgagctgtgctacaccaggcacaaatttccgcatattaacatgttgctttcctgtaaggtttatttctttgagctggcttagaatttagctaatttattttcttttgatcatgtaacttggatttttgttttgttttgaaagtacaatttatcggggtcacacctaagttacctaacatttcaggagttcatttaatttaatcagaggtttccctgaacctgcctggtgatagatatcacctgggacatttggtaacaataaggattcccaagggcctatccttcgagattctattcagtaggactggggggacttggaggtctgtgttttactaggtactcaaggtgatttatgaatcttaaccaagattgacaaattctgggtctttaaacccttatctttactgagggacacttgaaggcaggcaagtggaagtgacttgtccaagattttacatctagttggtacagagatggcttctcagtgccagcctctgtctcctggtccagttttgttccctgtgctacacactgctgctggctacttgtctctctgccgtctgtcatttaacagtgtctaagggccacaactttcccagataaaagggaagaagtgtgtggcaagagagaatcacaacacacagggggccacgtttctaggacaccatggggctttcaaagtctccaaaaccccaggatcttccttcttttcagcacccttagtttattatctctttatgcctcccactcagtctgactcttctttactctgtgatgtttgatcttggtgattaaggacaggaagggtttcttgcttcttgcttggatggttttccatcttcatccaatcattctctgcttattctattcaatcactaatttaataaatatttttgaggatctgttgtgggtcaaggtgggtccaaggttgctatagactaaatgattatgtccccccaaaattcatgttgacacctaatccccagtgtgatggtatttggatgtgggatcttggagagataattaggttctgagaatggagccctcctgaatgggattaatggccttgtaaaagaggccgcagagagctctatgtgaggacacagtgagaagtcacagcctgaacgaggaagctggccctcgccagtcaccgaatctgccagcaccttgattctggtctttccagcctccagaactgtgagcaataaagttgtgtggtttataagatacttggtctgtgttattctgtcatagccccccaaatggtgttgggcataaagccatgcataaagcagagaagattgctccctcaaagagattcttatgagaggaagcagaaaaactagtaaacaaacaaataaataaatgcgcaggatacagttggccatgactgggtctgttgaaagaatgaaagagattgatgggatggaggatgacttcaaatgtgaaggtcaaagaagacagtgaaactttacctgagatctgtgaggtaagaaggggccctgcccatggatgacgtgcaggaagaggtctgcagcttgaggctctaagagaagaaggaaccaggcgtgtgagagcctgaaggaaagccatggctattgttggcctgcagggagcaccttaaggtgaggctggatagggaggtagtgtgaggagcctgtccttggttctacgtgtgtgggaggaggctgtgtttcatgaaagctgattggattccttgaccctcctcaaaggagatggatatgcatgacagtagtagtcacctcaggccaccataacaaaataccacaggctgggtagcttcaccccggaaacttgattctctcattgtcctggaggctggaagtctgagatcaaggtgttggcagggttgattccttctgaggcttctctccttggcttgtggacagccatcctctccctgtgtcctcacatgtcagccctctgagagtgactgcatcctgatctcctctagagacaccagtcatgttggatgagggctcacccaattgacttcattttaccttaatcacttgttcaaagtcctgtcttcaaatacagtcacatcttgaaatactgggggttcaatgtataaattgtgggggggtacaactcagattaaaacaagcgactttccaggactaattccacggctacagaactcctaatgtgcaaaataggaaatatatttgtgaagttgaaaggaaacttcaggataagtagatgataataaatatgaccatctgatgtaacagctctcccttatttctttttatcttctcagctcttttacttggtttccgtctgcctgtgtgttgccgttattgtcgccttccagttaacagcttttactttccgcaagaacttggcagccacggccctcctgctgtcacttttcgggtatgtgatgagaaacgctgctgcagaattacggtttgttttctgaaagagaaaaccctcaggatggctttgaacctgctgtcgacttcatgatttcctctcttttgaagcaattatgttgcttctgcaagggacacggagcaaacaagcctgagcaggatgatgaatgccccgtggaggaaggaagggctgacctggtcgtgatgaagacagcactgccctgtctcagacaggcccttgagctgtttgacaaacttgtgcagctggaaatggattctctattattctcactttgacattaatcaggggctcaaatacataatccaattaactcggagattgcatttgtggaggttctctcagcaagctctctggcattttttctcctctcctctaatattagtagtttgaaaatgttttgtctaatttctatcacttttttttcagatgaaaaaatagcaaatggagaaaagtcattttatgaatttctgatttatgcatgctagtcaggatcattgctagtggcctcaaaattatatctatccggtatcaggatatatatgtcttcttatttgtcatgcacgtatgcttatatacaggctaactacataagagatgcttagtagggaaaatcattatcatactaatttattatacttcaaggctattttaaaagataaaacagcttgctcttatttaagaggattacaaatgaagtgatttttacagtttgtatttatataagtgccctagaattattcaaaacatctaattagagacagagttttacttaaacaaatatataccattactagatgattgtataggtgggtgggtggatggatggaagtatgtagataagagaaagaaagatagacagggagagagagattaacagagagagggaaagagacactaagagagagagggagagagagattaagagagagagagaaacaagacagacagacaaacttttgggggaacattgatattactactcactaaccccaatgctgtagctttggtaatactaattattctgtctaatcctcagttttttctttgtaaaacttcatgtcttttgctataaagattaaatagtttatatgaatatcatggacaatgactggtacaaaattcccattaaattaattttagccattattgttactctttagaattattttactctttagaagatgtaatatcctgagctataaaacatgcttatagtagacatatatttattatatttagctagaaatttatggacttgtgtataaagatctatgtgtgtgtacccagctctaagaacacagtttgatttcagtttattgatccaattgaatggatagtgttgtcatgtctccctctatttcaagtaaaatagactttgctataaaattatttttgaattttaggagagtatatctcaaaaactgagttaaaacttagatgaaatggttagaaagccttgaaaacacgcttttagaaatttttattagttgttttgattgtgaaaccctttaagaatttgaattaaactaagaattctcttcatacataactaccacatttttcaaagaatttctggagattcacaggtctgttgaagcacaatcataggcaataggggttacacgcttctggttaagaactcttaggttgcagagactggaaagatgtcagagataactcagaccgtgtttgtaatcatggctaatcccagggaagaagagcccccaaggaaagtttatcagggtcactgggtgacatccatgggaatgcagatttagaaggtagctctttcttcattggagcacagccagtggaactggtgacaacctcccccgccactgtaacaggaggggcagtgagagacccggtctggggaactgctgtctcctgtgtgcctggcaatctctgggtgaggatagcagaattggctcatgcctgctgtccttctaaggacctatgggtacacggagcccaagggcaaactcaggaaagctgaatcccgagctgaaacctaagagcacgtccaggcattaaatggctgcttaaaggcaggaatctgaaggaataagggatagtatacacgaattgattcttttaagagataacaagataaacatgcctaatcgcagtcttattgtttttcttctttctatcaaggacaatttgttatttaaactataaaagggagagtcagggagaattagcatccaaaagagggaagtaacacctaaaatgaatgaaagaaaacagagcctaacttacataaagatggaaaccttaagaacatatttgatgtatatttaccgctaaaagatgagattgcagaatcctgcttggtgtcttgggaaatccacaaagcatggggaagcggccgattttcaaaaggggaattttcttccgccataaattccatgatgttgtgaacagtaggccagtctctagcaaattttaaaatcattaaaatgatattatattttaataaaagcctggagattgttgaaattcattgtaattttcacaaaaaaataaatataagccaatttcatttttttcttataaaataggagacgggagctgctaatacgttaatttgagccaagtattttaaagataactaatgaaaatgtagtaaaaaaagtgatggaatcatagcccgttgaaaaccacactggaatactcttcattcatctagcaataggaactctcatgtggcttcatttaggacaatgtctctgattctttgtttttcttaaataatgctttgatccacttgtcaaatatttaaatgacataacccaacatggaaaccttatgtaataagtaactagatacagatcctgaaccatctcaaaggaagtagagcctaatgttgaggtggtaattagtcactcaagtgcagatcaggtatgcagactccacagcaagaccgggaggctgctgtacccttagattgtattgctggatgtggagatgctgatcaaagcagatgataatcttgctgtgtgttgtgccaggccaaccacatcatgttctctgtgaggtagctttacctaaactcccctaagtcccacaatgcaaaatttaacagagagagctggttgaatatcgtgttgttaaaggagcagagaaagacccagtcttttgtagtggaggtttaagcagaataacatggctatcctcagctatttaaaggactgtcacatggaaaagaaaagcaatttgtcacgtgctgttccagaatatagagtttgaatcagtagctataagttggagagagttttcattcactcttagaatgaattttatagcaattacagctgccccaaaatttggctcacaaacttctactactgcttatatttctgttgcaaaaatacttgcaattctgtgatttcatttgattctcaaaacagttgcgtgaaggagtgtagcacttgatttttgtctcagaaggcacagtaaaggaaagagggtaggtgtgtggtgtgggtgaatatgtgttggggtttgaattctctctgtggtagtttatttcagacagagatgttgataatgtacagccctaagaagtcatgacttatctctctggtaattattttgatttaattagttgattgtcttatgtagcaactgttttagaacagctcttgcctccattgtgtgctttgaaataattaatgcccacattttgaggcagattgctattgagtagagtgtctaaaacactatatgattttatatatcatattatatatatcttatgaactatgagaatgtatcttttaacccaggaaagcattccaacatcatggatgtcatatgaaagggggtgcatactagactaagagttaacttgagggcctggcatctcttatatcattttgaagtctcatacttttcagaacttgttaacatattaggaaaacctcagacattttgcaggcactgaagtgtttcaggttaatccaattattcaccataagaaaacagtgatacatttaccttgagtgagcagagaacttgttggagctccggatatatgagaatcttttgggaaagttgtgattcaaaatcagtgacttctctgctgatattaggaaccatcgttcaaagtgtacttcctttattgggtgcagtggtattatttcaggaaggagatgagggaagttgccatgagtgaaacctggctctagaattgaggagacggaatgaagaaaatgagatgttttccttttagggacatttgggtggtatcttagatcctgatgtcatctgacacatgtggggactgcttctagggttcaatgtttagcaatgcttcttactccccagctttggggccacatggaaatgaatcccatgttcatctacttatcacctgcaaagctcgatcaagtgtctgaactctgcaaatccccattgttctgcctgtaagatgacagttacagtgctgtctcctggcttgctggggactaaaggaagattagggcacactgaggagttacagatggtaccccctgtgcagtggatgctggaaggaggctttcagtttttatttttaggccttattttttttacgtagctctgcagctttttatattcttgatatcttttgattctcaatataatgaataagtattattcctgccttcctgatgagaagcagagcagagaagctccttttggagaagagaggttggagaagtcagccgactttctccaggccacagagccgacaagttcaggcccacgtacaacccgtgtgtgtgttgtgaccccatccggtgttctttattgcattgcagagtcctctgaagccccaggaagagtgtgttgtctttgaaaaataccgtggaatgtattatgtaaagttcatttctgttcaccaagtgaggaaaaattgctgggccaataaaattgcatctataattcagtcttacggctgtccccttatctgcatttttgctttcagagaattcggttacccacagtcaactgtggtctcaagatattaaatggaaaattccagaaataaacaattcatcagttttaaagggcacagtgttctgagtagcaggatgaaatcttgtactgtcttgctctatcccatcagagacgtgaatttcccctttgtcctgcatatcctcactttggacctgggagtcagtgagttaccaaattgactgtcgcagcatggcagtgcttgtgttcaagggacctttgttttactagatggccccaaagtgctagagtaggcacgctggcatattgctgtaattgttctattttatactactcattgttcttaatctctcactgtgcctaatttataaatcaaaccttatcataggttgtatgtatggggaaaaacatagtatatgtaggattcagtaatatctgcattttcagggattcaccccaaggtcttagaatgtatctgccatagataaaactactgtaaatgttacagtaaaacaaacattacttttcactttacttttcagatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaaggtcagtagctttgtagcatcacctctacacttctgcacctctagtgcaaagacggtgttaactcatgcctcttttgttgcttttctgactggaattcaatggaaatgcattggtatccactgtctttaaactccagagagataaatggattctaattaacaaaaaacacattgccgttataaaagccatgcctaggcttagcaacaattgacgaaaaaatgttctgtttcggccactccattcttgagggtagagccatgaagatgttcactgccgcatccctagcattttcatcagagactatttattgatgaattactgatgaatggtggaagagtgagtcattgaaacatgccctctcaatgttcaccatcgtttgggtcagacactacaagatagaatgggccacacaacacagctgaccatgctctcggggcacagcatgtctgaatgatgatctggcgggattctaccctcttctctgggatttctggaacaaatttaattttgctgttttccaagcatggcagccaagggctttcctgagcctgaggcccgtggtcaggaagaacttctccttgtgaggtcaacgccactctccaataggccgttctgattagcaagtcatttcttaaatgtcatctccagctggtgtctaggtcaaggtgaacccattagtcctgccacattcctttcactcctgtctcctcccttagtgaggcctgcctgggtgtttgcctctgctttaatacatctttcagcccctcagcatccccagtgctacctggagatacagacttcagattttgcactttcctctgcacccttattgcaatccttttcattctgttttcttttctcagctctgaccacactattctctcctgattccctgctgcttatatggagtctgattcctcagtagttcccaaatgtttggccagctcaggggctgagaaatgacctggaaaaggtactgagctcctagttttgaagcatgtgctgcagttctcatttcaaatcaaacagggactgatgcctatttaattgggatgagtctacttcctcatggctggactttcagagacttagtaaatttgccactgatagctaacattagtttttattactgtgcttcatatttggatagaagcagtgaactctgtaaacatctattatgcattcagtgatggtaataatctattttggtgatttttacagatttattattgacactgatttatattaatatgtctacactttaaagagaaaacttgcagaaccattgattggctttagcttgaggagaaaattgaaatcagtagagatagtgtacaatttccctcctccctcatcggatctctagcatgacatgaaccatcaggatgtcagtcatgaatcatggtgaaactgaaaagagactcacagtagataatcctattggtgaggaacttgaaagcagagagcttccctggggagtggagtcacagaagtgagatttagctccaaaagaaaaacgaagaagaattgtccatatccaaagaggaagctgaccaggaacctttccactcatgaggttttaccagtgtggcaagtggaaagccttgttacctttaattataaacagcattgcttacttgttaaaaaaaaaatcaacaggcaatgaagtgtttgccagaaaatggatctaaatcaattggtaacaagtaattaaaagcagcttattgcttttgtttgggtctttcttttcctttgctctttattttgatattatttgcttaggaagcaaccttattcaaatgtttatttcaaataatttcaaattttcatttgtaggttatggagctttgtagcattaattcttatagaattaatgaaagaaaccaaaaaaggtgactggattctcagatcactctttttcttaaaaaataaaaatattttaagttctggggtacatgtgcaggatatgcaggtttgttccatagataaatgtgtgccatggtggtttgctgcacctctcaacccatcacctaggtattaagcccagcatgcattagctatttttcgtaatgctctccctcccccaccccatcccccaacaggccccagtgtgtgttgttcctgtccttgtgttcatgcgttctcattgctcagctcccacttataagtgggaatatgcagtgtttggttttctgttcctacattagttttctgaggataatggctttcttgctccatccatgtccctgcaaaggacatgatctccttcctttttatggctgcattgtattctatggtgtatccatctatccagtctatcattgatgggcatttgggttgattccacgtctttgctattgtgaatagtgctgcagtgaacatatgtgtgcacatatctttggaatagaatgatttatattcctttgggtttatacccagtaatgagattgctgggtcaaatcgtatttctggttctagatctttgaggaattgccacaccatcttccacagtggtgaacaataagtctgaatatctagtgtaaccagtattaaccattgtgtttacaaattatagtgttaattaatcattttcattgttaccaaatcacagtttatatgatgacacattttgatttcaaacacaagatctggaacatctgtctttcccactggtgaggctccctgttggagcgagggggatgtgggggagcaaaaactcatgttttctaatttatttctttgtataattatcattttcacataatcctaaatcgaacacttatggattgttattctgtgagtttgtgcacctgcatcccccttctatgtatggattatttgttaactcagtgttcatatattgctaacacctttgttcatacttgtgtagagatcattgtgatttccttaaaagtagatgtaaaaatcatcactgttctcaagcaagaaaaccttgaaaggcaaataccagtagatctaattaatatctctaaacaaaatacctttgttttgatggctgtctgagaatatcagtgaatagttgggatagggaagacctggaacacagagctaaccaaggagaaaaagaagttattggtatatattatgaaaaggggaatagcttttaattggattttttttctttttttcactgtgcagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggtgggttctgaaggactcatcctcgagctgcacttactcctgcaaaatgagaggaagagaaaaattcatcctggaggttgtaaaataaaaattatatctgatcagcattatacatagttctaatgcgttaagattttattattttttaaacattgattggtgtcagtcacccacaccaggaaggaaaatttcaaaggataaggtgacaaactgtgagatgatctttccaattatttgtctcagcatattttctttttttaaaattttttttattgtactttaagttctatggtacatgtgcacaatgtgcaggtttgttacatatgtatacatgagccatgttggtgtgctgcacccattaactcatcgtttacattagatatatctctgaatgctatccctcccctctccaaccaccccacaacaggccccggtgtgtgatgttccccttcctgtgtccaagtgttctcattgttcaattccaacctatgagtgagaacatattttcactttgaaattgctgaatttctctgttactttgaagcagctaaggtaaatttggttaataccataacattatttttacaactaaatgccaagaactctgggagcaggaagataggaaaattcagtacagatgtctgtgtgtcctttgctggatcttgttgcttatgctgctgtactctgatctttgtcaggtgaggtcgaaagtcagtagcatggggcatgtgtagacatgtagatatataatgtggtttatacacatgcatgcacacacatgcattcctactactataaataggatttaatgtggccttgaaaggatatctgaaatattgtcagataaaacatttgaactgcataaggaagcaatgtgctttcctgtgtagggtccacaatggttggcttcccccccatacccaagtggcctgaattcattggcctgctctttccaagggctatgtatttccgtctgacctctacttgagggagggatcctttttggagaaattaccaattaagaccatgtcactagaaaatctattaaggattataaagacacatgattaataatttatggtgatctcttcatagaattatttttcctttcagccatttcctgacatattttgttacataaccccttttaataaagtaaaatagacaccgttttgagtataaatcccaatgtgcttttgaattggccacatcaccctggagtctgcagatttccaatagctgactgaacctggagtaaaatgcagagtgccctttaaacataatttgttctctgatgtcccttactagtttagtctattttataaaactgtaatgtaggatcccccttggcagatttcagggtactccattttcctatagtatcaaaagatttttctttaaagagaaaaatctgtattacctttactttctagagttgtaagtataagttgaattgtattttagaataatatccttgttacccacagtaaagagtcaatttttttctctacatgaaggttacagagcatagaaatttaagtgaatttagacactagttgcctactaccattttatggataactgtcataatgactgcatgacccagtcaatttacttttaagacccagatctaactaagccactaatcattgtttgaaaggtaaagcccaaggttcttagcaagcccccctgaagtgtggtgccttctgctcagtgaaggtgtctgtgatcctcctcccatcccacagggatatttgttgccctgcctctggggctgggctgatgccttctccgtgtttctgttacgccctctttctctattagggcacatctatgttggtttatggtatcgatatgctactcataattgaatcttgcaagaaaatagggagaccctgccctgtgcaactgggaatggatagatcctgccttcccagcctgagcagggcccctgtcacctgcacccactgctggacatgagtgctgagatcccacttccttgctgtccttccctaacctgcgctgactcctgtccagctgtcccactgtcctgctgctggccttgggttgtttgccatgaattcaggtttccattaggacctgagccctagttcctgcctattttgtctcctgcctagagctgcacttttgctgtctgtaccctaggtgctggctgggttggaacagccacactgttcagatatgagatatgctgcatatctggaaagttctgctatacctaggtcccatctgaattcttcctatttaatacagggatcgtttgttagtcattttcagttagaggataactaagtggcacatttctgggcatagttggattcctgtattaggacactggattgttgtgagtgggtggaccagaagtaagctcagtcaattgtctccaccaaccagaattacttgaagagatttaaatgaatgtgcacacctgggcccctccctagaactctgcaatgagaagctctggggatgagacccaggagctgttcataaagcttcccaggtaatcctcctgaggagagaatgagcaagctgatgtgggttactgtgaatactactctgccaggcaggagggaatacagtggcacaacttcctgttggagtgggaagacttccaaaagtccaggatagggtgaaaggtcaataaacacaccttcatctgggagagggaaataacattcaaacagaaaagtgtaaaattcaatgaattttcacaaattgaacacattgatgtagccccctctcactaataaactgaatactgccaacacttcagatggcctctcataaacttctccatcaatagctgcaccctaggtaactgcaatccttatttttatttttattgattcatttttcttgcctttgaacgttatataaatgaggtcatgtaagatagaattctgagtatctagctatatttttctcatcgtctatgttctctgtagaataaattatatattgtcaaatggtgattttatatgtggaaaaataataaagaaaagttgctggggatactgggagcttgccatggatattggattttatttttaataccttttttattttgaaatagtttaataatcagaagaagttgtaaaattattatcgaacattgctatgtaccttacacccagcttctcccaatgataatataataatatattacatggcaatttacactgtcaaagccaggtaattgatgttggttatgatactaactcagtcgttatcattaaaatataatcattaaatatattttaaatgattaaatataataattaaaatgttggcatattatagtttataggggaaattgaaatttattggaaagttaaatgtgtcagattgcaaattagaaagaagattaaaaagtgagcagctcagatttagagaaaataagagttgaaaattaaatttgcattcctctgatagatacttactgaatactttttgcaaagtattgtgcaaagtgctggttatataatccttttatgcgattcaacatatactataaacttacaatgtttcagtacttttatatacaatctacattattaaatgacttgtttagtaaaaagcacttaataagtaaatgccttataataattttgtgataagctattttaacatttagtacaattaatctggcatgatcttattcataaaattaaaaactagctctagtttagtgccaattcatttcagtatcttttaggaatgtatatatttcatttatgttagacaataaaaaatggattcttgcctgataatcaggatggcagaactggggtgctctggacaaagctgactgcccagaagtccgaaggtgatatcttcaattttttacaaatctctgacctttttgcctcttctagactattctggtatcatttgctaggtgtgaattcactctgatttcatcttcccaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagaggtaatgaagcttctatttttaatcttcttctgttgtgaacctgtacaactctagtagctgatctgcttgtgttagtctcagaatatttgaaatcagagccaaaaatagccttcaaattttagaaattcctacaaaatcagtaggagcagaaccaaatagagggtctgttgactatttcatagtaaaaacttggctgattgataggatttattttgttttataatgttaaaaatttcatgtgattgcatagttttaattatgacttgggctatgggataactttttgttgagcaaatatttttttgaatctaattaaggaaccacttttatctcttactgggacatcagtactctaagtgtccaattaagcccatctggcaaaatgctactcagaaaaggtaaagaacactcatccacctagcaatagctcaggaatttttgttcacaggtaagacattaattctagttataatgtttaatcagaactgacagaagccatataaattgttcctgatttatgcttaatgtgtaaagggaaatcagttctggaagtgattgccttcaattaactgttaaaaataaaagagcaccttgcattcatacggttcccagctcctgagaaattcaaaataggttatattgttatctgattggtatctatattctacttgtgatctgacagtaggtgtctcagatatgtgtattctgaggtaaagagaagccgagagatcaatctgaagtaatgcaggcatattcttactctctgaactatgatttctggtagattagaacaaaatgttaagaaaggatttttttttttagtagttgttagcttctgctctaagactggctatgcaatcttacccatcttattgaactattttttgtacccttgctttaaaaatcatgattattatagttttgccggtacctctccatagtagtttgaggcaaaggggtgtgggagggccaagattcactgaaaatcaactgacaaaaggcagagtaacaggaaaaaggcatatgaatttatttgattatagttttacgtgatacgagagccttcagaatgaagacccaaagatacagggaaactgtctgtttttatgcttaggttcaaccaagtacggacagccatgtagaaatatggttggacaaaaagagtatgacccaattaatgctattaggctgagaggggaagcccagcaaggcctctctgtttagatgcgctttttttttttttttttttttttgagttattatctacatgtttatgatgttttatttttattgttaaaaattttattttaagttctgggatacatttgcagaatgtgcaggtttgttacatagttgtaaatgtgtgctgtggtggtttgctgcacctctcaacccatcacctaggtattaaatcccacatgcattagctatttatcctgatgctctccctcccaccatccctctgacaggccccagtgtgtgttgttcccctccctgtgcccacgtgttctcattgttcagctcctacttataagtgagaatgtgcagtgtttggttttctgtttcttccttgtgggtgtggggcaggaccctctctggaatgcaggtctgtcttatgacctacagtcaaacaaggtaggacagataacttctttaggggtaatttttgtactgaaaaatatgtaaaaggggagaagttagggtaatatttttggttttatggtggctttggggaaaagaggttctagtttctatgaccagcctcaggggagaaggaggggccggagacagcagggcaggaaaaggtcagagtaaaacttttgattctgaggctgcctttggggccttcactttggggtattattttctgagtcccaacagggctaagagataaacttgtaaaacattgacagaatgatgctccaggtatcttaaatggtccaagatgccatttaaagttagattttattatcttaagctcttataagcattacagtttaattacctagatggagagtgctatgcaaaagtctgtggaaaatacagaaatgactaagatacagtcctgtgttgtttaacaatggggatattgtctgagaaatgtgtcattaggtgatttcattatataatatactttcacaaacctacatggtatagcctacgacacacctaggctgtatggtaagcccattcctccttggctacaaatctatacagtatgtgctgaatactgtaagcaattgtaacacaattgcaagtatttgtgtatctaaacatagacaaggtacagttaaaatatggtattgtcatcttgtaagatgaccattgtatatgcagttcatcattgcctgaactatcattgactgtatatccttctccatctagaaattaataatcagttaggaaacaaaatatcataagcatgtactatgttacatgggagcataagcattgtcccaaggcagggactgtgatataataatgtaatattttttggaagtcacagcatcataataattgttatcctcccaatttcatttttgtatatattaaagtactttctaaaaagaactgaaaggtgcatgagtggtattgtcttcaatgctgtcagtccagagagggtggctgtgcaggcagggaaggaaaggtgggaggacagggtatgtggggagagctttattaaaaatgtggtttatagctaagcctaaaagcgttggtagaatttggataggctgatggtggtgtaccctggaacatggacagggtaggcctgggggagacggactcatattgcaaatggtgggagagatgcagggaaagcggggaaaacatggtaattgaagcagatggcaactcatggggttgtgaaattcagaggtccaaaatagggtgaggtgatggttaggtggggcttggtggcagaaaatccagaagcagtcactttccaagatttgaggagccaggaagccagtttgtatccatagatcgcagctcctagccatcagaaaacagctgtcttggaaggagattgacagaaccagagagacactgtcaccaaggtggactctcaggcacagtatatgctgaggcacatgatagagacaaagtgtagaaaagacagcaagaaggccatttttcacattggctgtaaggcgagatttgatcaagaactgagttgactctatgctcaatgtcagaatatagaacgagagtttctcttttaattaatatcaagattagcttagactctgagttaggagtgaatttgcaggaatttacaggctcttcaatggaaaaagaagatatataagaaagctgtgagcactacacacacacatacacatacacagacaaacacatatgtatatacagtagaagatggaatcttttaagaaaatactttaaaatacacaaaaatgaaattaggagaataataattataatgatgtgacttcctaagaatattatattatctctgcataatttgggggtagttggcatttacttctcatcctcttgagttttccacacatgaatttattgtctgtaaattactgctgaaattcttataccattcaagtgccatgatgattttgagaggactttgtaatctatacagtgttttatacactattgtcattttaaaactccataaataacacaaaccagcaaagtcaactcaaagttggctaaaagcaagtgctgtttctgatataattttgattttatttaacttgttctatttatttagcttgtttgattgaatgtgctttacttaactttgtttcctcttagtgctttggacttctaggggtgaatggagctgggaagagcacgactttcaaaatgctgaatggtgaagtttctctaacttcaggacatgctatcatcaggactcccatggggtaagatacagatttcatcatttttgttgcttaaagagataataagcccagagaacccccagcattttccctcagtcccgtggaataaaatttgaaaacatcattttcctccaaatttaccttccaattaccactcctctgatgtggggaaaagtttccaaatatgaataaactgagctcagtacttccagctggagtaaagggccttggaggtcttatcacagagcagccaaaggcagacgtccctgggaggtatcagagtggattggaagtgcccagctcctctctgcagatggaactcaggggagcaggaaatggccaaggggtggttcttctttattctcctctggataaaacttcaaatgttcccatcagcctaagtggccagatggtttccctctttttaccacccagacttcctctttcaggtggtcatgactccttcagggtgggagcagtgaacacattaaaaaccaagaaagcggcctctaggggagtaggcaagatgtttattccccttgctttaacatatgtgaggtccctgggcaccctgcacactcagaggctgcctgaggccagatgacccctgcaggctctgtgggtaacatacactcatgcattcctttatgtcactcttacctgggccctttcactcccatttcacagggcacctgattcttcacctccttctaaactgtgtgcttggttgggaacattcagggcatggtgccttcacgcccctttctgcacctgtgtggtagtgtgtcttcctttttcccctgctctgatcaggactaatgttaatgatgtttctctctactgcaagaagaaatcccctgctctaaacctctctgtgctcaatttgctctttgatttgtgtgctatcaagtttaccctaacagcaaactgggctcaatatcacaaactaaaatcttagacctttaatttcatagccagtttctggtgattctttctccacataccactcctgtgctgtgccttctaatatggatgtcctcgtatcccattcttttttcagcactgtgttacaaggccccaggcatctatctttcttttttcccactacagcaaactcatggtaacttgatgggtagtcaaattcatagctgtctttatgaatttaaacccagcacccaccagccaacaggttgagatgcgacctccagctttctgttcagtttctgatccgcagagatatttatttttaagagaggttatatgttcttgaccctagttttgtagcaatgaatatggcaaataaaaatcgattaaacattgttttgtggatgtagagaaagaactgtaaaggattgtgtctacaatttcccactggaattttaattgactttatgttgcatttataaattaatttggaaagaactaacatttgacaatctctttttttttacaatcacttgctaaaataaatataattcatttgtgaaagtattttaattaatccttgcagtctattagaagagaatgctcttatcagtaattaatgaaacagttttctacactttctctacagtaatgtctcctttttaaattttattttttatttcaataggtttttggggaacaggtggtgtttggttacatgaataagttctttagtggtgatttctgagattttggtgcacctcacccaagcagtgtacacagtacctaattgtgtagtcttttatccctcactcctctcccaacatttctccccaagtccccaaaattcattgtatcattcttgtaattcattgtatcattcttatgcctttgtgtcctaatagcttaacttacaattatagtgagaacataagaatgcttggtttttcattcctgagttacttcacttagaataatagtctccagttccatccaggtggctgccaatgccattatttatttagttcctttttgtggctgagaggtgtttcatggtgtatatatatgtatatatatacacatatacatatatagatgtatatatacacatatatacatatatattctttatccacttgttgattgatgggcatttgagctggtttcaaatttttgcaattgcaaattatgctgctataaacgtgtgcgcaaatatctttttcatataatgactttttttcctttgggtagatacctagtagtgagattgctggatcaaatggtagacctacttttagtactttaaggaatctccacactgttttctatagtggttgtactagtttacattcccaccaacagtgtaaaagtgttccctttttaccacatccatgccaacatctattattttgattttttgattatggccattcttgcaggagtgaagtggtaccacattgtgttttgatttgcatttccctgatcattagtgatgttgagcattttttcatatgcttgttagtcatttgtctatcttcttttgagaattgtctattcatgtccttagcccactttgtgatggtattttttgtttctttcctgctgatttgtttgagttctttgtagattctggatcttagtcttttgtcagatgtatagattgtgaagattttctcccactctgtgggctggctgttaaccctgctgattgcttatttggctgtgcagaagctttttagcttaattaagtcccatctgtttatctttgtttttgttgcatttgctttttggttcttggtcatgcagtctttgcctaagccaatgtttagaggggtttttccgatgttatcttctagaatcattatggtttcaggtcttagatttaagtctttgatccaccttgagttgatgtttgtataaggtgagagatgaggatccagtttcattcttcaacatgtggcttgctaattatccctgcaccatttgttgaatatggtgtcctttcccatctttatgtttttttgtttgctttgtcaaagatcagttggctgtgagtatttggctttatttctgggttattgattctgttccattcgtctatgtgcctatttttatacaagtaccattctgttttggtgactatggccttatagcatagtttgaagttaggtaatgtgatgcctccaggtttgttctttttgcttagcaattgctttggctatgtgggcttctttttggttccatatgaattttaggatttttttttctagttctgtgaagaatgatggtggtattttgatgggaattccactgaaattgtagattgcttttagcagtatggtcattttcacaatattgattctacccatccatgagcatgggatgtgtttccatttgtttgtatcatctatgatttctttcagcagtgttttttacttttccttgtagaggtctttcacctccttgtttaggtatattcctaattttttttttttttttttttttgcggctgttgtaaaagatgttgagctcttgatttgattctccgtttggttgcttttggtgtatagcagagctactgatttgtgtacattaattttgtgtcctgaaaccttgctgaatttatttactagttctaggagttttctggatgagtctttagggttttctacgtatacaatcatatcatcagcaaacagtgacagtctgacttcctctttaccaatttggatgctctttatttttttctcctgtgtgattgctctggctaggacttccagtattatgttgaatagaagtgctgaaagtgggcatccttgtcttgttccaattctcagggggaatgctttcagcttgtccccattcagtataatattgtctatgggtttgtcatagatggcttttaataccttaagttatgtcccttctattcctattttgctgagggttttaatcataaagaatgctggattatgtcaaatgctttttctgcatctattgagatgatcatgtgaattttgtttttaattctgtttatgtggtgtatcacattaattggcttgcatgtgttaaatcaaccctgcatccctggtatgaaacacatttgatcatggtggattatctttttgatatgctttggattcagttagctagtatttttataaggattttttcatctatgttcattagggatattggtgtgttgtgttgtgttctttttttgttatgtcctttcctgattttggtattggggtgacactggcttcatagagtgatttagggaggattccctctttctctatcctgtagaatagtgtcaataggattggtcccaattcttctttgaatgtctgatagaattcagctgtaaattcctctggtactggatttgtttttgttggtaatttttttaattatcatttcaatcttgctgcttgttattggtctattcagagtttctgtttcttcctggtttaatctaggaggattatatatttccaggaatttattcatctccttcaggtttcctaatttatgtgtgtgaaggtgtttatactagaattgaatagtattttttatttctgtagtatcagtaataatatctcttttttcatttgtaattgagcttatttgaatcttctctcttcttttcttggttaatcttgctaatggtctatcaatttgatttgtcatttcagataaccagctttgtgtttcatttatcttttgcattttttttgtttaaatttcatttcattctgctctgatcttcattatttcttttcttctgctgggtatgagtttggtttgtttctctaagtctttgagatgtgactttacgttggctgtttgtgctctttcagatgttttgatgtaggcatttaaggctatgagctttccttttagcattgcctttgctgtatcccagaggttttgacaggttgtgtcactattatcattcagttcaaagaatttttgaatgttaatcttgatttcattgttgacccaatgatcattcaggagtaggttatttaatttctatgtatttgcatggttttgagggttcctgttggagttgatttcccattttattcaactgtggtctgagagagtacttaatataattgtgattttcttaaatttactcagacttgttttgtgtcctatcatatggtctatcttggagaatgttccatgtgctaatgaatagaatgtatattctgtagcacatgaatgttctgtaatcatctgttgagtccatttgttctagggtatagtttaagtccattgtttctttgttgactttctgtcttggtgacctgactagtgcagacagtggagtattaaagtcctccactatcattgtgttgctatctgtctcattttttaggtgtagtagtaattgttttataaatttaggagctccattgttaggtgcatatatgtttaggattgtgatattttcttgttgggctagtccttttgtcattatataatgtccttctttatcttttttttaactgcagttgctttaaagtttgttttgtctgatataaaaattgctactccagcttgcttttggtgtccatttgcatggaatatctctttccacccctttaccttaagcttatgtgtatccttatgtgttagatgagtctcctgaagacagcagaaatttggttgatgaattcttctctattctgccattctgtatcttttaagtggagcatttaagccatttacattcaatgttagtactatttgttgcctgaatgtcttgtttgtttgtctgtttcattgtgttattgttatataggtcctgtgagatttatgctttaaagaggttctattttggtgtattttgaggatttgttttaagatttagagcttgttttagcagttcttgtagagtggggctggtagtggcgaattctctcagcatttgtttgtctgtaaaagactgtatctttccttcattcatgaagcttagatttgctggatacaaaattcttggctgataattgctttgtttaaggaggttaaaaatagaaccctgatcccttctagctttcaggatttcttctgagaaatctgctgttattctgatagcttttcctttataggttacctgatgcttttgcctcatagctcttaagattctttcccttgtctttactttagataacctgataactatgtgcttatttgcatggttttgagggttccttaaaacgtaggtgatgatcttttttcaatgaatttcccaggtgttctttgagcttcttgtatttgaatgtctagatctctagcaaggccagggaagtttttcttgattattccctcatatatgttttccacacttgtagatttcccttcttcctcaggaaaaccaattagtcttaggtttagatgcttaacataatcccaaacttcttggaggctttgttcattttttaaaattcttttttctttgtctttgatgaattgggttaattagaaagtcttgcctttgagctctgaagttcttgcttctgcttttccagttctattgctgagactttccagtgcgtgttgcatttctctaagtgtgccttgatttccagaagttgtgattttaaaaaatttatggtatctattacactggagatttttccttccatgtcctgtattatatttttgatttatgtaagttagagttcacctttccctggctcctccttggttagcttaataattgaccttctaaattatttttctgacaattcagagattttgttttggttttgatccattgctggtgagctgatacgatcttttaggggtgttaaagaattatgttttgtcatattaccggaattgtttttctggtttcctcctcatttgggtagactatgtcagagggaagatctgggactctagctgctgtttagattcttttgtcccacagggtgctcccttcatgtggtgctcttccccttgccctaggaatggggcttcctgagagcccaactgtagtgattgtttttacccttttgtgtttagccacccagcagagctaccaggctccaggatggtattggggagtgtctgcaaagagtcctgtgatgtgatccatcttcaggtctttcagccgtggataccagcacctgctcaggtggaggtagcaggggaatgaagtggactctgaggttccttggttgtatttttgtttagtgtgctggttttgcattggttggcctccagccaggaggtggcgctttcaagagtgtatcggctgcccttgtggaagaaggatcaggtggtgggtggggccatagagttcccaagagattatgtgctttatcttcagctaccagggcaggtagagaaggaccatcagatgggggcagagttaggtgtgtctgagctcagactctcctttggtggggcttgctgtggtggcagtgggggtgggtgtgtggttctcaggccagtggatttatgttcctcaggggattatggctgcctctgctgagtcacacaggttgccagggaagtggggtaagtcggcagtcacaggctttaccccgctgccatacagcctgcagtcctaaagacaggtctcactcccaccgtggccctcccaacagcatcaagtcaatttctgggcagttggtgaccagggctgagaacttgccccagagaactcagccttcctgctgagaaagcaaatggactcatggttttccgatgtctcattgagccagcagcagtgatccagttccttcaaagggtctgtggattctctcagctttcctggtatgttcctagggtaattcttgtagcaaaagttcacgatatgagtcttcacatgcagctgtctgagcaggagctgcaggctagtcctgcctcctttccctctatggtaacatctctgattctaattctccttattgctttccttagaactatcaaaacaatgttaaatggcaatgcattttctcatttaatggtaatatttctatttatgaaatgatggattgaaaattatctacaaattttcatctaatgtagacattattttgttggcaattttataaaaagttcttacaagaatattttaaatttatcactttaaggccaggtgcagtggctcacacttgtaatcccagcattatgggaggccgaggtgggaggatcacctgaggtcagaagttcaagaccagcctggccaacatggtgaaaccccatctctactaaaaatacaaaaattacgtgggcgtggtggtgtgtgcctgtaatcccagctactcaggaggctgaagtgggagaatcacgtcaactctggaggcggaggttgcagtgagccaagatcacaccactgcaccccagcctgggtgacagagtgagactccatctcaaaaaaaaaaaaaattataacttcaacatttataaagttgcatgtattttatagttcttttccttttgacaaatttgttataaataagaggtagttgattatccacctatccttagctttccataataaattttatttttgttagatttttaatatttttgttaaatttcatatgctaatagtctatatagattttatatttattattcataagaaaaattaatttgttgaaaacatcattttcaatttttgctattaactattttgcatttttgtaattttgacaatttgtgtttccttagaaactcattaatttaatttaaaattgcaaattacttacataggattataactatggttctcctaaaatttgtatttccttcctatacctgtgtctgtatatttgtgttttatttctataagttatattttccagattctgacttttatttttaaaaggatgaaatattaatttatttagaaattcaaattatttttgcttttcaaatttatcaaactttgtcattcttcttaatcccccaccatgcttttctcaatctagttttgttgttttatttctaactttttgatttaagtgttttttgtgtttttcatcttaaaataaaaaatcaaattatgaggactaccaatatgctttttgtacagcttttaccttgatcctaaaaatgtaataaatcatagtattgttgttattctctaaatgatgttagaaatacattttcagtgccacaaaggaagtagcactcgaacatgaattttctcagcaaggcaattttacttctatagaaggatgcatctcacggatggagcaatggcgagagcacacctgaacaagggaggggaaggagtttttatccctgacgcaggtagcccctactgctgtgtcattcccctattgattagggttggaccacacagtctaagctaattcctactggctattttaaagagagcagggttacgagccagagtggtgggatgagcagttctggtgggaaagacggttacagaacaaatgactaaatgtgactcaggtcagaacaggtgaccaagggtgactcaggttgcagcaggtgatcaggggtgactcaggacagagcaggtgatcaggagtgactcaggatggagcaggtgaccaggggtgactcaggactgagcagatgaccagggaaacagttgtgaactactgattacaactggtggggaggttgtttactgaaactaggggaaggagatgaggagaacaaggaagttaaactttaaaatgaaggtcatagaactgaacatactgacatactgatactttgaagagaaacttagaactcactgtatttaacaatgacatatatgattttaatatagtatttttatcaaactttagaaggctttttttcagatactcattatcttatttttttctttctttctttccttttttttttttttttttgaggtggagtcttgctctagcacccagcctggagtgcagtggtgcgatctcagctcactgtaacctctgcctcctgagttaaagtgattctcctgcctcagcctcctgagtagctgggattacaggcgcatgccactgcacccgactacattttgtatttttagtagagatggggttttaccatgttggctaggctggtctcgaactgctgacctcaggtgatccacccacctcgacctcccaaagagctgggattacaggtgtgagccatcgcgcccagcctatcttatttcttccttcaatatttttacaaaataattttaaagacttttttgaagtttaatttacatatgaaaaagaacatccaatgacttttcataaaatgaatataattatataatctgtacctacctcaagaaacagaaccagaccaccaacccataaattccatctaatcacatccctgttgaggttaactcttatttgcatcttttttgtttttaatacaacttaatgtattattaaaggcaatcttgtaaacaaaactcaggacaagaagtagaactttggtagctaacttataagtcattctatgtactccattccaaatacaacctcttccatttaaatgattttttttgaattcattacgcaagagtctattcctagacaccatagtttaatcttgcatgtttgtaagatacttgatagggcctttaagttactcaattcacaggtcctttctccattcctttcatttctttacaaactctctgtcgaagaacctgaactgttggacatggtgagttggcctacaaactttgctgactgcatactgatgatggaatttaatatgttcatttgttctgtttcttgcaattgcagctggattcagaggtttagttagacgcaggttcaatcctttggcatgactaaacaggagatgatgttctctttcatcaagaggcacataatgtctgggccaggtgaggtggctcatgcctgtaatcctagcactttgggaggctgtggcgggcgaattgcttgagcccagagtttgagaccggtctgggaaacatggggaaaccctgtctctaccaaaaatacaaaaattagccaatctcataaccttgtgtaaaaataataaatattaaaatataaaactaaaaaataggcacataatagctggtctttagtctttttttttttgcttttagcagttttgatgtttaatgcttaggtgaattcatccattgcaaaatggtcatgttttaacctagtctttttgttttcatttactagtttggataattttgtacagagatgctttaactgtcttttatttggctactcagaggtacagttcatacaggaaaagagacagaatttatttacccagttttcacaataatcaattggttttcagctgtcctcagaaagtgacagattaggttttcatgtatttgtttccttgtatcattctgacttcattctgatagaattagaatgtatcacaagtgtcactttgtgcttagttatctcttttacttcttagaatttcccttttttattctctcgacattctcctctagtcatttcttcatccatatactagaaataataactcaaatgtttaaatgaaggttcaatgctataccacataaaatccaccttgtgcagaaacagacatgctgttgtcatttaactgcaactaacttatatgaagaaaattgcagacctgaaatcaaatctatcttgctccaaatgctacatgctatatctgtttctgtctgtcggcagataatgcagttttacttgggttaatctatgtcaataggtgaaaactcaacattaagagctaattatgtttgagaacagaaagtagagaaaatttattagttgagcaagtgtttgaggttggtatgtgtaaagagagttgtgatactacttactctgaaaggaaatcctgctgtatgggattgaatctctctcaagtgtttccttgatttttctctgcagtcatagaagaagtaagatatttttgttgaatttggaggtaggttttgaaaaaaaaaattctaacttctctatttacaagtacatgtagacaaaagaattttaacttataaagcaaaattaggtttatttcttcatccctggaagactgactctctcctttgtaattctatttcatcatttgtaaaataattggaaaatgaaattcaaataactactcttgaaaagaagaataaatttacatacaaataatggtctgcaagtcccttattatactccatatctgtgtaattagtttaattataactaaatcatgcttgcattaattatattttaaccttgattatttgtaatgttaattgcacattggtattcaaagaattaaataggtaattagcagcacaatggaatttttcactacttagagagttgaaatgtaccttcctgcccatgaagcccatagcttattgctacctaattgaaacacatctactcattcattcaatatattaaggtatttttgtctcttctttgaggttatattatctaaaacagggctcttttactttcctgtttaatttactaatctccatgaatgcacatcttcaaacttgagagtaatacatgtctaaatatatttcaaaattgtccactgtagtttggctcagagcatgtcatgttctcctgatatactgatagttgtctcaggccagaaatcacatgcatttttattattattattttctattctctgtagctcttcttcctactatcgtaactctcaactttttgtcttggcaagttgtcaaggctgcagcatgatagactaggtcccagaggaagtgaagacaaggaagtgaagtaaggaatttaagactaagatttgttttatgaatttgatcaacacagttgagaagcaggcataagaataaataattatttgacttaaaactagcagtctcatatctggaacactaaagtcctgctaaggtagtggcaagattaacaaaaggctctaaaaattggagacaagttttctgatgaaaatcttatgttgtgatatttacttaaaatatgaaaggctgtggcatttttatttggtcagcatagtgttaaaattttggatttggattggcgttggttccagtttgtcacagttgccaccattgcttgttgccttattgatggacaccatcaaacatttacttggactattacatctgaaattattgaaatttgtggctcctgaacaccataaatgttaatctcattagccatgatttactgtgtctctcttattcgccgagtattaagttaggggctttacattctagatcttatttgataattataatgacaaagaggttgttatcctaattttactgacaagaatctaagattcagaaaaattaagtggcttgccggaagtcaaacttctagaacatgatggagctttgaatccaagtttttgaaactctaaatcacatgcagttcctatccaccctttgactattagagaaaacaaagtagtcacaatcaatgagacagaacataaaatattttaaaagggagaagaaaaagagatatatatatacatataaaatatcatgtatataaatatcatatgatatatatcttagttatatctatatatatattttaaaaggaaagttgacagataacagagcaggcacatatttttataataaatattattgggagtatctttccttaaaaaatcagacactcagaaactgggttaaaaaaggtatttttttttttacatgacacaacacaccattacagtgaaattaaaaataatggccattatgcaaatgaaaacaaaacaaaactgtataaatacgttaacatttaaatatataattcaagtaaaggtacatatgaggcaaagacactactaaataaaatacattctttgatgtgaagtcattgcagtcaagaaattctgtatatgaaagacatagaatgataaggtgtaaagcaaagtctgttgggaaaaccagaaagagaatgagaggatacgttggaaggaagagaccttaactctttaattatctaatagttacaaagtgtaatatatttggagaatgagtttcacgtcatcaacacaagaaacaagactgtttatcatacaaacatgacaaatacaactcttcatttttatttatgaagtactagagtaattcctgttaaaataagaaacagaataacatgatcaacattattatttagcattttctggaatttaagttcctgctataagacatagtttaaaaaatagtatgagtatttatactgctaattattatcttttgtgtcatcatacacttaaatacccaagaagatcaattaagaaataatttcaactgaagtggccagaaaaaataataaatacattcaaggctatataatatgaaaaacaattacaatagaaaaaaacacatgcaaggtaatgaataaccttagaaggaaatatggtcaacctatatgttaaaatgtagatgatgttttcagcataaaagaataaataagtaataagataataccatgttgctgaatggaaaagctgaatcatcttactattactctcctctagcaagttttatagatttaatgtaattccaattgatattgcagagaatagagtaggctttacacagaatttctgaagttttaaacacaagaataaatagatgggtctaatcgtgacatttttcaaaaagaataggttgataatggctaaatgacttaagaaatatttcagtgcattatattgactttgtaataaaataatgtctttctaattggattgcttaatcgataagagaaaatcaaaatataaaaaaggtagtatacacattttacattagtgataaaaggaaaagaagttgcaaaattttcctgagattggtattttctatccctcaaagaaaattagaaataaggcaaataaacacattgtttattcaataaggacatttcttttagacattaaattaatgtaaaatttacagtagaaaatacagatatatttaaacatagaaatttaaatttcttctgtaagtcgaaacattaaaattgaaaggctgaaaacaaggatcaaataagacaaagcattaataggtataatatgtaaattactgtatagtgataaggaaaagactacaattacaatacaaataggctagctgggcacggtggctcacgcctgtaatcctagcactttgggaggccgaggcaggcagattgactgaggttaggagttcgagaccagcctggccagcatggtgaaatcctgtctctactaaaaatacaaaaattggctgagcatggtggtgggcacctgtaatcccaactactcgggaagctgaggcaggagaatcgcttgaacccaggagtcggaggttgcagtgagccgagatcgcaccgttgcactccagcctgggcaacagagggagactccatctcaaaaaagtaaaaaataaaaaaaataaaaaataggcataagacttaagcattaaacacaatatgaaagtgaatggttaataaacattttaaaaatagttgccatcattaatataaaaatgcaaaacaaacaacagatacatatatatttttaatcattataaacaactaaaatgtagtgcacaatttcatgaaggtatagtaaagtggacactgttatatgcttatctttggaatataaatcataattttactggagttaagcatggcaatatatataaaaaatacttgggctaataattttccttctgggaaatttgtgcctagggagataacagaaacttggataaaggtttaaatgaaaatatatttattctagtaaataattgagaaggtattgttcctatatatttaacaattacattaattacaaaatgttggtgcaaaatcatttaaaataatattaaatatattaaaatggaagattagcataacttgaaaatgctctcattactagataagaattatctaaaacgattatattagtacctatctgaggtcacaagaaaggagggaaatttccaggtgccataaaagaagaaaccaacaaacctgatgtgatactgtgcaatatatatttttgtcttagacccatttccaagcctacaactcctaaaattcttggaatgtccaaactgatgtaatttttatgctaatgatttatggcgctggcagcctctaggtcacttcaggatggggctggtcaccagaaagaccaaggcaggattacagggttgggacttccagccacacccctcaatctcaggggatgatgagacgctgaaggttaagttgatcacaaatgaccaacgatttattcaaccatgcctctgtaaaagctctgtaaaatcccccaaaactgtgttcagggagtttctggatacctgaacacttgatagttcctggagggtggttcccagagagggatggaagctccataccccttcccacatgctttcccttatacatcttttcatttctatcttttgtaatagtctttgtaataaactggtaaatgcaaataagtgtttccctgagttctgtgagccattctagcaaattaatcaaacccaagaagagggtcataggatccctggccgatcccaaaaggtcagaagctcaggtaaaacaacctgaggcttgtgactggcatctgaaagggagcggtcttggggactgagccctcaacttgtgggatctgattatgtctgcaggcagatagggtcagaatagaactgaactagagaacattcagctggtgtctgctgcagaaatgattgcttgattgttggtggggagaaatccccacacatttggtcacagaagtcttgtgttgattgttgtggtgtgagagcagaggaaaaacagagttttcacactttcattccagagtaattgcttgtgttgccacctaagaaaggggcaaagcatatgtaaatttctgatttggaggcataggttttaatgtccctgatggtgcaagagctatgactgcagctctgcatgtggagaagcattgaactgaaactctgtataaagctaggatcgttgaaaggctgcatccttactgaaggggtaggatctagaaaagaccttctactggcatagaaagataataggaaaacattaatttctgtctaggattagaggtgaaaagaaaaaaatctcccctggaattttgaaaacctgagcttataccctagaactgaaactcctagaattgtgggagtttaaatttgactacctgtgatctgagaaccacaactccccctacccaagaatataacataaacattgacctcagtttgatgatacccatgggcacttttaagaagaaaacacaaatctttgcaaggatggtctcacagctcatatatcattttttttcaagagcccattaaagtggagtgactaaacaaacattacaaaacacacaagacaactatctactatatagataaattaatggctatcacaaaaaggagaattggcacacaaagaatgtaatgtaagagaactacaatcacaaagaaaatgtaagaagtaccatgatatgagagagaatagatttgaaaaaaaaagtactaagattaaaaactgtggctattaaaaagaaaaacaatggttgggttaaaaacaaatgatgtactgctaataaaaaatatgaaaatgaaattatgtgaaatatggaggatagaaagaggtctaacataagtctaattagatttctgaacaaaagaatagagacaatgggagagaggcaccatttgaagaaataataggtgaggattttctagtgttaagactgttgcttccttcaattgaagaaacattacatttattgaatataataaatgagacattcatacttaggcactttgtgttgaaaccaagaattccaaaaacaaactcttaaaagaaacaaggtggcaggtcaccacaaagtaagaaatacacctgcatctgttcacaataatagccactagccacttgtagcatctaaaattaaatgtaaatatgttaaaatcaaatcaaattataatttttttctcagcagccactagcaacatttcaagagtacaagaaccttctgtttcaggcagcacagatacaaaacattttcattgttgcagaaagtttaatttggcagtgatgaattagaccaaagaccaacttcttgacagcaagaatataaacagaatccagtaaaatgaaagaacataatgaatcaaaatgcattaataggtcaatagttgttatatatagacacagaattataggttaagttttattttttcttaatccttcctgtactttccaaatcttgcgctatgatcgtgtgttagattatcagacaattaaataataaacgggatataaactcttaagacaaaagcctttctcttcacatttcaaactagcattttttgagtttgctccattttaatatatgcaactgggataaactgttttttccttaggttttcccgttttttaagtgaccgtatcatagaattcatgtgaacaataactatgaagtgctatgacaccatcaaaattctaagtattatgtatataatacttaaaaatttatgtataaattactgtgcttcatataaaccaatgcactaccaatatatacaaaaagacatggaactcatttattgcttttaaatgtttcatcttcctttagactaatatgaatcacaaattagagtagtttgaatcataacctcaccaactagcaactagttgacaatttaattttctccatttaaaattaaatgacaatttaacaatactaacctaggaaaacaatgaaagaaagtcctctctaattttacatcaaagtgatttttattcttgcagacaccagtttaaaaaaatggtctaactgtgcctctatgtttgtatgtatcaattatctgtctgcatgtacacatgcttgcatgtacatatacacaaaaatgctcatatacagtgtatatttttttcattcatttcattcagtttttaaatttacatcatcatatcaaaatgttttcagaactgctgcacagtcttcacattaatgcctaccttgtattccactggttttctatgccagcatgtactgagtcatttctctattacatagttatattctcatttgaatttcccttccctggaacaaagtatctcttagctgaaaaagtcttattctgtgaaagaaaatgctgcctcttccatgctatgtctaagatatggcagaatgtgcaaactagcagaaagcatctgtatttagccacaagcattgacttcagtcggccccatgtagatctgtattagatgggtttccctgctgcttgctgcctcaggcttccatggggagcacccagaatacagtatgtgcagaggtgttcttaatttcacactgaagatgctcactcctctgcacacatggtccgtgatgtcccaactttacactggtgtaaaaatgatacacatttcagtgagtaccatactttgggtacccatacaatcattcttttcactttcagtacagtatttactaaattacttgagatattcaggactttattatgaaataggttttatgttagatgattttgcctagctgtaggctaatgtaagtgttctgagcacacttaagataggctaggataagtgatgatgcttggtaggttaggtgcaataaatgcatcttcaacttacagtattttaaacttacaataggtttattgggatgtaaccccatcctaagttgagaagcatttgtatttgctacttgttgatgtttacttcctgtttgctaacacactacctgtggtgtggcttctgtcatccacgatgtcttttgtgtcttttcaagaacaacaaggttgatgcatagctagaactgataatatgttctttttagtggaaaatatcttctgtatataacaaactgctaactgctcatacacagcgagtattttcatttgttagttttcactggaaaatattgtttatcctataggaatacatatatttctatattcctatcccgatatgccactataattaaatcatcttgggtacagtctttgtttcattacgcagtggtattagaaaacttctgaaagtcccctggcggagaaatgtccctaagcattttgttaattaagggataatttcactgaagaggaatattggaaggaattgctttctttctcagacatttaaatataaaagccgagttgaagtctttgttaatctagaatctatttttctttctaaggctatgccaacataaaaccatattttctttagttaatgtaatacagtactgggagtgaaggatgataaaaacaccagcatgtaacacattttttttttttttgtccacagattgttaaacgtcaaaagcaacctcacgctatggcttatgtattgagctgtgtgagagttcacatgtcgacttccaatcttcaaattttagttaatatattgtttgagctccctagcgcttcatgggaagtcctcactgggagaccttatctccctttcagctgctctcgttacatagaaactaagccaccatgagcaatgtgcaggttccctcatgccagggtgttttctgcatgccttgcttgcacagcttctatgttccctacatgctccttacacctggggagctctaatcctgtcagtgccaggcacaggtgagtctactgactcacacaggaagggaggattattctcagcttctttctaagattgaaacttgactacatctctattaaaatagagatgggtggtggttgcctggtaaacctatagccagacaactctagcctatttaggagtcattattttttctttactttttttaaaaaaaatttactttaagttccaggatacaagtgcagaatgtgcaggtttgttacttaggtatacatatgccgtggtggtttgctgcacctattaacctgtcatctaggttttaggccttgcatgcattaggtatttgtcctaatgctttccctccccttgccctctacccgccaacaggcccaggtgtgtgttgttcccctccctgtgtccatgtgttctcattgttcaacttccacttatgagtgagaacatgtggtgtttggttttctgttcctttatgagtttgctgaggatgatggcttccagcttcatccatgtccctgcaaaaggacatgatctcgttcttttttatggctgcatagtattccatggagtacatgtaccacattttctttttccagtctatcattgatgggcatttgggttggttccatgtctttgctaccataaatagtgttgcaataaacatacgtgtgcatgtgtctttatagtagaatgatttattttcctttgggtatatacccagtaattggattgctggatcaaatgatatttctggttctagatctttgaggaatcaccacacgtcttccacaatggttgaacaaatttacattcccacaaacagtataaaagcgattttatttctccacagcctcaccagcatgtattgtttcctgacattttaataatcaccattctgactgacgtgagatggtatctcattgtggttttgatttacatttctctaaggatcagtgatgttgagcttctttcatgtttgttggccagttgaatgtcttcttttgagaaatgtctgttcatatcctttgcccactttttgatgggattgtttgtttctttcttgtaaatttgtttaagttccttgaaaattctggatattagacctttgtcaggtgggtagattgcaaaaattttctcccattctttaggttccctgttcagtctgatgctagtttcttttgctgtgcagaagctctttagtttaattaaaccgcatttgtcaattttgaattttgttgccattgcttttggtgttttagtcatgaagtcttcataggcagatgaagcatagctaacatttctgtcctatgcttaccacaaagtagctgaatatttatttttatagaaaattctgcgtttcatatattttcttctttaccaaactctttgaagtctctatttttcttttttttggaaatggagtctcgctctgttgcccaggctggattgcagtggtgcgatgtcagctcattgcaacctctccccaacctgattcaaatgattctcatgtctcagcctccagagtagctgggagtacaggcgcctgccaccatacctggctaatttttgtatttttagtagagacggggtttcatcatgttggccaggctggttttgaactcctggcctcaagtgatccgccccccctcagcctcccaaagtgctgggattacaggcgtgagccaccaagcctggtctctactttcttttttatctttgagtaacaaatctcttaatttatgtgtgtgttgttgtttattcttcttttttcagtggatgatgccactggctgaataatactgtgaatccatctatttatctatctacgtacctacatacctatctatctcatctatctatctttttaatctatccatccgtctgtccatccatccgtccatccatccatccatctgcttggcagacctgcacaggtcatccatgttatgtcacctccccacactatcagtgtgcaccaactgtcatcccaggcagatactgtttttaataattttacagataagactaatagaggccaactgaaaattttttttaccttccagctctttactgagcattctattttagtcatatttctaaatatttcaagaattattttttctctcttgacttatttatgaaaaaaatggcatcctactttttagaaatgcaatatctaaataaatcattttttctttaaatattgatgtatttttcttttaaattagtttatctgcattgtttcagctacctgaattttctggagttttttgtttgtttttgtattgttcatgtcatatatttccttcaaatagctaatgttttgtgattgtctactcctacttaatatgtgagcattaaaatccttaatgaaaacccttggtatatggctagggcttactgactgttcactatagagtgagctatcattttgatagaatttggtgaggcaataaaagtaaaatgtacatttaaacttcatctttaattagatgtctagattaattaaaaccacttttgcattgccactataatcccatgtgattatgttgtattcctttgaatttttcaaaaatttgaatttccagaatcaatagtgaaatatttttgagttacagacacataaatctaaggattattagatctgtcctttttctcttcagtcttgataatgttctttgattttagatttagactgcttttaggttattactttattattttttcttttcaaataaattcgtatgtattgcactcttttttttttttaagatatatgtctgttttaatttgtttctactgaccaccaactttttcattcattataataatgcttaattcccagtttggtaaaattaatcttagttgtgttttatttttgtaacaaaggatgactgcagtgagagattccctgtcctgattccctgactaccagagagtaggtttcagccttcccttctgaaagacaagaatgcacatgccattctaaggtcacacattttctcaccagactctgggcattatcctactgtcttctgacagtcagcatgcaatggagaggtccaaggcagcctcactttgattcttgttcagatatttacatgttttatgttctttcctctgaagttaaccaaaaaaagcaagaaaacaaaacccattaaactccttgtcaaatcatcaaggcttagtagtattttcatttgtccttttagcctttattcatagttttgtttttaatttaagaaaataattttggtttccttgcagtccttactaattttaacctattaacctgttgttctcattctggagggccttaaaaaaaaagttacaattttatctcagacattcctttccttgggttttatgtttctatttcattgaggctgcttcatcttgcattcttctggaaataccagtgtctttccttaatattcagatacatgttttgctgaatcttagagattttgttccttttccactgtttatttttagaggatgttgttttactcatctaagaaaatgtaaactttttattaagttgatgttgatcaacagcaatggacagtagaattctctctgcttactttggtggtggttggatacagaatttggacctacaacataggttgaatagaaatgtataggtcttagttcagtcttggtttttagcaaggttttactttgtacttcctttgtattgtaggagcattgttcctcacctttgttgccttttttttttttagaaaaaaatatgtattgacaaattataattgtatatatttacggggtacaaagtaatgttatgatttaagttgtttaatttttaatatttgttggtacataagggttatatatatttatggggtacatgagatactttgatataggcgtacagtgcataataatcacatcatgacaaatggggtatctgccccctcaaacacttatcctttttgttataacaatccaattatactattagttattttaaaatgtataattaagttattattgactgttatgctataaaatactaggtcttattcattctttacaactacttcttgtacccattaatcatccccacttccctccctacacacccactaccctccccagcctctggtaactatccttctattctctttctccatgaattcaattgttttaatttttagctcccacaaataagtgagaatatatgaagtttgtctttctgtacttggtttatttcacttaacacaatgaccaccagttccatacatgttgcaaataatgggattctcttttatggctgaatagcactccactgtgtatatgtgccacattttctttatctattcatctgctgatggacacttaggttacttccaaatcttacctattgtgaacagtgctgtgataaatgtgggagtgcagatatcccttttacatgctgatttcctttcttttgggtatatacctaggagtgagattgctaggtcctttggtagctctatttttagttttgaggaacttccaaacttttctccatagtgactaccaatttacattcctactaacagtgtatgagggttcccttttctctgcatcctctctagcatttgttgcttgttgcctgtcttttggataaaagccattttaactggggtgagatatctttttgtagttttggtttgcatttctctgatgatgagtgatgttgggaactttttcgtatacctgtttgtcatttgtatgccttcttttgcaaaatgtctattcagattttttgcccatttttaaatcaaattattagatttttcctgtatatctgtttgaacttgttatgtattctggttactaatcccttttcagatggatagtttgcaaatattttctcccatgctttgggctgtctcttcactttgttggttatttcttttccagtgcagaagttttttaacttgatgtgatcccatttgtctgtttttgctttggatcacttgtgttcgtggggtattactcaagaaatttttgcccagaccaatgtcctggagagttttccaaagtaatagtaatagtaactgttcaagtaatagtttcatattttgaggtgttagatttaattctttcattcgtttggttttacctttttatatgatgagaaaataggggtctagtttcattcctctgcatatggatatccagttttcccagaaccatttattgaagaccatcttcttctgaatgtatgttcttgacacctttgtcaaaaatgaatttcctatgggtgtatggatttgtttctgggatttctattctgtcgcattggcctatgtgcctgtttttatgccagtaccatgctgttttggttactatggctctgtagtatattttgaagtcaggtaaagtgattcctctagttttgttctttttgcttaggatagctttgtctattttgggtcttttgtggtttcatataaattttagggttgttttctctatttctgtaagaatgccattggtattttgatagggattgtattgaatctgtagattgttttgggaaatatggatattctaacaatattgattcttccaattcatgaatatggaatatctttccatttttttattccttctttgatttctttcaccaatgttttgccatttttattgtagagatctctcacttctttggttgggttaatttctagatatttaatcttatttgtggttatattaaatgggattactttcttgatttctttttcagattgttcactgttgtcatgtagaaatgctactgatttttgtatgttgattttgtatcttgaaactttaatttgtttatcagttctagtagttttttgtgctagagtgtttagatttttttcaaatataagataatattatctgcagcaaggataatttgagttcttcctttctagtgtggatgccctttattattattatttattattattattattattattatttgattgctctggctagaagttccagtactatgttaaataacagtggtgaaggtgtccttgttgtgttttagatcttagaggaaaggctttcaggttttccctcattcagtgtgatactagctgtgggtctgttgtatatgacttttattatgttaagggatgttccccagttttttgagggtttttaatcataaagggatgttgaatttactgaatactttttcagtatcaattgaaatgattatatggtgtttatccttcattctgttgttatgatgtatcacattgattgatttgtatatgttgaaacatccttacatccctaggataaatttcacttggtcatgatgaatgatctttttaattcattgttgaattcagtttgcttgtatgttgttgaggatttttgcatcaacattcatcagagatattggcacatagttttctttttttgatatattgtctgatgtgggtattaaggtaatactggcctcatagattgagtttggaagtagtctctcctcttctacttttcagaatagtttgagtaggattggtattaatttgttaaacatttggtagaattcagcagtgaaatcattgggtcccaggctttattttttgctgggatattttattatggcttcaatcttgttacttgttattcacatgttcagattttgaatttcttcatggttcaatcttggtaggttgtatgtgtctaggaatttatccatttcctctagattttccatttatgggcatatagtagccactaatgatcctttgaattgctgtggtatcagttgtaatttctcctttttcatctctgattttatttatttaggttttccctctttttttctcagtctggctacaggtttgtcaattttatttatcttttcaaaaaacaaatttttattttattgatcgtttatattattttctttatttcacattcatttatttctgttttaatctttatttattttttaccaattttgggtttggtttgctcttgcttttctagttctttaatatgattattaggttctttatttgacatttttcttcttttttgttgtagccatttatagctataaattttcttcttggtactgcttttgctgtatttcatagattttggtatgttgtgctctcattagcatttaaataaatttttcaatttctttcttaatttctttactaatctactggttatttgtgatcatattgtttaatttccatgtgtctctgtaatttccaaaattcttcttgttcttgatttctagctttattctcttgtggtcagggaagatatttgttattatttcaaagtttttgaatcttttaagatttgttttgtgatctcatgtatgttctttccttgacagtgatctacgtgctgagaaggagaatatatattctgaagctgtggagggaaaggttctgcagtatctgttagatccatttgttctatagtacagattaagtccaatgtttctttgttgattttctgtttataatatctgttcagtgctgcaagtggggcattgaagtccccaggtattgttatattgaggtctatctctctctttatctctcataatatttgctttatatatctgagtgctcctgtgttgggtacataaatatttacaattgttttaccttcttgctgaattgacccttttatcgtgatgtaatgaccttctttgtctcttcttatggattttgtcttgaaatccattttgtctgatataaatatagctactcatgctacattttggtttccatttgcatggaatatagtttttccatccctttattttcagtctatgtgtatttttataggaaaaatgtatttcttgtaggcagcagatcattgagtcttgtacattttttttcatttggccactctgttttttgattggagagttttgtcaacttacactcaatattattgataaaaaaggatttactcctgctatgttattgttttctgtttgttttggcatcttctcatctttcttttattcctttattgaagatgattttctctggttgtatgatttaattttctgctttttattttgttgtttatctgttgtatgttcattgatttgagttaccgtgaagcttgcaaatactattgtataacccactattttaaattgatgacaacttaacagtgattgcataaacaaacaggcaaaaggaaactactaaaaactctaggttttaatcttgtcctccagcttcttaactttttttgtttctctttaagttttttgtactatctatgtcttcaaaagttattgtagttattatttttgattgggttcatcacttagtctttctacttgataagagtagtttacacaccacaattacagtattataatattctgtatttttctgtgtgctcactattaccagtgagctttacactttcagataatttcttattgctcatgaacaaccttttctttcagattgaacaaatgtttttagcatttcttgtaggacaggtctgttattgatgaaatcattcggcttttctttgactgggaaagtctttttttttcccttcatgtttgatagatattttcactggatatactcttgtaggataaaagttttttctatcaacactttaaatatgtcttgccattccctttttgcctgtaaggtttccactgaaagtctgctgccagacatattggagcttcattgtatgttatttgtttcctttctcttgctgcttttagaatcctttttttattcttgacctttgggagtttgattattaaatggctcagagtagtcttcttttggttaaatctgcttggtgttctatttgtttggtgcaaaagtaatcacggtttttgacattaaaagtaattacttttggcaattaaaagtaattaccacaattacatttgcaccaacgtaatataaccttcttgtacttaaatgttgatatccttctctcagtttggtaagttctctgatattatccctttgaataaacttcctgcctctatctctttctcttcctccactttaaggtcaataactcttagatttgccctttcgaggctattttctaaatcttatatgcgtgcttcattcttgtctgttctttgttcttttgcctcctctgactgtatttttaagtagcctgtcttcaagctcatcaattctttcttctgcttgatcaattatactgttaagaggctctgatgcattctttagtatgtcaattgtaccttccccttccttccttccttcctttctccatccctccctccctccctccctcccttcctcccttccttccttcctctctctctccctttcactttctctttccctttctctttctctcttttttctttttctttttttttttttgacagagtctcagtctatcacccaggctggagtgcagtggtgcaatcttggctcactgcctcaccctgtcacccaggttggagtgcaatggcgcaatcttggctcactgcaacctctgcttcccaggttcaagtgactctcctgcctcagcctcccgagtaactgggattacaggtgcacaccaccacgcctggctaatttttgtattttttagtcaagatggggtttcaccatgttgcccaggctggtcttgaactcctgacctcaggtgatctacctgccttggcctcccaaagtgctgggattacagacatgagccactgcacccaggaatcaaatgtatttttcgactctagaattacttcttgattcttttgattttttcaatctctttattaaatttatctgatagaattctgaattccttctctatgttatcttgaatttctttgagtttcctcaaaacggctattttgaattatctatgtgaaaggtcacatatctctgtttctccaggattgatcctgccttagctcatttggtgaggtcatgttttcctggatggccttgatgttcagagatgtttgtcagtgtctggacgttgaagagttaagtatttattttagtgtttacagtctgggcttgtttgtgcccatatttttggggaaggctgggctactgtcatagtggcagcctttttgctttcttctttggccccctctcagctgctaatgtctatctaactacctaacataaccactacctgcctaccacctatgttcactcaaggccctagggctctacaatcagcaggtggagaaaccagccatgtttgtgtcattcccttcagggggtgagttcccccaggccctggctggacccagagaagctgtctgggatccagggattagagtcaagtatcttagaaatctacctggtactctattttgctgcggctaagctggctgtcaaaccacaagtcagaatccttccctccttttcctcccttttgactgtcagaggagcctctctcagtggccaccatcactactggctcacagggagttcttcaaggccaacgctgatgtccctttaaagcccaagaatcagcttgtgataaatgctgccaggcctgtgactcacccttcaaggcagtgggctcccttctggtccaagacaggtccagaaataatgtccaagagcctaggcttggactctgataccctaagagctcactcaggtaccataagcgctccaccccactatggctgagctggtacataagattcaagacaaagtcatctttcctttgccctctgcccttctcaagcagaaagattattttatcatagccactacagctaggaatgtgctggatctctcctgaagccaacacaactcagtctcatccaaggcccatggcatattacctgggtatcactgccagttattcaggactcaaaagttctttcgtcatcgagtgatgagtcctgccacgactggggccttcctttcaaggcagcgggttcccttctggctgaagttattctagaaatgtcatcccggagcaaaggcctagattggaggcctcatgaatttgcctggtgccctatttgattgtggctgagctgttaaaagtcctgtttattttttctctcctctctaacagaaggaaggagtcactttcattgccaccagctatgctgccttgggttgagggaagggtggtgcaagaacttccttagctgaccccactggtgtctccctaggtcacatgccaccctagtccactggctgtaatcccagcctagaattaggatttgcctgggaattttagtccttgtgttctaggctccctttcaagtttacctaggaccctagagccctttagccagagatggtaaggcttgctgaaactcaggttccaactgctgggatggatgactcccctccagctagggctggtccaaatgctacctccatgtgtgggcactgactgagccctgcatgattttgctctctgctgtgacagggcagcatttagttcagtgccaagtcccccagtcactgtgctcttcctcccccaagtgcacagattccctctccacaccatacagctgctgcaggggtatgggggagggatgtaatcagcgatttatgactgtctctcccaccctcttcagtgcctcttttagtgatatgaagttaaaaccaggtactgtaattgctcacctaatttttggttcttatgatggtgctttttttgtgtgtagttagttgttaaaatttggtgtttctgcaggagggacaatcagtagaggcttccattctaccatcttgttccacctctattgtgatttttgatgagaatatggaataactaaattaagctgattagcatacccattacttcaaatattttaacttttgtgtgataagcatattagacggttactttctagcaatattgaaatgtacagtactcagttattagctgtatttagcatgttgtgcaatagatctcaaaataaaatcagatttatttattctatctaattgagcctttgtatgctttgactattatcttctgattctcttcaccattcagtctttggtaatcatgattctactgtctgtttctgtgatttcagttgttttagattccacatgttagtgacaatatgtggtatttgtttttctgtatttgacttatttcccataacataatgttctctaattctgtccatatcatcacaaatgacataatttcttcctttttaagggctgaatagtattccattgtatgtatatgtatatatatgtatgtatgtatgcatatatattttttctttattcattttctttatttatccatcccttgatggacatgcaggttgattccataacttagctattgtgaatagcgctgcaatgaacatgggactacagctaactcttcaacataatgatttcaaatctttcagttaaatacccagaatcagaattgctgggtcaaataatattatatttttagtttttttgagtgatctttatactttctctttcataatgtttatactaatacactttcctatcaatagcatgtaagggttcccttttctccacatcctcaccaacacttgtcttttctctttttgataacagatttaacaaatgtaaagcgatatctcattgtgtttttaatttgcatctccctaatgattagaaatgttgaacatttcttcatgtatctgttagctattcagatgtcttatttttagaaatgtgtttcttgcccattacttaattagattattggttttctttctgagaaagtttgtttgaatttcttatatattttggatattaatagcttatcagatatatggcttacaaatattttctcccaatccatagattgtctcttcactgctgttttctttgatgtgcagtagctttttattttgatataatcccgtttgtctttgtttctattgcttgagtttttggagtcaagtctaaaaaatcattgcccagaccaaagtcatgtagttttttctcctatgtttttttttcctacgaatgttatagatttgggtcttatgtttcaatctgtaatctattttgaattgagttttggatatcgcataagataagtgtccaatttcattcttttgcaggctgtcttttctgaaagctttctgaataagtgtagaacatgaaaacaggccccgtctcataagcagcccccagtgtttgaggagcaaagtgccctgtcttctggttggaaagcttccttcctctgtgagccggggttcagaggacatatgcatatgtatggggggggaggtggatacaaagtttgcctgccttttttttcttcatatattctctctttatgatttgaatccttattatgatctgagctgcagttgtgatagtttttggttgttttagtgccactcttcacttctgtcttgtaactattaagacaccttctaatgttattattatactgcttttttgtgggctgagtttttaattctatgggcattttagggaaatattagaaatgtcattccttaatgacatctaaggttggaagttagagctttggttttgaataataaatccgataagataaagtgtgaatcaccatgggcaaaaactcttcttttcttcagatatctaggcaagggaccatggggaatgaaacaaagagaagagctgaggagttaaagaagcagaaatgacatatgcaaacatagattgggtaccatagaacctaactcttgaccagggccagtgaaaaaaatagaatcaaatataattctgaagtagagatgtttgagtcaggattttctgaagagtgacatgttaataagcaacagagaacatgaaaaaggaaccactgggggactagatgctgtctttacttttagatgttattattttattttttggtgtttgttacatgttcaaaggtacatatgcatcctgaaactgaaaggcataaagttgtgattttgatataatttgttacctgtgaatacggtagatggttgccaaaattatgtagcataaataatataaacatgtggtatcatcctctgtaatgatactaatatgttgtgatttccaaaaagaatgatgatgccttatagctttgagttattacatatatgtatgtgtgtatatatatatatatgtctgtgtatctacatatatatattatgtgtgtatatatatttatatatatgtcttgtgatattgctttagcatttgcatttggcatgatcatttaaaatatttttaaatatgcaatgcatggccatggtataaatatccaggctataaaaaggtacagtcaaggtgtgtcaaagtcactgaaaggtatagttttccccagtcatgcagcatttctcttcacagatttcttgtttagttttgtgtaccttctatgtgtagatttgtgttacagtgagaaggagttgttcttcagcacattctttccaatttctaaataataattggtcattgtttgctcatctgtgaggtcagtttgggttatttatatttcctgaagaaagagagggttaaaggctagggtggaaaagtattgggtacctagtcggagtagggaaatgtgtcattaaggttctcccttgctcctcccatgatgaggtctcagcagagatgatgaaggactcagataaagagataagaatgaagtcacctgggctagaaatgccaatacatgtaagagcatgcctggccaaaggagcctgagaccttgactgggacttctctcagagacttcagtgtgttggctgtgcaccaagtctcatagaggaagggcaactttcccccatgaggcctgtcaggtacagattttgtaatggcctgtggtcaggcctgaaaagttgcataagtctttaattggaagcaagactcctcaaatccccccaccccaatcatgtttaattatatccgtgtatggtctagcttttgttgtttttgtttactgcttgtgtgtgtgtgtgtgtgtgtgtgtgtgtgtgtgtgtgtgtgtgttttgcatggcctcatctttcttcctataatttggaggatttctagcctgtgtttagcttctgtggtttcctctacaaatataactctatataatgcttggtttcctacttctttacagggactatattaactcttcagtataaacaatagcaaagttatttagtatattcctaactccacatgtcatctcctctctttctttttaaatagatctcctttcatctttttccctctagcttttttcttttgggaaagcatcatggcatgagactagaagtgagacttggacccacagccagaggttctgggtgcaacacatctctcagatctaatctagcacattgatttggtccaatgtaactgtcatatatggtcctgaattctgtcccctttaaatctgtaaaataataataacctcaatttatccatgtctttttttttttgaggtaaaatacattagaatctctgaaagacactgacagatttaaagaatggtataaaactgaggcattatcatcttatggctactggttatcaacagcttattaacaaaaaaatgaagctcttttttctgatagctgtagtttcaactttttttttaataataatgattcttagtgtattttgacacataatatggtaaagtaacctgtgctcacataggaatttgtttttaatatcactttaggaaaataaaaatcttagtaagtttaccttcccttgcttaaatatctaaaaatatcagccaggtagagaatagttgtactaacattctcaatctatcaatatcttgtaaatagtaaagttttggtatttctttatataaaaatttcttatataattaaaaagttaaatagattagaaaatacgttagaaaaatttgaaatactaaagtttaaaaacctccctgacaatatctattatggaattaataatgcatttaaaatttttgaatctacatatatttggaaaataatacaaatatgtgtaagctatattacagacaattgttatgtgaattagtggctctcatatttactatccggaatctgtaaaatttaacagtgacttgcttgatctctaacactaactttgtggaagaattagatttggtaaaggagttctaagaaaactggaactgtattgttttctggatagtttttaaaactgaacctgtgtgtgtcataaattaagacaccaaatgaaagaaacattaaatgaaaagtctgagtgactgcggaaacggtgataaacataagccaccatttgttctttaaaaacatgtctttgatatattagtcttttcctccaataaattattaagtgggaagattggcagctgctatgaacagagcatgtgtgtaatttaatgagcttttttttttttttttttgccagtagtttataacattttcttcatgggcaagaacaaaaaaaaaaaatctcaggagtatgaaaatataattgtgtgttaatttttctgttttgaaaagatgtaacttaatcagatttgtgacgtctccctcagccaagcacaaaggaataaaatgaataaaaatcattactgaagtcccgaaatgaatgactgttttctcttatgttgcaattgtagtgatgtttaaataccaatctgaaatacccgagagaacttcaacttgtattagagggttatataggtgtgtatgtgtgtgtgtacctttaaaccggggggataaacttattctacctttcaaagaagataaggccgggcgtggttgctcatgtgtgtaatcccagcacccagactccatctcaaaacaaaacaaaacaaaacaaaaacaaaaacaaagaagaaggtaaaaacatattcctaatccatatgtaagaaacaaatcagcatgagagcatcgtaatctttctaaaacaatgtcaagctgtcatggagtgtatgctccctgaagctgtctttggattcagtttctttggttttggtcacaggctcagggccttctcctaacaaacacatggcccatgtttaagagctaacaagaccaacagacaggagcctgtgacattcctgttaacacacaaaaacaattcagatattcaggatccagtcacttgatgaaagggcaggtggtaaactgggggttaaccttcctataaagtatggccagtggcagtagagaatccagcagtttggaagcaaatgaatttaaaatactatctggaaagcaaatcaaatcaggaccattgagctgttctttcttgactctcattgacctactttcacggtttacagactgctgataatataaaggaaattaaatgcctgcagtgagaaggttcttgatctggcaaagacccctcagagtgctccaaacattttatttaatttccaaaatttcttgatctgttatgtcattaaataaagggggagaaacagctagtcagcatgcatcatgataaaagccacttgaagctcacttttctgtcccacccaggactaaaaaatgtcttgcctttccaagtggtgctgaagcgtaaagcatacagttatgactttcactgctaggttgagataactgaaatgcaagtgcatggaaaccgtaaaatggatgtgagcattttctaataatatcaatatgattgacagtgattttgattaaggagatgttggttagcatctcacagagatagattagaagatttatatagatgagctcacttcttctaggtcagtcagaatgagctctggtttagataataagctcttgccttgctgaaaggctttattatcatatgacctccttttgtatgcaaatctgcacaaggctgtacccacttagtgcttccatctggattataagaagacaccatggaaaatgggtcctgttcacttaaactgagttgtcaggttggtcttcgtagatccttatttgcccccaaaattcacataaagaaatttagctattcacagagcagcaggtatttaagccaataaaatagagcatgggaaatcacagtacagtttgacttaacatgtctttaaaatgctatttgagtactgacctctactgtggtttagcacactctggatcttctccgcaaacattctaccgaactacttatagtgatagacacatcactgcttaataaaatctaaagaattgatagatatgctgtgtgcaaaagttgagtgaggtgattcccactaactgcaaagcaactgcaaccattttaattgtacggcacacagaagataccctgctctgaaagtggaagtaaaggttcttcatttgttttcattatgaagtcatgcccttagtttaaaaatataatctaagtaattaaaaattaggcagctgtcattgaactggatgacgggttgctttgaaggcagaaagaccttttccattgttgaatccctgtgttcgcagagtgctgtatttcctgttttgaagtagaaagatactgagtagaaaaaaatgagtatgggccttgggcagtgcagaggctgcaagggtgctggggtcattggacaatgcaaagaatatctgaatatgtattccatatctttatatgttttagaacatttaaaatatatattatatggctttacattgttagggagctcattgagattggggagtagttggtaggagaccatccaaacacattctatcagaacttatataaaaccttttttagacatgaacatttgtgctaggtgattaattaatgtgtggagattaccaacaaattttaaaatatcaacttaaacattgagtatataatactcataaatcataaatatatgggttgatgaacttttatagtattagcatacatgtaactatcatcaggagagagacctttggcagacccccaagaaactcctttcatgaccctatctaaaccaaagataaacactgttctggcttttattagcataggttagttttacttgtttgtgaattttatataaatgagatcatacagtttatatttttacatgagcgattttttcctataaaatcatatttgtaaaatgcttccatattgtcacatgttgcaatagttttattgtcattaataatgacagatatttgttaggaacaatccccaatacgtatatgaatgaaattgcctccatagagcatgtgtgtgtttagcttttgtaaatactggtagtgttttggttaactaagacataattcacatactatcaaacttataattttttaaatgcaacaattcagtgatttttaccatattcataaagccatatgatgatttccactaactctagaacactttcattactttgaaaagaaaccctataccaattaacaatcattctccattgcgtccccccattgtcaaccattaatttactttctatctccatggatttgagtatcctggaaattccatataaataggttcatacaataacttccttttatctcaaattcttttcctgttttatcataaaagggtattgaattttgtcaaattctttttctgagtttaatgagatgtgtggtttttgcactttattccattaacatggtatagatgattggtagaatcaacaaataattaattttatatattaaactaactttgcattcctggaataaattacacttgagcatagtgcctacttctctttatatgggctggatttgatttacttgtattctgttgaggatttttaaacatctatttataagaaataatgttatatagttttctgtcatgtctttagttgtggtatcagggtgatactgaccttatgtaattagcttgggaattttttttctcttctactttttgaaatagtctagaagcattagtattaatccatttttaaatatttggtagaactcaccagtgaaaccatttggtagtgggcttttatttatgaaaaggttttttggcattgtttttattgtttttattattattattactaattcagtatctttatttgtggatctgtttagattttctttttctcatttggtcactttcagtattttctgtctttctaggaatttgtccgtgttatctaaatttcttaggattttggcatacgaatatttagactattaaaaaattttccatttctttaagattggtagaaatattttatttcttattttagtaattttaatattcttgttcccttttgttggtcattgtagctatgagtttgtagatttgattgaccttaaagaatcaagatttgattatgattattttctttattatttcttccctattttatttatttctgctcaaatcattatttttttattctgttttctttaggtttagtttgctttagtttttctaatttcttaatgtaaatggctaggttattgttctgacatctacctttttaaaaaataatacagatattacagctgtatcttctctttatgtacctttttagctgaataccatgttttgatatgttgtgtttttgttttcattcatctcaaagtattttttcattttccttttgatttcttctttgacccattggttatgaaatagtatgttgtttaatttctacacatttggaatttcccaaagattgcttctgtattgatttttaattttagtccattgtagtcaaagaacatactttgtatgatttcagtccttttcacttactgagtttttttgtttgcttgtttgtttgtttgttttttgatggagtgttgctctttcacccaggctggagtgcagtggcatgatctcggctcattgcaacccccacctctcacgttctagtgattctcctgcctcagccttccaagtagctgggaatacaggcatctgccaccatggccagctaatttttgcatttttggtagagagtgtttttcatcatatcgggcaggctggtcttgaactcctaacctaaaatggtctgctcaccttggtctcccaaagtgctagaattacaggcttgcgctactgcacccagctaataagtctttttatttgtttgtttgtttttttaatagccaaacacttgttctattctggagaattgcttctatatacatttgagaagaatgttcagtctgctctttttggatggagagttctaagtctctatagtctcttaggtctagttatcttgttgtattgttccaatctcctatatttttgttaatcttctagcatagttattctattaaatattgaatatagtgtattgaacttgttctattgttgaattgtctatttctccctttaatgctgtcagcatttgctttgtgtgttgtgtggctctgttcttaatttcatgtttttatgattagtctgtcttcctaaggaattgacccttctattgttataagatgtttttctttgtttttagtaacaatattttcttcaagtctattttgttatatattagtagagtcacctcagctctcttttggatactgatttcattgtatatctttttgcatcctctttttttttttttttttttttttgagatggagtctcactctgtcgcccaggctggagtgcagtggcgcaatcttggctcactgcaagctctgcctcccaggtttacaccattctcctgcctcagcctcccaagtagctgggactacaggcgcctgccaccacgcctggccaattttttgttttttagtagagacggggtttcaccatgttagccagggtggtcttgatctcctcacctcgtgatccacccgcctcggcctcccaaagtgctggtattacaggtgtgagccaccgcacccagctgcatccttttactttcaaactatttgtgactttgattctaaagtgtatattttatagacagcatacagttggataattaaaaaaaaatccagtctgccaatctatgaatttgttaaatggtagaattaattgataattatgtggtaattacattaaatgtaaatgagctaaataatctaattattgagatggtaaaattggtttccaccattttactatttgttttctatatttcctctatatttttcattcctctgttcttctattactgccatcttttgtgctaaataagtattttctaacataccactttaagtccttattgtgtttttttgctatatatatttttgagttattttcttagcagttttcctggggattgcaactaacatcttgagttaaaattctctaatttagattaataccaacttaatttcaatagtttataaaattgtgtttctacatagctcctctcccatttatgctattattattacaaattacatttttagagattgtgtgctcatcagcattgatttttaaattattctattatggaaatgcatttaactaaaacagaaaaaggaattacaagaaacacgtacatttatcttgtcatttatatttctttatatggtaatcttaaccagtgctttttgttttatttcattatgtggattcatgttactgttagtacttttcatttcagcttaaagacttcatttagtaattttgaggcagttccactgtcaacaaactctctcagtttttgttgagctgtgaatatcttaatctctcattaaattttaaaagatagtcatttcttctttatttcttctttactgtagaattctaggctagctttttttttttcttttaaccttttgacactttgtgtatgccatcctattgtgttctggcctctgtgatgtctgttaagaaagcagctattaaccttcctggagattctttttacactatgagtcacttctctcattgccatcatgattctccctttgtctgaagtctttgacagtttgattatgatttgtctaggtatagattattttgtatatattatacacataaggatctcattcctgaatatatacaacattattattttctttcaatctttataactttctttttcttgccttattgcactggccagcactggcattataatgttgaatagaagaggtggtaatggggaccttacttttgtttttgatatgaaagggaaaactttaaatattttatgattaacataggctgggtgcagtggctcatgtctgtaatcccagcactgtgggaggccgaggtggatggatcacttaaggttaggagttcaacagcagcctgcccaacgtggcaaaaccccatctctactaaaaataccaaaaaattagctgggcctggtggcacacgcatgtaatcccagctacttgggaggctgaggcatgagaatcatttgaatcctggaggcagaatttgcagtgagccgagaccgtgccaatgcattccagcctgggtgatggagtgaaactttgtctcaaataaaataaaatacatattttattattaacagaaatatatagcttttatggacttggcatacattttaaaatcagattaagaaagttcttttatattttcctttctagctcaatttttgacttttatttatttatttttataaagaatatatttagagacagggtcttgctctgtcacccaggctggagtacagcagcatgatcatagctcaccacagcctcaaacatctgggctcacataatctttctgcttcagccttctagtaggtgggactacatgcccagctatttttataagcaataattttaacattttactattttttctcaccttttctttatactcttagtatattatgtgacattaaataatttttaaattttatttaaaaaatattgaattcatggataaagttgacttggtcaaaatttaataccccttttatatatcacttgatttaattgggtaatagttactaaaattttgtggtgattattatatgaaattatcttgtgaattttacttattgtaacacatttgccaggtttaattgtcaaggaataatggcctcagtaagtaacttgaaaattgtttccagcctgttttccagaatagtgtatgatccatgtaatttttacatagatgtttcaaagaatgccctaatgaaagcatttgggtctaaatttatcaaaacaattttaattaatgattcaatttcgttttacatgtagaaatttttaggctttctatttcttccttttcttggtttattatgttttaagggatttttctattccatctaaattattccatttctatgcagaaatttggtgcataatatactaaaattttatttttaatatctatcttaagtgatgttagtattcctgatactggtattttgtatcaaattatattaatgtttctattcattactatgtttaaagtactctgttactgtcttaattttgcttattataactttccagttataaaatttttatttgattttttaaacagatttcaattttctagtataattcacctctttttcctcttttttgttcatttattaattaaactatgttaaagtctatgtctgataactccaatatctatatcacttgtgggtttatttttattttatttgttttttatcttatttatttatttttttaagtggtattcctggtgtattcattttctaggactactgtaaaaatataccactgtctgggtgcagtggctcatgcttgtaatcccagtgctctgggaggttaagatgggaggatcatttgaggctaggagtttgagaccagcctgggcaacatagcgagactccatctccacaaaacagaaacaaaacaaaacaaaacaacaacagcaacaacaaaacatttaattagccaggcctgatggtgcatatatgtagtctgagctacttgggaggctgaggtgggaggattgctggagcccaggagttcgaggctgcagtaagctatgattgtaccactgcactccaagctcagctacagagtgagactccatctcaaagcaacaacaacaagaacaacaacagaacacaaacttagtggcttaaaccaggaaaatttattctctcatggttctagaggcttgaactccgagatcaagctgttgccattagttccttctgattgctgtggggaagggatctgctacagccctgtctccttggcttataaaggaccatcttctctctgtgtgtttatatagtcttccctctatatatgtgtctgtgtccacattttcctttttttaaggacatcagtcataccagattaaagcccaccatagtagcctcatttggatttgattttctctgtgacattttatcttcaaataaggtcatattccaaggcatggggagttaggaccccaatattattattattattactattattttggatgggacacgattcaacccataacaactgataaattttgattaaatgaaaatatttagagtctctggatgattctgttttacttcaaagagaattctctttagctttgatatggaattagaatagataaaattatctcagaaaatgggatgatcttactaaatacgttttttaaagggcttgtctatttttacatttccggaggcttcactgttcaatggccctgactgaaagccacgttcatttgccagagtcccaacacctgaatgtctgcttaatgacagtttctgttatcccagctggttattccaggtttgttataaatttgataggtttagttactttttagattcttagatttgtgtcttgatttccctcttcaattatagacctgcattactcatacattaatgaacatctcaagcatgagacacctagagttacagggtttttcttactttcttccccctgggatattggcctctcaagtcctgtctgctctggtagccctgaatctcaatttttatctcttccaaagactaataacagctttgcttagctcctctgccttttagccatcactttctccacaacatcattacttcttcttcctcattttatatgtgtgactaatatttcgaggaaaaacaaacaaaacacatgtctcctctcagtgagtttcttctttttgggatttgaatctttaattcctagtctttaaatagatttttctgcattttatccagctgttccattgttttatgggctattgaaaacaactcccattttagcatcaattttgataataaagcaaaaggataatatagcacatggatggtatatttgaagccacaggtaatatatacattaacatttataaatattcccctatccagaaaatacttgaaacttgagtttccagtagacattttttttttgcataacacatgtaaacattttatggtacatacttagacttaacatttattcattgtctatctgaactataaacttaagtggatattttgtatttttttctggcaatcttgctctctttagaagaatgcataaacaataatacaccagaataattatggtacaaaagctgattggagcactatggaaagattctaactaaaaattatacatggatatttttattatttaaatataagggaatggttttttaaaagttgatactctaaagacttaaaggttaaaattttatgacataagtgtggaaactttcatgataaatgtgctagctgaatttgaaagataggagaatatggatgtaatagaaactaatgtaaaggaaattaagtacccagtagatcttaaattctgttttctcttatatttatcacatacaacagaattaaaagtgcggaatattaaattagcgctgccagtgataaacttgagaaattgttctactgtgtagattagaagccattgacatgatgagtaagagaatggtatacaatgtagaggatggagagatacatttaaaatttatagcttttcctgtgggtcagagatgtggaacatgaaaaaatgaaacaaaaactctactgaaaaaggtactgagttgtggcttttggtacaacatttaaagagcttgcaagttgtcactttcattttcacaacaggaaaataccttaaaaactaaaaattatcaactcttcttagatccctcagagatttgaggtcagaaagcaaactgctaccccagtactagagagacagtcaggggaccccctacacccatgggttcatatccatggattcaactaactgtgccacaaaatattcagaaaaaaagggatgattctgccggtactgaacatgtacagacttttcctgttgttagtattccctaaaaaatacagcataaccaccgtttatatagcatttacattgcattaggtattataagtcatctagaaatgatttaaagtatttgggaagatgtatgtaggttataagcaaattctacagtattttatataaaggacttgagcatctgtggatttttagtatccaaagggagtcctagacccaccccccatggatatagaaaaacgactgtactagaaggaagcccaggactgtgaatcaggagacccagaagcagaagtcaccatatgaggccaggatcagtaggaacacatccgctataatcaaaaagtgatgtaggctcagtgtggactaacttgaaagtagccttgggggctcctcactgatgagtattacctacaggaaccctaccagattctccatgtgaagacaggggaaaaatcctttcgtgctttcagcaggagttaattatatagaagtatgcccagacctctgtaagcattagaaagaccagcccaaaggggaaactgcttttccagagcctaactgacctgggaaaagggaaatgcccagctcaggctctagaagactgagacatgattgtgggaatatagaactcttcccctcaaccaactcctcaccaccacatcagtggtgctcctgtgtaataaccagggactaagagaactacaagcctcagactctatttaagatggaatctctaggcaaacccaaagacaactgggtataaacagaaggacactagaactaacaccactgagacagccaccagtaagcacaatataacttctagtcagataaactcaaacctcacactaaaagcccaaataacagcttaacaataaagaaatagacatcatccaaactatgctgtcaaaccacaatggaattaaactagaaataaaaaatagaaggatagctttagaaatccccaaatatttggacattaaataacctatttctgggtaacacacacgttaaaggaatcagaaaagaaattacaaaaattaagcttcaatgaaaatgaaatttaaacctatcacagtttgtggaatacagcaaaagttgtgcttaaaggaaaattcatggaatttgatgcatctgttagaaaagattagagacctaaaatagataatctaagcttatatgttactaaactagagggagaggagcaaattaaattgaaagtaagtagaagaaaagaaatgataaaaattagtggagaaatcaataaaattataaaaaggaaaataataaagaaaaatcaatgaaactaaaagctgaaatcaatgaattaaaagatgaaataaataaaattgataaactcctagtgagattatccatgaaaaaaagaaaatacaaattactaatatcaaaaaccaaagatgttatccttactactctcatgaacattaaaatattaataaggaaatattttgagcaactctatgcccacatctttgataacttacttgaaatgggccaattccctgaagacacaatttacccaaacacatacaaggagaaatagacaatccaaataggtatatatcattgaaagaaattgaatcaataactaatgaccataaaagcaaaagcactagacttaggtgatctcactggtgaattctaccatttaagaaagaaatgatatcaatttactgcaatgtcttttagaaaatagatacagaacaattatggttaactgtttttatgaggccagcattatcataatactgaaaccagacaagggcattacaagaaaggaaaactatagcctagtatctcttatgaatatacatgcaaaaattttcaacaaagtatcaaattgagtctaacaatgtacgaaaagaattatatactatgacaaagaaggacttattccagataggcaaggttcgttcaatttttgaaaatcaattaatataatccattacaacaatagaataaaaggaaaagatggtttgatcctattaacagatgcataacaacatttttcacaaaagccaacacttattcatgatactaactctcagcaaactaggaacagaaaggacattcctcaacttgataaagaacactgtaataaaccttcaagtgatatactaaatcatgagaagctagctacctttctcctaagtttgggaacaagatgtcctctctctccattcttacctcaatactctgccagcaagcagtcctacgtaatgcaataagagcagaaaagggagttaaaatcacacagattgtgaaggaataaataaaactgttattgcttatagatgacatgattatatatgtagaaactcccaaagaattgtcaaaaaaatactcctagaactaatagccatttatatcaaggtttcaggatacaacgttaatatagaaaagtcatgtttccctatatatctacaatgaataattggaatttgaaattttaaaaacatatcatttacattaacaatccccaaaatgaaatacttagctataaatctaacaaattatgtgaggaaaactacaaaatcctaatgaaataaatagaaaaagctctaaataaatagatattccatgttttggggtagaaaaacttaacatcaacaagatattggttcttcccaacctgaatgttaggtttaacacaaccccaatcaaaatcccagtgttactttgtggatattaacaaactgattttcaagtttatgtggaaagacaaaagatccatgataggcaacacagtatggaagaacaaagtctgaagactgacattacctgactttaagatttactataaaagcacagtaattcccagagatagccccacatcaatacagtcaactgatatatgacaaaagaacaaaggcaaccatgtgggcaaataatcatctttgcaacaaatggtgccagaacaaatggacatccacatgccagacaatgaatctgggcacttaacttatacctgtgacaaaaattaactccaagtggatctatgacctgattgtaaaatacaaattataaaagttctagaaaataacataggataaaatctaggtgaccttggatgtgacaatgcctttttagagacaatatcaaaagcatgatccataaaagaaaatgttggtaagtttgacttcattaaagtacatttctgctcctgcaaaagacactgttaagacattaaaaagtcaatccatagactgggaaaaaattttgcagacccatgtctcataaaagacttgtatatgaaatacataaagaatccttaaaattaaacaataagaaaacacagagttaaaacatgggtgaaagatatgaacagatgtatcaccaaagaagacagatgcaaataagttcataagatgctcaacatcatatgtcattggaaaattgcaaataaaagcaacaatgcaatgcatctatatagctaatagaatgagtaaaatacaaaacactgacaataccaaatgttgacaacagtgtagagcaataggaactctcatttgctgctgatgggaattcaaaatggtacaaccactttggcagacagtttggcagaatcttataaaactaaatatagtcttcccacctgattcagcaatacatattaataaaaaaacagtttgattatgtatgtagacacaggagtttcacacaaaaaataagactcaaggagctgcccagatgattgaggcttatgtaccatataaggctaaacaaagcaaaagggatttggggattctgggcaggggaggccagctatgggaaggtgaggggaggaaatgtatggtggactagggttgtctcattatgcagataagagtctctccagttcagagttttctgggaaagtagctctctttctggtagggagacatctttacaaatgaaaatttcctttgtaaatgtgaatttccttttcaaaagaagacatttatactgaatttttaggcagttaaggagagataaagagcttttcctttgtcctctggttctcagttgcctttagctcaaaataatccatatgccaaagaggcctattttggggtgacttcttgtattcttcacgtctcatgaaatgaacctattattgtgaaatgaactaattgttttaaataaactgcagtggacttgttattgatgagccacattttaaaaatgggttggtgccagtttgggaaactgctgttctcagcctgtgctgcttctctctgcagagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggtaaatctccctggggtcttctagataaagggacccattgaggaatgcttggtgaccacctctggctccaaggcagctctctcaccctatgaggagaaggaactgtagtatcagataaacttacctgcaagagattttctaatatgattatactgaagaaaacattaaatatatttcccttattttacattatatatttaaaaggtatctgtgtgaggcagtcatgtggtcggagttaaagcataaatacatcatttataactttgtatcccccttgctcttttcttcctctctaaatgccttttacatttattgaactacaaacttgtattcaggaagaaatatcacaaactctgtattttcagggcttgtgaaagtgtgggcacaaattatgtgtggaatctgggggactgctggaaggaatgacttcctgatgagtgggcggacagattcctcctgccaggggattccttctgccaggggattcctttctgggtggtcttaggggaatgaaggagtggcagaaactgagacccccacctccatcactgcctgtgacaggagagaggcaggtggagcagtgagagagcaaaagacagctgccacttcttctgtgtgagtagaggtcagcgaagcagagcggacagccttgattgacagctcaggatgttgtaccgtgagccaccaaaattgcagttacttaagcacatttttaccttttctgcacctcattatagaaagtctggggtgcgtgctcctcagatttctggattctgaactagaagcagaaataagtggcttatattatgcgtttgcaattagattctgcgggagagggaaaattctaggactcacaggagacaaaactaatagccttcgccttcactggtccatgaacgttcattctctgttctgtttttataatgcttcagcatttgtttcttatttatgctttctaactttaagtgaaactaaacagaatgtctgcacctcattgtaaggactctggccccttttcccatctcccgtcttaataaagcaaagataactgaccaccccacagagacctgctggttgtagttaaacagttattggcatccgtggctaattgttggatcaatttttaatcggtgtttatctctgtcagctcctctttgttagtttttgatgaaagaggcgggtgcttggcaaaggctttaagctggcacttttgtttttcgagggaaacatgcttatgaaaaagctctcgttaatgtaggtcggtgctttctgtcattcagggcaattgtgtcttgatattcatctgtcttacaactttgtttttctgaattgttctaccaataaaagttatttaaatggtaaccaattaggaactgccttcatttcctttataaaactgtaactgattttgcagacagtattgctacttgctcttgtttctaagatgtctgcacacttttgcatctgtttccaaaggagttagctccttttctggaaacaaattttcttttctatatattttgggaatatttaagttatagaacaggcatatccattttgaggtgcttatcacaagatgtccagaaagaattattataaaataatggaaaataaagttttatctttcagtatttattccacatcaggtactgttctaagtattttacagcaaccatatgaagtagatgcttattcccattttacaaactgagaaattagacacagtttaattgagacacagagacacaggaaaactgagacaccagagaaattaggccacttgcccatgttcacatggctagtatttggcaaggttttactttgaaaccatataaaccagctccagggtacaagttcttgactaagacattactctgacacttagtttattcaggctgttagttgtataagatggaatttctggtggtattaacagttcagtcttatttttataaccctgggatggccaaagaagtggaaactgtgtggggttagtgcatgacttctctaacatggggctcctcctgctgcctggctttccattggtctggagttggactcaacatgtgtgcctcacctccaggctttcagaactcatagatatgggggtaatctttagacacatctgctgctcaccttagttgttttcttcaggctgccatctattttcattgtaacatggagagccaccattgtaagctctatgattctagtgcaagaccctctgtgcttgcggggaggctcctttgttcagccttacagtcccctctcctccctcccggggaccctcagagcccatgccatggctgagccagtccacctgtgctccacttgctggtcatttctaagtatggtcaaattgctcacttcctcaacctttcaaaagtttgatgaggtaagaataagatgccacttcataaagcttgaacttaggtttgacaagttaacaatgatttccaaatttcccatgatttacactgcacaaaactgtgcagtgtacatatttgagcctcaatttaattaaccttgtaaagcatgttatattaagttatatcacttggttattaccaaatgatgcaagagatgagggctacatagtctgggatgctagagaaaatgtgtcagagttcatcatgctaggtagtttcaatgttagtgtcataccataacaaacaaccagtacttctaaatgggaagagatttggcaaattctgtgttttagttttccctggtatagaagaggtatggcccctcatcatcttagttttgttaatacctgcacattcctaccagggactgtccctactgtgtcttgcttccccttatcttctgtaaagacatgacttttatatttaagttttcttccattcacacagtcagtttagctagaaggagctagaatttataagatagtaggaatggggacaggaggtcatcttcagaggaagggccaggataaacatttccatctgaaatccttggttccctttccctactttacgactcattttggtctttaatctcacagaaatgttgacctggccattatgtgtgctagtggaaacactttggctttggagtctgatagatgtatgtgtgaatctcagggcaatttattttggctccagtgatgtttatggaagtcctactatgtgccaaacatgaataaacactggggatttccatcccagtgcatatcccattgagattcatcccaaaaccaatgcatccgcaaacgaaagcatcccaaaacaaatgcatcccagtaacttgcctgaagtatggtacaatttctagagcttcatgagagaaaaataccaaacctcagagagagattctgtgaacttttgacattttgggattttaggcagtattttgccaactgagattgctaaggcattgcttttgccattactttgacagtattgctgagtgcagaaaagactacagcaaaatacttcttattaggctattttcagttattttctgacaacatgacattcagaaaacattggatcaaactaatacatttgttcctgtatactctggaatctttcctatggttaaccaatccagaatttgcaggctgcaatatttaaccttttgtgaaattgggaaaacatgacatatgtttcctaacttcataaaaatatgcaataataatttggcaagtttattcaaaatgtaacttgcattctcaggtgcatttctccagaaccaggtacatatattattatttttatttcatttgtcagtttatcagttttcttttatgtatggctaatctttgaataacatggatgagagtaactaaacatttctttctaatacatgcacacatacacacattttcattctctttttcttgtaatatttatagatctaaaaataaccaaaacaatcattatcacaatttgtcatttttgccagcctcaccactgttagtacagcaggtccccaaataacattgtttagttcaacattgtttcattacaatgatgagaaaagtaaaattgattttctgccaggaccactgtcggagaggagtttgcacgctctctccatggctgcatacattttctccaggtacacttgttttctgtcatgtcccaaagctgtgtacattagtttctttggtgtgtctatattgagcccatgtgggtgagtatatgtgggcgtgtgagtgtaccctcgatggaatggcatgctgtccagggctggttcctgccttgtgcactgagcttccaggatgggctctgaccaccctcaaccctgaactggaataattgggtaaatcatgtttttgttaatctttcacaaatatatgtgtagctcacatttatttcagtgtttgctattagaagtttttttttatttagaagtttggagatgtttttgtgaccagacatatgacataggaacttttatttctaccaatcagcttatggtaaaattggtttcattaaatgttgattcggttaaagcggtctccaagaacatatagatgacattaagtaaggacttttttccgacagataaagctttctaacagggtctatcatgctcttagttttcttctcttttatggggacatctgcctccttttccaggaagcctccctggtttccttccttcatctctcatatgagtgtttatctagcactgatttacacttcttggccattcttctgtgagaaaaatttggacgaagctacatgactacttctgctatctctttaattcctgaaatgccaggcatttatatttcttcatttataagacccttcctttaatatttgtgtttgtttgcttgtgatgaataaaacgttttgttttgatattttaaaattcacttaagtgaatttttattcaacttgtgataattaaaatagttgttctgaatggagccaggaaaaaggatgattcatataaaacattctggggaaaatgactttactttcaataagaccaactactggccttgagaagattttcttaggcagatagcaggagattaaatatttcatctttatatatcttttaggccttgaaatctgcatttcctagaattatactattttaccataagaccagtccttgagcctcttcattcatttgcaacatattttgaagttgcacaagtaaagccatataataatttctgttgaaagattttactggggggcataatgattatcctaatatttgtagaggttcttaatgcttcattatcattattgttattatcctaacttttatgtacttgtcaaaaagagtatacacattagtttatatttattcagttatttgggatgcacaattattaaccaatctttttagtcctatagaatttttccctcttctcctaaatttgaattaaaatatgatcttggtcaatttggctatatgattatatctaaaaaatgaatctatattaatacttctatggtcataagagttaaataaaattgtttggaaaatttttaaattatgctaagttggaaacaaaaaaattgcttaccttggaccccaggaagaattaatccagcataggagatagaactggaaacagaaaatatagtgtggtacaaattacagtgggaaatgctaaataaaagtgttctatagacacatataatacacagaagaggtgacacatatatcacacagaagaagtgacaattattttttctgatgagagatatgggctgggccttctaggatgtgggacaagctggcagggtggaaggcagggaagaagaaagaagctgtgaaccgcaggctcttgggtacagtctgaactctcctgtggctggaggggtgaggtttgacaaatgctgccaccatccttgggtcttggcaaagtggttttcagcagttgcaaataagaaatatttcccattctcctccccatctctagttactttataaaccaaactctgagtttgcaaacattaacagtggcttctcaatgtcaaagggatatttctttccttgtgttaatattgaaaattccctccagccataaaaatgaacaaaatcacatcctttgcagcagcatggatgcagctggaggcatcatcctaagcaaattaacacaggaacacaaaaccaaataccgtgtgttctcgtttataggggggagcttaacattgggtacacatgggcacaaacatggcagcagtagacacgtgggaatccaaaagtgcggagggagggcgtgtgacaaggggtgaagaactacctgttgggttccatgctcactacttgggtgggatcattagaagcccaaacctcagtgtcacacaatatacccatgtagcaaacctgcacatagactccctgaatctaaaataataaagaaaattttctgcttcggttgtcttctccctttaagttttgacaccgctattagtttcattcccatttgtttccttctcagttttctttttggcatacccttctctgctcacctcaacatgcttatttatctggacccccaaccttgagtgtgtttcttgcccacccttctccctgaactctagatgtgattattctgaccatcacttagatgtctccagctgcagaaaactcccacctgttcactctcaattactgcctgtatggtaaagggggatgtttcaggagatgtacttgattgtatgtgtgaaggtcggcagggttagtgggaggtagaagcaggaatgaggactgagaccagctgtctggtgggcactttggtgaatgctggtgtgcacatggacatgcctctcttccaggttgctggagacctcatcaggcgcttacacctcgaagcccacgcggacaaacctgtggccacctacagtgggggaaccaagcggaaactctctacagccctggccctggtggggaaacctgacattcttttattggtgagtagaagaatgtcaatatcttggagtaagatacatattgcatattgatttataaactgattttaagggtttttctgggaagtaacttcagaacttgcaaagctggttctacaaactagtaaactgttttgccataagccagcatttcccaaatgtcatttgtattttacagaaataaaacatttattttttgctagattcacttatatttgtcaagctgaaaattctataaaattttaacattaaaacagtgttttaaaagattattagaattcatctgtaatctgaaaaccaattatgttttcctctagaatattgcttttatgtctttttctgtgtgtagatgtatgtttatcacagcagtagtgacacctgtcatggtgaatcttaaagatgggtgttgagagtgaaggatggatatgatgttgagagtagggaagaaaactccagcaagagggtagagtatatgcaatggtcttgagacagggtggtctataatcaatctgggaactgcagttaatttgatttgaatgaatcaaagcattaattggaggcaacaattgtcaagaaatggagttaattatcttgcatttcataaaacagctataactgttaatacaagtaatgccattgaaagaataaataaaggctattgttacatgccataaattggattctaatcagtagagtgcatctttggacttcacaccagtagagagtctgaggggtgtcaaaaagtgtggaaaacaaaacagattcctttttttctatctttcttcatcaaatgaatacacccttttagtggggtagtaaatggggattgagaaggtctgtgtgggaaaatggtctcatcgtttgctggttgtctcctggaaactcacctgaatattctttttaggtaccataaatttgcttttgcaatgtccaaattcctagactattgtatagtttcatattccagaatctgataataaaaactaccatttgcacaatcctgaagtttacaaattacattttattttcaacatgaggcaggattatgttgagtagttaacaagacgtgggcattcattactttctgtggaatttccctttgcccagcctcttacaatgcatctccttagttgaatgaaggggcctctgctctgtagccatgacctgctcactgcagaccctgacatgcttttctttgatacatccttgctctcagctttccttggatgcccaaacctgtgacagagtggtcaaggtggggactctggagtctgactgacaagctttgaattttgcttctgcagctgcccaacacttggccttgtatgttctatgcctgtttccttctcatctgaaaattttcctgataatagtgtctgtctcatggagtcattgaaagcagtaaataaaataaactacattaagcatatagcccagtgtctagcagatggtaaaccacagtaaatattcgtgactatgatgatggttactgttcagagcaataggttaaagagatttgttgccaggcctttggagttctcaacagagagactagaagtgattctcagagctgacatcaaggagggaatcaggaaaacgtaaattacacatacaactctcataatgagcattgcatgatcacaccttttatttacttatttttataactaatacacatatattgcttgatttgcagaaaagactagatatttattttcctgttcagtgcttctccccctacacttactgcttcccatctgtttctttctttatggaagtttatgaacctaagctcttaagaaatatgtgtttagtactccctggctaataaaagcacagaaatacatcttacagtttggcgagatttctctagaagtggttcatataaggaatactttggtgtctattgaaggagaaagcttcaagttctaagaaatattaatttatttgatgttgctaaataaatgaagcctttttctgctatcatatgtcttcctaggggatatcattccgaaattttatggaggttgaaaattcattttagaaacatcagggttggcttacctagccagatcatggaggagaaccaacctgacatgaaaatatagcccaattcccctcctctcagttttatggaagtataattaactgataaaaatggtatctatttaatgaattcaacatgtgttttgatatacataaatattctgatgtgttgactacaatcaaactaataaacatattgatgacatcacataattgccattttttcccctgtatgtgatgagaacacttaatatctaccctcttagcaaatttcaaatatgtaatacagcatcgttatctacagtccctctcttagttcactgtgctgctataacagactggataatttataaagaacagagaacagaaattcaggttttggagtctgggaagtccaagatcaaggcactgccaggtccaggtgtctgctgagggtgccaaccctgcttcctgaaacctgtgccctccagaggggaggaataggtgtcatcacaaggcaaaagtcagaagggcaaaaagaggtgaatgtccttcatcaggtccttttataaggtcacttaatcttataaactcattcacctcccaaaggtcacacctctcaatactgtttcattagggattgagttttaacatgaattctgtaggggacaaaacatccaaactatagcagccctatatcctgtatattaggtctccagaacttgtttgtcctgtataactgaaattttctgccctttgacaagtatctccccatttccacagcctggcacctttctactctctcttcctatgtgttcaactttttaatatttcactaagaagtagtgtttttccatgcatggcttatttcactttatgcttggcataaagtcctccagattcacttatgttgttgaaaatggaaggatttccttatttttcaggcagaataatatttcattacacacacacacacacacacagtgagagagaggagagagagagagacaaggaaacagggagagagagagaaagagagagagagagacatacacattttcttttcccatttatacacttagggatgcttaggttgtttctatatcttggcttctgtaaataatgttgtcatgaatatagcactgcaaatatcccttccagatattgattttatttcctttggatacacacacagaagtgagattactggatcagtggcagtagtatttttaatttgtagaggaacctccacactgttttccataatatgtgtacatttacatttccaccaattgtgtataagggttcacttttctccgaatccttgccattgctggttatcttctgtccttttaacaatagccattctaacaagtataagatgatatctcattgtggttttcatttgcatttccctgattattaataatgtcgaacatcttttcatatacctattggccatttgcatgtcttcttttgagaaaagtctgttcaagttttttgtctatttttaattattattatttgctatttagttttacgactttcatatataggatgtaaccccttattggatatatggttgcaaatattttatcccccgctgtagtttgtctgctttgttgatattttcctttcttgtgcagaaactcttttcgtttgaaatagtcccactttatgtttgcttctattttatgtgcttttggtgtcatatccaaaaaagaaacaagcaaaacattgccaagaccaatgtcaaggagctcttctttttttttttctacaagtttcatggtttctcatcttatgtttaaatctttaatacatgttcagttgatttttgtgtatggtgtaagataaggaccgagttttaattttttgtatgtagatattcagttttcccaaagccatatattgaagagactgtccttttcccagttttaatttcagtgtatttgtcaaagattaattgactatatgtgtgtgggtttatttctgtactgtctattcttttctatgaatctatacatctgtttttatacaagtaccatactttttaaattataatagcatagtagtatattttgaaaataggaaatgtgaggcctccagcaccattcttcttgcttactttctttagctatttgtggtcttttgggttttttaaatataaatttcagtattttggttttctatttcagtgaaaaaatgacaatggaattgtaggaatagcactgagtctgtagatcgctttgggtaatatggacatttaaaaatattaattctttcaatccatgtacatggatagctctccatttatttgtcttcaatttctttaatcaaaatgttatagttttcagtatacagatctttcacttcctttgttaaaattatgcctaagtattttattcattttgatcttattgtaaatgaaattgtctaaaatttccttttctgataacccattgttattttatggaagcactattgatatttgtatgttgattttgtatcatatgactttattgcatttgtttattaattctaatggattctttggtggagtctatagtgttttctgtatgttagatcatgcttttgaaaagatgattttacttcttttttgatttggatgccttttctttgtcttgactaattgctctggttaggacttctagtattatgttgaatagaagtggctagagtgggcatccttgtcttgttcttcttagatttgaagtttttagcttttcactgttgaatatgatgttagttgtgggcttatgatatatggccttttattcttttctatttctgctaactttgggattagttcatttctttatccagtttcttcaattgcaaaggtaagatatttatttgaaatctttctttttttcttaatgttgatgacttcttcctcaaatctgcttttacttcatcccataagttttgttttgtttccattttcatttgtctcaagatacatgtattttttaaaattttctttttaatttcatttttgacccattggttgttcaggaacatattgttaatttacacatatttgtgaattttacagttttcctccttattaatttctagtatcataccatggtggtctgaaatgatactggatatgatttcaatttttttaaaattgtttagacttgttttgtggcctaatatatggtctctcctggagagtattttatgtgttctggagaagaatgtgtattctgctattgttggatggaatgttctgtgtatggctgttaggtccatttggtctaaagggtagttcaagtacattgtttccttattgattttctgactggttattcaatgtatcattgaaagtggagccttgaactcccctattattattgtacttatgtcttttactcctttcagttttgttaatatttgcattacatatatagtactctaatgtttagtgcatatctatttacaattactcttttatcattttatataaattgaccattttatcattgtatttttctctttttacagtttttgacttaaagcatattttgtgtgacataaatatagataaacatgccctctgggtcatcatttgcttggagtatctttacctattgtttcacactcagtctatgtgtatccaaaaaaactgtactaagtctcttgcaaacagcataagattggatcttggtttttatccattcattcactttatgccttttgattggcaaatgctgtctatttacatttaatgtaattattaataggtaggatcatattcttgacattttgttaattgttttctggctatttttaaagttatttattcttttttttcctctattactgcttttcttttaatttgataatttttttttgtgttggtatgttggtatgctttgattcatttctgtttttttttcttttgtgtgtgtgtgtgtgtgtatgtgtgtgtgtgtgcatcttctataggttttttatttgtggttaccaagaatctatataaaacatcttatagttacaaaagtctatttttaacctgatagtaactgaacttatatcacattaaaaaaaaactacacttttgcttccaaccatctcattttatgttttagatgtcacaatttgcagctctttatattgtatttccattaaaaaattattatagctatagttatttttaatactttgtgttttaatctgaatattaccattataagtgatttatacaccaacattaaagcattaaagtatgctgaatgtggctgtatacttaactttactgtgagttttataatttcatgttgctaattagaatccttttattttgttttgaagaacccctttagcattttttttttataagacaggtattgtgtcaatgaactctttcagcttttgtttgggagcatttttttttttataagacaggtattgtgtcaatgaactctttcagcttttgtttgggaaattctttatctcttttttatctctgaagggcagctttgctgggtaaagtaggtaaagtatttttatttggcaggttttttttctttcataggcccactctttcccagtcctgaagatttcttctgaaaaatccactgatagccttgtggatgtatgtcatgagccttttttttcctcttgttgctgtgaaaattctgtttttcatttttgacagtttgattattgcgtatctcagtgaataatttgttgggttgaagctatttgggaacttttaagcttcatatatcttgatgttcaaatgtctatctctttatccaaatttgggaatgtttcagccattatttatttaataagcattctgctgcccctttttctcaccttttttattttgtaaatctcatattgtaaaagttaggtctctggataatgtgccataaaccctgtcaggctttctttgttcttcttaattcttttttacttttttaaaattttccttgactggataatttcaaataatctgccctcaagttcacagattttttttatctgcttgatcaaatgtgcttttctctattatattttttatttcattttatttttctgcgccagtatttctatttggttctttttttttataattttgatctgttttttgaatttctctggatgaggtgagaaagaagtggggctcctgggtagcatgctgcatggctggaggagtcaggccctcactcattgctctctcacattcccctatcattctggctttgttgagcagagtgcaacaaagccaattggagaggtgtcttttagagccagagcagagatttttctttcacctggggtctggcctcccatgtcattgtgtatatttctatttgtgtttttcaaatgctgattactctgtgttgcctttccttcaggatgagcccagctctgggatggatccctgctctaagcggtacctgtggcaaacaataatgaaggaggttcgggaaggctgtgctgcggtgctgacctcccacaggtgagttccagtttctcttgtagccatttcctgataagactgagtaacaaaggttaagaagtgcatttaggtacctgcacagtgttacacatggacatttcttaatctttacaacacaataatggtgatattattgttagccctcattgtataaattgagactgaagccatgagggattacgttatataaccaagtttacatagcaaataggtggcagagctagaatttgaacctagtgttctgtgtccaaagatgatattcttgcctcatccattgctactgttcaaggatgagtgctagactaccattttcaggtcttcctgagggatctttcagatcctttccatccaaggcctattatttcagcaggtagaattagctgaactaaaatacttaacaggttactgaatctggtttaacattttctttatcacagaattaagtttgtaattagatttcaaaaccattggcttctttttaactttctaatacactgttctagcccacaaagaattacaaatatagatttcataaaacctacttatggggagtgagcaatatgatttaactaatacaaattctaatgatgtaataaagaccaggctttaatgtttagacttgttttgtctttatgtttaagtaaaatatactgtgaataagatgtcaagagctgccaaagatctcacattttgcccttttgcaagctaacaaatttagcttgatacagttttatggatgttgacagaagaaatgagacttctgggtcggagatgaaagactttattgctcacagcaagaacagtagccagagtgtcagcatggtttctcattggttccctaaaccccagtttctattggactaatggatgcctgcacacagaggagaggaatgccaaatctggtgaaattactaccttataacatctgataaggaagccagcccttcgtttgggaggaggtgtcgcttcttccatggttgtttgctactagcataactttgagaaatggcccagttaaagagcagttagggccttatattcttggaattcatggcaagacacgtaggaacacaagggacccatggaaacatgcttcccaacagtctaaatcattcagtctatgcttgagtaccccagctcttgttaccaggagtgaaatataaagctagccctatcatttgaaacgtgagatttctgagaggacctcaggagactttactgattactgcagcattattagtttacgtaaaaatactattaaatgctataactcagcatgcataatcctattacacataaatcttacagccatttcctgtaacaagtgttactggctgcaaagccaatgtattgtgaagaactcagccattcacacatttctcacattgcttcatgtcaaagtagacttttcttaattttctatctctgggctctttcttttttaaaaaaattcattcactgataggtttgtctatactgcttaacattccccaattttcactgccagactaaactttacactgttgtttttttaaatgccattttctgaagtataatttacatttgatataacttaaccactgtaagtatggaattctatgattctttagtaaatttatagacttgtgcaaatattaccataaataagccttagaatatttgggtcacctcccccaaattttctcatgcttactttcagttaaattagcatttgaggctaggtgccgtggctcatgcctgtaatcccagcacgttgggaggccaaggcgggcggatcacgaggtcaggagatcaagaccatggagaaaccacatctctactaaaaatacaaaaaattagccaggcgtggtggcgggcgcctgtagtcccagctactcaagaggctgaggcaggagaatgtcatgagaccgggaggtggagcttgcagtgagccaagatcgggccactgcactccagcctgggcgtcagagcaagactccgtctcaaaaacaacaaccacaacaaaaaaattagcattcaaaacctccacctaggaaaacattgatggctttctgcctctgtaaatttgctttatatggatatttcattaactgaatcatataatcagtagtctgctgcatctcttttttttatttatcataacactttttttttttgagacagagtcttgctcagtcacccaggctggagtgcagtggcacgatcttggctcactgcaagctccgcctcctgggttcacgccattctcctgcctcagcctcccgggtagctgggactacaggcacctgccaccaagcctggctaattttttgtattttagtagagacggggtttcaccgtgttagccaggatggtctcgatctcctgaccttgtgatccgcccgcctgggcctcccaaagtgctgggattacaggcgtgagccaccatgcccggcctatggcaacacttttaaaggctatccattgcgttttatgtcaataggttgctccttttcattccaaacggtatcccattttatagctataccacttttatttatccattcaccagttgataagcatttgggttgtttccagtgttttgctattatgaataatatgttatgaacagtcatataaatgtctttgtatgtatagacatgttttaatttttttagatttttctgagtcaagttgctagattgaatagtaagttgtatttgagactttaagaaactgcagagttatttcccaaattggccttatcagtatatgttcccagcaacaatgatgagtctcctttattccacatccttgtcactactgtctgtcttttttcattataggcatcctagtgaagtggggttttaattcacattttcctaaggactaacgctgttagaatcttttcatgtgcctattggttatttgtattacttctttagtgaaatttttattccaatatctcctccatcctccattttttaaaaatggcttgatactttagaatagttttaggttcactgaaaaattgagaggaaggtacagaaattttttaaatccctccttgccttcacacatgcatatccttccctattatcagcatacattaccagagtgatacatttattaaaattgatgagcctacattgacagcacattaccaccccaatccaatttacatagggttctctcttgatgttggacattttatgggtttggacaaatatctaataagaatccaccattatagtatcagatagaattgtttctctgccctaaaaattttctgtgttccacctattcatctctccctcctgcctaacccctggtaaccactcatctttttactgtctccatagttttaccttttccacaatgccatatagttggaatcatatagtatgtagtcttttcaggttgacttttttcatttagtttctcccatgtcttctcatggcttgatagctcatttcatttcagtcctgagtcatattccactatctggatgtactacagcttatttatccactcatccgctgaaccacatcttggttgcttccaagttttgacaattttgaataaagctgcttaaggatccgtgtgcagttttttgtgtgaacatattttcaactcctttgggtaaataccaaggaatgtgattgctggatcggatggtaagagtatgttaatttttgtaaggatcctttatatttgaattgttttttatctattatttttgaattgtaatagttctttttatgtagcagatattcctatattctgaatagaagtcccttgctggataaatgatttgcaaatatgtatttccagtctatggctgtctttccattttattaataatgtctttcgaagtgcaaacattttaaattttgattacattcagtttatcaatttatttttatatggtttgtgcttttggtgtctcatctaagaactatttgttcaaatgaagtcctaaagattttcttctatcttttttttctaaaaattttagaattttggctcttatatttaagtctttgatctatttcaagctaagttttgtgtatagtatgagaaaaggatataaattcacttttatgcatgttaatatccaattatttcagcactcttccttgaaaagattatcttttatcccactgaattgtcatagcacctttattatattatttattgtatgatttatttttggactctcaattattatccattgatatgtatgcttattttctcacccaataatatcatgttgattatggttgttttctattaagttttgaaaacagtaagtgttattccttcagctttttccttctattataaaatttttcattatcttgaaatatttttcaatttctcttgtgattacttctttgacccttagtttatttagaagtgtcattcaattttcagatactgggagatttttaagagatttttttttctgttattcatctctgatttaatttggttgtcattagataaaataagttgtatgatttccatcattttaaatttgttatgactttttaatggcctaccagaggggttacagttttttttttataaaacaccatattttaattgttttttatctattatttttgaattgtaatagttctttttatgtagcagatattcctatattctgaatagaagtcccttgctggataaatgatttgcaaatatgtatttccagtctatggctgtctttccattttattaataatgtctttggaagtgcaaatattttaaattttgattacattcagtttatcaatttagaactagaaataccatttgaccaagcaatcccattactgagtatttggttttgcaagtcgtatggtgtgtactgcagtatccaactccactgtgtagtgtgaaagcttccaccagtattaggtaaatgcataattgtggttgtattccaataaaattttatttgttcctctcccccatcccccacaaaatggtggcaggctggatttagccaatgggctgcagttttttactccaggcttaacatatggtctatcctagagaattgtctatgcaaaggaatatgtattctgtagtagttggatggaatattgtatatacagcaagtcagcaagttagcttgacagtgttgtttaagtattctgtattcttgggaattttttcctgggtattctatcaattactgaaaataagatattgaaatattcaagtataattgttacatttttcttttccttctttagattctgtcagtttttgcttcatatatttggagtctgtgtagttaggtgaatatgcattcttaattgctatcatactaatattttgactttcttatcattatgaaatgtctctgttttactctagcagtatgttttatcttaaatcctattttgtttcttaaaatagccattgcctctgtcttttggataatgtttgtgtggtatatcttttcatattcttttactttcaaataatttgtgtctttgaataggagtgtttcctatagattgtgtatagttggatattgtttttttttttcccaatctgacaatgtctgccttttgtgggaggtatttaaactgtcccacatttaatgtaattattgatatggctgaagtaacattgactgttttgctattttttacataatgtctcctgtgtttcttgtatctgtttctacttggcagccttatatattaaatgaataatttgaagtatactgtatttaatgttttatctattttttttagttatgttcttactggctagtctaaggatgatagtatacgtcttgatgctaacttaattctagaaaagtgttgtaatcttgccctaatatggctctatttcctccctttttctttgtgctattattaccatatatattgcattttatatgctataaatccaataaggcatattttaagtttcactttatacacttttaaatcttttaaagaagataagaaaatatatcaaaaagacatatccacagtcttaaatagtaatccatacaattgtcatttctgacgcatatctgtccatatgaaaaatgtgagaaaattttggccattatttactcaaatactttttctggtcctatctatctttccttttcttttggtcttccattacgtgtatgttgaaactctgatcttatcgcacaagtctgagttcttgctcattttttttagtcttgtttttttctatttttggattggataatctttattgatctatgtgttcactgactcctctgccattttgaatctggtgttgacccctctagtgaatttttccttaatttcttgtaatctttaactgatttattttttttataatttttatccccttcttcagaatccccacttactaatgtggttgtcagacttttctttaattctttttattttttattattatacttaaagttatggggtatgtgtgcagaacgtgcaggtttgttacataggtatacatgtgccatggtggtttgcagcacccatcaacctgtcatctacattaggtatttctcctaatgctatccgtcacccagcctcccacccccgcaacaggccccggtgtgtgatgctctctgtgtccatgtgtcctcattgttcaactcccacttatgagtgagaacatgtggtgtttggttttctgatttgtgttactttgctgagaatgatgatttccagcttcatccatgtccctgcaagggacatgaactaattcttttttatggctgcataatattccatgatgtatatgtaccacattttctttatccagtctatcattgatgggcatttgggttggttccaagtctttgcttttgtgaacagttcctcagtaaacatatgtgtgcatgtgtcatcatagtagaataatctgtaatcctttgggtatatacccagtaatgggattgctgggtcaaatggtatttctagttctagatccttgaggaattgccacactgtcttccacaattggtgaactaatttacactcccacccacagtgcaaaagtgttcctatttctccacatcctctccagcatctgttgttttctgactttttaatgatcaccattctaactggcctgagatggtatctcattgtggatttgatttgcatttctctaatgaccagtgatgatgagctttttttcatatgtttgttggctgcataaatgttttcttttgagaagtgtctgttcatatcctttgcccactttttgatggggttgtttctttttttcttgtaaatttgtttaagttctttgtagattctggatattagccctttgtcagatagaaagattgcaaaaattttctcccattctgtaggttgcctgttcactctgatggtagtttcgtttgctgtgcagaagctctttagtttaattagataccatttgtcaattttggattttgttgccattgcttttggtgttttagtcatgaagtctttgcccatgcctatgtcgtgaatggtattgcctaggttttcttctagggtttttatggttttaggtcttacatttaagtctttaatccatcttgagttaattttcctataaggtgtaaggaagtgatccagtttcagctttctgcatatagctacccagttttcccgacaccatttattaaatagggaattctttccccattgcttgtttttgccagttttgtcaaagatcagatggttgtagatgtgtggtgttatttctgaggcctctgttctgttcccttggtctatatatctgtattggtaccagtaccatgctgtttctgttaccatagctttgtagtatagtttgaagtcaggtagcgtgatgcccccagctttgttctttttgcttaggattgtcttggttacgcgggctcttttttggttccatatgaaatttaaagtggttttttttttccaattctgtgaagaaagtcagtggtagcttgatggggatagcattgaatctataaattattttggacagtatggccattttcatgatattgattcttcctatccatgagcatggaatgtttttttcacttgattgtgtcctcttttatttccttgagcagtggtttgtagttgtccttgaagaggtacttcacattccttgtaagttgtattcctatgaattttattctctttgtagcaattgtgaatgggagttcattcatgatttgactctctgtttgtctgttattggtatataggaatgtttgtaatttttgcgcattgattttgtatcctgagactttgcttgagttgcctctcagctttaggagatttagggttgagatgatggggtttgctaaatatatagtcatgtcaactgcaagcagaggcaatttgacttcctcttttcctaactgaatatgctttatttctttctcttgcctgatagccctggccagaactttcaacactatgttgaatagtagtggtgagagagggcatcctcatcttgtgctggttttcaaagagaatgcttctaggttttgcgcattcaatatgatagtgcctgtgggtttttcataaataatcttattattttgcagtatgttccatcaatacctagtttattgagagtttttagcatgaagggctgttgaattttgtcgaaggctttttctgcatctattgagataatcatgtggttttcgtcgttgattctgtttatgtgatggattatgtttattgatttgcatattttgaaccagccttgcatcccagggatgaagctgacttgattgtggtggataagctttttgatgtgctgctggattcagtttgtcagtattttattgaggattttcgcatcaatgtttatcagggatattggcctaaaattttctttttttgttctttttctgccaggttttggtatcaggatgatgctggcctcataaaatgagttacagaggattccctctttttctattgattggaatagtttcagaaggaatggtaccagctcctctttgtacctctagtagaatttggctgtgaattcgtctggtcctggactttttttggttggtaggctattaattactgcctcaatttcagaatttgttattggtctattcagggatttgacttctttctggtttagtctttggagggtgtatattatttcagtaatttatccatttctcctagattttctagtttagttgcatagaggtgtttatagtattctctgatggtagtttgtatttctgtgggatcagtggtggtatcccctttatcattttttattgcatctatttgattcttctctcttttcttctttattaatctggctagtagtctgtctattttgttgatcttttcaaaaagcagctcctggattcattgattttttgaaggatttgttgtgtctctatctccttcagttctgctgtgatcttagttatttattgtcttctgctcgcttttgaatttgtttgctcttgcttctctagttctttcaattgtgatgttagggtgtcaattttagatctttccagctttctcttgtgggcatttagtgctataaatttccctctacacacggctttaaatgtgtcccagagattctggtacactgtgcctttgttctcactggtttcaaagaacatctttatttctgccttcattttgttatttacccagtaatcattcaggagcaggttgttcagtttccatgtagttgtgcggttttgagtgagtttcttaatcctgagttctaatttgattgcactgtggtctgagagactgttatgatttccgttcttttgcagttgctgaggagtgttttacttccaattatgtggtcaattttagaataagcatgatgtggtactgagaagaatgtatattctgttgatttggggtggagagttctgtagatgtctgttaggtctgcttggtccagagctgagttcaagtcctggatatccttgttaattttctgtctcagtgatctgtctaatattgacagtagggtgttaaagtctactactattattgtgtgggagtataaatctctttgtaggtctctaagaatttgctttatgaatctgggtgctcctgtgttgggtgaataaatatttaggatagttagctcttcttgttgcattgatccctttaccattatgtaatggccttctttgtctcttttgatctttgttggtttaaagtctgttttatcagagactaggattgcaatctctgctttcttttgctttccatttgcttggtaaatattcctccatccctttattttgagcctattttgtgtctttgtacatgagatgggtctcctgaataaagcacacccatgggtcttgactctttatctaatttgccagtctgtgtcttttaattggggcacgtagcccatttacatttaaggttaatattgttatgtgtgaatttgatcctatcattatgatgctagctggttattttgcctgttagttgatgcagtttcttcatagcatcgatggtctttacaatttggtatgtttttgcagtggctgataccagttgttcctttacatgttcagtgcttccttcaggagctcttgtaaggcagccctggtggtgacaaaatctctcagcatttgcttgtctgtaaaggatttgcttgtctgtaaaggctggatatgaaattctaggttgaaaattctgtacattaagaatgctgaatattgtcccccattctcctctggcttgtagggtttctgcagagagatccactgttagtctgatgggcttccctttttgggtaacccgacttttctctctggctgcccttaacattttttccttcatttccaccttggtgaatctgatgattatgtgtcttggggttgctcttctcaaggaatatctttgtggtgttctctgtatttcctgtattggaatgttgaccttccttcctaggtttgtgaagttctcctggataatatcctgaagagtgttttccaacttggttccattctccccatcactttcaggtacaccaatcaaatgtagatttggtcttttcacatagtcccatatttcttggatgctttcttcatttcttttcactctttttctctaatcatgtcttcttgctttatttcattgaattgatcttcagtctctgatatcctttcttccacttgatcaattcagctagtgatacttgtgcatgcttcacgaagttctcttgctgtgtttttcagctccatcaggtcatttatattcttctctacactgattattttagttagcagttcatctaaccttttttcaaggttcttagcttccttgcattgggttagaacttgctcctttagctcggaggagtttgtgattacccaccttctgaagcctacttctgtccgttcgtcaaacttattctccatccagttttgttcccttgatggcgaggagttgtgatcctttggaggagaagaggtgttctggtttttggaattttcaagcctttttgctctggtttcaccccatcttcatggatttatctacctttggtctttgatgttggtggccttcagatgtggtctctgagtgggcgtcctttttgttgatgttgatactattcctttctgtttgttagtttttcttctaacagtcaggcccctctgctgcaggtctgctggagtttgctggagatccgctccagaccctgtttgggtgtcagtggtggaggctgcagaacagcaaagattgctgcctgttctttcctctggaagcttcatcccagagggtcacctaccaaataccagccagagctttcctgtattaggtgtctgtcagcccctaccgggagctatctcccagtcaggatacacaggggtcagagacccacttgaggaggcagtctgtcccttatcggagctcgaacactgtgctgggagaaccactgctgtcttcagagctgtcagacagggacgtttaagtctgctgaagctgcacccccaaccaccccttcccccaggtgctctgtctcagggagatgggggttttatctataagtccctgactggggctgctgccgtttttccagagatgccctgccgagagaggaggaatctagagagacacttagccttgctgagctgcagtgggctccacccagttcgaacttcctgagggctttgtttacactttgagggtgaaaccgcgtactgaagcctcagcaaggacggatgcccctctcccaaccaagcttgagcatcccaggtccacctcagactgctgtgctagcagcaagaatttcaagcccgtggatcttagtttgctgggctctgtgggggtgggacccgctgagccaggtgccaggcactggaggaaatctcttggcctgctggttgcaaagaccacaggaaaagcgcagtatctgggccggagtgcacgttcctaccagtacggtctctcacagattcctttggctaggaaagggaaatcccctgaccccttgcacttccacggttgaggcaatgccccaccctgcttcagctcaccctccatgggctgcacccactgtccaaccagtctcaatgagatgaaccgggtacctcagttggaaatgcagaatcacccaccttctgcgtcgatctctctgggtgctgcagactggagctgttcctattcggccatcttgccagctctctctttaattctttaaacttggttttcgttagttctttgatgatgtttataatagctgcatttaaattttttcttctaaatctagcatctgagaacacttatgaacaatttcttttgactgctttttcctccccagttatggggagaaactttcttgtttctttgcatgccttaaaaatttatattgagaactgcacattttagataattgtagcaggtctggattctgattctccctcccctgtggtggttattgttgccaatttgtaaaaagtttatttgtttattttgtgtttgtgtcttacttatttgcctgagataaatctgtgaaaactctcctttagtgagtagctacctactcctctactcattttcttattttttatttttatttttggaccgtctcattctgttgcccaggctggagtacagcaatgcaatctctgcttactgcaacgtctgccttgtgggttcaagtgattctcctgccttagcctcccaagtagctgggattacaggcgcctgccaccatgcccagctaaattttgtatttttagtagagacagggtttcaccatgttggtcaggctggtctggaactcctgacctcaggtgatccacccacctcggcttcccaaagtgctgggattacaggcataagccaccatgcccagccagtttgttttttaagactggctcataggagtcactctgtttatgcataggctagttgctagtgagtgactgggcacaagttgtgctcaaccacctgaggccaacaaggtttttgtctttgcaaatgtatctgtgtgtgggtagtgaagaaattagaagttcaggctattttcatgttagcctaactttactggctccttttgtgtctctcctatgtgcatgtggacagcctctgggttcacaaagaacatgtggctggcctgggccctctccaatctcagctgcacatacatgcagccgcagctatatgcatgctacatccacgtaattccagtctagtagaggccagatactggaggaattggctttttctgtttgtttggctcccaaataatcaggtatatcaacagtgtcactggacctgggcattacccaatggtccaaattgtttgcatcctcttcagctggggcagagaagctgctgatcctcatggtctgcccttcctgccagtagttgcatgttttcgaaactagggagagtggggagcagcctatggctggaatgccactgattatcagtcttcttatcctaagtttagcaatttgtcagctaaaagtgcttcttagattgtggtatgctttttgttcaattttcagaattttgaaatggctatttttgttaattttgtccagattcatcattgctttttgagaaaacaatttaccagtttcttcatttgaccctagttggaagtcctaccctgggatttgttgttgttgttgttgtttttcttgtattttacttcagaaaataaaattttacattgaaatgaattaaatttgataaaccttctactttatcataatgcatacatgtgtttacttaaaacgatcattttgctttgccagttctagaaactctctacattcttgtatttattttgctggagtttgctggcatgagaacatgagccttcatgttcatgcagaggttctaagattggataaactggtgtcatgacaaaaatttcatttatttctcatataattattagattgttctcagaaagactgcatatcattgcaatttctcttttaaatcctcctattcatttggtttcacattaaatatatatatattcatttccataaatctgtccatatccatgcagtacaaaggtcaaaattactcactgtcgatgaagagtggggaagcttatgatttatcctgtgattctaaaatggcagactttgttgaaaaaaagtctcgtattggacattttcccctgaattttgagtttatttatcattgcctcttctggttccttaccccagggaatcttggtaaagcatggagcaggaaactgaggataagaaccttgcgtactacttttcttactaagggagttgaaatcagtataatcaagaatgaccaacactacttttttctcacacatccaacatcatgaattccaatataactcctgaaatatctgcattgcctagccatatttctgtactaattagattatccagccatacaggaaattttgtgtttattttttgaagctagcacatcttacgtggccagagaaggagaaagagtgtcaaggggaaggtgctacacatttgttaacaaccagatctcatgagaactcactcactatcacaagaatagcaacagggaaacctgccccatgatcaaatcatctccggccaggcccttccaccaacattggggattacaatttgacatgatatttgggcagggacacaaatctaaatcatattatttcataactggcctctcccatatctcatgtttttctcacactgcaaaacacaatcatcccttctcaagattcccccatgtcttaactcatttcagcatgaactcaaaagtccacagtccagagtttcatctgagaaaagtcaaggcccttctgcatgagcctgtaaaataaaaaacaaattagttacttccaagatacaatgagagtacagacattgggcaaatacacctgaacaaaaaggaagaaatcagctaaaagaaagaggctacaggccctgagcaagcccaaaacccagcagagtagtcattaaattttaaagctccaaaataatctcctttgattccatgtcccacattcaggccacactgaagcaaggggtagattgcaaggccttgagcagctccgcccctgtggttctgtggggctcggctcccaaggctgctttcaagggctggcattgagtgcctgtggcttttccaggagcgcagtgcaagctgtcagtggatgtaccattctgtggtttggagggtggtagccctcttctcacagttctactaggcactgccccagtggggactctgtgtgggtgctcaaatcccacatttctcttctacactgccctagtagaggttttccacgagagccacgtccatgcagcagacttctgtttggacagccaggtgtttccatacatcctctgaaatctaggtggaggctcctaagcctcaactcttgccctctgtgcatccgcaggcttactgccatgtggaagccaccaaggcttactgcttgcactctctggaccagtagcctgggatttatctgggacaatttaaccatggctggagctggagcagctgcaacacagtgagcagtgtcctgaggttatgcagggcagtggggccctgggcctagcccacaaaatcattcttccctcctaggcttccaggcctatgatgcgaggggggctgcctagaaggtctctgaaatgcttttgaggcattttccccattgtcttggctattaacattcagctcttctttacttatgcaaatttcttcagccattcctcctcagaaaatgtgtttttcttttctaccatgatgtcaggctgcaaattttccaaacttctatgctctgtttcccttttaaataaaaattttaatttcagatcatgtcttcgctcatgcataacaaaactgaactatgctccagtttccaataagtttctcatctctatctgagatctcctcacccttgacttattgtctgtatcactatcagcattttggtcacagcaatttaacaagcctctaggaagttccaaactcccttattttcccatcttctcctgagccctccaaactgttccaacctctgcccattatccagttccaaagctgctttcacattttcaggtatctttattgcaatgcccctctgtctgtaccaattttctgtattagtttcttttcacactgccatagagaaaagaagtttaacaggctcacggttccacaggctgtacaggaagcatggctagggaggtttcaggaaacttacaatcatggcagaaggcaaaggggcagtgggcacgtcttacatggccagagcaggaggaagagagtgaaaggggaagtgctacacacttttaaacaaacagatctcacaagaactcactatcatgagaaaagcaagggggaaatcggtcaccatgatccagttacctcccaccaggcccctcctccaacacaggtgatcacaatttgatatgagattttggtggggacaccaacacaaaccatatcagacctccacttgtctgaactatgtttaagaaactaatatataagtgacttaacattctacctctttaattagagtacctacagtgcacccataagatgattacttttaaattgaaattaattaaagaaatatgtgtttgtacaggaaaatatataaagcatatttggaaaatttatgacatgtatctcttggacttcatgctaagcaactataacaaagaaacctcaacttacagtggcccagacaagacacattttttcctctcgctaaattcatgtcagtgggctgtgcatcatcaggccaaccaaggccttgggttctttccaccgtgccaccatcaccatcatcatggttgatgttgactcatcagcaccgtatctacatcctagctcaagggaagtggagaaaaacaaaatccaggtcaagtggcttgctgtatttcaacatgacccagaaattgtgcattccattgagctgagtttgttgcatgtccacattgaggtgcatggaaggctgagaaatatcttgatctgaatgcccattaacccacctaggagactgctttatgactgttctccaataatataaataacacatgcttcctgtagagcatttggttatgcaaaatggtaaaataagtaaagaaaatccatcattaatttcatttttgagatattgacagtcatacttttttgtgtgtttttcttactaggtagttttttaacatacctgtgcaattctctgaatacacattgtcattttaccattgctatactatgaacttttctccatgtgattaattgactttagtgaacctcattttaatagctaacacatggatgaactcttacttaaatgagtgatatattctcctactgtgaaacattaacctgtttccagatgcttactattataaataagttgttacatgcatttatattttcagtgttttctagggtaagttcttaggaaagtaattactgccaaattggtgttcaaaaagttatgccaatttttactcccaccagcaatatatgagatgacatattgagaattactgagaaaatggccttaactttctgggtatttttttttttatttgagaactcattgtttttgaagtgacgattggaaataaaaacccctcgtttttctctacaatacacaaaagtacacatgaacacttttccagcaagaaaatagttttaaaatcaatttgatttaatggtttatattttataatttgttggcatgtttattacccacgagcagttctttgaatggtctctacatgttatttacccttttttctctattatatttttattattttgttttaaactaacatatattagttctttatagtaagtatatcaacctctacccagtaggtctattggaatttttttctttcttttttttttgagatggagtcttactcttctcacccaggctggagtgcagtggcaaaatctcggctcactgcaacctccgcctcccgggttcaagtgattctcctgcctcagcctcttgagtagctgggattacaggtgccccccaccacacctggctaaatttttgtacttttagaagagacagggtttcatcatgttggctaggctggtctcgaactcctgacctcaggtgatccacccacctcggcctcccaaagtgctgggattacaggcatgagccaccacgcctggctggaattttttaatgctagtttgctgtgttaagacacaacgactacaaatcccttaatagcttcttccattgcttttctgcttagaaaatatcttcccatattcaaatcattatgtatataagatagtaacatcttgttccttgtaattctttagtgtattactgaattgcaattattttagttgtatagaaaatatttatgttttctggagcaagtcttctttcatgattcctctttcattttttttcttcctttcactaagtaattttaaaggtatactttataattattttaaaattttctcatgggagtgataaatgtaaaattttgattagatttactatatctgtattataatatattttcattattataataatataattatagattaccaattttgtaacatatttcaaattgaaatgtcaaaatataatttaaattataattacacattaaaatgttatttatggtattatattttatattatgcaccatattaaaatacaacttatttatattttacatataattaatttacttatgttttatgtttacacttaaggtaatatttaatatttatactaacatattaatattattttatattacactaattttcatattataacagtttttccattttcaaaatatccattcttttcttttcttccatgcctccttccattgattcaatatttcatttgtgcctattagtaaggcttccttgtttcttttcataaaacattcacattgctttgttaagattattcttattttgtatttttgtactattgctaaatgcttctctcctatatattttatagctggtcttcctggtataagaaaatactgatttttgttagaatggcaatcattaaaaagtcaggaaacaacaggtgctggagaggatgtggagaaataggaacacttttacactgttggtgggactgtaaactagttcaaccattgtggaagtcagtgtagcgattcttcagggatctagaactagaaataccatttgacccagccatcccattactgggtatatacccaaaggactataaatcatgctgctataaagacacatgcacacgtatgtttattgtggcactgttcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctgagtaaactatcgcaagaacaaaaaaccaaacaccgcatgttctcactcataggtgggaattgaacaatgagaacacatggacacaggaaagggaacatcacattctggggactgttgtggggtggggggaggggggagggataacattaggagatatacctaatgctaagtgacgagttaatgggtgcagcacaccagcatggcacatgtatacatatgtaacaaacctgcacattgtgcacatgtaccctaaaacttaaagtataataataataaaataaaaaaataaataaataaaaaagaaaatactgattttttgttaattgtaaaattggctgtctaaataaaaccttattgttttcaaaagcttttgatttggttaccatgagatttctgtgtaaaaaaattaagtaatttgccctaatggtatcttgtctcctttttgttttgaaaagtttgactcaaccctcccctcttcaggaaatggctcatttttgtctcttttccttctttacagcatggaggagtgtgaggctctttgcacaagactggccataatggttaacggcagcttcaaatgtcttggttctcctcagcacatcaaaaataggtgcgttgaagttctccttttgcttagatatttactatgaaatcaatagcatgatgcagggttatgactggagatgctttagaggcaagtatgttccaattacctgctggcataaaataggagatgaaggctctgaggggataaaatactgtggctagtaagtcaaacacatagcaactcccaaacacagtctagtgttctccctgtaagggagacattttgcttttctcttgccaggtagacattgctccctccttgtagtgacattggtaggggtgagaataagattgcagagtcaagatgatgacaggacacaaaatgtcctctttacacacaaaatgccttatgaaaaggctgtgctgatatgtccctcatctgcagtgaatcaaagttcccattttatcctaccaaacactatccttttgaaaaagaccatcaatttataagggtaggagagggttgttatggttgctttccatttggattatgaaagactaaagacttctttcctgtgctcattgatcctttatatttcttcctggttaattctcttcatgtattttctttatttcctttttggaatcttaataattttgttatcaatttgtgtgagcattgttacatcctggtataacattaaaaaaattaaagttgcctaaatacacgtccaattttcctttgatttgtttaacctgtcattctatgtagaataatttattcatttatgttgataaatctcttattttcatttattcagtgtttttaaggttaggattctcaagcagagatttggtaaatagtcatatgtaaattttaaatacttttaatttatggagaaaatagctgatgctcaggattgagatgacatagtagggagtgagtgtccatttttagagttaggcactgctgggatggtcagcctcacagttgcttgctgcttcgggtcaaccactggtcagatgcacctactggaaactattctcggtatgtactctgcccatctttaataagtatcatcaaaagaaaaataatatttcatggtctccaacctttatgaatgcctacataaagttttataacccattcttgattgttgggtgatttatgtctgatttatgtttacaaaagtttcccacaagagccagcaggacgaagcacatggggataggttttctctagctgttgcattctacatactggaaaatctgtgcctacttcggagtttgggttcccataatgtgatatatgggttgagcatgaattgttagtggatatgaactgtaggactatattaaacaagaaatggcttgtgggttattcactgaaacatcaaacttaataaaatttaaaaaataatttgtggccgggtatggtggctcacacctgtaattctaacactttgggaggatgaagtgggaggatcacttgaggcccagagtttgagaccagcctgagcaacatagtgagacctcattcctacaaaacattttttaaaaattaattttaaaaaattatatccaggtgtggtggggtgcatctgtagtgctagctacttaggaggtaggagaatcagttgtgtccaagagatcgaggctgcagtaagccatgattgtgccactacactccagcctgcgtgacagagtcagaaaacaattaaaaagtaaaataaaataatttgtaaaatgcttattctcctataactataaacctataataaacaaacacatgatgatgcctgtttctataatattgagataaagaataaaggattgatcatgacatagatggtaacaataactagatttttcataaacttcggcatccatacctgggagttagcaacatcagaacccatttctctgacgtggaggtgttgagatggatgagagaacttgtagtgggtctccttcctcctcctctccatccctttctttccatgaacatgaattgttaggaacgtgaataaggaagagtagggtctgggtgagggaagaggttctgaggagataactcaggagaaggcgagggttttggagggaagattatggctgaatttgggcagggatctgggtgtcaggatttccccgtggagaggcaggaggctggtgaggagggtcccaggcttgggctgggagacatctgcccagagggagaacggaagagaggagctacagaaatcccacagaggggggacccagagggcagggcttgggcttcagagaccagctccccttgggaggggcaggtgcaacaagagcctgcaatgagagcctagtggagtgaagccaggagagcacgagggtttagtcacctttagcttctgaattgcagtgctgaccttgacctcatgaacagtcgggaacccttcagtgcaggtctcagcaaattcgcccgtgacaggaagctgaggcttgcacctgctacgtcagttcactcggacaaagcagccatttttcagggtgaagtggggaaagtggaaaaggaatgtaaggatcagaaaaatgaggagccacagaaatatagagggaagaatgtccgtggcaagtagggacagatacataagaggaaaaaacaaaatagaaagtgaagtgaaatttcccaaaccaaagaacttttcctacctcactctctgccccaggcacagccctcagagaaatggggcctcagatgagaaacagctcttccatgggacttcagaccccacctgggctccctgagttcatcccaccttcctgagcctggggagtaagacccaagcacagggatcactttctaccccaatctgcaggtggcactgtctttccttcccaccctctgtcggttcagtcagccccgtaaacccatgcctgactctgctctgattctcttccttcctgctgtgctcatttgagttgctttcttgggtcttaagcaaaaccttggtacatgcacttcaccatctgagaagggtttccgcagaggacaccaaatcccattcccatgctcctaacagagcattaacaccccagcatcctgcttcattcctggactgacctcatccttagcccactgttttaaaatatagtgtgttaatagaaaaattgaagtacaataaggccaatagatcaggaaacgactgcctttgaaaataccatgtattacagtttccaataataggggcatggcacacagggtcccatgagggagcatcaggtcagccaggaggcagagggcagctggaaggaaacctgagcaagggattttattgtgatttctattggaaggaaggggtgaaatagggcaagcaggcctaggatctgctactttgaataactttagtgggctgtgcagcataggggttgtccctagttgtctagtacctgtgcctggggtgactgggggaggtggattgtggcttaacatgtgagagccccttagaggaggtgtttgagatgatgtgtgctctgggtcagctggtttgtatttgaaaaagtgaatttatttgcaagttgtttactatctttaggaattggctagctctgggaggggcagttcttccagagtcagcaagtccccactttttcaaagtattagaatacagaagataataggcatggttaatacacacactccaggactcactgaggctgagtggagccataagggcagggccaatcacattctgcctgcctggaggaagccaggcttgcccactttgcagaggaaggcagggagctctggctgtgccaagggttctgaagtcccccttctcttccttggtacagacttttgttcttcctgggaatctttaatagcttgtttcagagctattatctacatagtgaatttccaaacactttgagattatagagttgtattaaaaagcaagttccttggacccctgatctatggataacctaaagctctctgtgaccggtctgtaccaatcatccatggagaagggcctctgagaaaaaaaaatgcaataggccactatctagtgtgtatgtctatccattgatatcaagttgttatgttaactgtgatgttgtttcttacctgagtcacaatttaagaaaagtcaatcaatattagatcttttgctcgtaaaactgaggctgtttgcttctgacatttaatatttctttaacaaatgtttattgaaacccagcaagggcatgcagaggtaggtctgatgcagtttatgcctgctttggtactcacaagtgcagagagtgagtccggcacatgcccggtgacatcacaaggcctaacagggcaggcaacatagaaaaggtatcaactagagtgttccgtgaaagtgtcatatatgccaagtggcctccaaacccaggaaaagccgagaaatcaaagaaggaggaagacacatccagtttgttggtaaagggcgatttcctggggtcacttatgaatggaagtgtggtcttgggaagcagcaagacaggtagacctctgcaacattactccccagacccagggctcttatatcacagggaaagggcacctaccctagagagacaattgaagacacccctccataacaggcaagagtttttcatgcgttatgggctatcatttgtgcaataacttaagggttgccttgatctaaaggcaggagcacttgttcttacaggaaggacaggaagtgaagtaggaatcaggaggcatttgcgggcctaggctaaccagaagtcaatgtggtagattagcatccatgatgcagtcacttttgtctccacatggagctctgaggaggaggaggaggaggccttttttagtttgaggaaatagcgaaatatcttagacctggagtacaggtaaaatttggttaaaaggggatttaattctggattgtatttagtaacaaaaaatcactacagaattggaatttgagagcaagtaagagggacagataccagtcaaagcaaagtttagatttcaatatgaaaaataaagaaaatcctcaggctaagtaaaagcagcatgaccattttaaatgttccttgagcaaccctcggcttcatggtcttaacttcgtttctgcagctcagcactgtttcgttttgggttggataattcttggttgtgggaggttgtcctgggcatgtaagatgtttagcaccatccctggcctgtgcagcaccctcaccccaattgtgacaactaaaaatatctcttgacattggcaaatgtcttttgggcagcaaattgtcctgggtgagaaccactgtctcagctgttactttgttctatgtccccagagacatggaacacactaggaaacctagttacaataatagttagaccagattccaaaaacattaggcagtcaaccctgtctttcctatggccagatctgaaacgtgtcctgctcagtggctaagaggaggcaggtgtatgaagtaggaggatgtcagcaaatgggcacaaggatgggtagagggcgttgcacacagggcattgtcttaccagaggcaaacactctgggctgtggagtgatctcattttgcagaagtccaagatccatgagaaaggagtgccctcttctcctttcagtcttagtacagccctagtatgagatgtatgaagtcatagtggaaagccagaggtcctgagaggagctgcaactctgcaggccagcatcactcaggtgctttctcatgcttctctaaatacatccctaccccacctcagtgcctgttctcacttgaacaccttgcttggaccactccccatcactgattacacaatactcccacccacagacaccgaggatgattcttcctttttccttgagacttctctggctttttcattgcttggcattttcttccctttgcttgtgtttttttctttatagcaataatcttttcctcttctttggcataagtttgcatcctgcctgccaaaagatctgttcgtagagtgtttaatatccacaatcttacctcgttccaattcagtgttctgctcctagagagcacagactttgtcttttatcagtcctacttttgcgatatgctcaagtatccatgtgatttaggagataaaatatgagggcaatgacaaccagtccagtcctggaggtcttggtgtctgaaaacccaggggtaccacaataaagaggatatgtgtggtcctgaaatgtttaggttttagttcaccaggaggtttaatactgccaaattctacattcattatttactaagttggtgtcctatgctcttctcaagctctagatcttcttgttatagttccttaaattatttttttgatacttctaagtagttaaacaatgattttaactttagattggtattccaatgtatttctaaactgctgtatgtgttcataagttaagaactaaccaaattaaagtttaaagaatcatgtctatggtttatcacttcaacaaaataagccaacaatggatttctattagtgggatttagctaaaagcattttcctgatgctggtttgggacctcatcatgcttttcctggcttcagccaacaccaactgccccaatcctgagtctggtgcaggtggaaatatttgttcaaaattggtaattgatttcccagaaggacagacagcatctagagtatagaatttcggggacccaacctcatagggaaaagtgtatttgctccctccctggtcatcttgacctcattccagcgcttcccttcttctctcccacccttatgaccctctggcctatttcaactggagaaatcatcaagtccctccttgtcccctctccagcctgcaggactcttgctaagcctgcaaggttgtcacagagtgctcctcagatgcattcttcagctgtccttcctgtggcattaccaaaacacaccctcaaaggattattattatttgttctttctgccgaaccttctctctcctaatccattctctacttctcagtttctctagcctggacccagtttacacctgggctacacctgtgccattttcctcttggagcagaaggggttagaatgctgctggatgtcctccctttgggctcaataaactcctggaaaattctcttctccccttttactccctggcaaaggaaaatttaccccttataaaatctgtagagtgtgtcctaacgcgcaatactggaccatctcttagtgatgttatgtccccttgtcttgcatcactatattcccttcttcttgcctttctagcctatagatattccccctttcctaattgtcctcatcctcatcttttatctcttttgtcttcaccatttattatagtctgttacctactgctctgagcaagatatatagattatctagcaatctggataataatattgagaactaattcttatatagtgcttactgtatgccagctgtaagtgctttatacacatgaatcaatttattcctcatgacaatcctacaaagtagctgttattattacccttcatcttataggcataaaaaagtagtcatagaaaggttgagtgacttttccaggattaccatctagtaagtagagggactgacatttgaaccccagcattctggtgctactttgctctatgatgcatcatctcatgattgtccacatttaacaaatgaaagaagtgagcctcctacctgtggtggagctgcctttcaactgcagccagtctgactccaagcttgcaggcctggtcaccatttccgcttccttcctgctggagcacttcccagagccgtaagcatgaacatgcaaactctcgctgcatcttcaatggtgtctgcaccagcaactctctcttgttgacatgtcttttggcaaaattttaatatcttttccattcctattgagacctcatcatcctactcatttaacaagtaatttctaatttcctgagagacacctcttgtcagctagctttttgatgggctctcacaaagtttttatttcttcgttatccttttctttctttgtatctatgtctgagaaagaaatctgcttaattattgagtgtttttattctgtttgatgataacataatcgatttcccttgggatgccttctgtcagtggttttattctgctttacatccttgatcttttcacagtcaagagcagttaataacagaacatcaaccacattgacttaaccatattcatcgttatttgtagtaagaatccagaggtaactggttattggcattccttaagaggtcctaggcctgacagtgtgggtgttcccaaagtggctgctgtagctccacccaatatatatatgttctaggcaacaactaagaaaagcagagaaaagcaaaaagagcacatgccaactgtctgttccctcttaaagtagctttctgtcagagtcccacccagcaacttgtacttaggtttatttgtcacctggctacaaagaagtctaagaaatgtagactctagctgggcactttgctacttaaataaggttaggtttctgttcccaaggaagatagggatcatggttgtggagtgggaagcctgcagcctcacttattcacctgactggattcttttcctccattgagggtaggtcgttaggttgagcagctgagctgaacggactcttgggctttcaatttaagattgtcatatgctatgaaagagccctatatggtatagagattcatgagtttacgtgtgagcacatgatagagtgtgtgtgtgtgtgtgtgtgtgtgtgtgtgtgtgtgtgtggctcagttaataacagaggagagctggagtggagtggcactcacctaatagccacaggtggctaaaactatccttttgggcactgatgttttgtcccaggcaattagggatgcatcctcaaatcctctgcatgtcataaattgagcacataatggtgccctggtagctagctgcctttgtacttgcagacactgagcatattcccaacttacctggagggaaccattaacagctgcatgcggcatctatttgcttttctcctcccttgaacctgattgacataggaggcttaagtctgacttggtaaaaacactcctgtcatggaaaggaaataaaacatgcttctgaagcacagagtttacaatgtgaaatactccaggccaatttatgattttggggtgagggaggataaaggctgtgtattttgttgtcgttgttgttgttttcttttttctttttttttttttagacagagttttgctcttgttgcccaggctggtgtgcgagtgcaatgacacgatctcggctcactgcaacctctctgtcccaggttcaagcgattctcctgccttagcctcccaagtagctgggattacaggcatgcaccaccatgcccagctaattttgtatttttagtagagatgaggtttcaccatgttggtcaggcaggtcttgaactcctgacctcaggtgatctgcccgcctcagtctcccaaagtgctgggattacaggtgtgactcaaggcacccagcctgtttgtttgtttttctttctttctttcttttttattttttataaagaaaacacagcttcaaatgatttaaagaaaattgttaagattatgagaatttacatttccttgagttatcaactgtaaactttgagaaccaagaataaaagtagaataaagttcaaaggatcccatcatagatgtgttatatagccatctaagttaaaatataaagaatagtgtagaagggtttgtttgtggatttttttcctaaaaaaaatgaaaggaggcagaatcttgtttgagctctcaagctaccactgtctgagtagctgcaaattaatgtatcaccttatgtgacaccatatgctttagtgtggcaactttgacttaatatatctataaaccattactataatcataacatctcggattaagattgcatcaccacataatgaagtggatcatttaaaagtgaaatagataattcagtatgtttatgtcactttcacaaatggggaaggaagtttgcacatgagcacaaaaataatttctgccatgatgtggaactatggaatgatgtgctactgagttatatttttctatattttactttagtttaaagcatcatataattcacctgctgctactaaccactgaattaattctctttactagaaatgattttaagagagatagtgcacctccatatcctcagcgtgtttcacctcacctgctatgtgtaatttgtcatctcatttgttgtcacaacatcatgttgtatgaacacagcattgctctgacataattagctgggaagactttctgattctcatgccattctcatgctggacattttggttagctgcctctggtcttggaaattcaggtcatgaacagtatcacccagagctgtcactttatcaaaagtaaacattcggcattcattttttaatattttctgtaagaataaacagaatgcttttcactcacaatgaagatggaaaatagaagtgttggagatatttttagatgggtgaagttgttggggactcagactcacatcatgagtcctgttcattcatacacatttattgagtaaccacttaattagagatgatgaaaatgtgattcctaatctcaataaactcggcatagtgtacaggcagaaacataacaatgaatacaacacaatatgataattgttctaagagactggtgaacgaaatgctgtgttgtgcatctcagtttaaacctgcaaacattactgaatgtttacatagtgccagggtcttgggattgagtgggtaataaggcatgagccctgtaagaactgggctagacactcaaataaaaaaattatgtaagaaagaccattagcacgacaagaaggtttcaaagcccatgaggtaggagttaggaggaggaagaatgcacacacattgttttaggggaaggattggcacaggtagttttatgggtgaggaggaatttaaatcacgtgtatgcttagccagctaatcaactatgaatgcattagaggtagtggcacagagatgaacaatgtaaaccatgtttgaaatagcttgatggcaagtggaatacaggtggaatcatgcggcataaacttgaagggaatctttgggaccaaattatgggaaatattaattctaaggtaaaaaaaaggcaaaataatggaggaacaaagggaagcaaaaagaaacaggagaataactggcctattaaacagaaatttttgttctctagtaggaagttaaataagacaaactgaagtcaactggtgaccaagcacatggagaaggcagcatgggtgcaggagacgctgaagaacacgataatagaactttacagccggctgatctgagcttgagaaaaggaggtgcctttgggtttgggacatggaaagatagtgatgtctttagagaaacagaagttgggtgggctgtgagggtgaggaggattctgggtgttgagtatgttcctagggacactgatgggctgtttggagaattcctacgaggaagggctgttgatattcatgttctctttgctatggcaagaagcaggagagaaaacttaaagttgggggtgattattgcgtatggttgagacggaggaataagtagctgaactcatcacaactttgaagcaatatttataaactctgaagtagagtgagctgagctcagattcatgttgctgcatttattttaattattactaaatataggcaatttgccaaatgctttctgtgcatggtcttatttaatctttattacgtaatggctattattgtacccacttcacaataaagaaactgagacctaaagaatttaagcagttggccccaaaacagagtcagtattgagaaaagcagttttcaaactcaatttcttgactctaagtttcttattctttctataccacttcaatagtctcaaccaaccttatgtataactgactaaagaacaaagctttgcttcaagtacatgtcgtgggcacctgcgtgatgaaacctacacactttactctttgttgaatttacttcctgtgtatttaccgagaaaacagactatcttcttttaaaaagatgcacagactctgctttgaaagcctggtttgatgaaataaaagatatttagagtaagactcttactcacttactacgtatgtaacttggaaaaagttaacatctctggaggtagtctttttcttcagtggagataataatacgtattttatagtattttgaaaagaaatggaggaatataccaatcattttctcacctgcgttaatccatttgctgttactataacagaataccagagactgggtagtttataaaggaaagaggttcatttagtttagaattctggaggctaggaagtcctagatttggtggctgcctctggtcggcttctggtgagggcctagtgctgctggatagcctggcagaagcacagacatatgagtgcaagctaaaagagacaagcacaaggggtcaagcttgctatgtaacaacccactttaatgagaactagccaagttccctgagaactaacccagtctctaaagaatagcattaatccattcatgggggaagagtctccatgacccaaacacttcccacttagtcctatgtcccagtgctaccacattgaggaattgaggttctgatacctgaacttcggggggacacgctcaaaccgtagcaccacttgagcatgctatgctttctctttcccccgctgtaaagttctttcccaagaaaaacacatgactagttccttcagttctctgctctactgtcccctcttcagagaggtctccagcatcgattgtaattattcatagaagaagaagaacacctggatgttagctgacaacatgcctacataggaataagactgttttccagctttccctacagctacatgtggccgaagagttatagtaagaagagatgtccacaatgtcagggatatgaatttgcaaggagggacatccctgattcttccctttctttcttccttttactttatacagagctgatggctagagatggctagagatgaagcagccatcttgagccacgaggaaatcttagcaatggagacctgtgaagcggagcaataacacagaatgagccaaatgaatgctttttctactctggctgcctgacttcagactttaaacattaacatccttactatttggggctttctgtcactgtacatgaatctgaacagactaatattccctgtgacatattaaatatagcattaatttatgtacttagaggttattgtctatctctgcccagtagcatgtaaactttctgagggtaaaaccttttcttctgtttacttctgtatccttaccatttgaaatagtgccaggtacataaatgtgctcaacgtatttgttgaacaaatgaatgaatgtattaataatgaatgtaaaattcctagtacatggcagctttttgcttaacgggaattcctttcagaatgctgcaactagactgtaaaagacgaatcagatgaggccactcaagcattcagcttctgcctagcttaatgaacaacaaccactaacaagaacaataactgacccctttgatggagacttttactctgatgccatttatctttagacagggtgaagcctgctttctctcaaaacagtctgcattattcatgactagtttgctgcttttcgaaactggactctgtctgcctttggcatctccactaacagaaactatcaggtgtacgattcagtcctaattgctgccatggccttggcaatattgtgctgtcaccttctctgctggacagccagacttagtgctggtgtacaccggcttgccaagaattaatgtgcattgcagacagcaaaaatatgccattccagaatccaactgtacactatgggattatgatttcctattgtaaatatagcctaggcacaagaaaacatagcctaaccaaggaaatggatttctttattccaggtttaaaatgtatcaggattgggatttgggagaagcttttcttactctgagttcaaactatgagcataaaatgcgtgtgtgagtgtgtatttttaaatgcaccagcccacaacatttgtttcatagttatcttacaaattttattttttcattccatttttataaaagaacaaaaaaaattcctaaagcatcagttacattttggcaaaaaaaaaaaaaaaaaaaaaagctgcaaagtccaaaaaaactcagtggcttaaaaaatcatttgccctcaagagcctgcaggttttatggagatgggctggcctgggctggatttgtgcacctgtcccttgtcatcctgggattggtgtctggaatgttgaggcaccagaatggacaggccaaactgcacaaggatgaaccaagcctctggtcacatcaccactactaatgtccttttagccaaatcaagtcacgtggctagcccaaagtaaaagggtaggaaggtagtcccacccatagtggaagaacaccacgtatagctacatggcaaaggacacagatgtaggaatgagaagaattggggcaatatttacaatctgctacaacctccaaacattttcaccaatttttaaaattattattatctatttcttggtctattttgttctacttttccttttaggagagtttcctagatttaaaatttttatgtgttttgaaaatcttttttgtttttggattactactctaaatattttatataatatcctgtcagtatttcaaggataaaatgtcttttattaatttttaaaaaattttagttttaggggtataggtgtggatttcttatataggtaaatttcatgtcatgggggtttggtgtacacgttatttcatcacccaggcaatgcaaatagcatcctataggtagtttctcaatcctcactctcctcccatcctccaccctcaagtaggctccagtgtctattgttcctttctttgttttcatgcatactcgttgtttaactcccacatataagtgtgaacatgtggtatgtggttttctgtttctgcattagttcagttaggttaatgggccccagctccatccatgttgctgcagaagacacgatcttgttcttttttacgactgcacagtattccatggtatatatgtaccacattttctttatttagctgatggtcatttaggttgattccatgtctttgctaccatgaataccttctgcaaaaaacatatacatgcatgtgtctttatggtgaaatgatttgtattcctttgggtatatacccaataatgggattactaggttgaatggtagctctgttttaagtttttgagaagtcaccaaactgctttccacagtggctgaactaatttacattcccaccaacagtggataggcattcccatttctccacagccttgccagcatctgttttttttttttctttttaataatagccatcctgactcgtgtgaaatagtatttcactgtgggtttgatttgcacttctctgttgattagtgatgatgagtatttttttcatatgtttgttggctgcttatagatcttcttttgagaagtgtctcttcttgtcttttgcccatttttttaatggggttatttgttttttgcttgttaagttccttatagattctgtatattagacctttgttgggtgcatagtttggaaatattttctctcattctgtgggttgtctttttatttttaactctgttgatagtttcttttgctttgcaaaagcccttcagtttacttaggtctcacttgtcagtttttatttttgttggaattgcttttgaggacttagtcataaattctttgtcaaggctgatgtccagaatgatatttcctagattttcttctatgatttttttagtttgtagtgttatatttaagtctttaatccattttaatttttatacatggtgaaagatgggggtccagtttcattcttttgcatgtggctagcctcttatcccagcactatttattaaataggtagtcctttccccattgtttatttttgtcagctttgctaaagattagatagttgtaggtgtacaattttatttctggattctgtattcttttccattggtctatgtgtctgtttttgtaccagtaccatgatgttttggttattgtagccttatagcatagtttgaattcagataatgtaatggctccagctttgttcttttttattaagattgctttaactattggagctttttctttctttttgtttttttggttccatatgagttttagaatagtttttttttaattctatgaataatgatattggaattttgataggaattacattgaatctgtagattgcttttagaaatgtggtcatttttatggtgttgattcttctaatccataagcatgggatgtatttccatttatttgtgccatatatgatttctttcattagcatttgtaattttctttgtagagatccttcacttccctggctaagtatattcctaggtattttgtgtttttgcagctttgtgaagggaattgagttcttgatttgattctcagcttggttgttgttagtgtatagcagtgctactgatttgtgcacattgattttgtaaactgagactttactgaattcatttatcaagtccaggagtcttctggaggagtctttagtgttttctagttacacattcatatcattggcaaacagagatagatttacttcctcttttctgatttgaatgctctttacttttttctcttgcctgattgctttggctaggacttctggctgcctaagtctctgtaggtctagaagtacttgttttatgagtctgggtgctctttggccatttttatattggtttatttgtctttattattgagttgagatctatatctatatctatcttctggatgccaatttcttatcagttgaatttttcccattttatgggctgtcttttcacactttgggtattgcccttgaaagcacaaacatgtttaattttgatgatacttaattaatctttttttcttttgttgtttgtggttttcgtgtcatatccaaggattcattgccaaatccgaggtcatgaagatttacccccagatttttttctaaatgttttatagttttagcacttacatttaagtcttcgattcatctttagtaattcttttttgtattaactgtgtgtgaggtagggtcccaacttcatttatttgcatgtggtactcacaataggatatacctgtagatcagtgaaatagaattaagagtccaggagtaaaccctgggctttatggtcaactgatttttgcaagggtgctaagaacatttgatgttgaaaagactattcagacatttggtgtatgtgcttggctgaggagccaatggggtggataggattttcaaatcgtgttttcaataagtagtgctaggagaactggacagtcacatgcaaaagtatgaagctgggcccctacctctcacacagttaatacaaaaaaattactgaaggtgaatgaatgacttaaatgtaaatgctaaaactgtaaaactcttagaagaaaacatagggataaatcttcatgaccttgaaactgtcagtggattctcagatatgacaccaaaaacacaacaaacaacaaaagacaaaaagtaaattaattgtcatcaacattaaacatgtttatgctttaaatgacactatcaaaagtgtgaaaagataacagaataggaaaaatttacctgataagaaattggcatccagaagatagatagctgtagatatatatctcaactcaataataaaaagataaataaacaaatatggaatgaccaaaggcactcaaattcataaaacaagtacttctagaactatgaaaagacttaggcagccacataataatactgggggacttcaacaccccactgacagcattagacagataattgaggcagaaagctaacaaagaaattctagacttaactttgacacttgacaaattggacctaataggcatccacagactactttacccatcaaccacagaatgtacattattctcatctgctcatgaaacatactctcaaatcaaccacatgctcagccataaagccagtctcaataaattcaaaaaattgaaatcttgaaccacaatggaatataaaaaataaaaattaggctgggtgcggtagctcacccctgtaatcccagcattttcggaggccaaggtggatggatctcttgaggcaaggagtttgagaccagcctggccaacgtggtgaaactctttctctactaaaaaaaaaaaaaaaaatacaaaaattagctaggtgtggtggcacgcacctataatcccagctacttgggaggttgaggcaggagaatcaccttaacctgggagacagaaattgcagtgagccaagattgcactgctgcactccactctgggtgacagagtgagtgagacacttctctttcatagataggtagatagatacatagatagatagatacatagatagatagatagatagatagatagatagatagatagatagatagatgacagagagatgtaaataaaataaaaatcaataccaagatttctcaaaaccacacaattacatggaaattaaacaacttgctcctgaatgacttctgggtaaacaaaaaaattaatgacttttgaatgataaacaaactgcatttctagaataaatctcacttgatcatgatgtataatttttttcaatattattggatttaattttctagtattgtgttgaggatttttgtgttcatattcttaagagacattggtctgtaatgttcctttcttttgagattgcgtgtgtgtgatgtctttggttttggtattgtggtaacactggcctcaaagagtgaggtggaaagtgttcctccacttctattttttaaacacgtttgtgaaaaattggtattatttcttaaaacatttggtttaccagtaaaaccatcaaggatggcttgtttttgtaaggtcagcagtaatgctttctctttcatttctgatactagtaatttgaatcatctctctttttttcttggtcaattatgctaaatatttatcacatttgttgattttttttcatagccatattccatatggcattccaaacttccacaatcaactttagtttcatttttctctattgtttttatattcttgattttatcaatgtccactccaactttattatttcctgtcttcttgctttaggtttagtttgcttttctttttccagtttcttaaggtatacagttgagtattattttgtaatttttcttacatgttaatggaagtattattactataaatgtttctccaagcactgctttagctacgtctcataagctttggaatgttgtcccttcattttcattcatctcaaagtattttataaagtaacttgggattgcttctgcctcgttgttttacccacacgcagctggtaagattcactcattgctgtattgttttcaacaatatcatgggcataaattgttctacatataaatctcataaaatttaggctgtgttaaaggactccttcctgagatcagtgtttgagatttgttttaatcacaaatttgccactgggagggctccttccagtggtctccctggttctctctggtaaattagacagcctgtagtttagcctgtatctccgatgaatctatcaatctcccaattgcctttcaccacaggttccagttattaagaacacccttatggttgaacttctccacattttgttgccaaaaaaaaaaaaaaaaaacctaaaaactaaaacaacaaaacagtccctttggggatagattagcagttatctgtttatggcttgcttctttagaggcaaggaaacatatatgagccacatttctggagctagaaatgggagcaacatcatgtttctttctgaatgaccctcccactttaggagctgaacactcatgggagagggaggacagtgacctcagattctctcagcttgcttctcccatgtggaaaccccacaccatgatatgaggcaagaacaagggggaccccaatattctcggcaatgctgttcttaatttaaagcctctgtctaatgagcctttgtctaatgaggtagagctgggtaaaaaaagggcaccatcacctctcatctgtactcactggcagcttaacctcatgaacatgtagctggggccagaatgagaggggaagacagctcacttacagagagctaaggtgggagagagccctgtgttcttggatgcagcaggctggagtggagtttccatttccctgagctgggaggtagcagaagagtagatcttgttttaaatgccacagactattactgttcttactcagttttagtagactttcttgaataactatattttttatcttgctgtatacagaaaaatagcattttggagactttactgttttttaaaaaatagttttcagcagtcttactgggaaatgagtctgcagaactcctcatactgtcctgatggaagccttggctaaatgctttcaaagacatctatttatatctatttcatgctggtattgtacctgcacctaaagtgactgtgcccgtaaaatagggagtctagttctattgtttttgagtccaattttaacatccatattgactttttacagcccctgctttcttctcattattgtaaatatttatagtattaattttattgtgtacagaggcatatttgaatgattaaaaggcaagcaccagccttttgagaagactttatcaatcactctagcacaactgttcacaaagcaaggagtcagccgcctcccatataggcatcccccaaccataacgtggagaagcagatcccagttagtactttctatgttatagctcctctagtttgtaattagtgtttgaaaggatccagagtaacatggaaaagattcactgtcttgattcactttcataactcagctgtcacttgggtctttcctgcccatgggagatttaggaaaatgtgcctgatttcatgccagggagtccaggacccttgtctcaagggttctatgaactcctggtgagtcagaggcctgtgtgccctgccctgtttttgagcctgtgcagtcctgcctgggcatgtgctccagtgcctggggagccagccacattatcacccccgccaccatacacccaaatgtatcaataattccatgaatttagtaattttccaacatttttgaatgtgggcctgaagagagaagtaattgtgaatccctgggctgtccgtccacctggcccctccctgcatcctcagctgtttcccctcttgtgcccctggctgccagggtgctgtcattactcaggcatccagttggaaagttccaggcacatttcggcccagagtcacttacccagagcctggcttatcaaagccttttcttaacaatgggagggaggttgaatcttaaagcaattcttctctgttaaggcaattatgcattttttcttattattacattatttatttaagggctgtattacatgggatctgactggagacgatagaggttatttgcaaagcctttgaaaatgaactcagaagaagtttaatccactctcccaagggaaccatgtccctacaaaaacttaaaactgcagcaaaacagaatagagagggtttgcttgtgtgcctgcagcagagcacccccttccttatgtaaacacttacaaagctgccatctttgcacagatggtggctgagtggggtgctggctttgaaggctccctgttttaatactggtgttttcctcctcaggtctcacgcacgaagtactgtaagcttctctatgggcagcactcatcaagccagaaagtagcttgccatggcttcttctatggggtgttttctttattatgttcataaagcaaaaaaaaaaaaaaaaaaaaaaaaacagagagagaaagaaaagaaaatcagaagacaatgactactttagctctcttggcctctcaaggtgactggtgtgagaatagcttggtggctaaggacagaaaaaaaaatcttttgtttatctagactctagggtatttctgaaatgaagggaaatgttcagagaccattaaaaatgcaagaggccacataaggggctgagtcatatagctgtcacctcaccaccttggaaacaaaacgctctatcatgtttgtttagctggtgacaatgatataatgctggagatgaggctatgtatttttttttatcccactgacttggctattgttccttactttaaaatgatcccctttggttactctaaagaacaaaggaaaaaaacaatagatatgcattttgctgtttagttaagaaggaaatattgttttcattacaccaaagtctgacaaggaatttaattcactcattactccattaaatatgaactgggcatctgcaggggtgttagagtcagtggcagaagggtttatgtgtcctgtattcttggagctctactgtaacaactgatggcattgaaggatgcaccatacacctgcatgtacacaggaagggctttcacagccagaatagggccttgcacaagtgagcactgaattagtactgaatggatggaggaaaggagatctggttgtgggtagcatgaaggatactcttagatgcgaagtcagagaggaaggcactcgttacatcatggagagcctcatggacaagctgaagagtttgatattgagtcagagtctttcagacatgaagctgacatggcctccggagttctgagacagttctgttggcctttcctggaggtgacgttgacccaaccactttaatttggatctatgaatggtggagtcatttaagaaagtgacacatccagccacagagagcagtgtttatggagtgatgtgtattaacatgaatcaagcttcttttttattgtgaagctgtcatgtccctatacgatctcgtctttaaactcagaagtgtattgaggctgttttcaaagaggttttcttctccaggaggaatgtgagtgccagctgccaaacactgttttgttgttgttgttatttgtcaaaggctctctttatgttaataccttgggtctgtaatcctcacagccattctgatttgcatatgcaatgattggaaaatgatccaaatcaaacttaactgaagttgaaataataaaggtgcttgcagtgaagggacatggttgtgaggtaagccccatggtctcagctctgctagttaataagctgagtgacaaagaaaaaatctcctgatctctttgggcctcaaatttttgcattttatagagaggaattggtatccattctagtccatgtacaggtgtgataagagtaaaatgaaattattgatgtgaaagtattaatataaaggatataagagcattaacgattagatgagatcctgcttcaggctggagttttgaggttaattactcagctggaactgtaactccctccattcccttggagttgtgtgacccaaacaagttatgtagcttctctgagatccacctcgcttctgtaaatcagaggcagagatagcagcatcagtattttgtggggattaattgggataatgtgtttggtgcctcactcacagaggatacaggacagagctcatgtcctcagtcttctcttttggtttccttttctttccagtgggtaatcatgaggactgagattacaatgaggaagtttctattaataatacagagatgccagctacacatcaagtgctcacataaatgtttgcatcccgctgtttgctcagccacccttcctcagtgccatcctctcctcctcttcatgcatccaaaggaaacctattacaattcagtagctgaggacagatcactggaatttggtactttgttgaggcaccaacccatgaggagtggggtgtggtgtggtaaggcaggaagatgagaattagggaccaatgtagtctgaggcagcggggaccccatattccacagtcagtgctgtaacacttgtgctggatgagagcttaacgtgagaccacgggaggcctggtccccctccgctctctgctcttgccctgtggtggatgagggagaagtcatctttaaaggtatttcctactcagatatgtgtagggaatagcacatgtatggggttgtggatgtgagtgtgaatagactcctcgtggggcagatgatggaaatcagtgggcatatatctataaacacataatacaaatattacatattttacaaatcctgttattttctaaagtctaagattagtttctataccaagaagaattttatgcgtttaatttttagaggcaatgtgacaaaaagttcctaaataaatgatttttaaaatcagaaactgaaatacagtcgtagagtatgagacattagtatgttcctttaattctcttagaagccatgtatattttttctttctaatgataaagttttatgtgctcattattttagaattcaaaatagtataaagaataaaacctaatggttatgcgattatttcttgtccggataacattccagaatttatttcagtctgactgtaaatatgtgcaaacatacttacatcattaatgtaatactgagtctatgattttctattttgcacttaatattatataatagccattttctcttcattaaatattatttgtagagatttttaatagttgaggctgaaatcaatgtatttgttataaattatgacttttaatttggggggaaggacttttataaggggagccttaagctcaggaatgcaaagcttcataggcacttggtataacttgacaagtgatttttcagaaatgtctctgcaggtgcattgccacctcttttgttctgctcttgaagtgtctgactttcaaaatatatgtgtgtatgttttttcttcctctcatgtattattcctgcttctgttttagcattaattaatatattacatttaatgtttgtggttccaaaatgttgtacctcaaaaaattgtagaatatttcttgtaagcacctttacctacagataatgccatttatttatctctatttaatcaccgattatacaaataatgtggacataacgtattatctagaaatgttagatcaatgagtgaacatagaaataaatgactccttggctattttgcaacattttattctgtggaagtatgaaaatcaaataaatccttcagggaatttagattattgacataactgtgtatgttatagatagaaatgaaaaagtcaagctaatattaattagatatttacatcataatgaatttaataatcttcgaagagtgtctaaattgttgaaggtgccatgcttttataattttacgtttagaagtcttcttaactattaactgttctagagagatcctgagtaacctatttcaacctatctcctatctgtttcaggcatattttctctagagtgtttctattttggaagactggtagaatttactttttgtttaatttctgtgtaatttttcttttttcgtaattcatgttcttcacagtaaagttggaattcttttagttcaaacgaaattttaatttgaaagaattttaattattaatgtgcatatgtgcttatagagaatttattagataattactggaatttagcatgaatttttcaaaagtcattagcaaaatatacttaaagggctgcagtttctactaatggtaaaaatggatcctaatatgcataagaacatacagccatctctgtgccactgtctcctcataccattgtatttttatataatgcttcctattcatgtttgaattgttttatctgcttttatctaagttctccaaataaatagtggccttcttcactccaagaagaacattcttctgttctggtcatattctgaatagatcctaaatttcactgcttatttatctacttagttacacagtgccagacattgttccaagtaatttgcaaggattaattcagtcagtcctctcacaaccttattaggcagatactataattaatctatttgctagatgaggcaactgaggttagaaaatttaccagactttccagggtcaaacaactggtacgtggaggagctggattcagtagtgcaaacactacattttgtcatgccatcagaatcattaataaacatgagaccagaaacacatctccatgcaacacatcccctctgccctggaacataatgttatgcccagacacagctgagagctctcccaggagcatttacaaagctccagtgacatggtgcttcaccttgggaagccccttcaaccacctaggcctcaatcccttcttttcatgaaacgtggacatatagacccactttgggggatttggtgaagacacaatgggttgatcgtgttattcagcagcatagcttgtaacatactgctgagaagggggatggccacagaatatatacctcttgtaccaacccaatgtgttggcctttaacaattctgagagatagccaaatagaaatgttagagaggtgcatgtccgtatgcttttatgtatattttgtcagtgtcctcaccaacctctcagccatgtgaagattagaaaccattaactcgaatgatgggaggctactgtggccatgcacagacctcagagggaagtgacatctgacagcctgaaattaagacaagaggacagaaaaacagaacaccagggcaaagagctccatgggtgctcacaagggtgatctatgtcactgaaacaaggtcacattgtcttgggtcccctgtctttaccagacagacttgaaaaataatttgaccataaatctgttagggatcagcctcatttaggggaaatttacttaagtgtaacacattttcccccagcaatgctttgtaaatgagatgagtatgattgctaagactgggcatgccatttcattcattaaactaatatttaccagtgctaggtactaggtactcatactgtgcttggtacttagaaaagatgcttcagtgaacaaaatggacagagattttagtcatcagagtatattcatgtatttctgattttttttgggatgctatgatgtgcccaacaccacctgagataagggagtagaataattcatatagtttttggaggacccctacattcctggagattgctatttgaggttaccttagggtatgagtatgagctcatgtcttgctgatgggacaccagtggaactactgtctataactctacaatgtgaggaacagagccccttaggcaggagacttcctttgcagtcatagggcctgtccacctaggctgggttgaagtacaattgggataacttttttatataacaaacaaacaagtgcctggtaattacatatgcaatccctttcatcttttcccagccaaattttaatcagtacagaccttgaagcaataaggccagcaatcatgcttcccagggccagtttccagcccagcttcccacttccactagctcaggactttgctttcaccgtttgcattttcaccttccctcttttattgactgggtgttgattctgggacttgctgataatttttttaaggtaattcagtgtctgtgtcaatataaatggaaaacaactaactgtataattgacttacaattaatttctgtgtcttatattgagaatccaaactcccaacaatttggagtaattacttcctttttctccctctgtgtgaaaatggacttagaatttactcatcttaggtcaatatgataataatcatgtttctattttatttaactctcaggtttggtgatggttatacagtcaaagtttggctctgtaaggaagcaaatcaacattgcactgtttctgaccacttgaagctttattttccaggaattcagttcaaggtagtgctaatatcttgtattatttctttgttttcagctaaaaaaaaataataaatgtacctgtctttttttgtttttattctatgctgttataagatactacttgttaccttagccacattgcaaagtataggccctgcctccctaccaaaaatagcatggatagctgatattgcttgaccactctgaagagtgacaagcctgcttaattgcttcctggattggccagagcagcctgtgattacatatcacgcctcttatctgtgggcacaggtccattgcataactcatcttgttcagcatagaagattgcaaaagctaatctcttccatatatttgctgtagggtttataggcttgatggtttcagcattgcttcacagaaatagccctatgcttgagatcacaatcctctataaacttgctgtcatcaagtatggtcactgaaccagcagcatcttcattgcctgggacctgttagacatgcagaatcacaggccccaacctattgaatgggaatctgcattttaacaaggtgacccggagattcctatgaacactgaagtttgagaagcactgtctaaaaatctcttggataactgtgggatgctagtttattataacttctaggaggctgtagtccataaagtagttatgttctatttatttcaacaactgtcatttagtgaaatcctactatgcaagaagcatgctgtgtgagactgtcattcatgctcaattatgactctgagtcaccctataaaacagacataattatctccattggcatacatgaagacaaggatcagaggtttaaatatcttcccaagtgttgctcagctaatgatgagaatagtgagagataagcccaagtcccagtgtaaaactcagggcccttccatccgtctctgttaggccatgttaaattcctacatttcaaatatctttgggcatcttatgattccttaaacagggcttccccatgctgttgcaaggttagagcatatcagggggcagaacagcaatgccactcagttgaacgttgtttgtcaaatataccccatgaaaaattgtcatcaataagcattcattggagactcacaaaattaagtgtaggttgagaaaacgtaactgaatttttttgccaattaaatgtagtatgatcaattttgtttaataatgctagttatatgatactttttttttttttttttttgcttttagggacagcacctgaatttattagaatatcatgtgccaaaaagatggggatgcctagctgacttgttcaaagttatagagaacaataaaaccttcttgaatattaagcattattccattaaccaaaccactttggagcaggtatagtatcttgaatgattcaggaggttgaattttggtctgttcatcagacctaatgtagccaattttaaaattaatcgaattgcttcaattcaccactttattcaattcatcttgttaaattttataaaattatgataaggatggtgagtgtcagaaagtttgtttactgtatacccttctacttaagatagatattcagtagagtttcaatttgttcatattattttgggcatttaactaattaaatcatgtcacgttaaccttcctatctccaccttactcagccccacaagacttttcgggggggcttcactgtaatcaaatgatagctaacttctggggaaacaaaaagcgtttcatttactaagagtaccaggaatataaaaatacatcacgacatatttctaaaaccaggcttaaggtattgagaacttctaggtgatttattattataattgtctagaaatatgaatgttcttagagttgtgtcctcaatggatttatatatttatgtgatttgggagggaatggtatgaattaatgatctgtggtttttagggcaagttggccagtgttctgagacaatgtctcctttctaataagtgagaccaaagggttgtattcttataagtaaacaacatttttatggtttttttcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaaccc

SEQ ID NO: 1662 - DNA, 53064 bp, Homo sapiens
ccatcttggggcgacggccagaagtccagggctaggagcctcagccggcggacgccaggaaacaggtagggatagatattttcattgaatatgaaacgcaggattggaagggatttttttttccctaatggaaattttaggatttttaatttttttcatgtattttctgttgaaattcatctctcttattattgctgttttgaaggtaatgcttcttatcttgctcattcaggtagaattttttgttctttgttttctgaagtcttcctatgatatgtctgtgtgaattgaaaattattagaaatcatttttcctagatttcgcagagatttttgtgtatttgacttggcgaagtcttttttctcttctttgcttctaggatttcagttaccataataatattggatctttgcggtatgtcttttacacttttcatctttctgtgcttcaatttgggtatttttttctgtctcatcttccagtttatttattctcttctttttggtgatatctactgagtcactaatatatcttaattatatttttccaattctagaatttttatttaactttttatagattttatttaactctttatagatcaatattgatattttatatttgtaattgaatatatatagaaaatataaatgcaatttacattaatattatatatgcgaatataaatatctatcatctacatatctttaatgacagaagagtgcattagtatctggtttagtgatttaaatatttaataaaaattaagtaagataatctttcatggtatcttctagaagtctactacatcaagataagcactaaaccaacatttgtattcccttagtacatgtagattttacccttacctgagaattgtaaactacaatcaagtgtgatataattgtatatgtgtttgtaacacacctttactataaccaaaaactttgaatgtgaaaaccattatttcaaactacagcatttattgatattttattaaacttactatttatttttgctatccgagagcaatttaaaattaagagaagcagcaatggacatgtattattgagaatttcaaatctaagatatcatttttcttttaagcacaagcaatctatatagttactatatttgaagtcgtactctgaccaacctcaatttcaaatttgtagctagctgacccaaaataatgatattggtctggcgacttcatgccttatgggacttgtggagaaaaaaaaaaaaaacataatcgatcttctttcatgagatgttgagccctgtaggcttccttcaaaggagttctttgtcctcatgtagaaagagtaaaggaaaggaagaaggaaagaaagagcccaactgggttttaatacagagtctgtgaaagtgattcagtgaggcagaaagcttcattgcgagtttatgatacaggtccagttacaggcaacaaagagaaagtaaattccaaaaatcttttcaaaaaagtagatttaaaaacaacaatgataacgctggaaagccagatcaaatcaagagttgtaacccccaaaattaacaaatctagagaagtgaaaaaaaaaattcctgtgctaaattagtttcattaaatggccatcaattcatgttaacttcctatggtggtaacactatcaaaaatgttttttcctatttcctttgtttctggtaacactattatctatctctatctatctatctatctatctatctatctatctatctatctatctatctgtcatctatctatctgtatttggaaaatatatttttagtataatatttaggcttcaaagcataaaagcctaatgttcaagttagacaaaaataatgaacttttttttaaagaaatgaagacccatgtacctaatataccctgcagttgtttgtgtgtgttgatgggaggttgcatgtgtatgaatgcttgtgcattgtgcatgtgcatgcttttctatgtgtgaatgtgcttttattatgtgtgcacacaccaaatatagtgtgtgtgtgtgtgtgtgtgtgtgtgtgtgtgtgatattttggcttacaatatattaacctatagcataataatgttaacctataaaattcatggcccttcacataaaaatctggattttcaacttcgcttagaagagagaaatatgggaaaataccaggccaacaatttgctatggaaatagtttgctggagctccgctctctttagactgtgtacattcctttgccatagtacttatttctcttattatctgccagattgagatgtttgttaacttttgtggaagcttggattatttaattgtaaatttaggagaaagatttttcttcatgcgtctatgaaaatatgaaaaaaaaggctagtggtctgtgcactttagataaatggtagtaagcactgttcttagtagaagtgaagaatatttattcctttttatattcaaggtgtgttgttgtgaaaagagtaaagacactgtttaaaaaataagtcacattaagatacatgccagaaattagaatttttaaatgactaaagaaggaaaaagagcaaccagaaataaaagtggcaagccagcatgttttattttagatgttgtgctgcatataagcccttctctttgaacacccatatctttttaaaaattatttttgtttttctttatttcttctaaaaaaaaaccaaaatgggatatatatacataatatgcagggttgttacataggtatacatgtgccgtggtggtttgctgcacctattgactcgtcctctaagttccctcccctctctcctcaccccccaacaggccctagtgtctttagtttcgctctctgtgtccatgtattctcactggtcaactacctattacgagtgagaacatgcagtgtttggttttctgttcctatgttagtttgtggaggatgatggcatctagcttcattcgtgtccctacgaaggacgtgatctaattctttttatggctgcatagtattccacgatgtataggtaccacattttcttcatccagtctatcactgatgggcatttgagctggttccatttctttgctattgtaaacagtgctgcaataaacaaatgtgtgcatgtgtctttatagtagaatgatttataatcctttgggtatatacccagtaatgggattgctgggtcaaatggttctggttctagatccttgaggaattgctatactgtctcccacaatggttgaactaatttacattcccatgaacagtgtaaaagagttcctatttctccacagccttgccagcatctattgtttcccaacattttaataatcaccattctgactggcatgagatcatatctcattgtggttttgatttgcagttctctgttgatcagtaacgttgagcttcttttcatatctctgttggccacataaatgtcttcttttgagaagtgttcatatcctttgcccactttttgatggggttgtttgtttttttttctcataaatttgtttaagttccttgtaaattctggatactagatgcttgtcagatgggggtagattgcaaaaattttatcccattctgtaggttgcctgctcactctaatgatagtttcttttgctgtgcagaagctctttagtttaattagatcccatttgtcaattttggcttgtgttgcaattgcttttggcatttttgtcgtgaagtctttgcctatgcctacatcctgaatggtattgcctaggttttcttctagggtttttatggttttgggttttacatttaagtctttaatctatcttgaattaatttttgtataagatatgatgcagtggtccagtttcaattttctgcatttttctagctagttttcccagcaccatttactgaataggagatcctttccccattgcttgttttttttcaggttttttgaagatcagatggttgtagatgtgtggtatttctgaggtctctgttttgttccattggtctatatgtcttttttggtgccagtaccatgctgttttggttaccatagtcttgtagtatagtttgaagtcacgtagtgtgatgcctccagctttgttctttttgcttaggattgttttggctataccgggacttctttgattccatatgaaatttagaatagtttttcctgtttctgcaaagaatgccaatggtagttcaatgggaatagcattgaatctgtaaattactttgggcagtatggccattttcaggtattgattcttcctatccatgagcatgggatgtttttccatttgtttgtatcctctcttattccttgggcattggtttgtagttctccttgaagaggtccttcacatcccttgttacctgtattcttaggaattttattctctttgtaacgattatgaatgggagttccttcatgatttggctctctgcttgtctacggttggtgtaaaggaatgcttatgatttttgcacattgattttgtatccagagactttgctgaagttgcttatcagcttaaggagttttgggctgagatgatggggttttctaaatatagaatcatgtcgtctgcaaagagagacaatttgatttcctctctttctatttgaatgccctttacttctttctcttgcctgatttccctggccagaacttccaatactatgttgaatagaattggtgagagagggcatccttgtttggtactggttttcaaagggaatgcttccagcttttgcccattcaatatgatattggctgtgagttagtcataaatagctcttattattttgagatatgttccatcaatacctagtttattgagagtttttaacatgaagggatgttgaattttatgaaaggccttttctgcatctattgagataatcatgtggtttttgtcattggttctgtttatgtgatggattacatttattgatttgcacatgttcaaccagtcttgcatcccagggatgaagccaacttgattgtggtggataagttttttgttgtgctgctggattcagtttgccagtattttactgaggattttcacatcgatgttcatcagggatatcgtcctgaagttgtcattttttgttgtatctcttcctggttttggtatcaggatgatgctggcctcataaaatgagtcagtgaagagtccccacttttcaattttttggaatactttcagaaagaatgatatgagctcctctttgtaccactgatcaaattcattggagaatctatctggtcccgaggtttttttgtttggtaggctattaattactgctccaatttcagaacttgctattgatctattcagggattcaacttcttcctgctttagccttgcgagggtgtatgtgtccaggaatttatctctttcttcttaattttctagtttattttcatggagctatttatagtattcttgatagtagtttgtttttctgtggggtcagtagtgataccctctatcattttttattgagcctgactcttctctcttttcttctttattggtctagctagtggtctattttgttaattgtttttcaaaaaaccagctcctggactcattgaatttttttttggaggacttttcatgtctctgtttccttcagttcttctctgatcttagttatttcttgtcttctgctagcttttggatttgttttctctctagcccttttacttgtgatgttagggtgtcaatttaagaactttctagctttctgatgtgggcatttagtgctataaatttccctcttaacaatgctttagctgtgtcccagaaattctggtacattgtctctttgttctcattgttttcaaagaacttcttgatttctgccttaatttcattatttacctgggagtcatgtaggagcaggttgctcagtttccatgtagctgtgtggttttgagtgaatttcataatcctgagttataatttgactgcactgtggtctgagagactgtttgttatgatttcagttattttgcgttagctggggagtgttttacttccaattatgtggtcgattttagagtaagtgccaggtggcactgagaagaatgtatattctggtgatttgggatatagtgttctgtagacatctactgggtccacctcatccagagctgagttcaagtcctgaatatccttgttaattttctgtcttattgacctgtctaatactgacagtggggtgttatagtctcacactattattgtgtggaagtctaagtctctttgtacatctctaagaacttgttttatgaatctgggtgctcctctattaggtgcatatatatttaaaatatttagctcttcctgttgaattgttccctttaccattatgtaatgcccttctttgtcttttttgatcgttgctggtttaaagtctgttttgtcagagaccaggattgcaatctctgcttttttttttgctttccatttgcttggtaaattttcctccatccctttattttgagcctatgtatgtctttgcacataagatgggtctcctgaatacagcaccccaatgggtcttgacaatttatccaatttgccaatttgtcttttaactgggatatttagctcatttatatttaaaattagtattgttatgtgtaaatttgatcctgttatgatgttatctggttattttgcacactagttgatgcagtttctttttagtgtcattggtctttatattttgttgtgttttgcagtggctagtacaggtttttccttcccatatttagtgcttccttcaggaacttttggagggcaggcctggtggtgatgaaatccctcaacatttgcttgtctggaaaggaatttatttctccttcacttatgaagcttagtttggctggatatgaaattctgggttgaaaattaattcatttaagaatgttgaatattggcccccaccctgttctggcttgtagggtttctacagagagatctgctgttggtctgatgggcttcccttcgtaggtgacctggcctttctctgtggctgtccttaacagtttttcctttatttcgaccttggagaatctgatgattatgtgtcttggggttgatcttcacatgaagtatcttagtggtgttctctgtatttcctgaatttgcatgttggcctatcttgccaggttggggaagttctcctggataatatcctgaagtgtgttttccagtttgtttccattctccccgtctccttccggtactccagtcaatcataggtttggtctttttatgaggtcccatatttcttggaggctttgttcattccttttcattctttttttttttttttctagtcttgtctgaatgtcttatttcagcaaggtggtcttcaacctctgatatcctttcttctgcttggttgattcagttattggtacttgtgtatgcttcacgaagttctcatgctgtttttcagctccatcaggtcatttatgttcctctctaaactggttattctagttagcaacccctctaaccttttatcaagtttctccgcatctttgtattgggttagaacaggctcctctagctcagcgtagtttcttgttgcccatcttctgaagcttacttctgtcaatttgtccatctgatcctctgtccagtctgtgtccttgatggaaataatgttgcgatcatttggagaagaggcactctggccttttgggttttcagcattctttcattcattctttttcatcttcgtgagtttgtctagattcaatttttgaggctgctaacccttggatgggttttgttgggggctttatttgttgttgatgctttgttgttgcttctgttagtttgttttactttcaatggtcaggtccctcttctgcagggctgctacagtttgttaggggttcacttcaggtcctattcatctgattcactcccacgcctggagatgtcactcaaggcggctatagaagaggaaagatgggtgtctgccctttcttctgggaactctgacctcgaggggctccaatctgatgccagtaggatcgcttctgtatagggtatctgacaacccctcttggatgatctcacacagttgggtgacatggagaaggggatgtatttaatgaagcactttgtccttggtggagagggtgtgctttgcttgtgggaaacccgctcatctgggctgctctgattcctcagaactaccaggaggaaaggctaagtctgctgctccggagactatggccacctctcccccaggggctcatttccagggagatccaggttctatccctgagcctctggctggagttattggagttcttgcaaggaagcccttcccaatgaggaaggatgggtcagggtcaacacacagatggccacagccggtgtgttgggctgtggaagaccaagctatccagcctccctggctgcatcaggggaaaagcccagtctggagctattgagatggatgccacccttctcctgctcagggagcttagtgtgttaggcagttgagagtctcagtgttggctgctgcccctccctcaaggagctcaactggcttagcaggcagtggcagccggtgctggtcacccctcccccctggagttccttagtcttcagcagattccagctgagaggctgttgagaatctgtgcattccagggttgggacactaggctccggtggcacgggtttgcgagtgggatcttctgatctgtgggttgcacagttccgtggagaaagcatggtttccccggctgggtagcacactcacttactgcctcccttagctagggagaggggtgtcgcttgctcagtgtgggtctcaggtgggctaccacactacactgttcttccttcctctcatggctcatgccaacctcttagtcagttttgatgagagaacctgaataccttggttgctggtgaaagattcacacaatgatcacaaggtcccacaataggccgtctgcaagctgaggaacaaggaaaccagttgtgactcaaagctgacaaacttgaagtcctatgttcaatggcatccagcacagaagaaagatgaaggctgggagcctgagccagtcttgaacacccatatcttaacaatctttttaagtttcaggaacttgaaatattatcattatcacctatgatgtgatatataataaatattctatcagtgttagtggaaggcaaggcctaaggaggttgaaatgtatataatcattttctcagccattcttgttgccagagtttgggcatgtgatttgagctacatctatcagatgcactgccctagactttgaattaagagtaaaaggttaaaccatttggggacaataagtatctctttctcttgttcaggctaattgcagcaagatggactctgaggtggcatgtgcttcatgccaattactgatctagtgctattagtgtcagtagaaccacatctagattacagtggagatggtcatggttttctcacctgttttgagcagtgatttgggacattgttactgacactgaaaactcaattagcggaagttagtttcttttatttcaactaagggcccttagagtcaactcaaattggtaccaaaaccctttcagattttcagaaaatcttcattagttacctggattaaaggcaagagaaataaaaagtactatacaggaatgagattctattagcttgtagtaagctatagacagattaaaccaaacattttccagaagtgtgtaacaaagggggcaggcttaagtgaaccataggtttaatcaagataatgatggccacagactctaataagggtaaaaagagaataaagaggtggtaggtttagtggattgtaacttcagattagtttgaagtccattggactaagtgttttagaaaaagttgtttgaaaagagtgggttttatttaaagaattgattattttaacaacaacaaaaaattagccaggcgtggtggtgcacacctgtaggcccagctactcaggaggttgagacaggagaactgcttgaacctgggaggcagaggttgcagtgagccaagatcccagtgctacactccagcctgggcaacagagtgagacttcttctaaaaataaattaaaaaaaagaaaaaacagaattgactattttaatttcagatgttggtatgtgtacagttctcctctgctgatacttgctctattcataccacacattttaattttacataggctgtaagtctattaattattgtctttttttaagcacaattatcttttaaatatatttaaataatgtgataaaagattattatacttacgcacttaccatttctgctatttcttgcatttttgtggggattcacagtgacatctggcatcatttttcttgctgaaggactaattttgacatttctttctcttagtcaggctaaggagttggctgagatgatgtggtctgacaagcaaaattgactttcttgtagtacagatctgctgtattgcttcagctttcctacttctgactttgtaagatttgtttcagcttttgcatgactgagaatgtcttgatttggtctttgtatttgaaaaatattccttttttcttttattactttaaataaattgcttcacaattttctcacttgaattgtttcaagtgagaaatctgctgtccagtttaatctgtacatgatgtgtctttttcctctggctatttttaagacgttatcactggttttaagccgtttaactaaggtgttgtgttgtgtttccatgcttgactttgaacttcttggatctgtgggttcatttattttccatttttttacaacatcaaaaaattgtttttattagttattaacataagaaaataaattaacattcagctattcattttaaaactttaatttaaagatataacttttttctgtgtttccaaagcaatagtttttgaatatttgtgtatgtggggtgtgtgtgtgtgtgtgtgtgtgtgtgtgtgtgtgtgtaatttagtgagtcttgactgctggatcatctcagtatctctcattcaccaggtaaatgatttcagtatctcagtatcattcataggctataactaacttctttatctggaagttatttacttaaactggctctgctataatataaaacacttatttagttgcatatttagctctggctatatggaaagtactttgtttttggagaactagaggttctccttagttagcataaatgtgtaaagcaatattgtgtccacagtatattgctcctgtggcttttcctaattttttggtcttcctactatcttaaaatgcagtaatagcatgtgcattgtctaacactatttgtacaatattgggaaatgtaatcttaaaatagatagagaagtcctaatagaaatactgtgaatatgccctaagaagtcacatagatttagtaagagacagttttcttcttcaatcaattaagattctattcccctaaagtaaatctatagattcaatttaaaaagggtatagtattcttctctatagttctcaccctccactaatatttctcaggatctcttcctgctgtaggtaatgaacatttattctagagcctgtcataacattaatcaacatacctaccttctagtgctattaaaaatttgcatctttttacttgcatttttttaatgtgaagtcaggtgctgtgatggttaaattgtgtgtctaacctgacttaacaatgggtgtccagatacttagtcaagcgttattctgggtgtttctgcgagggtgttttttgatgagttaagatttaaactgacagactgaataaaacagattaccctccataacatgagtgggccacattcaatcagttgaaggtttgaatagaacaaaaagcctggcccttcattataggagaaaaattcctcctgcctgaatgcttttgtgctggaacgttagtttttccttgcctctggacttgaaatgagacattcactcttcatgcatctcactcctgccaacagcagatcttgggatttgtctgcctccaaaatcatgtaaaccaattccccataagtctctttgtgtgtgtatacacacacacacacacacacacacacacacacacacatcctgttgcttatcttgttttctggagaactctaatacaagcatgggcttaagcaaaaatcttacagaatgaaattttgatttttcagcaacattcaacaacttagataaatggcaaatttcctaacttcatttgaagaactggcagcaaaacctattaatgttaccttgaaaagataaaaaaagtaaaacaatctagtaatgagagaataattcttaggaaaaaatatgtagcacgagcagcaagaaatatgctagttctgtccattgaacattcaaatatggtgacattggcagctttgataaaatataaaatgactagggaacttagttccaccccaaaagacaggcaagagaaatacctgctgtttctcttggcacagttaatagtaaaaagtatctgccaataaaagcttggaagtatctctaagcatcagaattctaccaaaatttattttcatataattttgattttgtttaaacaaagtaggaggaaatattaaaagacattgttttacaatgataaagggttatcgaagaacgaattcctttttttttgaggagttttagtatgagttgtctcaagtgcatcagtattcccagactaaataataactatttgatgtgcatgcacattatggagcagtgataaatgtgcgctactctcttctttccgaaaacagcagcattccctccattctgatgcttacacttactctcaaagccaacatgtgtattattcattgtaaagatatggttatattctaacggcaatcacattttttaaactacacgtcatatcattgttcatggatagtggtggtcatgtttgaattgttaaaattttaatggttttattctatttatctgcatagatcctaccttactgaccaatttacactgagttgtttagtctattctgctttcttttttgagggaaaaataatgcattactatacaaaaaaaaataacatgatccaagtggcctacctttctagaacatttgtgaaaaaatattaattaatattcatttattaaatcaaatcagtggagatgtttttctattaagaatttattcttagtctttgtggaataaaaaaatgctcttttaatgtcttttcttgtatacacctggaatgttttatctgcttctgagctcccactgggaacatcacatgtgtctccttgtctctctctctctcttttcttttaattccagataaaacttctctgctttcatgaaggtctcttaagtaaaaatgataatagttctaatctcttgaggacctactaatagaatgaaacaatactgtatcatattgtcattaatcctataaacaattcttccatcttgtcattattattctcatattcaaatgagaaaattaagaaataaagctgttaaatatcttatcaaaattcataaaacatgatttatatttatttgtattttggtgttaatcctttctagctcctagtacattttttgactacatgttctctttcatttagtaagctgtgagcttccttaacatgtaaaatatgtcttattcatatttctatcactatcatgccttctttatgacctgaaattcagtatgtggttacacacgcattgaataaaagtgaaataacataaaatatatttatgagtctgattttctcttttttaaagtctgagtgactttgtcacagcaaatacttgttaaaatatttcatacacattaaattaacataaattatgtgtattattcctatttaataatgtgtgaattttagtttttgaatttaagaattaactggtaagacaaaaacaatcattgttagataagactgacaaaaaaaaaaacaagacaattaaggtcccattcttccaagtggaaggcagttgaaactgggctctttaaaaaaatttgagcaaggcttacagagaaactgtgtgattatgatattacaaggtcctcaaaaactgtttggagaagaaataatattaagagtcttttttttctttaacagtactgagttgggagatacatatttcttatgtcctactgaaaaataaaacacacctcagggaaaaaattcagattaacactctcttactctttctgatagtctgggtccatctttcctaaaattctagggctgatgttcagttttctctaaatataactgcaatgccctaaagccactgcaaatggagttttccagttttataataatagtgtaagaaagtatgataagagtatagaaacagtgtccctatatttatttctaaacaaattaaatgaacaaatcataactggactttttattttctatatattatattttgctttttaaagtagaaactttacttttcaactgcttttctgttagctttgatgttctctgatactctcattttgctatggacaaataggaattataaaggatgttcagtcactgatttcaagtaatagccaattttttggaagaaaagggacatatatttaaaaaattttctacacatataaaataaaaacacacctcaggggaaaaatatatatacatatatattctccagaaaccttatataatttacagtgatgcaaattggcatatattgtaatgattatgagtgatatatgattaatatctataaagctcaaaaattcaggagtattcaggggtcttttttattttgtaagttgtcagggtttaccaagtattaagaaatgtgtctaattttgagcagttttgcttcctgcagtaaaatgtgtgtgtgtatgtgtgtgtctcctatcatagcacggatgatttttatgtgactctattggaatcctataattgttgaaatgaagaaaacacatgctttatggcctggctgcttttgtatagtaaaacttaaccattgaatcaatcttaatttatgaaattatacttggaattttgtctcaagtaagctagagatccacaagtcttgtgtgtatgataagcaacctggcaaatgcaaatgcctggaatctatgctcagagttctgacattttggccatgtatttggcctagacatctgcattttagttttctgtccatgcaagaaatcctgacgtaggtggctagtagagaacttcctgagcagcactaccctatgccgtcagatgagagcagggttctggctatcttacctactgccatatctacagcaacttgcacagttttttttttttttttttaatggaaagaatgagattgtcttaagagaagcttagttcattaagtaggtgtttatttagtaatttaaaaatgccctttatttatggaatttgaatatttatactgggattatggattcaattttgggaatgcggcaataaaacaagatttctacctatcaggaaatatatgagaaattgttaatacaatttgaacattaaaataggcatgggcatgaaacagaaggaaatcatgtcctttgcagcaacatgtctgcagctggaggccactatcctaagcaaattaatgtagaaacaaaaatccaaaaatcacatattctgacttatagatgggaactaaacattaggtactcatggacataaaagtggcaacgatagatactgggggatatggaggtgagagagagggagggggaagggttgaaaaactaatgttgggcactatgcttaatacctgggtgacgtgatcatttgggcaggctttagcatcacacaatatatccatgttacaaacctgaacatgtaccccttgaatctaaaataaaagttgaaattatttaaaacatgtaaaacattttttaaagtgattgaactatattcagaactcgacagatttgaagagataaaacctatactaaatttcacaatatcattggggcccctggattgatatataacaaataatttaatagtgtataaatccctactgttccaatttatcccatccttatcccatccttataaggaataatgtattgaataaagattgtatcagtatttgtaattcaataaaccagaacttgtggaaataaatatgtaggagacataaatatggtgtcctcaaattgaattatgtgggaaaaaagtggggtggagttaaagtccaagccaataaagtttgtaacattaaagaaagacaggtatgggatgcaaggtgcaaagaaaaggtcatcatatctcatactggggtgagatagaagacttcctgaagtaggcgatgcctatattgaatctataaggacaaactggcatcaatatgtcagggaagacaggttgaaggtggtcctgccagagaaaggagcaaggataaaggcaaggaagcatgtaacgtcattgtttgtggagaaacctcaaatcggctgaggaaaaacgactcaggtatgtagtagggcacagtatgaggaggaatatggcaggagatacaactaaacagagacgcagagactagatcaatgtgaggaaggacaagttacaattctaacttgatgtttactctgtatatgatagggtcacacaaactgtggaaaatctattgtgttcacatcaaaattatagctctggcaaaggaggagatacatagatacatacagaagctgaccggatgaacactcattttctttacttgggtcacctcccaagggaagaaaagaggcggtttaccaggtctaataactgtgtcatctggactctaggttgaaagacaagtgatatttgctaggaagaagaaactttatctttgaagtgcctttagcagaatgtccttggttaaggattgcctatagtaaagagtatctatggatttatgaaccatggctccctggagtagttagtgcaagctgtacaacaccttgttgtacaaaacagaaatgtttgaaaactcacatactctttctgctgttagctctcttggagacctcatctattactctgtagagaaggacacatttctgttgtgggaaaacaggacatagggagctgctcttgatgttccaggcccctctctgcttcatctgagcctattgactgatgatggcacccttcaaattattagtaaagcttgatattaagcaagatatttgatttgtattagtctgatttgacagttcaattattaacgtcgtcccatgtactgggtagccaatttagtatagaataatgcaattattgttttaagcaggaaaagtgcagaaatatacttagaaaaataaatgtttatttgtgctatactgaaattttcctggtcctcaaaaaaggaagaggggataagggtaatatttactttttatcatcataaaaatgggaaaaactaagaatatttggtggatgagacaaagaagcaaagacaaaaccatttatgatctgtttctgattactgatgatacatttccttccataattaagtgaaaactagaaatgtcatatttaaagagaagtaaatattaaataggaattatagctgagttcatctgagaagcagtcctgaggaaaaactcaaaggttgaaatgaagggtggggtaacaaagaatgaaattgcttttacagtggaaaatcactttcttggcgttaataaataaaacttagaatactgagttaattcctgcatacttgtatctcttacaaaactggttagctattacaaataagctacataagttattcatccatatcccttcacatattctatatattggactgctttatagagagaattacaaaattgggataaaattaggctcattctattggtatagtgactttttgcaagccagcttttctgcttggcagttatggctgcttgcttcattgattgccctcgctgacacttgctgcttccaaaggggacaggatatgtccaaatgggggtaaacagaaagtaccttgtttggtactatgtttaaaatgcaattaagtaaaaagaagaaataatgctactaatgcttttgccccgggatcttataacaccacagaaaatatagcttaatgcaggaaaagcctcttcagaggctaagtcatgaagtcattttggcaggaagaaaaaaaaaggaaaaaataaataaagcaaagaagaactcatagattgatattgtgtaaatccggagagttaacatcaagatcttaaaaatcaattctctgctttattgagacctagtggaattatctaaatacagaggaggtaatgtgatggaaagtccccgttcctggcaagatgagaggcattcaagtctgctgtaactacaagtaaatcacaggaaaagaaaaactgaatcagtaaataaaatgaaagaaaaaagcagagcaaaaaggaaagattccaaacattttggactttttctacagacacatgatagcaatagtataacataaagcttaaatatacggtgcaattaaataaaatcaaaggcaagacctgttaaagttaaccaccaatactttgtgctggaaaaggcaggtaaatggagctccagttgtacaaatatatcaatgcctacaaaatatatcaaatgttacacttatttgtacatggagacatctatttacgaaaaaaatgaatcaagcatcagatgttgtgtgcagcctggaaaacaattaagtttcaaaattcttctcatttaatctatttgtcggagagatttactgctctaaaaagacatgtttttctttcttttttttttttggcagtatcaaccaatcaacctgaatcttagacaaattgaaagtttttatctaatcggtttatatacatatatgaatagacacatattttaaaataataaataaatgtgctgaggtactatttttagaaagtaagttattgaatatgtttttgttttctaagcattcaggttttgcacctttaaataacatgactcttttttcctccctatcactttttcctttctttctttcctcctttgtttccccttccttcctttctcccttccttcttcctttcctcccttcccttctttccttctttcctcccttcctcccttgctttttcttttttttcttaaaacagtattaccactagacattattattcaaaaacaccaatatttagtctaataatctttactgccaaggaaataagattcaagaatataaaataagttcttaaattttaacacaagaagtgacaaagtcaagtgtaaataattatattacagtaactgaaatatttatttatttagtttgggggtaagaaattcatttttatcatgctttttcaaaactacatctatagagaaaaaaaactattgcttcaaagtcacacctcatttcaacccaaatataatattcctcatggctttaccctgctaattatacctcccaaaccctcttatgtgtttaaatgcaaagtatttattaatgatctatagaggctatttgtctatttgttgtggtatattttcataacaaatagtttaagatacagttttctgcagctttatcagtggccttttctggaccatactgtctctctctccgtgtgtgtgtgtgtgtgtgtgtgtgtgtatgcacacatatgtgcaccctcctttgtgtgtgtgtgtgcgcatgtatataggcacaaaggcatatatatggaggaatatatatgtatatatatgtgtgtatatatacatacattctataccttttaacttcattttctttgtaaatgcagagttaaataatttcattgtttttgtttgtttgtttgttttgaggtggggttttgctcttgtagcccaggctgaagggccgtggcactatctcggctcaatgcaaactctgcctcctggattcaagtgattctcctgcttcagcctcccaagtagctgggattacaggtgcctgccactatgcccagctaacttttgtatttttagtggagctggggtttcaccatgttggccaggctggtctcaaattcctgacatcaggtgatccatctgcgttggcctcccgaagtgcttgcattaaaggcatgaggcactgcacctggcccattgttttgattttattggtatgaatgcaaacttcaatttttcaaaaccatttcaatcttctaaaaactttcactgaaaggttaaatttcagtccttcatatcttaattcaccaagtgcaatcaatattcttgttctgaagtaatagagacggtatctgaaatgagaaaaattaagaaaacaagctgcctcattatgaggaacttggaattctagaggtgagtggataaaataaatagtcatgttttgaattgcatataacccccccacacacacacacaccattggtttgagatttagatgttggttttctataattaaaatacagaaagtctagtcttattgttggatgaataaaatactctccctgattcctgattatcctgcacaattagagctactgcttatggagagacatttgacaaaatgggtagacgagagtaggtagagaatgtttagtcctattttttcaatagtagtctctggtattatctttaaatagtactctctggtattaatatgcattgttaatagaattaatactattatgcaacaccataaaatgtatacagatattattttatagccccatcatgtttagatgtttatttgccacaactattttgttgcacccttgttatcataattttcattacatagtaaattacttaaaattagtttatcttttaaaaactaactggaccacataatttaaaggacacagaacattctattatgatttctaagttaaaataaagatttgaaaaaaaactcagatgtgatcttgaagtaaggacaaatacattgactgggacattctatgtaaatattatgcaattgatttatggcatgaggttgagggcgtggaagcaaactttaaatagatgcaatcaaataaaaggacaacactcaattaattcctgccttctacattttgccacacagtgcttcaattccttcactaatatctgcagctggtttgtttcggatcataatgaccatcatgactgttgattgtttttggtgaaaaattactttctattgatttgtttaaatatgaccttttatctttctaaccaatatgaaaaactaatctttatatttttgtaatttgcagtagccctaaacagaatcaaaggacaaatatactgctcagcttatttcagatctaataacaataacaagaagatttttaacaccttaggacaattgtttctttcttttctttttttttttttttttttgagacagagtttcactctttgttgcccaggctggagtgcaatggcgtgatctcagctcactgtaacctctgcctcccaggttcaagtgattcactgcctcagcctcccgagtagctgggattacaggtgcctgccaccacgcccagctaattctttgtatttttttgtagagacagtgtttctccacattggccaggctggtcttgaactcctgaccttaggtgatccacccgcttcagcctcctaaagttctggggttacaggcatgagccaccgggcgcagcctgtttcattttatagggtagttagcaaaccaaactcttgatactctcaagattcaaataaggtaaagagaatagtctgtagcttgaggttggttaccttttttgcatgctgcagagtgtgagccaccagtcaagatcaggatcttttaaaataggaatttggaaattctaaaaattatgagaaaatcatgcacttttatatggcctacaatgtaatcagcttcttcatggcaatgataatttagaaatatcttaaatatttgtttgtggtaaaaatataattaattcaagaaaaaaatgcagctctcttagctattcagttgtaaaaggacctagagtataaaaagagacagaattagtaatcactaagattcatttttctagactgaacttagctatgcatgtatttacctgttatactctgaaatcatttgcttataatgaacacttaaactcatgcactaagacaaatgaagagtgttttgacaaacctacaaaaatctgaaataaaatattttaaatgaatttaaacataggaagaaagcttattgtatcttaaaactcctacagtatgcttattgcatatttataaaatgagatttatttttagggggtggaaatttaaataaattaagagagggaaagaaataaagcaacaaattttcaacgtataaaactctatttttagtaaatgccattgttaaatgcaatttttggagatttttttttctcctacaaatgttaaggccaagtatggtaaaaagtgtaatattataattataatgctgtaaaatattttaacatatgcattataatataagtattctttaaagtactctatgtgttaggcatctttgtttttatttttctggtgtttcttctacagataatttttttccaagtatcccaagcatagtttcgatgaggctcctttttttttttttcttaaaataactgttcccttagattatccattcgggctgctataataaaatcccacagaatgggtgaattataaactatagaaatttatttctcacagatctgagagctgagaagtccaagatgaagtctctggcagatttgatgtctggtaaagactttctttctcatagatggcaccttcttgctcctaatcaccaccccagatgccctgcttcttatactataacgttgagggttagaatttcaacatctgaatattttgtggggtacaaacattcagaccatagcacctgtctatacactctctgggctccacctctgtcctaccttgagtcattaagtgatttgcagtgttgctaaagtttttaatttaattaatttaattcaagatagtgtgagtaattataattaaaaacaaaaattttccaatctggaaaactccacagtaatagtggagaaagatagcatctttaccattggataagtacagtcatgaactgcatatatgccagcggtgctgtagattgtaacactttatttttactgtacattttttacttttagatatgtttagatacacaaataccgttgtgttacagtggtctatagtagcatgctgtacaagtttgcagcctatgagcaataggctataccagatagtttgggtgtatggtaggccataccatctaggtttgtgtaagtacactctacgatgtttgtacaattacagaattgcctaaggacacattctcaaatgtgtcgccatcgttgagcaaacacagctctattaaatgagagtataacgaacatcacaggcaatccgctaaaagattgtaaatctcactcttgtacatagccaagcagatataacccattacatatatgttttcaagataaaaaatagtctttaagtaagagcacttgatagtactatttatcacatgtagtttatcctaactttacctggcaattgtggtgaccacctgtgttagcttattgactttatctggaggaaaaacaggcttatcaggttttcatggcagaaggtaattttacaacttaaagcttggtatccactgacattaggtttctaccctcccaagaaactgggagatatgggtgctatctctcttgatgtttacatgtcagagagatgtttcaggtctttgagaaagacattattgggtcataaagttgacaaaaggccaatctagtcttcgaaaggatttatatacatttcaaaaaacagaaagtgtgtacttataagttttaaagtaaatgcccaaagaaaaagggagaaaggaaaatcttttcccttattttcaacagagaattaagcccctagttttaaatttgtatttggtccttacaatagaatagtagaatctatgtgtttgacttttcttaaaaacatttttatgatgatttgccaatgtttcctttaaaaagtttgtcctgaggagtcatgctgtgctttcttcaattttatttttaattctctcacttgcctctctgtaggtcaaatagaaaatatatatattttaataagttaaaagtcaattgataaaaatgtaatttctgattcaaaatttatccttctgctttataatttattttcatttaatcagtggatgtttgattttagcatggtgagaaagaagctaatttaaaaactcaaattgaaatctcagcattgcacagtgtttgatcagagtcacattaatcacagttcatgtcaaatttctcaatgctgtaaagtatcattctgaataatgacttgctctccagggttcttagttattaaaatagaagttgaggaatgggctatagcatttctataatcatgggtttcacagtatgcattttagtaataaagatgaaggagtaagatttttgatactttttcagagtattctcattcaatacacatgtatcttgaaattatatttgatcaaaagttgtttgacttgggaactatcttctgttcagagcttgttttcttctaattacaattagcagttactgatgctacaatattcctttatgaagccaagaactgaaccaaaatacaaacaacataaactaccacttgatgagaagaacttcaaagtcaaattgcaaaaggtgactaaaaaaggggagtactttcagccgttttcaaaataatctatgatatgtactggaaaacttctaataatccttgtcattttacaagtaagtagagagtaatagaaaattcacccttaatagaaaaaatgtaatcataggattaaatttaaatcaatgacaaattatagtaataaatgaacactaggttgaatgttttgaaatcttagaggtttaaaatagataaattcctttaagtgagccaattctgtttccatttatgagtagaaattcaaaataatgttgataatttttatatatacattaaatatcttttattcctagaccaaaattcatttatgaccttcagagatcgtataagtgcttttgagaaaagaatttaaatattatgtggtcatatggagaatgaagtgcttgtactgtaaaaggaagctataacaatttcctgacttctgtgctatcaaataatattataaatgtatatttatttttatatgccattttttgagacagcttaaatagaatactaagtaacaatttatattgtaaatcacaaatactttgctattaagaaataatgtatataatacttgaatgatttagtatcttttttaataatataggattttcttaaagctttgtctctgaataagactctttcaaagtatttttaatcatcattatgctgtgtaatcctctgcagtactgaaatggaatctcatttcattataagcatattagtttcttagaatcacacacaaaaatctaatttataacacaactacttagaatttcatggttgggaaaaatatataggacttgtctatggagttatttagatatctagcaaataaaataattttataaaaagtactcacattttgaataacaatttggacaatggaaaataagtgaaagaaagctaaagtatttttaaaaataccctgtatacaggtagttcatgcataaaacagaaatgtaatggaatgattttgaattttttgcattaactatttatacctgcatttatctcttacaaatctctaccatagtcagtaaactctgagtactagagaaagagaagagctaaaattagaatagagataacaagtttatgccgcagttctgcttttcctatgtatatttttaactcatcaggctcatcattgaatgacaataatagtgtatattattatcgcatttttgaggaaactacatactgtgttccatagtgagtgtaccatcctacattcctatcaatcgtgtataagggttctaatttctccacatcctcactgacacttgttatcttttttttttttataatagtcatcataacagatgagaggtgataattcattgtggtttatatttgcatttttctgatgattagtggtattgagtatcttttcatgtaactgttggacatttgtatgttttctttggagaaatgtctatttaagccctttgctcatttttaaattaggttttcttttctttttctttttttttcttttgctattgagttgtaggatatccttacacattctgctcatatagtttgaatattaaccaaaccatgagatagatggtgtgcaaatagtttctcccatttcatatgatgtctttttcattcttgatcattttctttcctgtacagaagcttttcaatatgaagtagtcccatttattttgaggggttttgttgtctgcgttatcagtgtcaaattcaggaaataattgcccagacaaatgtcaagaaatttttcccttgtgttttctttgagaagtttttcagtttcagatcttacatttgtctttaatacattttgagttgactttcatatatcgtgtaagataggggtccaatttcatccttttgcatatggaaattcagtttccctagcattatttgtttaagagactataatttttcccatgtattcttggcacccttgttgatcaactgaaaatatttacatccatttatttctagggtctctattttgctacattggtttatatttttgtctttataccaatatcatactatttaaattactgtagctttgtaatatattttaaagtaagtaagtgcaatgcctccagctttttcttctttcccaagactactttggttatttggagttttttgtggttccatatgaatttaaaaattggtttttcctatttctgtgaaaaatgacattgaaatttgataggattatattaaatctgtagatcacttaaatagtacagatattttaataatattaattcttcccaacaaacaacatgggatgttttccttttatttgtgtttaatttctttcatcagtgtttaataatgttttgtttttgttttttatttttatgttttttagtctttagggttttctatatacaagaacatgtcatctgcaaacagagacattttaaattcttcttttccaatatgggtgccttttattgcctaattgctgtagctaagatttctagtactgagttgaatggaagtagtaagactgagcattttcatgttgttgctgattttataagttccctgacttcctacaacagaacagcttttattttttcacaattgagtataatgttagctgtggatttcttatatgtggactttatgatgttgtggtacatttcttgtatacccaattcgtcaagcatttttatcatgaaaaggtgtaaaatgttgttgaatgctttttctacatctgtggatgactgtgtagtttttatccttcatgttgttaaaatgatgtagcacatttattgattgtcttttgaacaatccttgctccttgggataaatcacacttgattacggtgtataatctctttaatgtatttccatgaattttgtaaatcaaactacaattaagctttcatctctaccagtacaacaaaacagtctttgccaactcagcaatgatcttcactttgatataccacgtttcattcttagtcttttattacttctgtcaatagaatttgatacagttgcccacttcctcattcttcaaacacttttgcacattttccttggttcatttcctatatcattagttgctgtttttctgtcttctttgctgttctcttctaacttgtttactttacagtacccaaggttcaacctatgaaccccttctcttttctagtgtcactcactgtttcttattgacattgctttaagtgttgtcttaaagttttatgactttctactatacttatccagccctgatattatccctcatgtacagactggtatataaattgtcgagttgacattttcagtcaggtatacaaaagcacccaagaactagcattcaaaagttacctttttattttcatgtcttatattgcaatttttgcaaccatatccatctcagaaaatgtaactcaaatattctaattgatagaaataaaaaatgtggaattacagtgggctggtctctttctttcacatcacttcttagtaaatattgtaggcccactttaaaatgtattccaaatcagagtgattttcactaccactacaaccctggcctaagctgccatcattcatatctgtattactgcaataactttctcacctatctcattccttctgcccttgtcctcctgtagtgtattcttcatagagcagtctatctgatttaaatctcatcatatcacccctctgtccaaaagtcgttagtagctttcatcatactcagaggaaataaagtgtctaacaaggctgtatcagttcatttcctagtggcaacagatggcctattcaaactagataactgaatctatttacagaggtctgattagtgtttatggagaccaacacagtagaaagtggtcttggccagtcgcagtggctcacgcctgtaatcccagcactttgggaggctgagatgggtggatcgcgaggtcaggagtttaataccagcctggctaagatggtgaaaccccatctctactaaaaatacaaaaaaattagccgggtgtggtggcaggtgcctgtaatcccagctactggggagaccgaggcagagaattgcttgaaccctggaggctgaggttgcagtgagccaagatcacaccactgcactccagcctgggtgacagagcgagatgctgtcacaaaaaaaaaaaaaaaagaaagaaaaaggaaaaaagaaagtacagtcttctgggttttgtaggtggaatttttttagagaagtagattctgagactgagtttggcatacaggatgtttattaaggagtgctctcagatccaggaccaacagctgtggaaaagaaaaaaaaggaaaaaaccaacattggatagagataagattccagcacaatgtgagctcaagacaaccacagctaaccatgtggtagtagctcagtagctaaaatcagagttgcttgagttatgctgccccagaggaggtggaggtgggtaacgcattctttgtcgaagggcaatctgagtgaagcattgcagtttccaccataaaagaaggtctaggcctgccagttaataaaaagaaagaattacttgtaccaagaatgtggagatgtttactttatagtagcttagtgtttagtaaaaggatgctatcatcctaagccaagcaatgggattaagccaggacaaaaatatacttatctgcctttcctttagcttctagcctccaacaggtaccccctccccacccacccattgctcaatccagatatcaaaactgcctgttgaggtagtacatacaggcttgactgctggtttctaagacaagatagacaagggtcgtgagtaaatacaataaaaaatagaagaatgtttgcttctggatcagcattttttaaagatttattttacctttactgctgctataccatatttccttctagagtccatctgtttccaattaggaaaacaaagtttacatcagatagtttcatagagaaaatacagggaacgaattacagatagaaaaactgaaagttcaaactggggaaattgaggaaacggtatttgtaactgtaggaagctgcaacctaagacaggaagaatcaaattacaaggtgttattactggagaccagaagttggtgccacctattataggcttgatccattgtagggatgccagattggagctggaccatagagatgacacaattattttagagaagctgtctaaatgggtagtgatgctctctgcattttcccttctcctcctctgtaatattcctgagcaaaagctcacaggaagacaaaggggaggggaatctagaaaatgcagaggcagagaactgacataagatagaaaaagaaaattaccagccaattcctcttctctcctttctgactttacttgcttctctcaaaacagcatcatgactaaagcttatgttccagatcagttgcaccaggattcttgctctgccacttactagtgtgagccctaatgacctattttagctaccttacttgccacttatctagtaaatggatatggtaataatacgacctgcatactaaaatggctataggaattaaaagagaaaatgcacataaagttcctgaacagtgtcaggcatacaaacaatttaatacattccagctgctattattttgtccctgtaaatgttaagataagtctgagagaagacctagtttctaaggagaaaagattgggaaacagcatttggattccaggaaggttgcagttctgattatttgtatagtttttagtagtgtctcaactctgatctagtatcacatcagaatcatctagggatcttgttaaaaatgaatatcttgggcaacatcaattccaagtgtaatataatgaataggggcatagaacatttaacaagtttttcaagtaatactatgcacaaaaacttaagaaacagtgccaaatgaaccctgagaaaacaactcccccttcctttttatctcccatttactgaatgagctgcatatggaggtacttggatttgtaagtgattgcatgggcatctcttccgggatccaggtaacaggtttcactatcaagtcatcacaaatttggaactggtttatgtttgaactttggtgcttcttgtaaatttttctctcccctttggctattttcactcttactggagacaacaaaaacagcaataccgtatttgtgcttttcttaatatccaagggagtgataaagttggtcaagctgacctcacaatattttgataggttttgttgctgttgtttttaaaagaacactgtttttagagaacaagcatctaacctattttacatgaaaactcaaatatcacggattcaccaaaatctttaaaaaatactcaaatcaaatgtgtctgctgaattgttgtgattctttacttctttgcaggtacacagctttttcttgttttaaaaaaattttatgtatcaagtttttctcacatgacacataatcacagaatttccactcattaagcctcatactttatactgttaaaaattagtttttataattaaaacccagaaaaattatactgaagaatggaatacttttaaaagtgtaaaatagtatctgtaatctgaggatgtggtgttttcttctcaatcatataatccagtgttttctgttcaatcctagatttataaaataagtatagtgttatttatgttgctgctttagtgcagcaggaataaagaccatttcacgatgggaaaaactgaacatattagtggaatgattgactcatggggtatcagacatatcaagtaagctaaaagcaagattagtaaacaatgatttcatttcatgttttattcaagttaaatcaaatttatcataattgaaatagttttactgatttcagtcattgaaatgactccctgatcacagtcaaattaaaaatattctatacagtatgcacatttatgaaactcccaaaggatccaacttacacttaatttctagacttcgctccactgattataacttgtatatttccttcatcttcatgtgaaataagttaggagtggaattatttagagtttatcacaatttttaggcatacttagaacttgtcttaatctattgcatttgtttttttgtatctgacatcccacataacattgatggctctcagaattttttttttttaagtattttccatctggtgtacttaggctttgacacagacccatagaaatttcctggtgaataacaatatatatgactttagttgctccaaagatcatgattattattccagtttctccttcttgtggaataacaaggaaaattcagcaaaattattacttctaaatgtgttccataaaccattgttaaatcaccatgtctcaacagcctgtcttctttcaaagtttacacaccatttatttaaaacacacccgaaacactctcatctactactgtccaggatagttgctgacctgctaaaaaaaactttagcacaacattcatgtctccatcccagtctctgtcttttctttgtttacatcaacagaagaattgatcattttaaagtatgtttgatatacattgacttcttccccacttatgagtatttcatctatttcttttcaactatccttagattgaaataacacaaaatatttttagatagaaccagtctacttctaatatttaaaataacgtatgctataatttcatttcttctacactaagcacaccataggctcttctaaaaaaaaacccactggttgctaatattccacaaaattaagtgaaaattttctgactgatatggagacttatctacaaactgacctaaatttatctttctaatctgtgtcccaataatataaataatctaggaatttatttataattcccagactgtagtggccattttatagccaatgcttgcatattgtttttggctgacatgttctcctctaccaaaaaaggacttactcttgtctatgttctaatattctttaagaaaatatttaaatatgaggatcctatagaggatgtcttaacagcaaaataagtactatttacattattgttggaagtagtaatcgtatttataggtaagaaaaagaacatgaacaaattttctgttatttaaggctgttaagaatgtttactatctctggaacataatagatattctcctcaaatatgtaaattcagataacaataaatgacatgaagcaaatgataactaaaaataaatatttttctttccattgcaatagctttcccacagttagatcatcagcaaatgtcacttggatccctagctaaattgttcttcccagaaaatagttatctccactatggtaagagttgtcgttataaaatttaaaaacaattatagcatacctttaataattaaacatttaacatttgagtgatttcacattactgaaatatggattccagtttatgaatgtggcttccaaggctttgaggatattttatactatttaactcttttccactcttctttttaatatccacccttgaattctatctccattttcaccagacatcttgtagttattctaatatcttatgttctttcactcctggccttggcacagtttattttcttaatctagaagataattttctattcccccacaatattttttgtttaactcataattttttaattttatttcaaatgctagtctagatatcacttcatttatgaatccattccttactttagaagccattctaagtactacagtaacactgcacttccagtgttataaatatcatactctttaatatttgcttatcttcttcctctggtatagtatttgttcactcagcccgggtagcatacatcgagtgtgctttgctgattccttatcacccaagataattttaggaacattgtaatcctccagtcaacctttgctatataaatggatgtggattagtggataaaggtttaaaattcatgaaattttggattgtagattaagcttgaaaatttggggaagggacttcccttctccatatacacattgtattactcctttgtgttgttgtaaatacatatttaaggcttagtaatttacaaagaaaagagatttattcagctcacagttgttctgcaggctgtacaagaagcatggtgctggtgtgtacattgggtgagtgcctcaagctgtttccactcatgaagaaatgggaaggggaatccatgcatgcagagatcacatggtgagagaggaagtaagagagagagaggaagtgccaggctcttttgaacaaccagctctcttgggagctagtagagtgagaactcattcattactgtgaggacagcaccaacacattcatgaggtctccaccttgtaatccaaacacttccctctaggccctaccgctaacattgaagattaaatttcagtgtgaaatttggagggacaaacatccaaactatagcacacaaacataactgaaaacatgtttaattaaatatatgggacttaagtcaagtgcctatggcggaaagaactgtcaaatggtttggagtgttaggctgtcaatagtgatgcatatatccctaataaaatcaagaaagaagccaaaatttcactaagccacagcccttttacagagaagtttgtattaaccattggaaataatctgctctaaaaatctagatactttcatgtacaggaatgctgcaagggtaattccttgtccaggaatgaaaaagcagagaatacctggtgttcctgaacaaagtaactcttctttactccaaggaaccatggcccaataaagcttactagaaaagtaggttaaaagaaaataatgaaataaaataaaataaaatattagagagtgtatttgataagtactagaaaaatctaaagatggcaaatttcattaagcattccaagcatctatgtcaaggcatagctgagaggatctctgctctcagaactttctctaaactaataggcataactgtgtgtatgtgtttttcagttttcttatcatcctgctcagacatcttcattcaagcttaccatgcatgaacaagatttgtttatcaaacaacttccttaatatatctaagatctggaggactagtaacccatatatgatgtgttgataccctcaacagaatgcctagcttggtgtttattgttgtaaaattaattgaatttttattcttctttctcaatatgtttctttttttatttatctcaactggttgcctaagtttctattttttactctaaccttcaccatcacagttcatttattttctgcctaaaatatcaaatatcaatcactgatggtttttcagctgcatgtaaagatactttcatctggtggtggcaactgtgacagggggcggagccgcctggatcacactttgtctgtggaggcagtattctaaaatgtcaatttatgaaaatcagcaatcctaagaggactcatagaccctctgaaggagggagactgctcctgcaggacccaggagacaccacaaatactgtgagtgccccaacggtggaagtgggtaagggagagcctcctctcccgaacacacacacccactggagaaactgaagaagtcacagcaatacctgcccaaggagagtctgagctcagacacactgagccctgtcccctcctgatgatccttccctacccaccctggtagtggaagacaaagggcatataatcttgagagttctagggccccacccaacactggttcctctccatactaccacagctgatgctttctggaaagtgccaactcccagcaagatgccaaccagcacaaaaatggagctttaaaccgccaaagctaagaacgctcatggagtctattaaccccccctctccccaccacttccacttgaacaggtgctggtatccacagctgagagacccatagaaggctcacatcacaggactctgcagacaacccccagtaccagcctggaggcaggtagaccttcttggtggctagacacagaagagagataacaatcactgcagcttggctcacaggaagccacaccataggaaaagggggtacatcaaaggaagaccctgtgggacaaaagaatctaaacaacagccttcagccctagaccttccctctgacagagcctacccaaatgagaaggaaccagaaaaccaactctggtaatatgacaaaacaaggctcattaacacccccaatatcacactagctcaccagcaatgtatccaaaccaagaagagatctctgatttatctgaaaacagttcaggaggttagttactaagctaatcagggaggcaccagagaaaggcaaagcccaatgcaaggaaatcaaaaaaataatacagaagtgaagggagaaatattcaaggaaatagatgatagcttaaagaaaaaaaaattcaggaaacattggacacacttatagaaatgcaaaatgctttggaaagttctcagtaatagaattgaataagtagaagaaagaaattcagagctcaaagacaagatctttgaattaacccaatccaacaaagacaaagaaaaaaagaataagaaaatatgaacaaagactccaagaagtctgggattatgttaaatgatcaaacctaagaataattggtgttcctgaggaagaagagaattctaaaagcttggaaaacatatttgggggaataatccaggaaaacttccctggtcttgttgaagacttagaaatccaaatataataagcacaaaaaacacccgggaaaatcatcacaaaaagatcattgcctaggcacattgtgatcaggttatccaaagttaagatgaaggaaagaatcttaagagctgtgaggcaaaagcaccaggtaacctataaaggaaaacctatgagattaacagcagatttctcagcagaaaccctacaagctagaaaggattggatgcctatcttcagcctcctcaaccaaaacaattatcagccaagaattttgtatccagcaaactaagcatcatatattgaggaaagatagtcttattcagacaaacaaatgctgagagaatttgccattacctagccaccactacgggaactactaaaaggagctctaaatcttgaaacaaatcctggaaacacatcaaaacagaatctctttaatgtgtaaatcacacagaacctataaaatgaaaatacaagttaagcaaaaacaaaaaacaaaaacaaagtagcaggcaacaaataacacaatgaattaaacggtacctcacatctcaatactaacattgaatgtaaatggcctaaatactccacttaactgcagaatggctaagaattcaccaatcgacaatccattgccttcgggagactgacctaacacataaggactcacataaacttaaagtaaagggatggatttcatgcaaatgtatgtcaaaagcaagcaggggtagctattatatcagacaaaacagactttaaagcaacggcagttaaaaaagacaaaaagggacattatataacggtaaaaggcattgtccaacaggaaaatatcacaatcctaaacgtatatgcacataacactggaacttccaaatttataaaacaattactaatagatctacaaaattagataaacagcaacacaataatagtggaggacttcaatactccactgacagcactaacaggtaatcaaaacagaaagtcatcacagaaacaatggatttaaactatactttgcaacaaatggacttaacagatatatacagaacatttcatccaacaaccacagaatacacattgtattcaacagtgcctggaactttctccaagatagaccacatgatagggcataaaatgatcctcaataaatttaagaaaattgaaattatatcaaacactctctcagacaacagtggaataaaagtggaaatcaactccaaaaggaaacttcaaaaccatgcaaatacatggaaattacataacctgctcctgaatgagtatcgggtcaaaaacaaaaccaagatggaaattaaaaaattcttcaaactgattgacagtaatgacacaacctatcaacctattaaaacctctgggatacagcaaaggcatctttctatgaggaaagttcatagccccaaacacttaatcaaaaagtctgaaatagcacaaactgacattctaaggtcgtatcttaaggatatagagaaataagaacaaaccaaacccaaacccacccagcagaagaaaggaaataaccaagatcagagcagaactaagtgaaataaaattgaaccaaaaaataaatacaaaagataaatgaaacaaaaagctggttctttgagaagataaataaaatggatagaccattagcaatattaacttgtagcaatctcacttgtagacacacaaaagacttgaaattcatttgctgaagacatatttgcatgcccatgttgattgcagcattatttacagtagccaagttatgaaatcaacctcagtgcatcaattaatcaaataccacttaaaaagtggtatatatacataatataatactattcagccttaaaaagaaagaaactcatttacaacaatatgaatggaattggagagcattatgctatgtgaaataaaccaaacagtgaaaaatagatgcatgttctcacttacatgtggaatataaaacagttgaactcacagaagcgaagagttaaatggtggttaccagaggctgggttagggggaatggggagatggtaatcaaagggtacaaagtctcagttattagaaggaataagtttgagggttttttcgcagtctatctcacaccatggtgaatatggctgataataataatttttttttgagactgagtttcactcttgttgcccaggctggagtgcaatggcatgatctcggctcactgcaaccttcacgtcctgggttcaagcaattctcctgcctcaccctcccaagtagctgggattacaggtgctcaccatcacgcctggctaattttgtatttttttagtagagagggagtttcaccatgttggtcaggctggtcttgaactcctgctctcaagtgatccacctgcctcggcctcccaaagtgttgggattacagacatgagcccccacgtccggccctatagctaataattgaatactgtacatttcaatactgctaaaagaggaaatcaaacattctcatcagaaaaaaattaaacatttgagagcatggataggttattcagcttgatttactgattccataaaaataataaatatatcatagcatcactttgtaccatacaaatgtatacaactataatttgtcaatatttaataaacaaaggtaaacttaagggttctgatggtcaagactctttctctgacatcactgaatttaaacagcagtcttctctgttcagcataaggtttatgatcttcatgaagacaaggtttgtgtggaaataaatacagacaggagttgttgctgttccactttggcacagaagttggatcatgaaggtgataagtggtgagatttaaatgctagatgatgagaagtccagtagggacaaaggagctttgaaataaaaaaaatgattggtatgatatttatttcacttattttctaattaagtataatacagtatggcccaaacctgaataatgcaaataaacagtcatttgttattaacaagttataattattttacataaatttaaacaaatactgttactttggaaatatgccctgtttggtgacagaaaattcaattttattgctgtttctatttaaccacctgtcttgttttacattttaaaaattattcaaattagaaaccataaggtattacttgctaaataagatccatctggaggctataagtatcctcaatcttaaggtgtgctatggttttggtatggtttgtttgtccccaacaaaactcacgttgaattttgattcccaataatgtggtttggggaggtactgcctgggcctagtgggaagtgtttgatctatggggtggatccatcatgaagggcttggtgctgttcctgcagaggtaagttcttgctctcacaagatagtttacttctcttcagactggattagttctcttgagagggacttgtttaacccaggacaccccacaggtttctttctctttgcatgtgtctgcttcccctttcaccttctttgctaagttgcaatgcagcactaatgtcctagtcggaagccagagccatgtccttgaacctctcagcctgcagaaacaagagctaaataaacctctttacccagtctcaggtattatttcatagcaacatcaagtggactaagcaaactaacacatgaatagaaaaccaaataccacatgttctcacttgtaagtgggagttaaatgatgagaacacatgaacacacagagaggaacaacacacactggggcctatcagagggtgaagagtaagaggaggaaggggatcatgaaaattaactgatggatactaggcttaatgcctgggcgatgcaataatctgtacgacaaacccccatgacacacatttagttgtaactaaccagcacatcctggacatgcaccgctgagcttaaaataaaaggtaagaaaaagaataatgaatgcacactaaaaaattggactaagacaaagtgtcatcaaagaatattttgatgctgctaccatatctgcctaaagcatatactgtatattataaatgtcgtctttctagttttactctatttcgttccttttcatcaccttaccttcaagtttctatgggaaatctataggggaaaagagtcgtgaaaaatttcctaggatcaccttgaaacaatatttttactgtgaggtttaattctgggagagttttacctcatcacagatatgggtatctccccctttaacaggaacattacggcattttttaatataagatttgaaattgggttttgcttatgtatgcaactgcttgtcatttggtctagcttctatatgaaactatttgcatagaactatttctgtgttttaacatgtatctcatttgtgatacatacatatatgtatgatatggtttggctctgtgtccccaccctaatctcatgttgaattatcatcctcagtgttggaggagggacctgattggaggtgattggatcatgggggcagatttcccccttgctgttcttttgatagtgagtgagttctcacaagatctatttgtataaaagtatgtagcacttctgccttcattccctcttccacctgctccaccatgtgaagaaggtgcttgcttcccctgcactttctaccatgaatgtaagttttctgaggcctccccagccatgtttcctgtacagcctgcagaactgtgagtaaattaaacctcttttcttcataaattactcagtcttaggtagttctttatagcaatgtgaaaatggactaatacaatgtatgtataaatatacatatatatgtatatacacatatatacatacatacgtgctatatacatatatatgtatatacacatatatacatacatatgtgttatatacatagagtaaaaactctcccagaattaaacctcacagtaaaattatagtttcaaggtaatcctatatatatgtacatgtgcccatgtatatgtgtgtatgtgtatacatataattagccatgttgatctgagtaattttgataatttgctttcattcaattctctgttaagaatttgaaaaattttagttaaatgcagaaaaaacaattgaggaaaaccttaggaatgaattttccttgggacaatgtagtgttggtatggcagtaatgggaagaagcaacttgttttaggaaaaaaaactaattctcttctaacattccttatctaatgtgcaaatatccatatctaaaaagtaaaatgttactagaaatcaaaacaaaataacattacactatatccatgacatgagtcatcttttttaaaaacaattattgctttcactttttacttcttcacttaaaattcaaagagaaaaagcagctgtcatctgtaggaggaagacatatacattcatatttgataagtttaagttcccatgaaaaagcaacaaataaaataaaacaaaagcagatctaaaaaagacctaatttaattcagtaccttagagaaatttaaaaatatttacagtgagttaaaacaggtagatcatttatttttccacatttcacttgtagcttttttcatttcttgacatttaaaagtacagttacatttttatcttattatcttattttgtttcatgaaacaggaaagtattttatcagaagaattcgtagaagtagaatctgtttgtcttcagttaaacaaaagaagaacctcattgctttccaactgggccccggccattttccagttgaaacatcaaatattttatttgtgtctttcactgccaattaaagggcaacagaaatggtacaggtaaatcatcttctctttggaggtctttccaaagaagactttaattcaagcatttcctagagtatgtaccataaagtcttatctgcagatttagacttgaatatgcattacatcattggaaaatattatgtcactgaaattggaaaaggttgagttaaacaaaactaaactattaactgtattacaagatctctgagattttggtttggtagcttccaggggcgtcttacgtagtgatgctgtttaggggcatctagagatcaggaacaacacttgttctgctgatacagatttgggaatgaaatctgaaaaggcatgaaatagactggtagaagggaaaaaatgttaagaaaagagcattcatattttattctaggtaacagcttgataagttgatacagagggaggagaataataaaaagaacacaagcaaatatttagagaagtatcagtgaattataaggtttttatgtgatttttctagggtctttgttgatttgtcaaagaaaatcaagaaaaatagcatacactttcttctttaaaccccttttgtgtatatgcttttgtgtctgtgtgtataaaatatgtttataaatacattaaactatttttactaattaattcacacaggtcattttctattatagtcaggatcagttatactgtggtagttagtagtaaataatttatttataaaatgttaaaaaggttcccaaggacttgcactttgttcattaatttttttaattatagttttgaaatattgcacacatttgtaaaatgcaaacaatagtagaatgggtccacattacttaacatcaacttttcaacaattattctcatatcatttgatctataatattttagatcatatgtttataacgattttagttttttaaaaaattagctgccatgccattattgctaatttttaaaaatacatttcttaaaagcaattaaatactaattagataactggaatatctgaaatcttaagtcaaataatatgtatttttgacatgtatttgaagtattgcgaatggtaacagaaaccaagctctgtgaattaggtttgttactggtgtaccattctttctagaccctctcaagctgacatagttaagaaatacaagcacatatattaaactttgtgtacacatatcaataactattcctatatataaatgtctgcatctgtattaagctaaacatgagttcatacagatgtctctaactctaatctgttaacatatggttcattgtagcctcctctccttacttatctgtaaactcccagtctgacaataagaacctggcttgtaacgtctgtcatccacttgctgaattgtttaattttactattcatgtatgtcagtttcagaattgttaattcatacccacaagacaatcaccttaactagagcatcgtacttaggtatagtttcttttagttttatggatgttttagaaattcaaatttctaaagtttcttaggtcagcacctctctcccaactcatcactattagtgaggttgttttatgcatttttaatatagttagattgcattgttacattctgcattgcattgatggattccccagactctcaaattatttttattaaaattttcatacaatacagtttacgatttgtataatgttaatggcttttgacaaacactgaatgtcatacatccaacattacagtgtcatagagcacaattttcaatcctaaaaattcccattctctacctattcaatatttactctcctacaaccaaacccttgataaccactgattttttaaattatatctatagttttacctttacaaaaatataatataattggaataatacattatgcatcttttttttaggctggccttttttcacttagctgtaggcattaaacattcaaccatatattttcatgccttgataactgatctctgtttatccttgaataatattattttcattgtaggtaccacagtttgtttatccattcatctgtggaaggacatcttggttacttgtagtttatggtgattaaaagtaatgatactataaacatttgtggacaggtttttgtgtggacataggttttcaattcaattgcataaatacttagttggattgtatggtaagactatgtttacctttgtaataacttccaaactgttttcaaaagtggtttaccactttgaatttccactgtcaatgaagggtacttcttcctgcactgtgcaatcaccatccactgatatccttactttctatttctatttttatactttaaccattctaatagatgtgtaatggcatctcattgttttatttggaattgcttaataatgaataattaatcattttcttatgtttatttgcatttgcatatcttatttggtaaaatatctgttcagatttttaaattgaattgttttcttattgttgatatttgaaactgttgacctttaaacattctttctatattttgaatataagtattttataagaaatttgttttgcaagtactttctcttatactatcagttgttatttcattttgtaacagtgtatttctcacagcagaaaatttttattttataatgcctaatatttcaaatttgttaatgaattgtgcttttggagttgtatctaaaaacttatcactaaaatccaggccacctaaatattctgttgtttccttctaaaaattttaattttgtgctttatattaaggcctgtaagtcatttgaattaattttgtgaaaaaatatataatatatatttaagttattttttgagggatggggggtattgatgttcaatcgttttagcatcacttgatgaaaagattatcctttctctcttgagttgcctttcagccattgccaaagacaagttgactatttttgtgtaaatctatttggggctgtatattctgttcttttgatttatgtgtagattctttcataaatattatgccgccatgattgttgtagctttatagtaagtcttcagatttggacagtatggaccttccaactcttcttcttcagtatcgtgttggcttttctaagtatcttagagaaaaagctcaagtgatgaactgaagataacaccagggctttatatagattagcaaagaatgcaacatgacctaaagattgatccacacaaattctctacactttcaaacatggctctgagaatacttaagttgccatatggtacttgggtaggtagaaaagacataattataactaatttgagtatgactttaccctcattgtctcattgcaatttagaaaagaattctcgatatttttgatgactaactgtggttttgggaaattgcttttccaaagaagtaagttaacaaaacaatatggaaatcttgacaccagaagtttaaatattaaagagagtaaaactcttatacaataactcattataataacaaaagaatattccctaaacaagtgcaaaaaaatctagtaaatatgctttaattggagttttcactagggtagggtaacatcaaatgtatatatatattttaatttattttttgttattataccttaagttctagggtacatgtacacaacgtgcaggtttgttacacatgtatacatgtgccacggtggtgtactgcacccattaactcgtcatttacattaggtatatctccaaatgctatcccttcccctttcccccactccacagaagtgtgatattcctcaccctgtgtccaagtgttctcattgttcaattcccacctatgagtgagaacatgcggtgtttcgttttctgtccttggtgatagtttgctcagaacggtggtatctagcttcatccatgtccctacaaaggacatgaactcatccttttttatggctgcatagtattccatggtatatatgtgccacattttcttaacccattctattattgatggacatttgggttggttccaagtcattactattgtgaatagtgctgcagtaaacatacatgtgcatgtgcccttatagcagcatgatttataatcctttgggtatatacccagtaatgggatggctgagtcaaatggtatttctagttctagatcctcgaggaaacgccacactgtcttccacaatggttgaactagtttacagttctaccaacagtgtaaaagcgttcctatttctccacatcctctccagcacttgttgtttcctgactttttaatgatcgccattctaactggtgtgagatggtatctcactgtggttttgatttgcatttctctgatggccagtgatgatgaccattttttcatgtgtctgttggctgcataaatgtcttcttttgagaagtgtctgttcatatccattgcccactttttgatggggttgtttgatttttttcttgtaaatttgtttaagttatttgtagattctgggtattagccctttgtcagatgggtagattgtaaaaattttctcccattctgtaggttgcctattcactctgatggtagtttcttttgctgtgcagaagctctttagtttaattagatcccatttgtcaattttggcttttgttgccattccttttggtattttagtcatgaagtccttgcccatgcctatgtcctgaatggtattgcctaggttttcttctagggtttttatggttttaggtctaacatttaagtctttaatccatcttgaattaatatttgtataaggtttaaggaagggatctagtttcagctttctacatatggctagccagttttcccagcaccatttattaaataggaaatcctttccccatttcttgtttttgtcaggtttgtcaaagatcagatggttgtagacatgtggtattatttctgagggctccattctgttccattggtctatatctctgttttggtaccagtaccatgctgtttttggttactggagccttgtagtatagtttgaagtcagatagtgtgatgcctccagctttgttcttttggcttaggattgtcttagcaatgcgggctctttttttgttccatatgaactttcaagtggttttttccaattctatgaagaaagtcattggtagcttgatgtggatggcattgaatctataaattcaatgggcagtatggccattttcacaatattgattcttgggcagtatggccattttcacaatgttgattcttcctatccatgagcatggaatgttcttccattcatcaaatgtattttttaaaaaccagttcagcatgaacacttaccaagccaaagcacctttacaggcctggacggcttctattgattaatacttgctgtacatcaggtctagctttctcttttgtcacagatgagagtgggaaattcaaatccctttcagctatttaaaggagtaatattaccagtgactcaattgtctttcattgccaaagcaaatagaggttctcttggaatcttatcttacatatccctaatctttaaaattatgtttctaagtaccttaggtttaatttttcagaaaatggaattgatagatctactttgtgtttactgagcttctgttcaccacgtaagaacttaaaagaaatttctgtcaaaggggaaaaagggatttacttcatttgatgtgactgttatatccatcataaaatcagcttgcagtagttcagctcttaaaaggatcttctaaaagaatcttgataagttgacaagactatttttgcagttttgtttttttaagaattaaagggatttttaagtttttctctgaaatgctcaggctatttgaagaaataaatgcttaattataaattaaatttctgtgggaatgaataatactttaatttccagtagataaagctagatcttgcattcttataattctagctgataccaattataaatctaaatttttgatattgttgcttcagaaaagcagggtatcataaggggatgtttttaggcagacaagaaatatacattctattaaataaacaaaccagaagttattaaatagctgccacattcaaattattgtgacagatgctgttgagattataacaaaagaatgaatgctcacaaaattctcccaatcaagtttacacagataagattttgcttgcaataaatgactgtgaagcatatttcatatgaaaaatgatttctgaagttttgtttggatttcattaaaaacaaaattaaatcaagaacaagtaaaccaatttttaaaacacgtctgtaagtctaaaaagctttgcttttttttaaggcattttggggtgctgcaatgatacttaaatcttatttaagagtgtgaccaaaaaagaactcatccgaaggtcttcatttagatatttctgacactattgaataaagaataaaacaaaacaaaaattctccacataaacaacaaaaatattcattaaaattaaataaatcaaatatattctgttattaatgccccaaatgtgtcagcttggtcaacttagtaaaaaaaaaaaatacagttccgtgatttaaggaatatttccggttttttttgtggtatctccctggtaatccccaaataacaaaataatatatttagtcatagtcactttttaatttttcatctgattaatgtggtgtctcatacatgcaaacaaagtacctttttctgttgccttaatgcctctttacaatggacccgatgggagataagcagacattagacatacaggttgataaaatacttatgtaaatatagtaaaacaatgttgagaccaagtataagagagtgtcgttatttttactggttacagcaaaatacctggggagcattttggaaattaacatttggtcactgtaagccagtatagattccattacggtaacttccattgttttggggcagacatttcatctatgacagtttacttgagagtactgaacatatttcagtttgccaaagtaagatactcttgttttcttgcactgttttcctatgtgcatcggaaaaatattacctttttcagaaattttgatttaatggtgtttgatattaggcatgtttttacacttaacagttattcagtgaaaactaattctgctcattttttgtctgaagatattgaacatgaaaatttcaataggcaccagtgctcttgttacttaagtaaaatagatttctgtgatttttattcctcttctattatcttccttaatctactaaattaccttattcgctaatatttaaaacatgtattttctaggaaactgtcatgactactaagttatcaggcacttactgtatgcaaagtatttacaaattgtgtaaatatagcactcaccaccatcccatgtacatgtatgttccaggaaggaagttttccttccaactccacaactgaattataaggaatagtatctgtgagctttctatagtcaatcaaaaatattggtgtgataagtggaaaacataaaaatagatctcctgccatcaagaagcaaatagtaaaactaggcaatgttagattaagtgctacagggtgaggagtccaacttcaggtcgaaatgccatgtgcgatatttccggcccaaacataggtagttataaaagctttacttcgcagatcttagcagggaaatcttccgcttgcggggaaatgtgctggtacacagccagcacatttcagtctccgaaggagttgtagtcaaggactcagctctccctgcctggccatgtccttatgcatagctgcatttttagcccaagtgccttcatttggaggtgtctttattgaggactttagcagggaccttcctcagtcgcctctattgagagcttatgggtaaaagaaaaggcagggaaacttgacacttttactctactctaactcagcttttttccactgttagccctttcttgctttccctctgcccttctccgtgtcctccacaccatctaggtcgataaaactatgggatccttttgttttaggctccctctgcagtggaattacccttatgtcttttctgtctatgctgatccacctgatcttgaactggtgctattccatggggaaaattggaacatggggcaattaacactttctccactttatcccatcaacagtaagtactgaaaggcttaaatgctacttccattttgactgtttgtcttaagcagctactctgacgtccagaagctaggttctctttcgagtttagctgagcttctgacacagagaagagtatacatgaaaaatacctgtgtagcctagaagtcggggaaaatgcaggaagtggagaagagagtagcatataaattatacgtatacatgggtcaagaacaaaaggtatcaactgaggctcagggatcctaagagacattaagaatttagtaaggatatgaacctgttcaaatgaaagctttcagttggggttacagcaagaaacatgcctaataaatcaagtgaggagattttatattaaattagaattcaagaaaatagaattagtttttatcctctttagacaatgacaaagttatgacatgtttgagcagaagagtaacgtaataaaacttgtgttttcgaagtgttttatctagctttttggccagcctagccaaacatttacttgggatatcctcttgaaatattgtgcaagatactgaagtgtctttgaatagctcatgatctaggaatatgttgcatgtttaaacaaagctgagaattatctgacaatgtgacttaacagagacattttaataatattacagggaaattgaaatataaccaactaactcaggagacatcatggaagatgtcacacagtgaatgatgatgaagcagaatttttaaaatgtgtaggattacgagaagtgggcaagtacttatgaaaagataccataaacaaaacctattttacttcagacattctctaaactttatttcaacctttagaaactgtgaataagtacatttgtccttcaaagttatataaattaaagggctattttgccatataaatgaaagtatttccaattccacaaaaatgtcttatgatcaacaaatgaatcttggtatttataaagttctggttgttactgatattttataatctgacctagcttaactgtccaggttaatttcccaccaattttcaataggcacatttcattttgaccaaaccaggttacaactgaaactatcgtatcttaaccaatctgtagtagtatttaattaaaaatacttgttaaagcagtaaattgaaaattatacttaggtattataaacattgcatttaacatgaaccatatacatagatattcatttgtcaaacttttgttgtagggtcatttttctttgtgtatggtattgctgatgcagtttaatgctccattacttctaaattttcatcataagctagattttccagttgtggtttctataaagaaaaacaaacattctgaagacagtttttccagatttattccagatatcgatgattaacttttgaaggtaagactattatcttttcacacataatttgactataaaattttaaatggctcacctttgtcaagtagttacaagtaatttatcataaaaactattgggaactaatttagttgatgtatgtaatattcaaattaactacatacttatcatagtaattgtaagtggcataaataggattagaaagaaaaccaactgcttttgatgatacaacttaaaatgaaaaagaaagtatatatacaaatggacctgatgggggaaaagtgtgatttagctacttgtgagcatttaacatactgtgagtactcctcagtatcttttttacagcgagaaggttatctgaataaatgggttggatggattttcctataaatgtctgctataattatcataatgttccaaactttcatctatttaccttttcacatgttgccctctctgctgaaatgcctgcccacctatcattctgggaaattactactcattttttaaagctctaggagaagcaatttccctggaaatcattttcaaattatttttcactaaagagcatcaggcaaccttgcatttgtgttccctctctgaattgctgttgttactctttttacacaaatgttaattatagctaataattgctaaccaccttattcttgtatgctaagccctgttttcagcaatttattagtatgaacttatttaatcctcataacaccctctgagattgatactattattattcttcattttataattgtgaaaagcatatagagtttgagtaattgtataaagcaacatagttattaggtaaatgtgtcaggattaaacaaacattctgtcttcagaagtcatgtttttagggtctgtgctagttgtctttcagtcatgcattgcacttcggttgttggtactcaacaacaagcaattggttcttgagattagaattctgtctttttcattttacatttttaatatggagcacaatgtcttgcaaataatacagtcctaacattgtttttgaataaatgagtgagaaatcaaatggaaatacattttagccatttgaactatagagggctgtctaacctttcacagcagatatgcctcaggaaaagtagatgacagttgcatgtttctcatattctagctcctctgttgatttgaacatccgctgaagcttatttttcacctcagaatagcatcaacattatttgaaattcaattgtactttctcgttacattaataaatcatggaagttga

SEQ ID NO: 1663 - DNA, 30745 bp, Homo sapiens
ttccgggcttccccagacagacagctggcttacagggccacctgaagacgttccagggctccacaggccactgtcttctggaggggaacggatcgactgccggtgcgcccagccaaattcaactcctgagtcctcagtctctagtcccgggaaggtaagtcagatctgactctgtctctctgggagggaaacggccctgacgaaggtcctccctcagactctgtccatgctccaggacactggaggacagagtcctggtttctgtcaggattctctgttaagtctagtctctctctctctctatctcttctccctctctcattcaggtctccgggagatctctgttttagaatgggtataaaaattgtaataaactctgagtgagtgagtgagtgagtgaatgtggagttcaagggcttgcgcttgaatttccagtttgtagctccagggtgaaagctagggaattcgagaaggccctcacctgtggttccgtggtgacctcataaggcttagggcggcatcaggcatagctcgatccaagccaggggtttataccagcctgccaatgccaagaggagcctaagtccccgaaaggggagcagccaggagggcatctgactgatcccatcacgggaccccctccccttgtctgtctataaaaattgccatgcttgtttatataccccagtgcctattgtcctgtttagtgtctgtctaaatttcatatgtcggatcgtcgatactgcccaaaatgactgggcaaggacttcttcaaggtccttagtacagattttctatcccaggaggtcaaattcctcattagtcggttgggctggccatcccagtcctgcctttcctgtcagaaacaaattaggtgttgttatggggaagggtgtggaagacattcacccgtttaggatttctggcaccataaagattgctggcgtttggattgccataccccacgccccaacgactggtccaccttctccttagaccagtggtggatccaaaatagccaccctgctgacctccttactcaccttttctgtcatcccataacttttcccatgcccttaaataaggcactgtgcagagaaacctacacccatactgctctactctgtctggactcttattttacctcttttggctactctccaacctttagggaaatccaagtggcccctttcctcctcatccccatcccttaccctgcacatctcattttcctgtgttgcagcaagtccagcgtctctaagacttggctgtgttctccctccttaaacccgtgaaggaaaggaccgagtttgaacattttgctttcgagtcgtggagacaccaaagttatttgggatataagtcaagaagggggggtcacctaagtcccactggctgaggatcccttggacccacctcttatcctctccatagatctcgaagcttgaggagacagaccttatgtggcaagaaatattggctatagttgttttcctacttcttctagctataatacttctgttcttctgataccatagcctcccaggccgtgaatatctttgtccatgctgggtttaatatttttgttcaaaccttgttaattgcctccagaatagtaaactcttcttcccggccccataaagattggagtcctctccagtgtatgttgcagaatttctctctaggcttctcagatgattacggggtccgccttaaaaaaggcaaactctggacactctgcgaagtagaatggccaaagtttggaactgggtggcccccagacgggtcactacacttcacagctgttcaggctgtgtggtgggtcgttgttggaactcccggtcaccccgatcagtttccctacattgatcaatggctagatttagtccagagctctccttcatggctccactcgtgataaaactctgtagccattcgtgatcctacctccaaggtcctttttagccagacctcacttttgcctccaccctcagctccctcgattcctcctgtactgcctccttctgaagaagaggaaagttttcttcacccatttccaccaccctataaccctcctcctcccccagaatcttcccttgtctcctcaactacatcctctgtggcctctctgcctatatcctcccaattatggcctcagccggaggaggtggccccgctcctcccactgacagaggcccaaatccctttgggcagtgggcgttgtgctccatttttagtttatgtccccttctctacttctgacctgtacaactggaaggctcataatccccccttttctgaaaagccccaggtcttaacctcactgatggagtctgtgctccagactcaccggcccacctgggatgagtgtcagcaactcctttcatcccttttcacctctgaagagagggaccatatctgaagagaagccagaaagtatttccttacatcagccagcttttagagatagcccagagagttttcgacaatcgagaatttgaaaagcaaaaacaggtagctcaggcagctgaaagggctgcagacaaagcatcaaaaagacaggcaaaaagcttagtggctgccatccaagaagccaaaaaggaagggcccccatcacagagcactgaccaggggaccccgagtccccaccaggaaggccagaaacgtgagaggactcccctataaagaaaccaatgtgcttcttgcaagcagattggacactggagaaaggaatgcccattaaagccagaggagaaaccagaaaagaaaaaggtcctcaccctgccccgcagcagaggaatctgatgattgacggggccagggctctttgtcacttggccccgggaacccatggtgaccaccacagtggggggccagcctgtacgcttcctaattgacaccggggtggaacactcagtactccagacacccttaggcagtgtctaataaaaaggttgctgagtaaagggctactggagctattcaggaatatcctgtcacccactcacgagaggtgagtttaggacagaaaagagtaacccacttgttcctcgtggtcccagagtgccccttctccctcctcggatgagacctgcttcataagctacaggcgtccatctccttctcggcccaacaaactcacctcatgttaggggacacaatgccccctactgctcagctcctgctaaccacccttcggtcagaggaatatctcttagtttcaccctcacaactgccggagaataaaagtaatcctctcctactggctttacagactctgtttcctcatacctcccaggactggcaaaccaccatctgccagctgttgtagaactcctggccaccaccctgccggtccaggtcaaacaatatcctatgattctgtgggctatagagggaattaatcctcatattcagcaactattacaagctggtatactcacaccatgtgagatcgcctggaatattccatttttgccggtccagaaacccggaacaaatgattaccagcctgtacaggacttgcaggaaggtaacaagcagacagtcactgtccatccaactgtctctaacccttatactttactcagcctgctcccaccagaacatatggtgtacactgtccttgacttcaaggatgcttttttttgctattcctctggccccaaaagtcaacctatctttgcttttgaacagacatatcctggctcggtagacaccacccaattaacctggacttggttaccccgaagttttaaaaattcccccaccctttttagggaagccctccaacaggatcttttaccattctgagccagtcaccctaactgcactcttctccagtatgtagacgacctgttattggctactgaaactactgacagctgcctgcaacatactacggacctactttacctccttcaggaattcgggtatcaggtcccagccaagaaggcccagctttttcttcccagcatttcctacctagggtatgagacaaatgaaggaaaaagggcactcaccagtgctcgaaaggcagccatccttcaaatccccactcccaccactaagagacaggtacatgaattcctgggcaccgtgggatatggtcgcctatagatattggggttcatggaaattgccaaacccctgtacaccactactggagggaataccccgctggtttggactgacaaagaagaacaggcttttcaaaatctgaagaaggcactaactgaggcccctgctcttgccctcccaaatatctcaaaaccatttcacctttttgttcatgaaaaccaaggagtcgctaaaggggtacttactcagactttagggccatggcaacacccagtggcctatttgtctaagagactggaccctgtggcctctgggtggccaagttgtctgtgagccatagtggcaacagcaagccaggtccaggaggctgataaactgactctgggccagaatttaacccttacggctcctcatgctgtagagaccttgctacaaagtgcttctggcaaatggatgtcgaatgctcgcatcttgcggtatcagagtttactgttagatcagccgcgtttaactttctctcccacaaggtgtttaaatccagctaccttgttccctgatccagaccttaccacacctgtccatgactgccaagaactgttagaaactatggaaactggctgacctcatctccaagatgtgcctctaaaggaggtggatgccaccgtgtttacagatggtagcagcttccttgaacagggagtacagaaggctggtgtggccattactatggagacagatgtactgtaggcccaggcactgccggcaggtaccttggcacagaggactgagttggtaaccctgactcaggccctccaatagggtaaagacaaatgtattaacatctacactgacagcaggtatgcttttgctactgtacatgtacacagagccatctatcaagagcgagggctactcacctcagcaggaaagagtgtcaacaacaaagaagaaattttagccctgcttgaagctgtttggctccctcaacaggtggctgcaattcactgcaaaggacatcaaagagaagacatggccattgctcgtggtaaccaaagagcagactctgcagcttgagaggcagctcagctcctggtcgtgcctttaaccctgctgccctctgtgtcctttccacaactgactgggcagactacccagaatactccccagaggaagaaaaacaagcttcggatcttcaagccagtaaaaatcaggaaggttggtgaattcttcctgattccagaatcttcatgccccaagcccttggggaaacttttatcaatcatctacattctaccacccatttaggaggagtaaaactggcccagcttctaaggagccatttcaagatcccccaccttcaggacttaactaaccaagcagctctccagtaaacggcttgtgcccaagtaaacaccaagcaaggtcctaagcccagcccaggccaccgcctccagggaggcttgccaggaggaaggtgggaaattgactttacagaggtaaaaccacacttggcagggtataaatacctcctggtgctagtagacaccttttctggatggactgaggcatttgccaccaaaaacgaaactgctaccacggtagttaagcttttactcaatgaaatcatccctcaacatggactgcctgttgtaataaggtctgataatggaccagccttcacctcgtccatagctcagtcggtcagcaaggcattaaacattcaatggaaactccattgtgcctatcgaccccagagctctggacaagtagaatgcatgaaccccatcctaaaaagtactcttgcaaaattaatcctagaaaccagtgaaaactaggtaaagctccttcctttagcccttcttagagtaagatgcaccccttaccaggctgggttttcaccttttgaaatcatgtatggaagggctccgcctatcttgcctaagctaaaggatacccatttagcagaaatctcacaagctaacttgttacagtacctgcagtctctccaacgggtacaagacatcatccagctgcttgtcaggggagcacaccccagcccagttcctgaccagactgggccctgccactctttccagctgggtgacctagtgtatgttaaaaagttccagaaaaaaggactgactcctgcctggaaaggacctcatactgtcatcctcaccacaccaacagctctgaaggtggacggcactcctgcttggattcatcattctcgcatcaaaaaggccaacaaagcccagcaaaaaaaatgggtccccaagcctaggccaggccccttaaaactgcgcctaagttgagtaaagctatcgaattaattctttttatttacctcttctgtctgtttccacctgttatgtcctctgccccttcctactcttttctcctcacttccttcatgacaggatgtgtgtttgcaaacaccacttggaaggtgggaccctccaaggaagtctcttttgtagtcggtttatgtgctttgttccccgaccctgcccatacccttgaagagcaatgcaatctgccgatcatgagagcagggaacgctgaccttgctgcagggttcggacacaccagaagccaaactggatgtggaagttctaagggtgcagaaaaaaggctccagagcgttgacttttacctttgtcctggaaatcgccctgactctagttgtcgagattcttaccagtttttctgcccttactgcatgtgtgtaaccttggccacttactctggaggatgaacctgatcctcaaccctttccatagcttgtgcttcccatcctaagccgtgtactataggaaattgtaatcctcttactataactctccgtaaccctagtttaactcaatggtattacagcatgtcatagggattaaggctttatatttcaggatttgatgttggaactatgttcaccatccagaaaaaattcctggtcccatgaagccaatcagaactttaactgatttaggtgaccctatgttccaaaaacacccagagagagtcgatttaactgtcccactgccattcctggttctgagaccccagctgcaatgacaatacctccaacccagcccgatgtccattttggacgggatacatcacctccttaatctcaccaagcctaaactagcctgagattgctggttgtgccgaaaggccaaacccccatattatgttggattaggagtagaagccatgctcaaaatggactctctttcttgtcatacgtgcccccatgcccttacactaggagatgtgtcagggaatgccttctgtctaattagcgcaaggtataacttacctgcttctccctttcaggctacttgtagtgagtctctccttacttccttaaacccctcagtctcctaccaggcacccaaaaatacctggttggcctgcatttcaggcctcactcgctgcatcaatgggactgaacctggacctctcctatgcatgttgattcatgtactcccccagatctacatgtacagtgggccagaaggacaacttctcattgctccccctgaattgcatttcaggtttcaccgagctgccctactccttgtaccccttctagctggccttagcatagctacgtcagcagctattggcacgactgccctgattcaaggagaaactggactaatatcactatctcaacaggtagatgctgatttaagcaatctccaatcagccataaatatactacatgcccaggtagagtctctagctgaagtagttcttcaaaaccgccgaggcttagatctgctatttatctcccaaggaggtttatgcacagctctagaagaaagttgttgtttctatgccaatcagtctggagtcataaaaaatactcttcaaagagttcgagaaaatctagatagatgccagaaggaacaagaaagtaacaccacctttctcattcctggagtaccaaagtaccaaagcatgtttaactggaatccctggctaactactctaattactgggttggcgggacccccttctcctcctcttgttagggttagtcttcaggccttgtatattaaattggtttcttaattttgtaaagcaacgcatagcttctgtcaatcttatgtatcttagaacccaatataacacccttgttataaccgaggaatcaatgatctgattcccccaaacacgagtgggaaatgtgataccctaacttcttttaacctgattgactctctcttagctgagagagctggacagactccattttggtttcttcacttgcagccccttgtccccctcccttaaggacataactggtgcaagctgactccaagcacatccaagaatgcgcttactgataagatactgaggcaagctgtaccagcagctcctgggaacgcactcggttgacggtgcccaaagcctttgcgtttatcactttgtgataatttaagcccctgcacctggaactgtttattttcttattactgtttctgtaaccatttatctttcaacttttttgcctgttctgcttctgtaaaaaattgcttcagctacactcctcctcccctctttagaccaaggtgtaaaaagatgtgtagccccttcttcggggctgagagaattttgagctctagccgtctctcggttgctggcaataaaggatcactgaattagtctcagactgtggcattctctctataactcagtcggttacaataaaatagcaaaacaagttgccatttcttccatttaactccatgccctcctcctactgtaacccgttttctcttccattgaacaaaagacgttgataaaaataggagctaaagaaaatgcggataggaaatggatattatcagatcaaagggaaatgttgtcaaaacctctcatgagggaagtcttgtctcaattacatcaagggacccattggggaccccaagcaatgtgcaatgcagttctccgggtttatgggtgtataagaatttacaccctggccaaacaagttatagatagttgcttaacatgtaaaaaaagctaataagcaggatctaaggaaattgcgccttggtggaagaaatccagcactgagaccatttcaaagtgttcagatcaattacactgaaatgcctccaattggtagttatacttattagtaataatagaccattttacccactgggtagaggcaatcccattctcacgtgcaacctccagtaatgtagttaaagcgctaattgaaaacatcatacccagatttgaactaatagaaaatactgattcagatactgcaacccatttcactgtgcatgtcattaagaagttagcacaggtactagatatacattgggaataccatactccttggcatccatcctccacaggaagagtagagtggatgaatcagactctaataaaccacttaacttagttttagaaactcgattgccatggactaaatatactcctattgcttggttaagaatccggactgccccttggaaagatattggcctgtcacctgaggaaacgctctatggaatgccctacttacactccattgctgacatccctatgtttgaaacaaaggatcatttcctcaaaaattatatacttggtctaggctctaccttcttttcccttgggactaaaggtctcctagcacaggcatcacccctggagtttccagaacatcagcattggccttgagaccatgttctcatccaagggtagaagaaaaggaagctcgaaccagcctgggaaggaccctacctagtgctcctatgtactgagactgcagtctggacaacagaaagaggatggactcatcacacccgagtcaagaaggtgccgccacctccagaatcatgaactgtcactccacagcccacccccaccaaattaactctaaaaagagcttaataatcacttatttattctcttttttcttttcaacagaaggtcatcttgtcatcagtgtaactcaggctagtcattttttaacccttcagtttgatgcctgttcagtcatcccgtatggagatgagcaaggtcaaaagaagctagcccatgttgataagtgtctatgtctataccacaaaaaatcaagcatgtataagtatggagtgttaaaagtcccagtggtgactgggcagatgtttggtggactaataagtacaaagggtggagagccaagctccctgcttcaaataaattatgacgaccaaaacaaaaaactccaactagtccctggtcccaccccaccaaattgtaagccatgacactgtaaccccttgttgctgattataaataatccccggaccatggcccaagagccctctatattcaaacagtatgggctaggaggagatgttgaaggacagatccatttcttagagaaatgaatgtgacaatgaaaaatgacactactcttcgttcatttttctttgacaaaataatttttctgtcaattttgtatgtatttaattttaaccaagtaaagcttcttatggacatatattcatcagatttaaaaaatgagtttcttaaaggtgcaaaaccaggaatagcttggtaaattcatgaagctagaaagtagctaatcaaagttcttattaaaccttctggggttgattaagagtagccaaaattatgccaggtgcagtggctcacgcctgtaatcccagcactttgggaggccaaggcaggcagatcccaaggtcaggagattgagaccatcctggccaccatggtgtaacctcgtctctaacaaaaacacaataattagctgggtgtggtggtgtgcacctgtagtcctagctacttgggaggctgaggcaggagaattgcttgaacccgggaggcagaggttgtagtgagctgagattgggcaactgcactccagcctgggtgacagagcgagactccacctaagaaaaaaaaaaaactattagcgaaaattccttgtaacaaatcccctcaagaggtgaaatctatttccctactccttggccccgtcctggccttgagacttgctttgatcaatagaaggtgacagaagtgacactgcacacattccaagggtaggcctcctacaatgctgctacctatgaacaagcccaagttagcctcatggaaaacggaaaacacataaagagggtccctgtcttccctgacaacccagtccacccagtgaggcccacagaggtgaggaaacccagctgataccacgtggttctgagatcggcttatcagctgattcctgcccaaattgccaacccacaaaatcacgagcaaataaatggttgctgtaataaccagttgggttgttacacgaaaacagctaatagatataccttcttaatctcaattatctaaaaaagatatccctcctcactgattcatagctaagtggttctagaaggaatatttttatgaataatacacatttctttattctgtgcatcacatgaaaatggtcagaatcaaaatggagtcactaatgttaaaaaacaaacaaaagactctgacaaatacagctgggaagaccatgaaaagagggttctaatggttgtacacctgaaaaccaaaagtaccacgaaagacggcgaacaccacaaccttgagcaaaggccattccaactgaacagaaaacatactctgcaaggacctctgaacaactgcctgtccaacctcagactaacaccactttcgtgattgatctttggagccaaggctaattaattcaaagaaattagataatcctcattttttccttaaaaaatttttgttttcctttattttcccaaatatacacatagtttactgtggcatgcatactcccattgcagtggtctattcccagagaaatatttttcttttagggacctctctctgttatttaggtttatagtcacaaaggatttactatttcaacaatactagcactgcatatcatccagtatacactgggaaaataaggtgccccatgtgcagatccaggagactttgtgaccaccagattatgaggcatgcatgtatttatttatttatttttgagatggagtctctatctgtcacccaggctggattccagtggcataatcttggctcactgcaatctccacctcctaggttcaagtgattctcaggcctcccaagcagctgggactacagatacgagccacctatgtggctaattttaggatttttagcagacacagggtttcaccatgttggccaggctagtttcaaacacttgagctcaagtgatccacctgccttggcctcccaaaatgctgggattacaggtgtgagacaccatgcccggaccatgcatgtattattaatgttgaagtagataatttaacaaacatcaatgaagtgttaacatttttcactcataggtgcaaaatatcatgccaattgccttctatgagctgtcgtaagccacagcctagagattcaattccatttcaagattcaaccaaagccaactcatcaacaagaacatgtaaaagacagaaaaacccactaccggcaggctgaaacagatgctgtgacgtggccctggcctgtcatggcatgtcacagcatggcacaggcctatatcatgttccctagactgctgactaccaactagttacagctgactccaatcaggtcgggatttgaccatctctgcactgaacctgcaattgtaacttttaaaattgaaacgctgcttctcacctctcctccctagactccatttcacagggaaaccatcacagggaaagaaagcctttgttttttcttccttctttgctttgctttctctctttcttttacacagggtctcactgtgtcgcccaggctggagtgcagtggcacaatctcggctcactgcaacttccacctcctaggttcaagcaattctcctgtctcagcctcccaagtagctgggattacagacatgtgccactgtgtctggagttgattccttccagtggttttgtggtctggctgacttcaagactggagcagcggaccttcacagtgagtgttacagttcttaaagatggcacagacccaaagagtgagcagcaggaagatttattttgaacagcggaagaacaatgcttccacatcctgtaagggtacctaagcgggttgcctaagcgttgctgctgggggctggggtgaccagctttaattcccttatttgtccctacccacttcctgttgattggtccattttacagagtgctgattggtccattttacagagtgctgattggtctattttacagagtgctgattggtccattttacagagcgctgattggtccattatacggagcactgattggtccattttacagagtgctgattagtccattttacaaacctctagctagccacagagcactgattggtgcattttacaatcctagctacagagtgctgattggtgcatcttacaatcctcttgtaagatagaaaatttctccgagtccccacccaacccagaagtccagctggctacacctctcaccaccacacctacctaatttctgtatttttagtagagagggagtatcaccatgttggccaggcttctttcttaatcttttcttttctttctttccttccttcctttcttccttccttcctttctctttctttctttctttctttctttctttctttctttctttctttctttctttctttccttctttcttccttccttctttccttccttccttgctcccttccttcctttactctctttctgtctttttctgtctgttttctctattccttactcttccctcattccttccctccctcccccaactcttctttccttcctttctctctccctccctactttccaactttgggctgtgttgaatttgttgactcatcgtgaacaaacagaaactccaatgatactgttacccaagagaactttgcaaaaggttgtcatgtttaataattcattcacagaatcctcaatctcacaaaagcctggaatggattttctgtttggacagggcagggaagctactgtggccaggctccagctcttcccactgcagctagcacaagccttctaaagcaggatgtggccaggcacagctcatgcctgtaatcccagcactttggcaggccgaggtgggtggatcacctgaggtcaggagtttgaaaccagtctgtctctactaaaaatacaaaagttagatgggagtgatggtgggtgcctgtaatcgcagctattcaggatgctgaggcaggagaattgcttgaacctgggagacagaggttgcagtgagccaagatcacaccactgcactccagcctgggcatcagagcaagactccgtctcaaaaacaaacaaacaaaaagcagtgagaggtgaagccacctggacttcctgggttgagtggagacttggagaacttttctctttagctagcagattgtaaagtcaccaatcagtgctctgtgtctggctaaaggattgttaatgcaccaatcagcactctgtaaaaatgtaccaatctttcatcccatctcatcccatctttcagtcacttcacaaatggttcctagtagatacaaaacagttttttctccaatgggaaaacagaaaacagccactcagtttgctcccaacacccgtttctagccgcttaccacagctaccttggcaagtactctaggagtatgggaaaatgaaaacgacaaactcacacacctttttaacatacacaaccagttctgactacctagccaaggcagattcttcttctgtggaatgtcaacctatatctgcctcccgaccaactggacaggcacctgcaaccttagtcttcctatgtcccaacattaacattgccccaggaaatcagaccctatcagtgcccctcaaaactcaagtccgtcagcacagagccatacagctaatacccctgcttatagggttaggaatggctactgctatgggaaccggaatagccagtttatctacttcattatcctactatcacacactctcaaaggatttctcagacagtttgcaagaaataacaaaatctatccttactctacagttctaaatagactctttgacagcagtgactctccaaaaccactgaggcctaggcctcctcactgctgagaaaggagggctctgcatctttttaggggaagagtattgtttttacactaaccagtcagggataatacgagatgctgcccggcgtttacaggaaaaggcttctgaaatcaggcaatgcctttctaattcttacaccaacctctggagttgggcgacatggcttctcccctttctaggtcccatgaaagccatcttgctattactcacctttgggccctgtatttttaacctccttgtcaaatttgtttcctctaggatcgaggccatcaagctacagatggtcttacaaatggaaccccaagtgaactcaactaacaacttccaccaaggacccctggaccaacccgttggccctttgactggcctaaagagttcccttctgaaggacactacaagtgcagggccccttcttcgcccctatccagcagtaagtggctagagaggtcatcacccaattcccaacagcagttgtggtgtcctgtttagatgggggattgagaggtgaagccagctggacttcctgggtcaagtggggacttggagaacttttctgtctagctagaggattgtaaatgcaccaatcagtgctctgtgtctagctaaaggattgtaaatgcaccaatcagcactctgtaaaaacgcagcaatcagcactctgtaactagctaaagggttgtaaatgcaccaatcagcactctgtaaaatggaacaatctgcaggatgtgggcaaataatggaataaaagctggccaccccagtcagcagcagcagggaaccgctcagatacccttccacaccgtggaaactttgttcttaccctcttgacgaaaaatcttgctgctgctcactctttgggtccacaccacctttaagagctacaacgatcaccacgacagtctgcggcttcattcttgaagtcagcgacaccacaaacccaccagaagggagaaactccagacacatctgaaggaacaaactccagacacaacatctttaacagctgtaacacacactgtgaaggtccacggcttcattcttgaagccagcgagaccacgaaccctctggaaggaaccaactctggacacagcaggacgtgagacttctacctgctcactcagaatcatttccgcaccaaccatggccacgtttgtggagctcagtacaaaagccaagatgcccattgtgggcctgggcacttggagggtaaatatgcaaatctttgcacaactttcttctctggagggctgtttgggtgttttctctttctacattcagccagaaaagcctggaggtcgggtaggggtttggagaggtgaatttcagtcctggagctgggactcgggttgctttcttttctcaaagctgattcaagctgcaatgctgcaagactggctttcccagcagtgatgagaactcctctagcaagtatcaaatttcaagcagagttggacttaaaattgttttccagggcagtttctctctctggctctaggacacttaattgggcacaaggtttccccagagtcttggctgtgggtttgttgtgggctgggtggttgtggagaggatgcagagccagaagtccctggcaccactttgcagatcaccatgtgggacttgggctagcagcatccctatgacctgggagcttgttagacatgcagaactggctgggtgtggtggctcatgcctgtaatcccagcactttgggagatccagacgagaggactgcttaagcccaggagttggagaccagactgggcaacatagcaagacccaatttctacaaataatcaataaattagctgtgcatggtggcatgcagctgtagtcccagccacttgggaggctgaggtggagattgagtgttgagcctgagaggtcaaggctgcagtgagcagtgattgtgccactgcactccagtctgggcaacagagtgagatcccgtgtaagagaaagaaagaaagagaaaaaatgcagagtctcaggcttcacccaggctacctaacgggcatctgcactttaacaagttccctaggtggttcctgtacacattgaaatctgcaacatgctgggactgcagagagcctgggctgggagtcgtgagctccacccggctgtttttatgacagctggcaaaacacgctaaggcacattgaggactcagtgaggcaggttcctgggcctctgttaggctaagtttgaagttgttccatcactgcctccctctgccttctttgccatttccatccatgatagcactaccctaactagtgatgagaagcagtctttggagttcctcttctctcctgtccctcatggctaatttccctgctcagacttctgcctctggctctctttccttctgtgcacactgacttttttccctctcctgtgccgagctggagggtaggaccctctgctgcagcactgggtcattctcaggataaagtcttggtctatctgggcgaacagatcacttccagctcgattcatacatactgactcttgcttgaatagcaagatttgccccaaatcagagctttaatcctatataaatggaacaaataatcacttccagatctccagggaatctgctcacccttcataagtttactagacagtttcagaattttggaattgaatgtaagaattatgaagggagctgccttcaacacgtggggatgatagattaaaggattatgaacttagcagtggaggtgaagaagggtgtagtatagcggttggggtcacagggctgcttctagatgccaggtggcagcccgtttcttgcccaggtggtagggtagttgtgcatctctgttttgtgtacttttcaatgtttgttacctcacaatagaagaggtttaaaagactattttgtgagagatcaagttttaagtgctttttgcccccatcattggcttggctaggttagaacaaagtgtgataattgtatttcctttttttcttttctttccttcccttctttctctccctctctctcgttctccctacctcgctctttctttttataggaatggaaaacaaactctattcctataagcttctctatttctcctttttttccaaaatgatcattgtataatggacggcctgtactgagcctgtgtgtcaggtaatgtggttaacttaacattcattacagcatgtcatcaccacaaaggcctcttgtggctggtgctatttttttttccattttgccgacaaggtttagagagattgaatcacctgcttagacccacacacccagtaagtgttggaatctggattgatgctgtaatgaccattatccagatccttatcaccgtttggggaaattgtctgaaaatccctctgggttatttagagtcaagctttcatctgggtcttcagaaagttgtagtggagccatctgcaccaccacacacctgaagacatttcaggactaacctggatgaaaagggaactgacttttagctaggataggacaaaagggcataatcataaaattaattcactttccttcctttcttttgaaaacttttctaaactgtgtatcctcccagatattccctggcaaagaagaccccagcgaagccttggtttggagaaactggaccgtgtggggcaggtgaaggtggtctggggataagagaatatggtggttgctgagtgtggtgtaattccagctactcaggagttgggaggattgtttgaacctgggagtgtgaggccagcctgggcaacatggcaaggtctcatctcttaaaaaaaaaatacatgtgtgatgggcttttcttttgcttttcagtctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgcacatggcgcatttggtgggaggccttcacttcaaggcaggcagaagtatctggatcgggtgggcagcaagaactctgtcggccttttctacgtgtacccgttttcatctctgccttgataacatccgtggatacaatactatccatactccaagccgttattgatatttgaacatgtcgtggctgccccacctgcctgcgggttggatttcccatagtgggcttggctccctctgggcctccctgttccccatcagagggatctaccatctgcccagaggcagtcacaggccaagggtgcaggcagggcttgatatgaagcctccctctcagcactgtggtctcagcgactgtgcccctgaggttctcagccagggggtattttggaaaacagtaggagcacttttctattatcacatgtgattttctttattcagtctagtaaaagttgaggtatacaatgttataaaaaaagaaaaggatgttgggtgtgagggtgttgagaatcactggatctatattatatgcaagttgctgaaaaaaaaaacaaaacactagttctgtgtacttggaaaatgcttacatctggtgggacaaatagaccccactgtgtagcagccaagtctggataaagcccttttaaagttatcacttgggtcctgataggcttgataagggacctatcagatgggtcagataaagggccatctattcccaaaggcctaagaatgcttgacatttaaaagctacacgcaattcctgctctcagagagcccacagctgaggaagagactgagacaggtaaacaaatttcaaatctgtggccacatttacttaaatgatctgagacacttatagagtactaggagagttgaaaaagtcaactgcttttaaaacttaagacatgtcattgaggtgctgagccctggcgatcttccacactgcatcgtggatcttaatcagctttgttatagatggcctgagccaggttagatgaggatgcaaatcaaaaagcagggacaatgagtataatgtggcccttccttttcccagtattactagctcattgctacactctttgcaggtgtggcccactttctttgagagaccccttgtgaggaaagcctttgagaagaccctcaaggacctgaagctgagctatctggacgtctatcttattcactggccacagggattcaaggtttgagtgactccctttctcagcctctagtttctgagctgttgcaggaattcagggacccccaacagagagactggctgaagccatggcagaagaacataaattgtgaagatttcatggacatttcttaattccccacattaatgtttttataatttcttacgcctgtctttactgcaatctctgaacataaattgtgaagatttcatgaacatttatcacttccccaatcagtacttttgtgatttcctatgcctgtctttacttaaatctcttaatcccatcatcttcgtaagctgaggatgaatgtcgcctcaggaccctgtgatgattgcattaactgcacaaattgtttgtagagcatgtgtgtttgaacaatatcaaatatgggcaccttaagaacaggataacagcgatgttcagggaacaagggagataaccttaaagtctggctgcctgtgggccgggcagcacagagccatatttctcttctttcaaaagaaaataggagaaatattgctgaattctttttctcagcaaggaacaaccctgagaaagagaatgcgctcctaggggtaggcctctaaaatggctgctctggggacggctgtcttttacagttgtagataagggatgaaataagccccggactcctgttgtgctcccaggcttattaggacgaggaaattcccacctaataaattttggtcagaccgattgtgtgctctcaaaccctgtctcctgataagacgttatcaatgacaatgcatgcccgaaacttcattagcaattttaattttgccccggtcctgtgatcttgccctgcctccatttgccttgtgatattttattaccttgtgaagtaggtcatctctgtgatccacaccctatttgtatactccctccccttttgaaaatcactaataaaaacttgctggttttgtagcttgagggcatcatggaacctgccgaaacgtgatgtctcccccggacacccagctttaaaaatttctctctttgtaatctttccctttatttctcagaccagccaacacttagggaaatagaaaagaacctacatgaaataacgatgaattatcaggggcggattcacccaatactgagcaggtgccagaaagtagtagctgcaccagggctgcagagtggtgtggactggagcaggagagcttgcacttcataattgggaatggcaggtggtcaggaagagaccttggagcagaaagatgctggctggaagggaggctaaggccatgtgcgctgctgaggtgctcacatgcctgggttatcttgcagttatgtctgagagaagacatgatttctggcagcccagacaagttgtaactgccatatcacctttgtctagattccatgccctggggttgccctcccaggaaacctcttgggttattcttccataactgtattccagggcttaattattttattaagcaaagcacacctggcagtggcatcttggagaaaagtccaagtatggtgatgctggaaggaagccagtagtgatcccagcacccattgcctggggctctgctcttacctgctcctgaggggtgggggagacaaatttccagctctctcccctcctgaccagctggagtgatgatggcctgccatcccgaattccacgcctcttctagaggctgcaaggatagaagttggccaatatcttctccagaaaaccacaccctggagatctaatctttatccagtgatactgaaatgaaagtttgcccttgggtgtgtataggatgtaggtgtgtgaggttaatgtccatggtgataatggtggcttctggaatgtactaacagaggatcttaaagtcaatccagtagtttctaaaaatatagggattaatatgctacagtagatatagagattttatttaaactcacattcttgtagtatgtactccagagcttgaaaaagtggtatgcagatgtggtatttagcaagcatcaggatcctgaaaccttgttgaacagaaccaagtgtcctgatgcagattccagtaaacttttcattctgtatttacagactggggatgactttttccccaaagatgataaaggtaatatgatcagtggaaaaggaacgttcttggatgcctgggaggtaggttccagctttgtctaagtgtgctgggagagaaatcctcagttatccatgagattcccattgatatgaaagaggccatgtgcctgatgctttctaatttcatcattgtgattctctagctcttctaatatcctcctcatcacctttggcttttgggtgcatctgatactatttatatttcaagcctactactgagtcttcaaataagactggaaatacaatgtaccccactttggggaatacacatgctgttctcaaaccagggtgaggcatttggaacagagggtttgggcctgggtttgctcatagcagctgagtaacctagggtcagttttgtaactcttgtagggctcagttttctctttaaagaaaaaaggtcttataatacatactactaatatatatctttcggggtgtgataaaacttaagatggtttacgtgccgggaacatcagtcataaagcccatgtaatcatctaaccctaggagacagggttaacatccccatttataaataatgacatttgaaacctagattggttggtgacttgcccaggtcatgtcacaatgtgtgtggcagagctgggattagacccagactcatctgaattgcaagtccaaccaccaaaaccatcagcatggtgcttggtaagcagtgaacacacatccggaaatcagggaactttgtaatcccagcactttgggaagccgaggtggaaggatcatgaggtcagaagtttgagaccagtctggctagcagagtaaaacgctgtctctactaaaaatacaaaaaattagccaggtgtggtggtgtgtgcctggaatgtgagctacttggaaggctgaggcaggagaattgtgtgaacttgggaggtggaggttgcattgagccaagattgcaccattgcactccagcccaggcgtcagtgcaagacaccatcttgaagaaaaaaaaaaaaaagaaaaaagaaaatcagggagcctgagtgccctgcttctcagatcaaacccatgacctgtttcacatcatttcatattgaaaatgaattaagggatgaatgttttctctggccattttttattataccattatgtccttttgcaaatgctaatagagaacgaattggagaaataagatataaatgaacagtggcatataactccaagagttaatcatgttatcttggcagctgtctgtgtaggggtgcatgtagttgcgagtttgtattgtgttttacacgggaaaatatattaagcctcacctttctgaaatgcttagaattgacatgattcaattaaatgtagttttttctgtgtattgtttgttcaaaagcattaatccacaagcacagcattctttttttgatacagattctcactctgtcacacaagctagggtgcagtgacaccatcttggctcactacaacctccctctaccaagtaaaaaccattctcctgccttggccttccaagtagctgggactacatgtgcatgccaccacacatggataatttttatatttttagtagagatgaggtttcaccatgttggccaggctggtctcaaactcctgacctcaagggatccacccgtctcagcctcccaaagtgttcagattacaggcgtgagctatagcaccaggctgtttgcattacatttgatctgtgtttttgccttagctcctatgatgatatgaagtatggcaagtatgtcaatgtaccctgcttctcacagtgctatgttttcttaatgaacatgaggatgactgctaaagaaaacatttgaaaggcatgaaaagatatcattgatcaagttcagaggctctgatttgaaacgagcatgcttgaatacgtaagcattggatgtttatgtagacccacaaccagttcagtagaaacctcattgactaccctgaagcagaggggaggaaaaaagtataaagaagtcaagttttaatacgggaaaactaacctgacctatgatgcacaaaagcttttaaattatctaattgctgaatcagaagtttttgggaaacttatgatttcatagcttccaaactctacttcccaatttgaataacttaatctatgctagtggttctcaacgttggctgggcattagaatcacctgaggaatttaaaaatcccaatgtctaggctacaactcagacaaaatcagtaagaaactctgggggatgaaatccaggaatcagtcatttttcttttttaatttagagagagtcttgctctgttgcccagagtagagtacaatggcatgatcatagctcagtgcagccttggactcctgggctcaagtaaacctctgaagtagctgggatcagaggcacacgtcaccgcatccagctaattaaaacaaatttttttttttggtagagacagagtcttgctatgttgcccaggatggactcaaacatctggccttaagcaatcctcctgtctcagcctcccaaagtgctgagattagtcatgagccactgcatccagccagtacctttcaaagctcactagtgattccaaattgcagccaaaattgagaagggctgcataaagtgttccctgaacatgtcatgctcatccctgcctctgagctttgctcctgccttcctgccttcctgtgtcatatgctcatgtttttcccctcttttctctctctcggggtttttgtttgtttgtttgtttgttttttgaggcccagcttatactctacctgaaaggactcccctgacaactgcgggctgtgtgaatctcttccttctctgcctttctgactctgtctatgccactgtcatgttatctgaggcagcctcagtgtcatgattgatggctccatagaagggaactctagcactttaattggactgtaagaatcccagaagaaggaagcacattgtatacttttacatcttgacaacttctgggcaggatctagaacatgtaatagatggctactaaatacatgttgcattggaggctgctgctaacatatatgatatctttgggcaagtttggaaaatgcccaataaaggctaaaaattatacaaagattcccttccttgcatgtccatgcagcttctgtaccaggaagcatggctggatatgcaaacagtgggtcaggttttagccccacacaactccgtggccgggtgcccctgctagggcgtaatttatatgcatgaccttcttgcaaaccaagccatggttggtgtgggagacagtgactcaggacccacaggtgaggcttctccgtatgctgcagcctcttcctgactaacacagcttgcccaggtttgggtgtacaatgtacacacacaacagtagctccctgctatcatttggattcattaaaaattaaatcatctcataagcttacaaatgttgatttttatttatttttttcatgataaaactttcatatttccatggtgtatggaactataattttttatgtgtttctttacgtgtaaggtgagagtggcaagaacataaaatctttacctgttagttttagattttcttgggctggggaggggcagtagggctggaaccaatcactgatgggcacccaggccctggactgaaatttcctgtgaatgcttcagctaactctgttgcggtggatcctttagcaatttctgccccagggaagactaaggcaagccagggtccctgtagtccctctagagctgcccataaggtattcctttctatgataggccatggaggagctggtggacgaggggctggtgaaagcccttggggtctcaaatttcaaccacttccagatcgagaggctcttgaacaaacctggactgaaatataaaccagtgactaaccaggtaaattctattcagtttaagggtaagggtcctgccctattacttcttaaacattgcggggggaatgttcaatgctatgccctgagtcttatctcaggggtcagtgatcaggacactttggggaggtgtgaggctgatctcatgggtgatttagcaagaatctcagtgcgcacttgtttggcctttgcttggtggactttttttgtgtgtagaactccctaggaacaatgcaaaacagagccggctttccccgtgatgaggattgtttgctgttgcaggttgagtgtcacccatacctcacgcaggagaaactgatccagtactgccactccaagggcatcaccgttacggcctacagccccctgggctctccggatagaccttggtgaggcttccaagtggtgggtctttctcttgataatcttaaaaacattattttataattggtaaatgtcggtatgggtccataagttactggaaagaaaaatgtgtgtaaggtaacacgtttggtacacacaaatgggatggcagtgggaaaaaatgggaattaaacaacaacaacaacaacaagggcgacatgcttgaccctctgggaatatttccagttcagccacccaagggtgaaccaggcttgcaaaatgctgaggcttcagagcccggggaaaggacccaagcttccaggtcctcctgcctgtctcccagatggagaggctctgatgatcagtcttgagaccctcattggagtggtgtccttctgtacacggtagccatggtgattattcacatcagcatctttctgcccctagggccaaacctgaggacccttccctgctggaggatcccaagattaaggagattgctgcaaagcacaaaaaaaccacagcccaggtaccatatttttatttttcttgttatccaaccactcatgcttccagtctcatgtttcatttctcgtgttgtcctcaactgactccttaaaggggaagaacacaggagctgaagccctctaaagtatttcctttgaagtctgttggaacctctaggaaacacaagagctgtcactgaagcaaagatagcttctgtctcacagcttcctgtcaagccctacagcccagtggcaaagcatggctttggagtctagggatatgggtgcagatgccaactctacctctgatcagccttatgacccccaagctactttcttcattcctaaaaaaggaagatcacagggttgtctctaaggtgaagggagagaaagaggtgggggtctggcacaagtctaatagctgtgaagggctcagtaattattagcgattgtacctgaagccacagtgagctgcagagatgttttattcttcctttccataaaaggaggggtccttgtagctgagtggaaacatgatgtcccctttctgcacaggttctgatccgtttccatatccagaggaatgtgacagtgatccccaagtctatgacaccagcacacattgttgagaacattcaggtaagtttccggctggtcgggcctggtattcctcagtggagtgggggacaggcagaccttctcactaggcttctcacctcatccctgcactgtctttggccccctccttccccaccaccctatcattttccagcccagggagctaggctcggtagagctgagatgaatgacccatgggctaagaacatcctgggggcagtgcctggtaaagccctatcaggtctgagcacagttgtgcctcacaccactgagaagaccctcagttgcccctgagcagctaggccctaggccatacacaagagcagactgtcctggcctacctgctcacctcccagcagcagaggaggtgtgaactgtccttggagaagtgtcctctagaagcacctgtcatggagcacagggcctgtgcacgcctggggtttagtgcctgtgagcctggtctccctccccccagaacactgagcactacaaatactgtggtctttgtgtaggacctaatttagagaaaaatttgtatcccttggacagaatgggaaaaactcctatggccagtttgtgctgtgaatgtgagctccctccctgctagaatggccggcagtctccagccacagcagtaacagccttaccgataatgtattggaattctttcctttctaggtctttgactttaaattgagtgatgaggagatggcaaccatactcagcttcaacagaaactggagggcctttgacttcaaggagtaagtggcatggagttaactagaagaattgccaggagtttttctaaactggtagagggttagttggaaggattagaaggttgttgggactacttgtgtcttcaaatactattttggggcagttttgaaagttaaaatttgggtacctgggaatcactgtaagggacacatctctaattgctgcttattgtctgaacttctggatgtagagctagaattgtaagagaaggtgtgttatcaataggcaggaggcagaacattcatttattcattcattcagtcaatatctagtggtcatctgtgtgccaggcattttctaggtgcttgggttatcatactgtacaaagctgctgcctccacaggcttagggagggagggaagaagagacaacagaaataaatcaactcaaaatattgatgtcagacagcaacaaatgctagacagaaaagtaaagtagggcaaagtggacaggaagtggtaggtggtagtgggactgatcctttatacgggttgggtcaagggaagctttgctgtgagggatatgccatatgtatatttgggggaagagcattcttggcagtgataacagcaggtgcaaagtccctgaggtgggattgtgtttagagcattcaagcaagaaggccagggaggctggattaaatcatctccaaatgcctcttaaaggaggtggtgctaactttactttaaatctcagataagttgttgaaaaaaagtctttcactctggctaggcgggaattctacatcatctctttagaatcaatactttctgattaatgtgtctaattacatatatcaaatagaattgtctggcatttattactgcgaggtctgcaattcaatggcaatttgaatttcttcaaatatttgtgtagccaaaaatgatttttcagcttttaaaaatgatttcagtatctcaagcgttgcttgcatgtcatgatattccatatctatcctgcccaccctcagtatcatagcagcctttcctcatcttacaatggcttagtttcatccgtgcttaacaaagtagcagctatttagagtaaaaaggaagggtgaacataagatgtgactctcccccaaactaaaacacttactttcctatgagcatcatttctggtgtaggcaatgggttggtggactcagaagtaaatccacctggcctcaaatccaactctaacactggtttcttcgctgtgtgacattgggcaaatttcttagtttttctaagttggtttctttacctataaagtaggatgataatactaatcgcagctaacatccattgaaccttagcttagaatgtgccagggtcctgagcccttttccggtggtattatctcatttaatactcataacaatccccaagctgtcaattctgctgttgtttcctacctcatgatgttgtgagagtggattgggacaagacttgtctgtcacctcgcctgacaccaggcttaccgtgagttgtcattacgagtttattctgctgccctgctcactgtctgccctccttcctagcaaaaccctcatatcgatttgaaggaaggtcaaggtgtaagcacccttcttgtgttcttgcagggaggaggctgagagaccacaaataccacagagtccaccagagaagaataccttctcagcgagagttgttgctttgatggaacacagtttctttttttttttctctctctctgtagattctctcatttggaggactttcccttcgatgcagaatattgaggttgaatctcctggtgagattacacaggggattctctttcttcgctgaagtgtgactgtctccactcaagaactattttagccaagcttatctgagatcacagtgaactttgtcctgttgtagaccagaatggaggtgctgttttagacatgtatttctgtatgttcaactaggataagaatatcacagaaaagcatggcctgaataagcaaatgacaattttttccacttatctgatctgatcaaatgtctgttaagcaccagaaactctgccaacactgaggatgtaa

SEQ ID NO: 1664 - DNA, 113230 bp, Homo sapiens
attcttccgatcaagatgcttttattagaatactaataaatgcagattaaaaaaaaaaaaacctcacacagaaaaagaggagaacactcagaaatgtgattacagattaggcatattagaggaaaaagagttcttcagggtatacaaaatgtaaacatttgccctgggatttcccacagatggcacagtccacatggactcttttggaacaaaaaaatgtctattaagtctccaggatagcctctatgacatctgcaaacttgccacattaaaagttaaagttcctaaaactttctacgcaaaacacaaaatggctcccaatccaggcaactggcacatgtggaagcagaataccaaagcaaatccgtcttccaaccatcagcttcgactccctccagctactgtatttacatttaccttgacagagattacagagatatacacagtatataaaactcctacttgaggctggggtgggagatgaaatctttcttgcttatcaaatgctctggggagaggcatcaaatcagtcctttaaacttagggacagaggactaagaagacgccctcttttgttcagaaaatggagactcataaacttccatgggtgggcaggtacaaaccaggtgctgatctccatatatgtcatcaatccgggcaatcgttggccagaatttgttctctggtttcacgaagggctgcaaaggacaaaagatggaaatgctgtgagatgttctgggaggtttctcttagggcaaaggaggtggcaatgctagtcccacaacctaagacaccatcagcccagcaaatattctgagaacctaaaatccaaccctacattaccatttaaaaaaaagaggcatttcccaggaggcgtgtccctgatcaccacccctgttaagcatccctatgtgctgttgatatctggaccagtttatagcaaagttgtgtttgaaagacttcaactgcttaaagaagactttggaatctatgtttatctgcccattatatccttaagtttggatatttagctgaccttctcttttaacataggtctaatttatttgctatgtcattttccatacaattcagttgatttaaaagttaatttctcggctgggcgcagtggctcgtgcctttaatcccagaactttgggaggccaaggcaggcagatcagctgaggtcagaggttcgagaccagcctgatcgacatggagaaaccccatctctactaaaaatgcaaaattagccaggcatggtggcacatgcctgtaatcccagttacttgggaggctaaggtaggagaatcgctttaacctgggaggcagaggttgtggtgagccgagatggtgccattgcactccagcctggacaacaagagtaaaactctatctcaaaaaaaaaaaaaagttaatttctcatactgtgtattaaaataaaaatttgaacgattaaaaaaaaagcatcagctgggcgtgatggctcacgcctgtaatcccagcactttgggaggccggggtgggcggatcacgagttcaggagatcaagaccttcctggctaacacagtgaaaccccgtctctactaaaaatacaaaaaattacccgggcatggtggcaggcgcctgtagtcccagcgggaggctgaggtaggagaatggcgtgaacccaggatcatgccactgcactccagcctgggcaacagagcgagactccgtctcaaaaaaaaaaaaaaaaaaagaaagaaaaaaaaagcatcattttgtttcctctcctctccaatgaatacaggatttaccattctcattatgtttttatactattactgcatagatccataaacagcacatagcataatttggcacatttttagccttctccctacctcactcaaacagactacacagaaccttctcctccatataagaatcagaaaggaaaggaaggttgcactgggcgccatctccctgtcccacagtggagggaaacacattggtccactgggcaggactcgtattcagttttcccccactctgttccctatgggttcccagatctgtggttgatactgtgtgacctcgcctctgaaagccaatttctttgctcctcattcctcttcaagacccttatttcacaaggtgccccacatatggtttctgtaatcatgaggctaagagcgtacacccgtcaggataggagctggcccatgccttcccagctggcacattcagattcagagaacttacgagtgggaatgctgccacctctctggaataaggccggtcccagtgggaagatgtaacgcaggtcagggagtgtggagacatctgagacagagacacggacagaggaggggtcagagcaatacactctcttctcctcctaccctgcacctcaaccgtcaatcttctgacaggagcccaggcagagaaagctgttgttttctttcaatttaggggggtacaatgtgatttataattgtgaaatattttaaatatcagaacgttatggtaataatcatcacatccaccacccagtaaagtctaatgagcattctgtcatatttgcttcatcttttagaaaaaattacctacacgtttggtgctgcctgtatatccccatcccagtgctaaccactcttctgaattcggtgtttaccattctcatcatgcttttatactattactgcatatgttaataaactgcatatagcataatttggctcattttaaaatctgatatcatcatatgagtggtattatccacttgtattataactcactattatgctctttgaaatgtttattgccatttaaaaaaatagcctaaatcctgaaagaagcaggtgtcttcagagagaaaagagtaataaacggtggtaagcataatcatcttgtatgcctccatgactctgtgaactcacctctagagaggtgcctgccttctgcaagtcactggtccctgccctctcctacaggtaggcagtttggaaacctgccccagctgctgcagtcatatcagacttgttctctggcttacagccatgaagacacaaccacagccttcatggtattctccactcctgatcttccagcttaatatctggactaacaagaaacttaggactctgaccagatgtaaaattaacatgttttggaagcggcagagtaatgcccaaccaacttttccccaacatggggcataaacattgtaacatccagtccaaatgtcaatccagttttctcagagataactgctctaatataagaatgtgtgcttgtacagagtttgtgatgtgaatatgtaaattttatttatgccataatctcactacagtacatcaaacagagatgcagaatgttacaaattctccaactagacagctgtggacagcttccacaaccacatcatccttgagtaactgctatgctgttcaagacgatggaaacttcaaagtaacaactgcatcttctcagaagaattaccttattctagggaagagtatcatcctcagttgagagttcgggagttgctggtacactgtccagacatcattttctagtttaaggaacatttcaagcaatgttccagggcctacgcaccttcagcggattgaccctggggtcgatgcggccctcctcaatgtcagcaatttcctgccgaatgctgatcatggcatcacagaatctgtccagctctgccttgtcctccgactcagtgggctccaccatgagggtccctgccacaggccaggacatggtaggggcgtgaaatcctgcaaagggagacaggagaacttgcctcactgaaggtcagtggcctacccagtttggaagaaaagttcgtatcccttcttatattttatcctaagaaaatcatcagatacatttgcaaatgtatgtatgtggggactcatctcagtgctgttcatagaagaaaaatttaggaaacaacctaatatccaacaatgggggatcagataagcaaattttacagagcacctatatggtaaatagacaaccattcaaaagtacataaatgtgttaaactggctaaacattcaaaaatattaagtgaaaaaagcaagccacataatgatatcccatttctatatataaataaaaggacaaagtacttatatgtgtattttatgagggaagatgccttgaagaaaacataaaatgttaactctaaatatggccggaaaatgagactgggatttttctttcacttcgattgtattttagagtctttcagtaattatcatgtattatgtgcaattaagagaaataaaaatattatagcttatcaaaagttaaataatgagataacaagtgttaaagactctggagcaaatcttattgtccccattttgtatgataaggaaactgaagtttggccagtatgtggaaagcctttgcctttacattgaacacaggctcagtgtgtttctgtttccaaaggttttcacatgtaaggtagtgcaacaaggtatgtagtcaagagacagatttccaggacaaaaatcaaaaacaacattttcatttcttataatttttctgtaaagcatttttttttttttttttggagacagggtcttgctgtatcgctcaggttagagtgcactggcacactcacggctcactgcagcctcaacctcctgggctcaagtgatcctcccacctaagccttccaagtagctgagactacaggtgcacgccaccatgcccagctaattttgttgttgttgcatagacagagtttcaccatgttgtccgggctaccgagctcaagcgatctgcctgtctctgcctcccaatatgcagagataacaggcatgagccaccacaccaggcctatgaaacttttaaaagctgaagaacaactcccaggttgatacacctctgaactaatcttgccccaatgtgcagtggttctcaaattctggtgagcatcattattacatggagtactttaaagtaacatctgcatgatttcaaacattctctaccaacattttatttaaaaatgttcaggccaagtgctgtggctcacacacctataatcccagcactttgggaggccaaggccagcggattgcttaagcccaggagtttgagacctgcctgggcaacatggcaaaaccccgtctctacaaaaaatacaaaaattagctgggtgtggtggtatgtgcctgtaatcccagctacttagaaagctgaggtgggaggatcacttgaatccaggaggtgagcctgcagtaagtcaagatcacaacactgcactccagcctgggtgacagagtaagaccttgtctctattaaaaaaaaaacactaacatccagatgagttgaaaggactgtaggtgagcacccatatacccaccacctagattctacaatgctgttgtttgctttatcacatctactcatccagccatccgtcttactttctgacgcatttcaaagtacactgcagtcattagtacacttcactcttaaacccttcagcatatatatcatgactagaattcagtatctgttcacatatttttgtgataaaacttacagtgaaatgcacaaatcctaactgtaccatttaatgagttttggtaaatgcatacacctttgtcactcaaaccagacagggattttttttttttttaagagaacaagctgattacctatcacgtctgcccttaattccatgtgtgagcaaattcagtccaacatatcctgctgtagtggtccccatattttgaaccacctgagaagttcttgcaaaagaaattcctgcatctgggccctgattcaggaagtccaaggtagggtccaaaaatctatgagtcataaaacatgccaggtgattctgataattggtctgataattagcctggaactgctgggtaaggcagtatgccccaaaattgcctgaaaagactcacacagaagctgcgtgttaaatatacagattatcagctctcttccttaaaaattcacattcagcggttatgctttaagacctggaaactgtgttgtcatgttcattgtttttcgacttagctattcatttggtctctcatttattaacactatgtgttgagtgcctactatgtgccaggcacctggacaattctgggcttttggacaagtgtggaaacggttctatcaatcttcaaaacaacattgaggtcaggagacaacatgattcagaaacactgggtggtgacttcagttaccacctccctgtgagcccctcctctctctccttgcaaatgctgttgcagttagatgtgtgaagtaggcaaggcatccacaaagtgagtgtgttttcctgagtcggccattacccaatcgctagccgggaggctgtcaggggaaaggagttctactgtcaggttacaagagttgccaagcagagatcttgaggatgggattggtaatttcattaatgaagcctttctctggctttcccatctattatcagtgtaactgcataataagatcattcattcaagagaggagtgagtcacacacatgggattcccattatgatgcagtagtgaaactattaaatttaaaagatttttttctttttttccaaaaacaagtcattaaaactcagagaggactccatatccattgaatggcaatgttctccccaacttagcctttctgagaattgaaagatccttgatattattatcattttcatattattataatagtaatattggctgggcgtgctggctcacacctgtaatcccagcactttcggaggccgaggtgggtggattgcctgagctcaggagactgagaccagcctggccaacatggtgaaaccccatctctactaaaaatataaaaaaatagctgggtatggtggtgtgcacctgtagtcccagctacgtgggaggctgaggcatgagaatcacttgaacccaggaggtggaggttgcagtgagctgagatcacatcactgcactccagcctgggcgacaaagtgagactctgtctccccaacccccaaaaaagtaatatggtcttaatattttaatattaataacattgttcactaggaaaatgtagtgagctgagctgaatgaacacccactaatgcacaggtaaagtgtccgtgtctttcaaaatgcttcaaagaaagttgcattttctttgtgaaaactactacacttatttcttcatctctagaagcagctgaaacagctacgccatgacagaggtggctataaaactccaatgccatttgtctctaccacttcgatgggttacttgctctgtctcctttaccactacactcactgcaactcaaaggggttttaattttaatcttaaacacttttcttggctgttaatggattcaagatgcatattttaatatcttctgaagggcaggaccagtgcagtcataagcaaacttttttctctattattttggaggttgccaagaaccctgagctccccatttatcccccagatcagtttactgtggtgcctgcattttccatttgtgctttaggaagtggtccacagccagcatgggcggcggcatgaatgtcaaaagccacttaccataatcctggagtctcttggccacatccacagcctcaatatttgcagactttttgaagggtctcgtgtccaaaataaattcatgacccacataacctgttcaggaaagttgtttcagcccaagattagcatcagcttattgttttacccaaacaaatgaataagtaatttaataaataagtgcatcagctttttatgtgtatcagcgaggaccaagaagccatgggcaccgggtaagtttattattggcaataaaggtttcatttagtcttattacaaataaaaatgtttagcacactgtgccgatgtgtcttatcttcagctcactacacacctgtgaacctgattatggctaatggcaggtggggggcattactgaacatatgaccggaggtgtctggggatgagattatttctattctgcggacataaaatctacttgcaacagttaaatgtgttgtatagtcctgatccttttatacaaaatatttctagagccattgacacttttcagcaactttaccctcaacatcaaataattacttttgcgtatatataggtatggatatattaaacatatatccataagacacatacagaattttatgtttctttgaaggaccttttgatgttttggtttcaggctgcaaacaaagaattagaaatacgcgacgtcaaacagtataccgtaagtaacaaggagttaatgaggccaaagtctgtgcgacccagttcactttgttctaccaatgacatatcccttatttgaaattacagatctttatttgagcctcatgtgggcacccaaaagttttggattttcaggccaggcacagtgactcatgctggtaatcccagcactttgggaggctgaggtgggcagatcgttttagatcaggagttccagaccagccagggcaacatggccaaaccctagccctactaaaaatagaatcacctgagcctgggaagtcgaggctgcagtgagccgcgatcacacaactgcactccagcctgggtaataggggcaagaccctgtctcaaaaaaataaatataaatttttagaaaaagttttagattttcagattagggatattcgacctgtagttcataaacaggcttcttctctaggtccaggctgccagtagctccccagaatgagctactgaccacacaaccatcatcaggaataaaccattaagtcagcgttttaataaatagaccaatattcctccggggcttcccaaattccacggtccaccaactgatgaatttccttccaggaaagtatctactcatgagataatgatgtactccttcttcttaacccactttcctcactctcagcaaaaatgaatccacttatagagactcagagcaagcataacttctcaagcctgtgaagaatagctccagtaattaatagcccctgaagacagtctacgaactgctctgcttcttatagaatgaataaacatgaaagaggtggagctgggctcattggctcacacctgtaatcccagcacgttgggaggctgaggcaggcaaatcacttgaggtcaggagttcaaaaccagcctggccgacatggtgaaaccctgtctctacgaaaaaaaaattacaaaaattagccaggtgtaggggcgggtgcctgtagttccagctactcgggagactgagtgagagaattgcttgaacctggaaggtggtggttgcagtgagccgagatggcaccactgcactgcagcctgggagacaaagcgagacttcatctcaaaaaaaaaaaagaagtggttttgtttgaaaataaaactataaagagcgtaagactctgaatatactgaaactgcatatttttaaaccacgcttgaagaaaaaaaaaaaaaacttcaaaaacattgaaataggggccaggcgcggtggctcaagcctgtaatcccagcactttgcgaggccgaggcgggcggatcacgaggtccagagatcaagaccatcctggccaacgtggtgaaaccccatctctactaaaaatacaaaaattagctgggcgtggtggcgcatgcctgtagtcccagctacttgggaggcttagacaggagaattgcttgaacccgggagtcggaggttgcagtgagcgaagatcatgccactgcactccagcctggtgacagagcaagactctgtctcaaggaaaaaagaaattgagacacagttgagcgctccgtcactcaggctggagtgcagtagtgccataacagctcactgcagccttgacctcctgggcccaagcaatcctctcagttcagcctcctgagagtagctgggactacaggtgtgcaccacatgcccagctaatttttgtattttttgtagagatggggtctcactatggctaggctggtctcaaactcctgggctcaagtgatccccccacctcagcctcccaaagtgctgggattacaggccgtgagccactgcgcccaggcaaaacatgctttctaacaatgatggggaataaactgtaaggagtatgattcaaaagcagaaaattcagccgggcatggtagctcacacttgtaatcccagcatttcaggagaccgaggcaggaagatcgcttgagcccaggagtttgagaccagcctgggcagcatagtgagagcttgtttctacaaaaaaacaaaaaattagctaggtgcagttgtgcctgcctgtagtaccagctacgtgtaaggctgaggtgggagaatcatttgagcccaggaggtcaaggctgcagtgagccgagatcacatcactgcattccagcctgggtgacggagtgagaccttttctcaaaaaaaaaaaaaaaaaaaaaaaagaggtagaaaatcctattcatgggtaggtaaacatagggaaaaaatgctgaaacagaatagtaagtggaatgttcaaggggaaaatcattagactaagtttttatcaactattaataccaggactcttaaatgctcagctgaggattgcttgagcttgggagttggagaccagcctgggcaacaaagcaagaccctatcctacaaaatatttaaaaattagccaggtgtgtggcagacatctgtagttccagctacttgggaggctgaggtgggagaatcgcttgatcccaggaggttgaggctgcaatgagctatgataatgtgactgtactccagcctgggtaataaagcaagaccgtctcttaaacaaaacaaaatgccctgattgtgacaatgattggaggacgaaggctaatggaagctcactgctcggaatgacaccagacagcagggaggggaggaggggagagacacagtgggggaggaggcactcttgctggcagcgcaagaggagagtcttccaagcagaggttcagtaatagctgaaaggcaccgtcaagccaagcccaacacagcactgctaatactacagtgccatctgaagaggtccccaccatagccaagaggtttaggaagagctccattttctaaatgaggttcagatgttattttctaaatccatactctattgcgttcaaatagaaactgcggtggaattccagcatctctctccatctctatgtgagccctgaaagggatgaaatttcaacttggtggctgtcagaagccagatcctaagatgttctttgcagcttttaggacacacaaacctgctatagggcaatgttggggcgatatcaagtggaaactgaataaaccactcagcaccaacttttcgtgttaacagagtaggtgtttctgctggacctaacagtgactacagctgagaaggtaccacgtgaaaggggcaaggaggacaggagggggggggatgaaggaaaagcaaggtaaacgttgggtggctatctaagtgggaaccaccgcccccatatgttgattgtcttctgagggtaagaacaatatgggagtgtgctgtgaaaaaatagggctgctcaaaaccctccttgagagaagggaccagaccttacttatcccccatcctcaaggcggctgctgaggaataaatgaactcactgggtaactactctggaaagctctgctgggcaatcaatgcttggtcaagccttttagctgaaatccacagaacatgactaacagaatcaaacctcccggctgtttccctgtagttcaagcgagaatgaggtttccccgagaatgaggtcaggtaagcgggactgagcagggtcacttgtgagccaaggatgtgagggcccagcccctgaggcccctgcccacccatacagcaagggccacctggaaacctccgcagggacaggtatttgcaggcaaagtcgctgtttgtctgatggaaaaacaaaaaaaaaggcagaagacctgaggtcaagatttcaagataagcctagccaacatggcgaaacctcgtctatactgaaaatacaaaaatcagccgagtgcagtggcgggcacctgtaatcatagtgggaggctgaggcaggagaattgcttgagccggggaggcgggggttgcagtgagccgagattgcaccactggactctagcctgggtgacagagcaagactctgtctcaaaaaaaaaaaaaaaaaaaatggataggcatataagaaattaaaacataaagaaaacgttgggatactaacaaagtcatctcctcctactaatgggaactccattcagatcaaacctttgcctcctataaaagtagacagctgtggatttttgcaattcttcctttaaaatgtatcaacttgccggggcaatggctcacacctgtaatcccagcactttgggaggccaaggtgggtggatcacctgaggtcggtagtttgagaccagcctgaccaacaaggagaaacactgtctctactaaaaatacaaagttagccaggcatggtggtgcatgcctgtaatcccagctactcaggaggctgaggtgggagaatcgcttgaacccgggaggcagaggttgaggtgagctgagattgcgccattgcaatccagtctgggtaacaagagcgaaactctgtctcaaaaaaaagaaaaaaaaaaaagtatcatcttacctgaggtaattcctttctttcctcattctagcagaatacagtcatgcatcacttaatgaagggaatacgttctgagaagtgcattgtgagatgactttgtcattgtgcaaacagcatggtgtacttacataaactagttggtaaagtctactatatatacctaggctacatggtacagcctcttgctcctactgtactgaatactgtaggcaattgtaacacaatggtccgaatctgtgtatcttaacatatctcaacatagaaaagacagagcaaaaatacgacataaaacataaaaaatggtacatctgtgtagggcacttaccatgaatggagcttgcagggctgaagttgctctggatgagtcagtgagtgagtggtgagtgaacgggaaggtctaggacattcctgtatactaccatagactttgtgaacgctgtacacttaggctatattaatttatttaaaaaaacttttttcttcaataataaattaaccttagcttactgtaactttttttatttttgagacagagtctcaatctgttgcccaggctggagtgcagtggcgcaatctcggctcactgcagcctcctattcctgggttcaagcgattattatgcctcagcctcccgagtagctgggattacagatgtccaccaccatgcctggctaatttttgtatttttagtagagacggggtttcaccatgttggcctggctggtctcgaactcctgagttcaagtgatctgcccgcctcagccttccaaagtgctgggattataggcgtgagccaccatgcccagcgtactgtaacttttttactttataaactaaattttttaaacctttctgactcttttgtaataacactttaaacacaaatacattgtacagctgtacaaaaatattttctttttcaatgtccttattctatatgctttcttctatatttaatttctttttactttttaaacttttttgttaaaaactaagacacaaacacacacctttgtctaggcctacagattcaggatgctcaatatcattgtcttccacctcctcatcttttttttttgagacagtgtctcactctgtcacccaggctggagtgcagtggcaccattacaactcactgcagcctcaacttcccaggctcaagcaatcctcctgcctcaaccttccaagtagctgggactacaggtgtgcaccaccatggtggttaattttttctttttttttttttttggaagagacaggtctcatgatatttcccaggctggtctcagactcctgggctcaagcaaccctcccggcttggcctcccaaactgctgggattgcaggcatgagccacagcacctagccccacctccgacatcttgtcctctggaaggtgttcagggacagtaacacacacggagctgctatctcctgtgatgacaatgccttcttctggaatacctcctgaaggaccgccctgaagctgttttacagttaacattttttttttacagtagaaggaatacactctaaaataatgatgggggccagacgcagtggctcacgcctgtaatcccagcatttggggaggccaaggtgggaggatcacctgaggtcaggagtttgagaccagcccgggcaacaggatgaaaccctgtctctactaaaaatacaaaaatcagccaagcgtggtgatgaacacctgtagtcccagctactggggaagctgaggcaggagaatcgcttgaacctgggaggcggaggttgcagtgagccaacatcacaccactgcactcccacctgggtgaccaagcgagactctgtctcaaaaataataataataataataataatgataagaagcattatgtagtgaatacataaaccagcagcatagtctttatcattattattaggtactatatattaaatgtaagtgtcatacttttagacaacccgcctcagccttccaaagtgcttggattacaggtgtgaaccaacacacccggctgctactaaataaaattaaacgtgaggaagtttaaaatatgaacaaataagcaattagggaaaaaaccaataggatgcagttatatgtctttttaagatatggaaacaacatgattttaagctgtgaaatcagagagtcagctgtgaaggagaaggaagtagacagaacagatgggggaacacagttaccctggatggacaaggctggcactaagaactagggaaacattgagcgcattggctacatatactaaaacaataaggtcattttcacctatcaaattggccatgatatattgtttacttgttcttctgtctagttctcagtcctcactaggcccctgtgtgatggccactctcatatgttatcactgtgagataaattggcacaaagtctctgggaaaaaaattgaagccatacatgtcaaaagcttcagtgcatttatatcctctgagataataattttttctatgactctctcctaaggaaattatcaggcaaaattctttaaaatttcaagcaaaggatactcacggccacattgtaataaatgcaaacaaagggaagaaaaactatacaattggttaaatcatggcacatctacacaatggaattgacagtgccactttcaaagaatatttagtgacaggggaaaatgctcataatatacatttaaaaaataggctaaaaactgtatttgtaggccaggtgcagtggctcacacccataaccccagcattttgggaggccgaggtgggaggatcactagagcagaggagttcaagaccaacctgggcaacagagcaagaccccgtctctacaaaaaatatatatataaataaattagccaggtgtggcgggtgtatgcctgtgttcccagctacttgggaggatgagttaggaggatgacttgagcccaggagctgaagattgcaatgagctgccatggcaccactgcacttcagcctggacaacaaactaataaaactatctgtagtatgatcaattgtacaaacaaagaggagaagaaatacagaaaatattagtaatggctataactgattgatggaaccatggaccatttacattttctttgtcatgctttattattttccaaaatgtccgtgttgagcatatatacattatttatgtaatctgatgaaataaatattgaagctattccttaaagccaatacacaagcaggatacatttcacagagcaggagctaagctagatttgaattaatcagaagctcttgtcacttctttagtacccacttcacagaagcattttattgtgctgcttagagacatgttgcccacaactgtgttttctgctctctggggagcattttaaccagcacttctggttatttggtcctattctttttcaaactgtggaaccacccctttggatactgatttataaggtaagaccagccattaaattaaagatcacagctatagagctacattccacctggaccagagaaaccaagatcccataagcgctttgttgctgttgcccaggtgcaggcgggtgggctggttcctgacgtctgtctctctgatctaagctccaggtcctggtctctgtcctgctcttactctgggcccatagcaaggacttgtacctggttctcagttccagcctttcccttccagggtgactttgttcccccatctgtttttctctcaaaggtatctttgctctcccttctcacagcttaaaatcatgttgttttcatagttaaaaagaaaatataactacatcctactgaagcagccccctcctccttcactacctgcaaacatggaatccttttcccctctccttcccgacctccatccacatctcagcccattttaaacacccagcgtctgcctcaccattgtgcccaaactactttcaaaggctaccaaaggcttcctaattgttatagacaaaggttccttttaagactcataatttaaaatcagatgtcaatcatacctcagtaaaagcagaaaaaatctaaataaacttaagtaagattaaatcagccacccgctctttacagtgtctctccttattatgcgtcatcacgtgcatttgtctgttgactgccagagaaacaaagcaggcgcagcctccactctctcctggaccctggagtcagatggacagagccagacaataccaagtgggagagcagctgctccggggtggggtcgggggtgggcaagaggagggagtggaggctgcagggaggaggtggagccacacggcagcaggagggccaggcaggggtgttgagggagaggcactgtgccaagcactgccagggttctaaagctgcctcaggtgtggagtgcccctcaccaggcacccaacttctccctccctcttaatgtagccatctacttgaggcgttttgttctggcttctcaccttcaatattctttcctggggcctcaccacttccaagactcagctattaggtcctgagcccacagcccaatgtgtaaaaggatgcctggtttttagttccctcccatcacttccagggtgactttgttcccctgcctattattccctctactgtaagccctagaggctagctaaccttcaatcacaggtgtgattacaggattgcaggtgtgagccaccaccccagccccttgctacctctaaggcatgtttcccccttgccgccgtcttaatgattgtaacggtctcttcatgaatccctaccctcccctgctcaaaaacctttaatggctattgtccagctcaagggtgaagtccagagccttccaaggccttcaaggccccacgctacatttccagcctcattgtcatttgctccctctcccctatcccatccttcactccagaccagagagctttcttttctctggtttgctcctgtgtctctgcttactcaggctctcatcggctacgctggcttccaggcccatctcaaatggctccagcaagaaggcgctgtcaaccattctatcctgcctctacccagtctgagttactctactctttcaaggcatatcatagcactttgtaaataattagcttatggtatttatgtacacatttcagtgttgtggaatctttattgacctgggctgctgtgtagactaggagcctaggagaaacctgcatatagtaatgcccctaaacagttaactaaagtggtgttatggctgggcgtggtggctcatgcctgtaatcccagcactttgggaggctgagacaggtggatcacctgaggtcaggagttcgagaccagcctggccaatatggtgaaaccctgtctctactaaaaatataaaaattagccgggcatggtggtgcacacgtgtagtcccagctactcgggaggctgaggcaaaagaatcgcttgaacccgggaggcagaaattgcagtgagacaagatcctgccactggactccagcctgggtgacagagcaagactctatctcaaaaataacaagataaaataaaataaacccgagttatttccaagaactctacactattttctgatatgtgctaagaaatagaagtctcttgcccatgtcagaaaagcgcatctaggtcaaacttagtttggccaagaaaaaaaccaaagtaatgatagattaaagttgatacttgcctcttgcacccctgaaaagaattctgtagtgtgtttctaatcgcttggccatgtagttggcatttaatatcgcagtttccgtggcttgtttaagacccttgcctcccatcatctgcaacaaagggaaaaagagccattagccattgaacaggcaaacacgaatgtgaagaaaccaaccaaaagacacccccagataaactccacccacaaaggaaggcagcccaccatgactctggagtaaagatgagtggaaaattccaacaaggatatctgtcagatccctgtaagcctgtaatacatttttgttttcttcttttaatagtagttttacgttctttattgtagtagcaaagcctacaacagggcaagctgactactgactactgtgttatctaaagagagaaaagaattgttcttaaattacatgtgttttgtgatttttttgtttgtttactatgaatttgagaggtcttgataattgccaggaatccgatgggatctgggccaatatctccacggaagcaattttgtctggtttattttcccattgtccctagtagaggctgcttatgtttaaaaactgctcaatcttgtcctggtagttaagagtccctgtgatcataagggatacacatcatcactgcaaagagcttcaaatcaagactgcaccaattcttatggcctactttcttcccagagtacctcacatgtgatggagttggcatatatattaaatacataactaatgtaaagagaatgagagagcaccaaataaaacaacagtagtactttggtatcattaagggggtccaaagtaaaaaggggccacattgctccaggctggtcaaagaagggttcctagattaagagccagaacttggctagaaacttagaaataagtagaattcggatagggaaagagaaaggagaaggtataccaggtgagaagaatggcagaaatgaaggcgtggaaggggagggcacatgactgtcatctgggagtggatgtagggcaaggtgagttgtgactccatttttaagcccaaaacttctctaggaaggacttcgactttgtccagccaaccactggctctcaacctatgtctcatggggggattttttaaaaatgcagacggcttaagtccaaccctacatgtgctcagtttggttctccttggaatggggcctaggcatgtgcattctgaaagaatcccctaaggatttcgtgcaggctagtgagaaccaggtaaagcaacaggaagccacgagagatacgtgggggcctagggtgagtctagcagtcctgtaggtgcgcctgtggaattgcagcagggagagaagcagctaaagctagagtccaggggataagtaataacagcctgaaataagagaaggcccaaggccagagggggcagcttaaaccctactttatttatttagtttttaaactgaggcaccagctgttgttccaggcatgtagccaaaccaaccttggggcatttatttcctatatgtgggaagtcatctccaacccaaatatgttcatacaaataacccagatttacagaacccagagatcaaaagggaagtggaatttgattctgcttacaaagaagcagacctttattctgattgcttgtgttgtttgcaaaacaacttgagtatcatttttaaaagcaagtgttagtgtctgaggtacagaattgttccggcttccaagaaacttttcgtgaagaatcataaatgccatgctgttccagaaataaacagtcagctccacagagtcctctggaatgattggcatagctgcgttttgggggttttgtttcagtgggagcccgccttcctttaaagaggggcactgctttggggagactgctctaatgagcagccaaacaagtgttcttattcacagtcttgtcagtccaggaggtgggcagggcagtgtgaacaagaactgtagaaaatcaactctggccctggtgttatttggaataagacaaaggaaggaagcctgtactctgactaattacgcagagagcacagcaccacaaaccctaaaggccaaagagctctggggaaaaaccagagaagcaaatttctgctatttttcatcttctcctctggccccccccaagaaatatatagcaaagtgagatatatagcaggatctcagcaaagtggaataattagtacatgcactgcttttcactcggaaggggctatataaatcctgcaggaaaccaaaggatgcggccagaacatccatatgactcatggaacttagctgtgtctggaaaaatatatctgatgtttcagtttctctgatgttaaacccactctgagaacccaaaagaagtagtgtaatgaaggagagatgaaatgatttttagctcatctcttcaggaaggtttcttccacccaggccatcagcaatattctttgaaccacatctcagatcatgaatttatttgtttttaagccaagaagtctgcagtatccggtccccatgcatgcctgacgcccccacccacctgcacacctgcacatactcccaggcctcaccttgatataagcccaggaaatgggcaagatggaactggagccccatggggccgcactgacggttcccacaggacaggcatcctcattccgctttagtgaaatgacgggatgattgggcaaaaacggggcgagatgtttcttcctgtattttttttaagtgcaaattcagaaaatgtaaacgattcagtttaatctaatgggaaggttctgggccctcccagaaagccttgttcttagcagaggagctctgacagtggaagggactctccacctgctgggaggcagatgttcaggaagcgatccttccttccttcctcctctggtggaggtccaccagccatcagtgtcccagggctcacccaagaaatgtggtggagggcttgatagaggcaggcagccataaaacagtggagttccatgtccctccctcccactcccagccccattccctcacccctatacactttcccaagatggacataggaggggctgatgagaagatgccccatgggctgacatgaacatcattctccccacctccctgacagctgaagcactggagctcacacatttactagaaataatcatcatcaaaatgaatctcactttaaccgtagtccaagaaaaaaaaaacaagaaagaagaaaaaagtaagaaggccaagcttccagcaactctgaaaactgacttctttagcatatttttgggagactgaagcagctcaggaaaacagctgctctcatcatcattttcccaagatgatttgatttcagtgtaaaaagttatccacagctaagaaatattccttcagtcctactctggcttcatccaattatttctagtaaccaggtttgtttcttccttacttatgtgttacttatctcaacaccttacatctaattcactttcaatggaaccattagctgattttaaaaaagaaaaaaaaaatgctaggaaatccaaaagtccgaaaggcactttctagtgccaatattccagttacaatacgtatgctcaggtgaagttccctattcattattctgttaataaacctgctgtctatgtgcaactggaagctcagtgaggccagatgctatggttagtaaaatctaattacgcttttctttggaaatcccctaaaagcacccattttgctgctcctcccccagcccctacaagtgcactacaccgatgagggtatcctcaacacatgaagactttgatgggatgagtagtctatttagggccactccttcattctgtctccaaagccatcctgaaaccagcagcccagaacttacactccgatgggccccatgccaggaccacctcctccgtggggaatgcagaaggtcttgtgaagatttaggtgcgagacatcagacccgaagtctccagggcgacagattcccacctaccacaaaggcaagggccaaaagcaaaagtcaagagcttggaagcaccctccagtgtgaaggccatggctggccggtgctgccttctcccctcagaggaaaagcaggcagagccacatccatggtgttcacagaaatgtcctctatactggcccagttccgtagtcacaaactggcatccgataggcagagtgcttgtggttgctatggaaatagcaactgaccatttagtccaatttagatttaaaaatatggatttgaatacacagtctcttcctaattatccacacaccacaaagggagagaagtgtctctaacacaagaaagggcagaacctccatgttgttgaaataggcaactcttccctgagcagcgctaccttcccctgcgtggtcggctttagtatgatgcacgttaccgaacggccccgttgggcacagtgatggaaggggctgcgggggcaccagggaggaggctgaactgagagagggaaggcaaggctcgcagtcttcccgagatgacccagataccaggcatgccatcccactagccttcccaccacttgggtgttaggactaattttgatggtgaccaaaggtacagaattcatttatgctacagaaccaatagacaatctctggattacacttgtgaaatgaatgagaaccaaagaaaggctctaaaatggtaggaaaaaaaaaagaggtcgggcgtggtggatcacacctgtaatcctagcactttgggaagctgaggcaggtggattgcctgagctcaggagttcaagaccagcctgggcaacacagtgaaaccccatctctactaaaatacaaaaataaaaataaaaaaatttaaaaaaattagctgggtgtggcagcatgcacctgtagtcccagctactcgggaggctgaggcagcagaactgcttgaacccaggaggtggaggttgcagtgagcagacatcgcaccactgcactccagccttggcgacagagtgagactccatctaaaaaaagaaagaaagaaagaaaaaggaaaaaagcaaacaccaataagagtctcaaaaagattgtgtcactcctctcctgcaggggctcccaacagcatttcttcagaggttcacagtacatagatcctctgtcccccaagtaatcaggattgggccctttgagcccccatttcacagctgataaagctgatgccaggataagtggctttccaaggccatgagagatcaacaaccaccagtggtcaggtcgtgggtctgagttccctcaggcaggaagcctctcaagaagtcagaatttttttttttttccacatatccattttctcagtgggaactaagggcgggcctcttcagttcccacctgagcattcatatttgccccgtctaggtagacctgtcctccatgttgatggatgaggtcacacacgtcactgatgttctcttcaaacaccccattggtggatgggtatgtaatcatgatagctgctaggttctccttgtgcttatccacctgtgaaagaaaaggggtagagaaggacatggagggaggatatgtttctttcttggccaaatcctcgcctttcattttaaaggatgaagaaagatgaagtctcagtctttactttcctggaactgtctcaaagtacaatgacagcaataaaaaaaaaccacagccattactcccttcacaaatcattccaaagaaataataagatcctggctgggtgtggtggctcatgcccgtaatcccggcactctgggaggccgaggcgggcagatcacctaaggtcaagaattcgagaccagcctggccaacatggtgaaaccccgtctctactaaaaatacaaagattagccgagcatggtggcaggtgcctgtaatcccagctacttaggaggctgaggcagggacaattgcttgaaccggtgaggtggaggttgtagtgagccaagatcacaccactgcactccagcttggacaacagagagagactccacgtcaaaaaaaaaaaagaaaaaagaaaaaaagaaataataagatcctttcaggctaggtctctatggtccagaccaaaaggactattcacaagatttttggatattttgggcccaactctctaaggtggttttcccttggttcaagtcatctcaataacgatttcagacgtttgtggttctaggtgcgtccattctcatagttaatctctctgctcatcttctcatatccattcctttcccttgccttctgttgaagttaaaattcccaaattacagctagataggaggagtaagttgtagagttctataccactgcaggatgactatatttaacaatatataattttgaatagttagaaggaggatattgaacgttccctcaacacaaagaaatgatacatgcttgagatgatggatatgctgattaccctgatctgatctctatacatttgatgtatagaaacatcactatataccccatgactatgtacaactattgtcatttaaaaagataaagaacagaggccaggcgtggtagctcacgcctgtaatctcagcactttgggaggctgaggcgggcggatcatgaggtcaggagatcgagactatcctggccaatacggggaaaccctgtctctactaaaaatacaaaaagtagctgggcatggtggcacacgcctgtagtcccagctaatcaggaggctgaggcaggagaattgcttgaacccgggaggcggaggttgcagtgagccgagatcgtgccactgcactccagcctgggcgacagggtgagactccgtctcaaaacaaacaaacaaaaagataaagaacaggaattggaaaaaaaaaaaaaaaaagaattcccacaagaagtgtttctgtaaataaaagtcttctttattctttccttttacagaaggcaagcatatataaaagtcacatccctgtttgttttcctggccagcatatcagagcaggcatgtttgagaacatgggggtggccagggaagtcatgtcctatattactataatggagggacttaataatttcaactactggcctggaacacttgttggaaaaaagctttgtggagcaatggaagggtagaggtggatcgaagagaggtgcagcattgtggattttcagcttcctttagaaggcaactgcacagagttcacagtctccatgcctaataacaccaccatcaaaatcacattgctattccactggtttccttcccgcttaagatgcagctgccagtccgctggtgggaagcagatacggttgctaagcaacttcttcctggaggttgggaggttgagagtgggggttggtggaaaccaagctgcatgatgccaggaattcagcatgatggggctggcacagtcatggatatttgcaaagctgacatttgtgttacaattcctgacacgaagatgtgtaagtgtgactgccattttgattattaagtggggaaggcgagaaggagagggaagattgggcagaaagaggcaggcaggttctgcaaggagtactcttactaccaccatgaataattcattcagttttttacacaagctggaattagaaaacggggatttctccctgttggtgatgggaggggtagagtagactctggtcaaaggaagaactgcagacttttcattagaatgcaagagaagacatttacataatccatcaagtccctgatccccaccagcactccccatcccggcctctcccatctgctaaggagaagacaagtaccatggccttgaggtgaactgcatcgatattcccatatttatccacctccacaggctgaatcttcatgcctgccatgtgggcacttgctgggttggtcccatgtgctgatttcggaatgaggcaaacctacagaatagaaaggaagcaaagaaagagcaaaatcatcatcagactatgaataatgacagaaaagtactacaacatgcttgtagcacaaattagacaccacctgtttttatttaggctgaacactagtgctttaaaatctgctacaatttaattatttgtcattgcaaagcaatgtccaaaaaaagtttccatatgaatccctaaatattgttccctgaagatgctcaggaaatcaatacaatcttcctttatcccagtacaataaaaataggcctggacttattctaaccttgtctcagttaggatacacagaaagcaccttagaagaacatgagactggaagttaaactcaaggactcagggcccacatcacagcttcagtgctctgcttggcttatccaggacagatgataatgacagacgttaattccaaggcctcccagtaccaatacaccaattatatcaatatttatcggatgtttactctgtaataaattattagtttctataagaaccataaactaagcattaataatgatcaacccggccaggtgcagtggctcacgcgtgtaatcccagcactttgggaggccgaggcgggtggatcacctgaggtcaggagttagagaccagcctggccaacatggtgaaaccccgtctctagtaaaaatacaaaaaatagctgggtgtggtggtaggcgtctgtaatcccagttactcgagaggctgaggcaggagaattggtttaaaccaggaggtgtaggttgcggtgagccgagattgcgctattgcactccagcctgggcgacaagagtgaaactccgtatttaaaaaaaaaaaaaaaaaaaaaaaaagatcaacctggccgggcatggtggctcacgcctgtaatcccaacacttcgggaggtggaggtcaggagttcaagaccagcctggccaacatggcgaaatgctgtctctattaaaaatacaaaaattagccaggtgtggtgacgcacgcctgtagtcccagctactcaggaggctgagacagaagattcgcttgaatccgggaggtggaggttgcagcgagccgagatcgcgccattgcactccagcctgggcaacagagcaagactccgtctcaaaaaaaaaaaatagctaaaaataaaaatgaccaacccctaccccgggttcacacaactcactcactaacaatggtggcctgtgaatgactgtctagagtccagagatgcagcagaaacatggacaaggggatgtagcttcaggttaaggaaatcaaggcaaagtgcctcaagagctgagcctaagttagagcttacagctgcactgaatttttatggaagctggacagtaggtgcaatgctaaaattctcagactcaaatcatccttcatttcctccaaacaaccatgtggacacaggctcttgtagaactgacgatgtgtcccagtgggaaagtaagtcagaaggttttccccaacaaaaagcatcaaggagaagccatgattaccctgaaaatcatcctcctattttttatcccacagagagatggatgggcattattgaaaataggctatgaagttaaatcttagcttacagctctttcctcaaaaacagcaaaggagtctacttaagaaaaataaacgtgtacaaaaagaaaacattagccaaaggcaaacatgaactactttgcactcttctactgtcagaaggtttgtgtccctttagaacggctgttggtctcatactggttatgtcacgttgtcctcaaatccgttttcttgtttgaatgcttcccttttgtagttaatttttttctttaatttctgaggacccaagctggaggcactgtcctctctcacaggtattgctagtctacaaaaggatcgttggatgaaaggatcccttcagggcagaatattgataagaaggagaaaggggaatgttaaaaataaatataaaatattcatagaaagccaaaatgaagaattcataccaggtgagttctgttgaaacacaaacatataaaaacgtcaaccaccctgtggtacactgaataacgggctcccaaagacatccctgtcctaatcctcggaacctgtgggtgtttccttatatggcaagggggacttgcagatgggattaaggtaaagaaagatcttgagatggaaaaattcttctggattttgggctgggccctaaatatattcttaagtgtcctcatcagagggaagcagagggagatgggaccacagagggagcgggagatgtgctgactgaagcaggaagctcgagccaaggaacgcaggaggcctgcagatgccaggaaaggtaaggaaacagattctcccctgtctcccccagaaggaatcagctctaccaacactttgactttagcccagtgaaaccaatttctgacacctggcctctgcaactataagaaaattaatgtgtgttgttttaagccactaagcctgtagaaatttatcatagcagccataggaaactaatacacatcctggtacaaggagcgatggaaagagaagtcacagtggctttgtgaagcactcatttatatgttgctgtcagacatttctggttttctatgaggatttagaggactttaattattctttataatgttaagtttttcctcagtttaaaattgtagtgttggccgggcgaggttgctcatgtctgtaatcccagcactttgggaggctgaggcaggcggttcacttgaggccaggagttcaagaccagcctggccaacatggtgaaaccctgtctctaataaaaatacaaaaaatagccaggcatggtggtgcacgcctacagtcccagctacttgggaggctgaggcatgagaatcacttgaacccgggaggcggaggttgccataagccaagatcatgccattgcactccagcctgggtgacagagtgagagtctctcttgggggaaaaaaattgtattgttgtgagggatatggaagtaacacgacccagatttgaagttttggtttatccaaagcaaatccagcatttggtgcattgatgcccatttagggggtgctatgttttctcaactccccagggtgccgcgtggcatagaatagcatgaggtcatctttagacttgttgaatgagtgaagggttaaggagatctcctgtgcaagggaaactaatgtcttaccactggtaaaatctaacaaccaaaggccactactttgtctcaggcagttgggaagaaaaaaatattcccatacaggttttgagctttctttgttgatttacatataacataatttgtttcctttggtcaatgttttccctttgtataggaaactcagactctgaacagcaaacctaattgtttttctttagagtttttattttttcgtaagatctggaggtctgctgagtaagtcaggatttgactgacaaattgaaatattaattataaagtgttaaaggccatgcctggtacatggtaattgccatataagtgtttgttaaataaatttgtattctcccaaagtaaactcataaatcaagaagttaggcattccattttaggaacctctgaaatttaacctaagagaaaatgtgaaaataacttcaaaaagcagcttgaaagaaaagacccatcaggagcccaggcacttctgtagcacatgatttccccacactccctgcacatgacttccccacactccctttcaaaaaagaatgatatattttgctggattccattagaatctattgtgtgggagcagctgcctcagacatcagtgatgtgaaaaaatcttccctgattagtgaatactaaatcattttcttctctaactaagaaagttggctttaattaaaaaaaatttttttttgagagggagtcttgctctgttgcccaggctggagtgcagtggtgcgatctcagctcactgcaacctctgcctcctggattcaagtgattctcctgcctcagcctccctcagtagctgggatcacaggcgtgcaccaccatgcctggctaatttttgtgtttttagtagagacagggttttgctatgttggccaggctggtcttgaactcctgaccttaggtgatctgcctgccttagcctcccaatgtgctgggattacaggcatgagccaccatgcccgagctaattaaaatttctgatccagaaggatgccaacatttccaggctaatgagctttgtatttctaccagctcagtggctggagggcttccctgcctctccctttccccctctccctgaagcacagcacccagcccctctccctcctgcagagtgaaatggcctctcatgacacttcagtgatggcaggatgggcaatggggccaagagaaacatcacacacagtgggtggagaagggaaggaggacaggaaaacacaaagagagggaacaggaaccagaaagaatccacaagtcacggaagaaccccgcccaggccaaacccaaaggcctttcattctttctccttggcctttccagtttggtccccagctgctggacattcacagctacttcctggtgtcagattgggaaatttgggaaatggcgaggggtgggaagcattactgcgtggaaagaatctggattttagctggccctttgccattagctagtcacctgctttctgcaaacactgctttctgcggcctctccgccaagcagtggaggagtcgggtggagatgtcacacaggacaggctgcccctttccagcatccccaggctcctgggcacctcgtggtgaaagatactaatgaagaggaactccagagacgacctcagaacatggaagccatgagggaaaaacagacaggagagaatctggcattgttttactggctggacacctggagctccaaagtttcctttctgattctgtgaaagtgccgagactctcaggtcccaagagcaattatagttctaaactaatcattccttagaaagctgagaattcagaaccacgaatgaacaaactgtgggggaatttcagggtctgtgtctgtctggttgaccacttcacttctctctggactggcaagcagtccttgaccagggtttaatcatttattcaattcacgaatggcctgtttttcaaagatctttagacatgaattctagggccaggtgcagagggtcatgcctgtaatcctggtctccctagcactttgggaggcttccttgagcccaggagttcaaggctgcagtgagctatgaagagaaaaaaaaaagggccaggcgcagtggctcacacctataatcccagcactttgagaggtccaggggcgggtggatcacctgaggtcaggagttcgagactagcctgatcaacatggtgaaactctgtttctactaaaaatacaaaaattagccgggcgtggtggcgcatgcctgtaatcccagctactcaggaggctgaggcacaagaatcgcttgaacccaggaggcagaggttgcaatgagccgagattgggccattgcactccagcctggggaacagggcgagactccatctcaaaaaaaaaaaaaaaattctattccccaaccaagatgaaagcctggaaagacacacctgtggaatcaggatgaactatgcaagggaaggagggaaaaaaatgttccttcgtttcccctgttatgaaagggaagtgaaacactttcagcattctttattgcaaattccaggcaactagccataagtaaccttccagtggtaataaaaccagaaatggactaagatcgggccactaccactccaccctacttacttagccagccagcaccaccctatcccctttgtctgcaactctctagtatcagcagatgcttttgccctgctctcggctcctaggcgatgctcctattaaggacttccgccccacagctcagtacaaactctagcatagcactggccatcaaaatgaaggaaccaggaacacaggcctcctctggcacaagctgaggcctgagttaggccactgctacaggcactgcccctggggggagcgagtggtgtccattagtacctgctggtccccacagtggtccccaagaggcgattgggatcctggagaccaggttctcatatccaaagcaaacattgaagcaggaccgtgaactctgctttatgccttttttggtgcttgaagttgagaatcatctaatggagaatttatttattcaacaaatattgtttgagcatactatgaccagaaccgggcttcagcacaacaggggttactgaagaattaaagcatggtctctgcccttcatccaggcccagggccggggctgagccaaggagaggatgcttgcaatggcaacattcctgccctcttcctccctctgctccctagagagcagttccacagccaactggctgacgtttgcattctgggtttgagcaagtcttttatctctgaatgtttttcctcaaaatggtcaagtgggatgtcttggaagcaaggatcataatggctagttcacagaaatttgtttcttgactatatgttccctcatctgcttccaagaaggcttggagggagtgtcccacagaagggaccctgagagccaggacctctgtgccccatggtgagcaagcgccacctcctgccatactcaccgttctgtgcccctctcctttctggtttaagtaggctcggatagtggccagtccagcatattctccctgggctccgcttgcaaagacaagaagaaagggatcacggttaggtcttctggctttcatttactcattcaatatttattgggccctggccaggggttcaccagcacgtgacacatggtcactgtccagacgctgagagaagctcatcaaggagctctgctggagtcaaaaggtcttgaacaatcaaaacaatcaaagcaacagcatccagtttgtgcactacagctcaaccactcctacccaaagatggagctttctatatccttgctcaggaccacgcattgaaaatagccttttgttattatgaaaaatttcaaaactataccaaaatacagtgaagaacaaaaggaactacgacgtgtgtgtcagccagctgtaacaatttggtttacggtcaatcttgtttcctattatatttctcactaaccactttcatgctgaactatatattttgaagcaaacttcaaacatcctatcatcagttcaaatgtcaatatgcagccttcaaagataagtattgtttttaaaaatataactacaggccgggtgcaatggctcatgcctgtaatcctagcactttggggggccgatgtgggcagagcattcgagctcagaagttcaagatcagcctgggcagcatggcggaacagtgtctccactaaaagtacaaaaaattagcctggtgtgatagcatgcatctgtagtaccagctactgggcaggctgacatggaaggatcactggagtctgtgaggcggagactgcagtaagccgagatggtgccactgcactccaacctgggtgacagagtgagatcccgtctcaaaaaataaataaataactacaaacacaattgtcacacctagaacaatgaacttcagttttttcctttttttttcccttttctttccccctttaaatgggtaatgtgtcaacatcttaacaaggtttaaggaagacacacctatgaggtgaaaacaaatcatcactctataatttcttagtattaccaaatatcgagtcaagggcctgatcagccccaaaagaatgaggcacttttaatgtgacaccattcctggcagtctcaggttcggctctcccaggccccggatgcagatggctgttaggggctggccatcctcatctcaacggtcctggaaggcaccactttcagggcatatgccatgactaacattccggtgagcaatgctgactcaatcgtagactgttatttcatgttcccagtaccctgtgcaggaagggaagggaaatgagtaatagatgtatcagtcccattcaaaatgtgtatgtctgcgaagctgaaggcaaaaattaaatactaaaaaaagatacaaaaatttaaactttaaacaaatgaaaatttaaaaataaaataactttttttaatgttacccacagaaaatcggtaagaattttaaaaaatgtgtatgttctccatgccatcacccccattttgcacacaaagaaactgaggtctgagtgctacatgccaaatggccaacagtgacagatgaagacttgggtgtggagtcagcctgcctcccagagctacgggctccctttgcaagcagtgctgctcttctgagcacactgtgctctccaaggacggagagttgtgggagcaaatgctgattttctttctagcagaagtcttgtctgattgatagaactggggggtttagctaaaataaaaaataaaaaaaaaaagaaagaaaagaagaaagaaagcctgtcttacaagacctgagtcaccccgttcctcgtcacccgcactgagtcagctgcagctatctccgctctcttccaagaagaaaggcaaagactgctcttctgttttcctggcttctgaaaaacaagtcctagcctatttgaggttttttcattttgaggacaagaaaatgaatatgccgtgcttcaggaaaccactcacatcacaagtaacttcatctccctgtgcctatgtgcctgagagatgtgtaaaatggggatagtaacagtacccatcacacagggcagatgtgatgtgtagtgagatcatcaaggtcaaatgcttctcagccaaatcctgcccattcttcaactggctacaactctctgcaaagccttccctaaagccaccaatccagctctgtcacttcctcagagaggccttccctgaaggcaagaattttgtcaaccttgttcacaattgtattctctattccaagaacactgacataaaaaatatttgatagattgattaaagaaataatcctctacctcctccaaattatcatagcattttactctacaatcttatctgacattaatatcctatacatgtactggacatagaaaattattaccgatttcacatttactttgtatgcctgtcttatctcaattagagcataagctctgacagtagggtctaattctcagagttctgtatattcttcaacagggaatatatagaacagtactctgcatgtagtagttctgcaataagtatttagtaaatattttaaaaattgaattcctccagcacaggcaatcaatatgaatgtcatcctttcccctacagtaaggaacctcaagaaaaacattttatatttacccctatgtttttctcatgaattctattcatctgactttcttgaaaggccaatcaaggtgtagactaggaatgaaggaagaagcagattactggctatgagccagtagtgtaggagaaagactatatgctaaagacttgatcagaaatgctggatttctctctctctctctctctctggccttaaacatctataaaaatcagctatgtttcaacccaaaaagtgcaaatgatatattcaaatgtgacacaaggattactactggggcattagtaaaacaaattgttagtgccacctgttggtagaaaagtcttatgaaaaataattgcttatctacataacccagactaagcaaccatcaacaaactattatatatggaggacaggctaggtcagtgcttttctgacatctgtttaaaatgaagtagtgaatggtctggagctgcagggctggccagtgaacggggagcctcagaaacaccaagtttatgtgagcacagcttaaactgtcctagaaaaacaaggccctccatgccgggcgtggtggctcacacctgtaatcctaacactttgggaggccaaggtgggcggatcacctgagatcaggagttcgagaccagcctggccaacatggtgaaaccccatttctactaaacatacaaaaaattagccgggcgtggtggtgcatgcctgtaatccagactacttgggaggctgaagtgggagaatcacttgaacctgggaggtggaggttgcagtgatccgagatcacaccactgcactgcagcctgggccacagagtgagactccacctcaagaaaaaaaagaagaaaagaaaaacaagaccctccagtgtatggcatttactcaggctgattaaggagctgctgcttaatgcagaatggggaaattgagcagacaacttcttccaaaactcagattcattctacaaagaatccacaagaaattcaatagaccagaaaaagtagaacaactgaataacaggtataagagcccacaaggtgaaaacagctggagttgatggaattcaacagtattgtgatgactataacccaggccctttcagtatcagtgtatcatcacaggtgtgcaagttcaggagcaatactcaatgtaaacttaaaaaaaaaaagaatttgtagatgacatggcagagatagggtgagggtgatagttcagaagagctaaaagttcctttgccaaggttggaacgggagttcaaagaaaaaacaaattttaaagattttaaaaattaatttatctttccctttactaagaaccctagccaaacatactgagaattagaaatggatgttgtgccgggcgtggtggctcactcctgtaatcccagcactttgggaggccgaggtgggtggatcacaaggtcaggagttcgagaccagcctggataatatggtgaaaccccatctctactaaaagtacaaaaattagctgggtgtggtggtgggcacctttagtcccaggtactcagggagctgaggcgggagaattgcttgaacccgggaggcggaggttgcagcgagctgagatcgcaccactgcactctagcctgggcaacagagtgagactccatcacaaaaacaaacaaacaaaaagaaatggatgttgcagaccaggcacagtgcctcatgcctgcatgcctgtaatcacagcacgttgggaggccgaggcgagcggattacctgcagttagaagatcgagaccagcctggcgaacatggcaaaaccctgtctctactaaaaatacaaaaattagccaggtgtggtggtgtgcatctgtaatcccagctacttgggaggctgaggcaggagaatcgcttaaagcaaggaggtggaggctgcagtgatgtaagatcgcgccactgcactccagcctgggccacagagtgagactcaggctcatggccggggggattaaaaaacatcgtggctaactttatagacaccataagcaatttctcagatggtgactgctttggaatatttggacatgggtcactgtagctgcatgctttttatatatgcaaaaagtaacatgaaacccattttgcaagactgcagaatgcactaaagtaataatttatggtgaacaccagcagtcaccaaaactcccactgaatcacattgtaattatatggagaaaacagtatttgtgttctcaaatagaatgttgtatttttatacaagtcaaaagatgttaaaaatgtgccataagaaaagaccacgctgtggattctaaagttttaaaaattatagtaccaagaaattaagatttatatatttttgaattactaaatatctagattgaccatatctatttttgttttaattttccctaaatattctgaaaatcattttatagtttttaacacaccatcatagtttgtgcacggatggccacctttagtgtgtgatttcagtgaagttcccattgaagttatttataagcagtggacctattttacttcttatatttgaacttcttaagaagtttcttgaccaggcatggtggctcatgcctgtaatcccagcactttgggaggctgagacgggcagatcacctgaggtcaggagttcgagaccaacctggccaacatggcgaaacttcgtctctactaaaaatacaaaaattagctgggcgttgtggcaggtgcctgtaatcctagctactcaggagggtgagacaagagaatcacttgaacccagcaggtggaggttccagtgagctgagatcgcaccactgcactccagcctgcgcaacaagagcaaaactctgtctcaaaaaaaaaaaaaaaaaaagtttctcggggtatgtttttaaaaaaaatattttattacatttaaaatgataccttttcatgaaaaatatttattttatgagtgataaattataagtttaaatatgaggtgaatttgttcccttcaactacctataatatctatagcatccagcatacagccctttgtacaaaatgtaacatttagaagctaaaatatacatcatcctcccccaaaataatgattttcttatagacacaagcaagattattctaaaatgcatatgtaaaggcaaagtaactggaatagctactttttttaaaaaaaaaagaaagaaactggcacaaatcagttcatctgatggcaaggcttattaacagtagccccctcttatctgcaggaaatatcttccgggacacccagtgggtgcctgaaaccatggatggcacccaaacccaggtgtactacgatttttcctatacatacatacctatgataaaatctaacttataaattaggcacagttacagattaacaacaataactaagaataaatagaacaattacaccaccataccagtatcactactcttgtgctttgggtacactactaaataaaataagggttccttgcaatgagacattgcagtgagatcgtgccactgtacgatttcactgttccttgaaagcgctgtgataacatagcagttgatctggtaaccaaggcagctactaagtgactgatgggtgggtagcatatacacagtggatatgctggacaaagggctgatttacatcccaggtgggatggaacaagatgctgcagggtttcatcacactatttagaatggtgtacaatttaaaacttaggatgaattgcttatttctcaaattttccatttaatatttttgagccagttgaccatgggtaactgaaactgcaaataagtggggactatcatatatagctacaataatcaagcctatgtacacagagatcacacatagatcaatggaatagaatatagaatccagaaatagatccaaacaaatatacccaactatttttgacaaagttgcaaaagtaattcaatggaggaaagatcgccttttcaataaatggaactgaaacacttagacatccataggcacaatctaagtctcacagcttatataaaaatcacctgtaaatggatcatggacttaaatgtaaaacataaaactatgaaatttctgggaaaaacaaaaaacagaataaaaattgttgggatctagggtagatttgaaacccaaagcacaattcataaaagaaaaaaattgataaattgaactccatcataattaaaaactttttgctcccattagggttacaaggacaagctacagaacgggagaaagtatctgcaaactaccatagccaacgagcagtaagtacaaatgcaattcagaaaatgatgctgggaaaatgacatgtggacatgctgtcaatgtgcttaaaagtacgaaggagggttacattaggatgttgaaaatcaactgggttttcattggtgctgagtttagaggtgtgtgtgggaatgcagagcctttcagtggctttattatctgggggaattccctcttttgtgtgagtctatgggagagacacggtcctacactcccctatgaaagcaaaaaggattagacattcccagtcactaaacactaataagacatggaggtgtgaaacatcctgtgcaatactccagccaggacattatgaatctggatggacagaccaaaggaatgggacagttccatatttcccacagtgaagatggtgactcttcgcatggtgagactccattttcttctctgctgccagcctttcttgggtcttactcactgctgaagtctaattctccagcttttccatcaactctgtgaactgcccaataacttccctgtaaattatttttctgctgaagttaatgcaagccattttctgttgtttgcaaacaggagcccttaggtggcacatactgttaaatgtttcctacaacaagatcatgttaaagtcactcattcccaggcagatctcacaaacaggtatttcctgcagccacccgggagtttctctcacctctaatatcaaagttgttttttatttgctgcccttttcaaagctgtctggctccaagcaaattattcctctggatcccatctgtcacgtggacataatgctatctatttcacaggtgaacttaaaatttttatgatagaatacatttatgtgggccaggcatggtggctcacgcctgtaatcccagctactagggaggctgagacacaagaatcgctgtaatcccagcactttgggaggctgaggcaggtggaggcaggtggatcacctgaggtcaggagttcaagatcagcctggccaacatggagaaaccctgtctctaataaaaatacaaaaattagccaggtgtggtggcacacacctgtaatcccagctacttgggaagctgagacacaagaatcgcttgagcccggcaggcagacgttgcagtgagctgagatcgtgccactgtactccagcctgggcaacagagcaagactctatcttaaaaaataaataaataaaagaatacatttatgtgattttttaaaaaaaaatccatcatcagtgcagaagggttataaagcaaaagaagaagaaaaaagcgacccccatccatcctacccagtgtcaccccccagaaggaaatacttcacagttgcttgtgatacgtaagggtttggtgttggacatctttgatgtcagactcccctcatccaaactctcctttacgttgagaaacaaaaacgatgcaagtgaaacatcagctaagaaaccgatacggtaaaaatgatggcagtaaagtgatcctaacaaccactgtcgaaatgacccacttcagttcatggcaccttcagaggaccactctcaagaaaataagggaaaaatgggtgcagattcctatctaccaggtggaaaaaacaggtgactaacaatttaacagtacaaataccttgcaaacggtatgattttaaccagtgaaactccatgtactgcatgtctcaagtaccctaacgttagccaggtctctatctctatggatttaaaatcaaaacccctcaacacaacactctgtaatgttcttaccaatctgtatcaatttgacataagtttagttccataattaacctttgctatctagtcaaaaaacgtagataaatcagctggtatcagaagagcgcctcagagcagtggttctcacgctcagtctagttcccagacaatagaaagcatcaacatcacctgggaacttgttagaaatgcaaattcaggccagaacttcgggaggcagatcacctgaggtcaggagttcaagaccagcctggccaacacagtgaaaccccatctctactaaaaatcaaaaattagctgggcgtggtggcgggtgcctgtaattccagctacttgggaggccgagacagaaggatggcttgaacctgggaggtggaggttgcagtgagctgagattatgccactgcactccagcctgggcgacacagcaagactccgtctcaaaaaaaaaaacaaagaaaagaaaaaaaaagaaaagaaatgcaaattcataggctccactccacgaatactgaatcagaaattctggggtgcagtccaatgttagaaccactgccctaaagtctaacaaacttcaaaaatcaaaatatactcttgagagttaaggaaattgggaaagaggagttccttctcactgctttacatttcccgaaagacggctctcctcatccctcaccctgcttttttcctggcattctgactgtttctttgggaaatcagagagggcttacaggtctctcatatttggcccccagagtactctgtttctgaagctgcactaggctcggtggaaaacttaccagaaatgatcagtgatgtcaaccatgagctcaggaagggaggggagggagacggcaaatagtgggcttttgaccctccctgcactaaattatttgtgatatgcatatgatagccacatccatcttgctaaacctttctctttggtgttcctccaggccaaattgctctccaacccagtgatgcacattagaattagagagttttttgcttaaaaactctcccacttcttagccaggtgtggtggcgggcacctgtagcatcggttaactacttgggaggctgaggcaggaaaatcgcttgaattcgggagtcagagattgcagtgagctgagatcatgccactgcactccagcctgggcgacagagtgagactccatctcaaaagaagcaaaaaaaaaaaaaacaaaccccaaaactctcccatatgggctccatccccagcgaagattctgatgtaactggtttgtgcagtaggtagggcatctgtgttcttcaaaagtctccccaggtaattctaacatgcagccaggtccaagaacctctggtaaacctagtggttttcacaggctggtggccaaacgagctgcctcagcatcacctggggatttgttaaaaatgcaaattctggggccctactccagacttactgaatcagaaactctgtagggtgaggctcagtaattgcacaagccctccaggtgattctcatgcacaattaattctgacagccattgagagccctgttcacaccacaatttaagaatcttcccatgaaggagattctgggaaaagcaatggccacctccgtctacattaacaatcacagtttgcagtttttaaggacaaaaacaacttcctcaattttttaagccaagtgagctaataataattccaacttgtctttcactttacatatccatgggaggtgttaattactctttctgtctgccttaaacatcacatcataattctaaactagcaattcctagaatgtacttatgagctgctgaatgatttgaagagtggcaaagtgttatggagaaaaagctgaagcaagccccgctgggctcagtgggaaatgaaaaggtaattaaatattatttggctgttttctacaccaagctggaaaccctccccggggtttatgggtagaacaaataaataggagaaaatagggataagcttcttgacattttttctttcaggcccttcaaacacccttgggatcaaaatgtcctaaggaactaggcagaccagtgaaggcttggctacatcaagcaaagttatcttgacaaaatttatggttattgtcttaatccatccaggtgctataacaaaatgccaaaaactgggtggcttataaacaacagaaagctatttcccattgttctagaggctgagatgtccaagatcctagaagccagcagacttagtgtctagtgagggcgcacttcctggttcatagatagctgtggtcttgctgtgtcctcacatggtggaaggggtaaagagctctctggggtctttcttaaaataatggcactaatcccattcaggattgtacaaccctcatgacctaattacctgccaaagctcccacctcctaatgccgtcaccttggagttataatttatttttttcttcttcttattttttttgagatggggtttcactcttgtcgcccaggctggggtgcagtggtgcgatcttggctcactgcaacctctgcctcccaggttcaagcaattgtcctgcctcagcctcccgagtagctgggattacaggcccctgccaccacacctggctaatttttgtatttgcagcagagatggagtttcactacgttggccaggctggtctcaaactcctgatctcaggtgatccgcctgcctcggcctcccaaagtgctgggattacaggcgtgaaccaccgcgtctggcctggagttaggatttcaacaggtgaattttgaaggaatgcaaacattcaatctatagcacttataaaacctttttatgatccatattgactgtctattcctgaattaaatctcattcacttttctgttgctagagaaacctacaacatgacttggtaggaagccacataacagagccttaaaaacctcacattttctagatcctaacctttcccttgagctgatgaattctctcttagaaagaaaattcaccaaagagaaaggtccctgctgcagcatatatgtgggcagggaatgactgcagaaagaacaaaagccttctgtgcgcataacacagaaatgccctggatgagaagacagcgcggaaaggcacagcagcaaggatgaggcagagccagcagcgccacacgcagagaaatccagatgcaggcctgaaagttacatttcattctgctacttggtcatttgagaaccagagagttgtattctgagtccacttgatgttaaatattatcctattctgcagagtttgaactgggtgccctgggagactacctcactgtatttattaggatagaggtgccgctagggcagatggaggtggttatgttttgcctccagccccagggcaagcttcaaagccaaccttatcccatatccatcagctgatggaggaaccctctgagatcaggagaaccaggtgcaaatgagcctataaccaacttactatgcatttagttgtttcacaatacgcatgttctccaccataaaaatatcttttttgaattgactaaataacatatgatcaaggctttaaaaattttaaataatctaaaaacataaggacaaaaagtaaaatcacctgatattctaccacctagagacaactgtttgagtcccatcctttcatacatctttccacctatgcccctgtgcacacacacacacgcagttttacgcagctaacatctgttgtactaaattttatttcactatattttattttcttataattcccctcctctcctgctccccatctctacgttattgatttttttttgctcgaatcctgattctttccttccttctgcttgctttgagcttaatgtacttctttctctgttgttttagggtggaagattaagttggtttaagatctttcttcttttttcttttttaaaacagggtcaaccaggctggagtgcagcggcaccatcacagttcactgcagcctcaacctcctgggctcaagcaatcctctggcctcggcctctcgagtagctgggactacagaaacacgccactgtgcccagctacttttttaattttttgtagagactaagtctcactatctggtccaggcttctttttttttcgagacaggatcttgctctgtcacaggctggggtgcaatggtgtgaacatggctcactgcagcctagacctctgggtgtaagtgatcctcccacttcagcctcccaagcagctgggaccacagatgcatgccaccacacctggctaattttttaatttgtacaaagagggtcccactatgttgccgaggctggtcttgaactcctgagctcaagtgatcctcccacctcagactcccaaagtgttgggattacaagcatgaatcatggcacccagctctttcttcttttttaatgtagttatttacagctataaactttcctgttagcactgttttagctacagcccgtgatgtttgatatgcggtatcttcattttaattagttggaaagtacttcctctctttttttcttctcttagaaacagagtctcactctgttgtctaggctggagtgcagtggcgtgatcatggctcactgcagcctcaacctcctggactcaagtgatcctcccacctcagcccccaaagtagctgggaccacaggtgcttgccaccatgctaggctaatttttttggagagatgaggtcttgctatgttgcccaggctagtcttgaactcctgggatcaagtgatcctcctgcctcagcctcccaaagtactgcaattacaagcatgagctactgcacctggcttcaaagtactttccagttctccttgtgattcctctttgttccactggttatttataagggtgttatttaatttccacatatttgtgaattttgctcatctttctgttatttctagtttcactccatgtgatcagcctctgttaatctgttttcaacatgcccttatgttcctaaatgtttgttaagaaatcatttatttctctatgtttttaaatttgttgacacagggtagcatatactattcctttataattctttggatcttatctatatctgggtatgttctttctcatttcttatttgtatatatatattttttccttaggcaagaaaagagttaactgatttcactggatctttcaaataatcagtttttgtatttattaatccttgtgactattttatcttctaggtcattcattctagcttttatctttaatcatttcattttttaccatcattttggttatacaattttttttcacttcctcagatgaatattaattaactcttccatgttctcatccccaaatgctgaatcttctgaatctgtcttctgagttccttaacttttccctcacagccttaatctgtatattttgggtttttgttttggaatatttcctccaagtacctttccaagtcactaattttgttttcaagagtatcccatcctgattatttatttgataattttattattttttttgtagatggggtcttactatgtcacccaggctgttctcaaactcctggccttacgtgatcctcctatctcagcctcccaaagtgctgggactgtgagccaccgtgcccagtcctgattgtttaaaattgaaactcatggttttagttgcagaatgtcctttttacttaatactgaatgtcagccagctctgagatcgaagttgtattgctataactagctgactttgcctcacgccagtgcctataacgctggctgcccgggcaacctgttctgagcactctccctgtgcttcctctctgttgctgggtccagtgaagtgtgcaactaaaattttccctttgctggctacggctccattcacccttagggctgagttcaggttgctgcaacatcttcagcagcagaaccagtctgcaagctgtcagtcctctgttgggggcagtgggagcatcactgggagaatctcctcatctacaaaggctagaatccacacagtctcagaactacggaagacctggccccactcttcatttcccctgaagcaccctgaaggccagagagaccttcgacccaggaacattccttcagacaactgcctttcgtctcagggtttgtggatctccataagccaagttctcttcaggccccaaagaactcttaccctcaccctagggctccttgactcttgcaggctctctgcttctataattgcaggaccagcccacactgggcctgttctgttgataacaaaatgttgagttaccttataacagagtccacagttgcaagtcatgtagtctgggaatgtgcaatagaaaaagctttgacttctaacgacacccagaaccagggattccgcccctcggaaccaacaaggctggaagagaaccagaccctgcatgccagaacttcttcagaagtgaggggtctactgatccggaagatgtagggctcagcataccttaccgtaagctgtcaaatctgaagccctctaattagaccttgccaagccagcattcccaaatcccttcccctgccttctgatcccttaaaacttgccccagatcccaaatagaggagagaaatttcagctgactcttgtctccttgcgggctggttttgcaataaataaagcccttcttttctcaaaagctggtgccatagttattggcttctgtgcacatcaggcagcaagcccatctgctccataacacttcctgatcctacctgcctatcagtccccttctccattcaggacccactcaggctgccatcttcccctgaaaggcactggcatctcttcttccttaatctagttatataatacttattatccatttgccaaaggccatgcctactataggcaacctgtagcagacaggatcattgtgctgctcacaggtctttgtttcatcctgaagcttacttccagcttctgtggacagctccgacataaaatgaccgtatatgaactcaagcatctctgcctctccacctgagggtgttctctgccaggcacgttcttggttgaaagacagcccataactatcaagcctcaagtattgaggggttaaggcccccggggtgaagccttcaacaaatgaagaacaagtgttgctaactccagcttctcagtccttcccgggcaacgaaggagcagttggtaaatactctggcttcctcagctcttcactgggacaaatcggaggcatgttccatccagtctccctcagtgcccccaatgggactgatctctaggatcccatacagtgatggtgataacctggtcactaatacaaccttttccagctttcctcacttccctgtctcacctctgtacttctccactgtgctttccgggatcagcaaccacataaacttcttgtactgaagttcctgtttcagggtctgattttgggaaaccccaaataagacacaagcataccagaggcatagtggcgtctctgacagacagttaccagcattcagggccaactggtatctgggtcaataacatagcatttccagtgcaaaggcctcctctccagtcagggtctatgtcgctctcatgggtcaggtcaaggcagataatacagaatataaatctaaattgcaccatggtagatcatgaatagtaggaatgaaaaagttaatgtaaataaaaatggactaagagtggataaaggttagactatccaggttgaccaaaagctaatatttaccagagaaggccacagacattatgctagataaggtgcaaatcctttatatttattgtatatttagagttgcctttgtgcatcaaaaaacactgtaaacagtgaaaaggaaattcatggaatgataggtaatgtttgcaaatcatatatctgataaggaattagaacatataggctgggcgtggtgttcccgcctgtaaccccagcaccttgggaggctgaggcaggaggatcacctgagatcaggagtttgagaccagcctggccaacatagtgaaacccgatctccactaaaaatacaaaaactagtcaggtgtggtagcgggcacctgtaatcccagctacttgggaggccaaggcaggataattgcttcaacctgagaggcggaggttgcagtgagccaagattgctccactgcactccaacttgggcgacagagcaagacttcgtctcaaaaaaaaaaaaaaaaaaaaaaagccgggcatggtgtctcacgcctgtaaccccagcactttgggaggccgaggtgggcagatcacctgaggtcaggagtttgagaccagcttggccaacacggcgaaaccctgtctctactaaaaatacaaaaaaatttgccggccacgggggcaggcacctgtaatcccagctactcgggaggctgaggcatgagaattacttgaacctgggaggtggaggctgcagtgagccgagatggcgccactgcgctccaggctggacaacagagcagggctccatctcaaaaaaaaaagatataaagaactgctgggccgggcgcggtggctcacgcctgtaatcccagcactttgagaggccgaggcgggtggatcacgaggtcaggagatcgagaccatcctggctaacacggtgaaaccctgtctctactaaaaatacaaaaaattagccgggtgtggtggcatgcgcctgtagtcccagctactcgggagggtgaggcaggagaatggcgtgaacccgggaggcgatcgttgcagtgagccgatatcgcgccactgcactccagtctgggcgacagagcgagacctcgtctcaaaaaaaaaaaaaaagaactgctataactcaacaacaaatctcccaagaaacccaattaaaaaatgggcaaaggacttgaatacacgtttctccaaagaagatgtacaaatgcatggtaagcatatgaaaagatgctcaacattgctaatcattggggaaatgtccatcaaaaccacagtgagataccacttcacacctaccagaattgctattacttgaggaaacagaaaataacaaatgttggtgggggacgtggagaaatcagaacccttgtgcactgctggtgggaatgttaaatggtgcaacccctgcagaagacagtacggcgattcctcaaaaaattaaacataaaattaccctatatccaaaaactccacttctgaatatataccaaaataaaaactgaaagcagggactcaactagatacttgtacatcaatgtaaagtggcattattcactatagccgaaaggatggaacaactcaagtgtccctcaattgatgaagggataaacaaaatgtgctatatatatgcaatgaaatattccaccttaaaaggaagtaggccaggcgcaggagatcatgcttgtaatcccaggactttgggaggccaaggcaggaggatcacttcaggtcaggagttccagaccagcctgggcaatgtagtgagactcctgtctctacaaaaacttttaaaaatcgccaggcatagtgatgcgtgccagtagtcccagctaagcgggaggctgaagcaggaagatcacttgagcctgggaggccaaggttgcagtgagccaagatcctgctactgcactccagcctgagcaaaagaatgagaccctgtctgaaaaaaagaaaaaaggaagtaaattctgacacatgccacaacattgatgaaccttgaagacattatgctaagtgaaataagccagacacaaaaggacaaatattgtatgatccacttatacgaggttcctaaagtagtcaaattcatggagccagaaagtagaatggaggccgccaggggccagggaaaaagggaaagaggaaccgaagagttactgtttaacaggtcctgagcttgaatttgagaaaatcaaaaagctctcagacggataatggtgatggctgtacaacagtgtgaatatacttaatgcctctgaactgtacacttaaaaatacgtaaagcagtaaattttgtgttatgtatattttaccacaataaaaaatactttagagttgtgaaatactactaaggctacttcctaaaaattatgctatggttatatctgaaatatcatacaataatgaaagggaaaggaaacattcagattcaaaactttttgtgactacagaactctacagacacattgactgactctaattagtcaggtataaatgaaattaccaggaaatggttccttgatgacacctgtgactgcacctgctattttgagtataacatcagtggctgacatggtattcgaaattctccctctgtgcagagttgtcaagaaacctgtgtttcttcttacaaaaaatgtgacgtgcatataggtcccctagatttcactggactctagccagcagtaaatcatgacaaattagccaatatgtaagccctgttgtagacacagaataattataagacaagaaatgtgtcacccacttgtgcagagattagcacaaataagccaaaataggattgaaacaaggttaaaaaaatcacttatatatggaatatgtggtgtatcccttccttttttctgcgaattaagacatcaaattgctttactcaccagaagcatggcccttgtactttctcaacaaagaataaggcattttctcatctgtcacagcagcttctgctcatgaccagaaacatccttcattcctttatctaagcctaaacattgtgcaaagcccctgccatgctcaaatcagctcttggaaatggatggtatagctgggaatctcaggaactggagaagacatcattgccaggaacgacatcatgatgaagatctcttaccctctgcaagattgggatagggtgtggagtctcactgtccatcatatgaatgagaaaaattaggacaaagaaagaacaccaggtatgtagggaaaaacagcggagaaatgtctaagacactggttctcaaccttggctgcagttggaatcatgtagggaactttaaagaaatactcacgcctgggtcccttccctcaccccagtcattctccattgagattatgattcaatctgggattgtgatgtgggcatcagggatgttataaagtcaccatgggatctaattcctagccaaggctgtaaaccactgctttaagaagacaaatttcctgattcttaggtcagtcttctgggatcctggctgggatcacaatttactgcaagagctaataaccagaattaaaatagtcttgaaaaatcactctccaatatgacagtgaaaatgtgattatattccgtcactagagggcgaaatttcttaattttcaacatttaataactatcatagactcaaggttcagaattcactgaggtttgtctcttaaaacaaaacaaaaataagtaatgaagttctaaagaaggtatactaaagcttgactttcatgctatcagctcctacctatttatgaagtgagactttaagacgcaattgagagcactgtatcctttcattgccacataccctcttcccaaagggtttgtattttatagggtgtattgtttttacaaagtaaatggctttgctgtgtagtctatgttacaaaacagaaggtagggcatcttgaaacagaaattttgcattactaaccagctcccagaggggtcaactctgaggctgctggtagagaactatactttgagcagcaggaggtgaagaacctaggggcagataccataactcattttctaaagatattctaaaatgtaaactcacataccgataacatgattcctgcccatctatcattcatctatgtatgtatgtatgtatgtatgtatgtatgtatgtatctatctatctatctatctatcatctgtccatcggtccatctgtcatctatcatcatgaaggcagagagaccacaaatccaggggattccaaattgactgtgtattagaatcacttggtcttgtcttaaaaataaagattctaggccaggcgtggtggctcacacctgtaatcccaacactttgggaggccgagccaggcggatcacctgaggtcaggagttagagaccagcctgaccaacatggagaaaccccatctctactaaaaatacaaaattagccaggtgtggtagcacatgcctgtaatcccagctactcgggaggctgaggcaggagaatctcttgaatgcaggaggcagaggttgcggtgagccgagatcacgccattgcactccagcctgggcaacaagagcaaaactccatctaaaaaaacaaataaataaataaaaataaaaataaagagtcttagtctcaccccctggaggttatgatcagtgcgtctggagcggggcccggagtttgtatttttaacaagtgctcaggagattttgctggaggctgttgcttttgaaaatcactgttcttcttcaaagtctttcctttacaaagaaattgaggctggaagaggagaagggacctttcaaagttagtgacattaccaaagcaggatccaggttctcctggccctgctaaactgagacacttgttggaattcagcatgtgtgcttgatccttcttcttatgctgtgtcactgacaggtgtagtaagctagcttccaaagacagtccgcaatgaacgacatctaccaaaattcacacccaggtgttgtcccctccccgattcaatctgggctcgcctcgtgacttgctttaatagatagactaatctggaagggatgcagtgtaacttaggaggttcggccattagagatttgcagcttctccatgcttcatctgggaacacgcattctgaaccccgacattgtgctgtaaggaacaaggaagctcaaggaactacaaggaaagccccatatggagaaaaactatggccctagtgaacatcctcaaatgcactcccagcccacagctcctcaccagctatgtgagggagaacacgatgcaccttctagccatgctctccccagtggagtggaactgtctagcaagtcacagaataacacaaaaaagttgttgttctaagcctttaagttttgtggtgtatgctatacaagaatagattgctgaaacaataagaaaagaaatgcccttacctgtttggctggaaacagacctggtcataacctgtgagttcacacaaatccttctcaagctctcggaaaagctgctgatatccttgagcttgatccagaggcacaaaggggtggatgtttgcaaattctttccatgtgataggctgaaaagaaagaaaacaaaaatgcatatatacatattataatagcaatagcaataataactttaataataatgacgatgatgagaaaagctatgtgccaggcactgttctaagcgctatacatatgttaatttatttaagttccaccacaaccttataaggtaagtaccgttactgtcttcatttaaaagtgggacatagttgtccaaaaagggaacttacacaaaaatacaatgttttgctaacttttcagggaagaaaagcccccaaaacagatttctttccatgaaacacaatgagttgcttcaggtatggttggcataaactcttatatagcaatagattgttctctttcttcactaagtggaacaagaaacaaacacaaaagtaaatgggaaggccaggtacagtggttcacacctataattccagaactctgggaggctgaggtgggaggactgcttgaggccaggagtctgagatcagactggcaaacacagcaagaccttgactctattttttaaaaaaatagagagggaaatattcttatcatgatataaaatgatttctttcgtctgatatgatatgtcacttcagaataaacgtaagaaatgaaagaaagaaaaaaaaagcttcgctaaaatggatcctggcctagtagagatacttgccaaccacaacagcgagttgcacaaatcttctgttgacttgaatccctatctttctgatacaggaatgatttctagaaagacggcttaaggttcgtaattctacctgagatttagaactataaacaattttttttaaaaaagcttttaatatgacaggtttaaaagggggtgggggtgggggagggataggatagaaaggcataaataccatatacatttaattaattttattaaaaaataataagtttacccatacatttaaatgatgaagtcgtgagaaatacagggttactcccaagattggtgaatagcaaggtaaagaattattaaaatagttcttcaatcacagaatcacagtcccagtagatttcactagttctgggcttaggtggaagctagaacactgccccttgctgagtatccacttacagaagtgagctacttactgcgagttcagacgaactgttcagtttcatggtgcaggatccctttaagaagaacatccaaaatgtatcacattagtgattttctatagtccatcaatcaaccctccattctcccagcatggccacccctttgttgctcttggagcatattaggtaggaccaagagacgtgggattggggtagcttggaaatgagaaaaaaggccacaaataactaccagtggaatcatgctgtgaacaagggaaatgtctttattttccagtttcttcatgtaccggacaatgtttgtttcagagtggtagctgtgaacacaaaacacagaattaggggccccaaaagtagatatgagtccatgcacatcctcctgacatataagacacaccgaaatctactttcaaaatgcagatcaattttggccacggacaatatgtcaactacactcagagagaagggcacagacccccacaaacctcagaggatgtcttggacaagaagctgactgtgggtatgagttgaaggttgggaagaagaggatatagggctcttgggagtgaacttcagcctggcaattattcatccctgcttcctgactgccaagggagcagagccaccaggaaacaaagtgtgcttttcccaagtcaggaacgggatcgttatgaggatgaaatacttgggagccacggctgagccagaataaccaggccacagcaggcgaaatcagcagcagcactctgcctaactccctagctgattaccaaagcacaaaacgcagaagtcacacaagacacacaaacctgttgaacacttgatgggtgaggaacgggctggtcctcttgaacacagaccctggaatacctctgcactcctctcccatgctttcagcaaccagttcctgaaggagaaacacagagatgatagggccagaactgtgcctggagccacatgtggacatccaggcttctgggtggctgggccacaaagcactcaaaatggatcaaatatataattttacttatttatttatttatttatttatttaatatttttggaggcagggtctttctctagcacccaggctagagtgcagtggcacgatctcaactcactgtagccttggccctactgggctcaatcctcctacctcagtctcctgagtagctggggctacaggtgcatgccaccacacctggctgatttttgtatttttctagagacgatgtttcaccatgccgcccaggctggtcacaaactcctgggctcaagcaatctgcctgccttggcttcccaaagtgctgggattacagtcatgggccactgagcctggccaaagatgtaaatttaaaagctaaaactactaaaacttagaagaaaataggccaggcgcggtggctcacacctgtaatcccagcactttgggaggccgaggtgggtggatcacaaggtcaggagatcgaggccatcctggctcacatggtgaaaccccgtctctactaaaaaatacaaaattagccggtcgtgttggcgggtgcctgtagtcgcagctactcgggaggctgaggcaggagaatggcgtgaacctgggaggtggagtttgcagtgagctgagatcatgccactgcacgccaccctgggcgacagagcaagactccatcttaaaaaaaaaaaagaaaatataggggctaatctgcataaccttggatctggcaatggtttcttaaatgtgacaccaaaggaataaacaataaacatatataaaaattagataaattaaatttctataaaatttgaaatgtgtgtgcatcaaagaacattatcaagaaagttaagagactgactacccacagaatggaagaaaatatatgtaagtcatatatctgataaggatttaatatccagaatatataatcaatacatggcttgatcctcattccttgccaggctaataatatgactaatacagatttaatacttgtcccctccagatctcagggtgaaatgtgatccccagtgttgaagatgggcttggcgctgtcttcacagtaatgagtgagttctcactctactagttcccatgagaactgatgagaagtgattgttaaaaagagcctggcacctccctcctctctctctcttcctttttcttttgccatgtgatgcctgctcctcttccccttccttcatgagaggaagtttcctgaaaccctcaccagaagcaaacgcttcttgcacagcacagcctgcagaaacatgagccaaataaagctattttatttataaattatttagcctcaggtactccaatgcaaatgaactaaaataatggccctcttgaccccttagtgatgctccagaaacatttctcaaatgcatgaaccaaatatctgtgattaaatttagtgcagagttctacagagaaggagctaactcagtcctgtttaattgaggtttaaaagagaacactgtgatgcttctttgatcatttatgaatgttatctggtataaccctttgaagtcctctctcaaagagggcacagataagcaagacagcaccactcagcactctggaaggtatttctacttcctttcatctatccatttaacaaatatttacttagtgattaatacacaccaggcagtgtaggctgttgtgattaacaccttgccacaggtctaggtagctactgtcggctctctttcactctcatcccatggaatggtaacttttctcttgctttcccccactacttcattattttagaaagcaactcattacactgaactgcttatagctttcatgtactccctctcccagcctttgtgactgctttctccagtgtctagaacactcggacccatcttcctttccctcttgtgccatcttggtctagataactcctgcttatcttcttggtaaggagctcatcctgtgagctcccagaacatcttcacacatcagtcacctggattctaatcttaagcttgtttatctgaatccctaataaactgtaagcaccaggaggacaagaagcatgtctaattcaccactgtgtcttcagggcctagcatagcacctgacacatattgggtcctcaataaatatgtattaaatgaatatcataattttccaatgaatgacataaccaagatacaaatgtcttgcatctttgtagtagaggcagtttctttcttttttctttttttgagatggagttttgctcttgctgcccaggctagagtgcaatggcgcaatctcagctcactgcaaccgccgcctcctgggttgaagcaattctcccacctcagcctcctgagtaactgggattacaggtatgtgccaccatgcctggctaattttgtatttttagtggagacggggtttctccatgttggtcaggctggtcttgaactcctgacctcaggtgatctgcccccccgcccccctgacctcccaaagtgctgggattacaggcatgagccaccatccccagcctagaggcactttcaatgaaacaccattaacaatctttccaactagcctgggtgcataatactggctggagccctacagcagtgacctccagctgtcagcagtgactagcaagggatagtcagtggaataattttaacaacaagctaccagtgtcacacttgggccccttctccctcacactcaggggataagctacttttgctaccacctccaatagttatgatgaggaacgcatgtttttattttacttactgcagatgactcacaaccaaagatccacaacaaatcgtccagatctttttcattgactgtttcatcaagagaaataccaagctacagaaacacaaacaaaatggaaaacatcaactctaaactccacatcactggaggaatcccaagagaggtcaaaggggagacagtgctaaacaaaatcccatcattccaaaatatcagggtacaattatctccacgctaaggcttagaggaaggtggctagaccagtcccaggtttcacaaggcttcgagttttgccagccacctctgaactctaacattccatggctgcaggacactccttttgaagctagacatgcttatctttttcttcccttaacccacttatcagatattgaggagattttcttcccttaacctgtatatcagttatcagagcctttatcttaaagtcagtcatactgtgaagagaggagtattatgaacaaaatatgtgcatttcagtcccacatatgaaaacactaagtctaaaagaaagcaaagggtgaatgatcctttactgaaaagaccacagtgttgcataatgtaaataacacttgtttatgaaaaaataggactgtgcctaaagttttcctttttattttttaaaaacaaagagaaaaccttttaatgagaaacaatgtgaaaatttgaaaaactggtaaaaatactgaaaatttgacttactgtgccatcctcaaaaagccgaaaattgatctgccgctgagcggccctgcccaagacctccttcactgagcagccacactgaatcttcaaggtatcaaagaacaggtcatgctggagttgatgccctgctcgcttgagacctacacaagataggagatcccccaaactctcatatagaaacctgctcctcagccattgacatgtcacagaataataaagagataaattctactagactcttgttggtcctggggagtgctttggtgattgctttttaaaaaactaaacatgtttattatcatgctgtagaaaattatgaaatacatataaaagagtaaggaaaatcaacatacaattgcattactgcgtgtattttggtgtattatttctcaagaaatgggggagcaggtagtatcagatatatatatatatatataaaattatacctttttttttttgagagatacagtctcactctgttgtccaggctggaatgcagtggcatgatcatagctgattgcatcctcaaactcctgggctcaagctcatgcaatccccttgcctcagcctcccaagtaactgggatcaaggactcatgccatcacacctggctaataattttttaaattttttgaagacagtgatcttgccatgttgcccaggctggccttgaactctgggactcaagcaattctcccacctcagcctcccaaaacgatgggattataggtgtgaaccaccacacctggtctcatctatgctttcctatagatcactattttaaaccatatttaatggctgtacaatagtcaaacatatggatgaaccatgatttaatcactttttttttttttttttgagagatggagtctcactctgttgcccaggatggagtacagtggagcaatcttggcacactgcaacctccgcctcctaaattcaagcaattctcctgcctcagcctcccgagtagctgggactacaggagtatgccaccactcccagctgatttttgtatttttagtagagacagggtttcaccatgttggccaggctggtcttgaactcctgacctcaagtgatccacccgcctcagcctcccaaagtgctaggattacaggcatgagccactgtgcctggcctatttctatttttttatagagatgtggtctcgctcttgcccacgctggtcttgaactcctggcctcaagcaatcctcctggctcagcctccagagtagctgacattacatacacgagtaaccatgtctagctcactacatagcagcattcttctgattgccaatgtaatgggataaatactagtttattgctttattttgtatctctttcattaataatgaggctaaaattctatgtctactggccatttatttgtatacttatttcttttaaaattacatttaatgtcttttgcctatttttctattagggtgttcatccttcttatgtttggggccggtaggaaagtaagagttctacatattaaaaatatcacagcttgccaggagtaaaagagaaaaaaatattaacactcagtctaagccaggcatggtggctcacgcctgtaatcccagcactttgagaggccaaagtggacggatttcttgaggtcaggaattcgagaccagcctggaaaacatggcaaagccctgtctctaccaaaaatacaaaaattagccagacatggtggcgtgtaccttaatcccagttacctgagaggctgaggcaggacaatcacatgaatccgggaagtggaggttacagtgagctgagatcgtgccactgcactccagcctgggagacagagcaagactccattaagcaaggaagcaagcaagcaagcaagcaagcaaacaagaaagcaagaaagcaagcaagcaagaaagcaagcaagcaagaaaaaaagaaagaaagcaagaaaaaggaaataaaagaaagaaagaaagaaagaaagaaagaaaaagaaagagaaagaaagaaagcaaaacaacaaaataatcatggatgttgaaagtatttttcctcgtttctcacttgacttttaattttgcatatagtattggacatgcaatattttcaattttactcaaatttatcaattttattatgcccaaatgttttagacagattaccaactcaccttctgacaaaatcaaagtggcattatgtaccctcctagcaatatgctccagcccatgggaaccatggtagattgcaaacatggcagccatattcgccaagagggcctaaaagataagaacatttaaagaatcacgtgatggaggacaattagtgggagggtgtaattacttgacttgggatgtcaaaactgaagacagcgacaaaacaaaatgatcagatttcctacattctttgatagttggggacaattaatatataacctgcctgactacctgaaaggaaccatcatccaagacaccctggagttgttactatactaaaccttcacatttgaccattacgaagggcttcttccatgcaacaaaatcatgtcacccttaagggcaaagatcacactaccatcagacattgagaagcaatgtttaatgttggaagacagtgaagcaataaagacctcagggagaaaaagtgagatctgagaattttacactcaaccaggcaattcttcaagaataaaaagaaacaagcaattttcaaacattcaagaacttcaggaataaaattctcctaagaacttaaataaaacactagaggctgaacttctgccaaccaagagttgaatggagaatctgtggcaaaggactggcaaaaacggcaatgcgcacttcagctgggagcggggtggtgtgcaactgtagtcccagtgactccagaagccgagatggatcacttgaacccaggatttcgaggttacagtgacctatgattgcgccactggactccagcccggttgacaatacaaaaccctgtctctgcaaaatacagttgatgttcaatactgggtccattttgttaggtacatctttttttctgctagactactagaggaagtctctatggagccaatgcaaaataagaaacagtttccaaaggtgaagtcagcaaacaaggaagtaaatgaggagaaagagacatcagaaaacatggaagtaggcattcttgtactaaaagtcctagacaaagtgtaaacactcttatggactccttacaacaatcagaaataaacacagaaactccacagcactttacagctgtggaaaaggcgaggctgaggtaaagaatctgtgacacactgtgcccaaatgctcatggctgtgttgctggaaacagaaacccaggcctgacattcacagaatgccctggcagcctccaccacaatattgtagaggttggttcatgtccctttttaatctacagatgattccttccataatcaggaggctatatcacacggctgaacaacaaattgatgagaagtataaaaccactttttaaaaacttcaaagggcactagaatatcaaaagaagaaccaaaaaaattaaaatagagaccaagaaaatgacaatttctttcacaaattgaacaaacttaaaaatacaaagggcttgaatcagtggctcacgcctgtaatcccaagactttgggaggctaaggtgggaggattgctttagcccaggagttaaagaccagcaagaagaacataacaagaccccatctctaaaataaataaataaaataacaataatacaattaaggtacttaaaagcctcaaaagctaatgaatgctcaaaatcattagttattagggaaatacaaaacaaaaccacagtgagattatcacttgacatccaataggatggctataaccaaaggataggaagtaacaagcattggtgaaaatacggagaaattagaatattcatatgctgctggtaggaaagtaaaataatgcagccactttgaaaaatgtctggaagttcctcaaaatgttaaatgtagagttatatgacccagcaatttcactgctaggaatataaccaaaagaactgaaaacattacatccatacaaaaatttacacagaagtgttcacagcaggcttatttgaaacaccccaaatgtttaccaattgatgaatggataaacaaaatgtagcatgtccaaacaatgggatattacccagccatagaaaagaattaagtacacattcatgctacaatatggatgaaccttgaaaaccttatgcaaagaagccaggtacaaaaggccacacattgtatgatcccatttatatgaaatattcagaacaggcaaatccagggagacagaaagtagaatagtagttgccaggggctataggaaggggagagggatgaggagtgactacttcataggaatagaatttctttttggggtaataaaaatattctgaaattaaatactggtgatagttgcacaaccttgtaaatagagtaaaaaccattgagctgtatacttgcaattggtgaaacttacggtgagttacatctcaataaaaaaagctaataaagtgtaaattattctttactacacctgactttagaaaagccaacaaggctggatgcagtggctcacaccagtgatcccaacactttgggaggctgaggcaggaggatcgcttgaggcctggagatcaatactagcctgggcaacaaagtaagactcccatctctattttaaaaagatttttatattaaaaataagaaaagccaatgaaagagctgctcattgtggtagaagctaagaaataagagaatatatggccgggcatggtggctaacgcctgtaatcccagcactttgggaggctgaggcaggtggatcatgaggtcaggagatcgagaccatcctggctaacatggtgaaaccctgtatctactaaaaatacaataaattagccaggcatggtagcagacacctgtagtcccagctacacaggaggctgaggcaggagaatggcgtgaacccgggaggcagagcttcagtgagcgagatggcgctactgcactccagcctgggcgatggagcgagactcgtctccaaaaaaaaaagaaataagagaatataaagaacagaacataatgaaaattcagacatctgtagtaatgccacaaatttatagaaaaaattgtttcttttcctttttgttttgtagaggtggggtctgattctgtcacccaggttggagtgcagtggtgtgattgcagctcactgcagcctggacctccccagctcaagcactcctaccacctcagtctactgagtagctgggatactggtgtgtaccacaacacctggctaatttttgtactttttttatatagacaggagtctcactatgttgcctgggatggatttaaactgctgaactcaagtaatcctcctgccttggcctcctaaagtgttgagattacaggtgtgagccaccgcaccctgttttttcagttttgttttagaatggggcctgctgagccagaataggctcagagagactccctatagaaaaatttatttaaaaaagaatcattaacacactttcagagattaaaaaagagtcatgccccatccacgatgcgaaactaagagtggactcccccacccaccccagtgacaagagagaagagcaagagtgagaagaatgtggaacagctgctacaacagaaggcgggggtcaaagacctacagcacaaaaggaacaactcaaaagacaccagtcatctcctaacaaaacagggagacttgcatgctcacaaagagtgaaactggagttatgagtaattcttgtatgcaatcaactatgaaaaggcacatatgcagtgaaatagacagtgaagagttagaagatcatcagaataagaggatgaaaatcagacaagctggagtatggccatctccagggcaaacattttaacaattgctggaaaagatacagacctttcaacccaagttaaataataaattatcagctatacatgaactggaagaaattaagcaacaggaacataaggccgggcacaatggctcatgcctgtaatcccagcactttgggaggccaaggcgggcggatcacctgaggtcaggagttcgagaccagcctggccagcatggtgaaaccccatctctactaaaaatacaaaaaatattagccaggcatggtcgtgggtgcctgtaatcccagctactcaggaggctgaggcaggagtatcgcttgaacccggaagacggaggttgcagtgagccgacatcacgccattgcactccagcctgggcaacaagagaaagactccgtctcaaaaaaaaaaaaaagaaagaaacaggaacataactggttcactgcagacagcccaaattcacctggaaaatgaacctagaggcagaaaactgaggccctaaatggacttatgatcagacggaaacctggaggaacctgaggagaaacagcaagacaggagcagtcagctgcaccgaaagggaaaacgtaagcagagaattcaacaaatggagggtaagctacagaaagtgaggccaccatataaagatcaccatgtggccaggcatggcggcttatgcctgtaatcccagcactttgggaggccgaggtgggcagatcatgagatcaggagttcgagaccagcctgaccaacatggtgaaaccctgtctctactaaaaatagaaaaattagttgggcatggtggcaggcgcctgtaatcccagctactcaggaggctgaggcaagagaatcgctggaaactggaaggcagaggttgcagtgagctgagattgggccgctgcatgccagcctgggtgacagagcaagactccatctcaaaaaaaaaaaaaacaaccaaaaaaacaaataaataaataaagatcagcttgctgttcaacagaggaaaagcctgtgccaaccacctttccttcctatcatactggaagagctcatatttgaaaagaggtggcaccttcctgaggcaaaacataatacaaaaggaccaactgaggaaatggctccaaagacccgtggctgcagaaccaactataagaagatcttattgcccactgccttcctggagaagcttttcagaggtggttctagacgccaaagccctgagacgaaagagcactctacctcccattgaagcacctgtgacatctctctctgacacttcatggaagagatgcaattacagtggccaggcacggtggctcatgcctataatcctatcactatgggaggccaagataggatcacttgagctcaggaatttgagaccaacctgagcaacaaagtgagacctcgcctctacaaaacatttttttgaaaattagctgggcgtggtggaatgtacccatagtcccagctacttaggaggctgagaccggagaataatttgagccctggaggttgaaggttgaggctgcagtgagctatggccatgccactgcactccagaatggacaacagagcaagaatctgtctcaagaaaaaaaaaaaaaaagaagccaggtgccatggctcacacctacaatcccaaaattttgggaggcccaggcaggaccatcacttgaggtcaggcgtttgagaccagcctggccaacatgatgaaacctgcctctactaaaaatacaaaaattatctgggtgtggtggcctgtaattccagctctttaggaggctgaggcacaagaatcacttgaacccaggaggcagaggttgcagtgagccaagattgcgccaccccattccaacctgggtgacgcaggaacaggactctatctcaaagaagaaaaaaaaagaagaagaaaaaaaaaaagagatgcacttagaatggatcctgtgctcaggagtgggcctccaactgatcctagggtttggctgggtttcacaaacacttcgacctaagccctggagcaacttcaaggagcagaacccagaaccctggtcagaacccaggaagctcttcctgttttatcccatccttttaaagaatgccagacatggccaggtgcagtggctcatgcttgtaatcccaacactttgggaggccgaggtgggtggatcatgaggtcaggagttcaagaccaacctggccaagatggtgaaaccccgtctctactaaaaatgcaaaaactagcctggcgctgtggcaggcgcctgtaatcccagttactcaggaggctgaggcaggagaattgcttgaaaccgggcagcagaggttgcagtgagctgagattgcgccactgcactccagcctgggcgacagagtaaaactctgtctcgaaaaaacaaaaaaaagaatgccagtcataatctcccagtaagagtgcctcatgactaccaccatcccctcaagcacagtcatcacaaatgcccttgctttgccttcctcaacccattcctggagaggctccttctcagtcctaagagagggtgtctcaactgccacccataacaaacctggcccaacgccaagaatactagagaccctgatatccatctttctatttacatatattttaagtctgtatataaaagtgaagactggccttttttgtcctttcttacgctttgcctgttcaggatctgaagatgtgattatgggtaaaatgaaacaaataatgctttttattttttttagtattaaaacatgtatggtgaagagaaagcataggcaaatggtgtacatataaagaacaccagtaaaacacagtgtctttttctttaactttttttgtgggggcaggagttggggacagagtctccctctgtcactcaggctggagtgcagtggcataatcatggctcactgcagcctcaacctcccagattctggtgatcctcccacctgagcctccctagcacctgggactacaggagcataccaccactgacggctaatttattttattttatttttcatagagatggtgtttcgccatgtcgcccaggcaggtttccaactcctgggctccagcaatctgcctgccttggcctcacaaggtgctgggattacaggcatgagccaccgtacccagccaatactgtattttggttctcataagacaatgagccttctacaccaataagatcttgccatttctggtgtgctcactgctcaggaggtggtgaataaatgaacaaatgaatgaatgaatgagtagctcatttctgtgtatcgtaaggcattcagtagtcaggtcagacgtgtgatttacctgagctgtacagatgttgctggtagccttgtctctccgaatgtgttgctccctggtttgaagagcaagacgatacacttctttcccagtggcatctctacaccaagaataaggcatccagttagcacagataatcacagcactgggagatgctataaatagaattacttctttccttcccagcttgaagtgaattcagcaaatgcacttgggtgcaaatttataaagaaacaatttctaaacgttcctcatctaaacatgattactgatttttttttttttttttgagacggagtttcgctctttcgcccaggctggagtgcaatggcgtgatctcggctcactgcaacctctgccttctggtttcaaacgattctactgcatcagcctcctgacaccacgcccagctaatttttgtatttttagtagagatggggtttcaccatgttggccaggctggtcttgaactcctggcctcaggtgatccgcctgccttggcctcccaaagtgctgggattacaggcatgagccactgtgcccagcaggattactgatttttagactgtactctgagacaccaagatatatacaataagtctaggaattttgaaagaaaattttgcaggaatttcccagacaaatacaataatggtgactgggaggattaagtttcactctgaacttcttaggagacacaggaaaagtggaaatatacgacaaaattgaaaagacttggctctctgtggattctacaccacagattccaccaatcacggactgaaaacattcaaaaaaataaaaaataatacaacaattaaaaatcacacaaattttatgagccgcgcatggtggctcatgtctataatcccagcactttggggggccaaggtgggcggatcacctgaggtccagagtttgagaccagcctggccaacatggtgaaaccccatctctactaaaaatacaaaaattagccagacatggtgacaggcacctgtaatctcagttacttgggaggctgaggctcaagaatcacttgaacctgggaggcagaggttgcagtgagccaagatcgtaccactgcactccagcctgggtgacagagagagactccgtctcaaaaaataaaaaaaaaaaaacaaatcacacaaatttttaaaaacaatacagtgtaacaaccattgcataacattaggtgttaataagatgatttaaagtatacagaggccaggcatggtggcttacacctggtaatccgagcattttgggaggctggggtgggcagatcacttgagccctaagaccagcctgagcaatatggtgaaaccctgtttttacaaaaaatttaaaaaattagttggacacagtggccacgtttacaccactgcactccagcctgggtgatggagtgagacttggtctcaaaataaataaataaataaataaataaaattttaaaaaaacacacttcacattatcatcacatcattgactaattcagcttactcacttatgttaaagtccagcttttatcaaaggtcaaaaacataatttttttttctaaatttccccagtaataatcctggaatgcatctaggtcccccgctccttttttttccttttttttcttttttttttttgagatggagtctcgctctgcacccaaactggagtgaggcagcgcgatctcggctcactgcaacctccacctccgtggttcaagtgattctcctgcctctgcctcccaagtagctgggactacaggcgcccaccaccacgcccacctaatttttgtatttttagtaaagacagggtttcaccatattggccaggctcgtctgggactcctgaccttgtgatctgcctgactcggcctcccagaatgctgggattacaggtgtgagccaccgcacccagccctttttttcttttcttttcttttttttttaaggaacaaagactacttctgaacatctacgtttttaatctgagaagtttcaccaatgagaagcagtcaggaaagtacatttggaaatttggaaattactcaaatggccacgtggcggaagcctctaggaaggaacgcggagcaaactcagtgtgtactttgcagtctcagtgcatttgtctttacagagccacgtggcataatgcttttgagaacgaaaactgtcgagacacaaaacatgcctaaaatatttagtctttcaaggcgtccatcaatctaagcaaatgcgttacatgacttcgatacattgtaaattatacacaaaatttttcaaaaatttacaaatttatagtatttgagaagtactagctcatatcccaaacagaattgttcttctgaatctatgttgtacatttccttaactgactcaacatggcccagttgaattcagatagaaatcaacatttgtgatcagaagaaatcagggaaatcataatcacaataaaagtagagaaacatgagcccctttaccttgttacccccaccattcttccaggcatcattctcaccaagctttctcggacagcaaaaaatgctgcatggggtcccccatagcccagtggcactccaaatctctgggagctgcccagggcgatgtctaccccaaattctccaggtggcctcaagatgcacaaagctaaaaggtcagtagcacagcaggccaggctctagaaaggaagtgagagaaaaggaacaaggttgctacctttccctgagagtagtgggagagtaggaaattatcttaactacaggaagacgggcagagtgtgttcacatcctgtgaactccattgctcattcattcattcagtaaatacatactgagtgcccaccatgtgccaggaatccgggaacagaaaaaagtagcagcaaggagtcaggaaggagagttttaccattccatgtgataatggtaaagaaattaaggcacatgaaaagacagagagagagataggtagacagatacaagttgggatacgcctccacggaccccccacaagaaaggtatacctaccccactctgatgagctctctccacgagttccgtaaagtcttccaccttcccctccgtgtctgggtactggaacaacactccactgacatcttttccactgaagtccatttcacagggtaacttcagctcagtgaggactccagtatatctggaaagacagacaacaaagaacaatcgtgctttcggtttataagggaaaattaattaacgtttcttttccagtaagacagcattcattttctgtgccctcccacagtggcctcccacccctgcccacatcccgtcccacaggcacttcagtggtaactacatcacagcaactcaagcgcatccaacagctctgcttctgttcctctcttctatcctctgactcccctttgccctttcctgtcacaatctactcctcagagaggcccaagagcattgcttcctagggctaatgagccaatatttgttaacaacagagccatcacctctttcactggcatcactcttaagtgaatggaaaaccataagtaagacaaggaggaagaacttccttagattcctgaactaataatgccaattatatgtcagaaaccccccctctgaagggatggtggtatgggtagggggaagaatgctcaacttttacaaagggaaagcaaatatctaccaatagtggttgttgcgaggattgttttacctgattacagcacgaaagaaaagtactacactttaaactacatagcatctcacctagggactctgcacaccctctgtaaactacgtttgcaaggaatacacacaaaatcttaacagttgtatgtgagtcccatttttctctgtttttcaaacgttccaaaacctgatcaaaacaatatttttattctttctacaaaaagaaaacaaaacgggccgggcgcagtggctcaagcctgtaatcccaggactttgggaggcggaggtgggcgggtcacgaggtcaggagatcaagaccatcctggctaacacggtgaaactccgtctctactaaaaatagaaaaaaaattagccaggcgtggtggcgggcacctgtagtcccagcaactcgggaggctgaggcaggacaatggcgtgaacttgggaggcggagcttgcagtgagcctaggttccctcaactgcactccagcctggacgacagagcgagactccgtctcaaaaaaaaaaaaaaaaaaaagaagaagaagaaaacaaaacacaacttactataaagcaatggcaattgtgtatttccccactcaattctgacacagtttacttaccagagagatgcccagaagaaagtgagaggtaaggcaaaactcagcaaccccaatttaaacagcaaaaaaccctgtttcagattcacctccaatcagtttggaagtgagaaagagaaagaaacagcagagatgaacatgacattatactgagtttaaaacacgaatcaaattaattacttggctcgagtctggacaacagctattgtctgtgggtggcaacggggatcaacgagaaatttcctcctcttgttgtgtctgttgaaaagaaaaagcacattccaacgtgaacattaaataaataggactatcttctaagaacgcaaagcaaacatagtaccgagggtaagtctaagcacagtataaaaaatactgagtaggccgggtgcggtggctcacgcctgtaatcccagcactttgggaggccgaggcgggcagattacctgaggtcaggagttcgagaccagcctggccaacgtgataaaacctcgtctctactaaaaatacaaaattagccggtgcatgcctgtaatcccggctacttgggaggctgaggccagagaatcacttgaaccagggaggccgaggttgcagtgagccaagattgcaccgctgctgcactccatcctgcgtaagacgagcaaaactctgtctcaaaaaaaaaatttaaaaaaaaattgagtcatcagtaactaatggcatttactgattagcattcctcatagatccaattcccattctaaccccatttagaaagtcagtcttaagatggttcaatttctatgtttactcaataacaatttttaaaaaatggttcaaaatgtttcaaatataccatgaggaaaaagaaaataaagcaaaggacagtgattagatacaagtgtaaactggacaggtgcggtggctcacacctgtaatcccagcactacgggaggccgaggtgcgtggatcacctgaggtcaggagttcaagaccagcctgaccaacatagcaaaaccccagctctactaaaactacaaaacgtagccaggcatggtggtgcacgcctgtaatcccactactcgggaggatgaggcaggagaattgcttgaacccgggaggcagaggttgcagtgagccaagatcgcctcactgcactccagcctaggccacagagcgagactctgtcttaaataaataaatacatacatacataaattaataaataaaatagtttatttatttatttttattttatttttggtggggggagaacagggtctcggtctatcgctcaggctggagtgcagtagcgccatcacagctcactgcaacctcgacctccaaggttcaagtgctccttccacctcagcaccccgcccctacatagttgggactacgggcatgtgccaccatgcccagccaatttttgtattaaaaaaataaaattggccggtcatggtggctcacgcctgtaatccttatactttgggaggctgaggtgggtggattgctcgagctcaggggttcaagaccagcctgggcaacatggcaaaaccctatctctacaaaaaatacaaaaattagctgggcatggtggcatgggcctatagtcccagctgcttggggggatgaggcaagaggattacttgaactggggaagtcaaggctgcagtgagctgagatcgtgcaccccagcctgggtgacaaagtcaaaccctgcctcaaaaaaacaattgagggccgggcggggtggttcacgcctgtaatcccagcactttgggaggccgaggcgggcagatcacgaggtcaggagatcgagaccctcctggctaacagggtgaaaccccatctctactaaaaatacaaaaaaaaaaaacccttagccgggcgtggtggcgggcacctgtagtcccagctacgtgggaggctgaggcaggagaatgacgtgaacccaggaggcggagcttgcagtgagccgagatagcgccagtgcactccagcctgagtgacagagtgagactctgtctcaaaaaaaacaaaataattaaaacaaataaattaactcggccgggctcagtggctcacgcctataatcccagcaatttgggaggccgaggcgggcggatcatgaggtcaggagatcgagaccctcctggctaacagggtgaaaccccatctctactaaaaatacaaaaaaaaaaaattagccgggcgtggtggcaggcacctgtagtcccagctacttggaaggctgaggcaggagaatggcgtgaacccgggaggcggagcttgcagtgagcagagatcacgccactgtactccagcccgggcgaaagagcgagactccgtctcaaataaataaataaattaataaataataaataaataaatgaaataagataaaaagcaattttttaaaaaaagagggaagatgaaaattagcaaaaagctgagaataataaccagagaggtgggtggatggcactcttttgtggctgtgtgtccctgacagaagggagaacctgaacccacccccaacggctgctcaggaatcagaaaggcctatggctggaatgcaccagaggcctctaaacttgctgaccaagtatggagctcactccccaccccaactctgcataagccaaaaaagaggcttacatgggcattcagggctaggagcacaaaacctaagacacggccagcatgtgtgcgtctttcccaaccagatggccatctacatgagaattccaccaggaaggtacactcctaagtactggcaaggcaaataagggaagcagaagaaatggagaaccatcctgattcagtaagtccacttccagaaatggctcttcaggaaataatcagaagttttgacaaagatttattataaggatgcacatgaagtactattaataacagtaagagacggaaataaactatatgtgtaatagacgagagattaaataaattatggcacttccatgtaagtgccatggagataatagaagtcctactctatgggcctgagaatccacccttgaccacagtgccaggacctttgtcactaccctcttacaaccccaccaaacagagaccctcatgcctttacactcagctatgctgccaaggtttggaacaacggagaggctcccgggcactcagtcatgtgtgtgtgttatgggggagatcctcacgtctgacccacacctgcccttgaaacaccctcacccccacccccagccacatctatccaaagtccactcctaattgagcttccccctcccctgctcccgccctctgccctcccaaagctaggtgccgagtcagctgtttaaggtcacatttccaccctagcctcactgccctgccttgagagacctcaccctgtcccctgaacaaccctgctggcccaccctcgcagcccccaggcctgcgcttggctgcttccccaagccagcacttcccagtgggggacctggcaccggctccctgtccttcctcccaaaaatagtcccctcaccaaatatgcagatgtctttacccctcgcctgccaacctcagccctcccgtctgatcttccccaaccccaaccaaaatccgggtggagacaccaagaaggaccctgagaggaaatatccaacctctaggtttttgaacctgttgagtttttcagtttctctgaaaagtcatactctagaaagctgactaaagtaatattcacaatatactatagaaagaaaacaaggccaggcgaggtggcccacaactggaattccagcactttgagaggcctctcacctgtagcacagctgcagtgcctctgcggctgcagtcccctcatccagcagggatgcattggccatgtccaggcctgtgatgtcacacaccatggtctggtagttgagtaaactctccagcctcccctgagacacctcaggctggtatggagtatactgggtgatcctgcaagggaaacaaaaggtcttgtccaaactgactgctgtttagagaagcacacaaaatgctatcatttcagaattcagtacctgaaaataatttgcctatcttgaggagaattacataacacaccagtaagcttctttttggcctttgtaaagcttagaattaaatcatagtaacaatattaccctttgtttggggataagcagtacttatttttctatctctctggtgttgtttttttgttttttgtttgttggtttttgagacagggtctcgctctgtcacccaggctggagtgcaatagcatgatcacgactcactgagcctcaatgtacaaggctcaagagatcctctggcctaagtctccaaagtggctgggacaacaagcacatgccatcacgctcagctaatttttgtattctttgtacagccagggttttgtcatgttacccaagctggtcttgaactcctgagctcaagcaatccacctgcctcggcctgccaacatgctggcattataggcatgagccactgcacttgaggctacctataatatcataaacagaaatttcatttgctattatctttcccctagataaaagacctcattcacattttacaataggaaagcatccaagaatctaacatgtaatactcaaacattttatttatttatttggatatttgttttatgttaaccaggagaagttctacatgctaagaaattaatagaggtctacttaagaattctcattatccagttactaagagtccatggcagttaactctatggctattgaaattccaggatggaaatgtttagaaggcaacgtaaacatggattctaactttatctccttcaattattagccaagaatgtggctttggatatgtcagttagccaatttagttccttcatccttacaggcgagagctaccacacctcacctattttacttgggaggtcaaggcgggcggatcacgaggtcaggagatcgagaccatcctggctaacatggtgaaacccgtctctactaaaaatacaaacaattagccaggcgtggtggcacgtgcctgtagtcccagctactcaggaggctgaggcaggagaatcgcttgaacccgcggggcggaggttgcagtgagctgagatcacgccactgtactccagcctgggcaacagagcaagactccgtctcaaaaaaaaaaaaaaaattagtacatcatgaacatctcccacatcagcaaatatgttttacagcatcattttcaatgaatgcatagtattatattcacactgtctaattatcatttcctttttagcagacactgcttgttttttctgttgttttctgtgctgtgatgaattctttggaacattattctctgtcttcctgtcgtatatcttgtgcctgtctttatggatatactaagtctttcctatttatcagatggactagattgtatgtgtgtattcctgcatgtgtatgtgtttctacatgacaaataatgattccaagtaaaatgaaagttttttattacccaagcaatctaagcacttggctggagtagtgccacatctgtcttcacggtgtcaagccatgtgtgtagatcttgtctgattcaagatcacaactgcctgcctgttgtctatgccttttgtatgaccccatttctgttcagatttccctttctatttgcctacaccatgtattgtgtgcctcattcattccagttcaccacccacttagaatctggcaaactaatttacagttgctaagccagtctcttcaagcaaaaatccattctgttgtatacacacacacacactcactctctcacacacacacacaaacacacactctctcacacacacactctttctctctctctctctcacacacactcacacacatacacatagccgcacaccaacaccccaatacaagtctcaggaaattatttcaaagtctcgatattgtactgcttggaaaggcaacctccccaccacactccctgtcaaagataagaagatgttggtttcaaagctttcaaaaaagaaagaaagaaaagtaatgaaagaaaagtagatggaggctgggcatggtggctcacacctgtaacccttgcactctgggaggctgaggtgggcaatcactcgagccctggaattcgagactagcctgggcaacatatgagacctcacctctacaaaaaaatcaggccaggcgcagtggctcatgcctgtaagtaatcccagcacgttgggaggctgaggaggcggatcacgaggtcaggagttcgagacgagcctggccaatatggtgaaaccccgtctctactaagaatacaaaaattagctgggtgtggtggcacgtgcttgtagtcccagctacttgggaggctgaggcagaagaatcgcttgaaaccagaaggcggaggttgcagtgagccaagatcatgccactgcactccagcctgggtgacagagcgagactccatctcaaaaaacaaaaaataaccatgaggctggaggatagtttgaggctgcaatgagccatgatcacgcctctgcactcccgcctgggtgacgggagtgagactctgtctcaaaaaataaatacataaaatacaaaacgttctcgtttttataagtttgtaaaaacaagtagatgaaccaaaatgtaagctggttttctctgggaggtaagatgattaacactaaattttctttttattgtatgttccaaatgttaaagaaaccagctaccattcattaaccatctcttatgggtcaggaacacatttaccaccttttttatgattatgttatacatgttctttgtaacaagttggaaaatccagataactattgagaaaataaaatcacttaatttccaaactttaacataactacagttaacattcaggtgcattttttccaatctcttttctacatcataatctatttatactaaaagtagtactggccaggcgtggaggctcacatctgtaataccaacactttgggaggccaaggtgggaggatcacttgcaccaggagttcgagaccagcctgggcaacatagcgagactctgtctctactaaaaataaaagaagtttttgtatcttaacttttttcagttaacattattccatgaacaatgtctaacataacatctttaaatactattcaaaaacatgattttaactgctctatggtattaaataacttatgaaataaattatttaagttataatttcttcaggtaaatcttgatttatttaacgagttccttccagttgaatacttttgatttcaaatattagaaatagcataatagttaagatctttatctttgtctaaggatacattcttagaagtagaattccaaattatatatgataactagttttttggggtttttatttttttttagatagagtcttgctctgtcacccaggctggagtgcagtggcacgatctcggcccagtgcaacctccacctcttgggttcaagccattctcctgcctcagcctcctgagtagctgggattacaggtgcgtgacaccacacccagctaaattttgtatttttagttgagatagggtttcaccatgttggccaggctggtctcgaactcctgacctcaggtgatctgcccaccctggcctcccaaagtgctgggattacaggcgtgagtcatgtgtaattatcacgcccaccctgataattagttctaaggctcccagagcatagtaccatgttcctctccagaaagagcatatctgtctgcattctcttaaacactacagtgattcacagatatccttgcatcttcaaaactactaagtattaagaagcactggcttttggtttttgttttgttttttgagacagagtcttgctctgtcacacagactggagtgcagtggcctgatcttggctcgctgcaacctccacctcctgggctcaagcaatcctcccacctcaacctcccgagtggctgggactacaggcatgcaccaccacgcccagctaatttttatatttttttgtagggatggagtttcaccatgttggccaggctggtctcaaactcctgggctcaaagacccacccacctcagcctcccaaaatgttgggaatacaggcgtgagccaccacgcccagctgaagccctgggtttcaatcttttttttttttttttgtagggacagggtttcactatgttgtccaggctggtctcaaattcctgggctcaagtgatccttccacctcagcttcacaaattgctgggataacaggagtgagccactgtgccaagccttaatcttattaattttctacagtcatgcatggcttaacagaaatatgctctgagaaatacatcgttaggtgatttagtcattgttgtgtgaacctcatagagtgtacttacgtgtacttagaaggtatagcctactacacacctaggctacgtgatatagcctatcactcccaggctaccaacatgtagagcatgttactgtactgaatactataggcaattgtacaacaatggttaagtatttgtgtttctaaatacagaaaaggtacagtaaaaatacagaattacaattttatgagaccactgtcatatacacaatctgtcactgaccaaaatatcactacgcagggcatgagtgtacttgtgaactgggataaataactaaacgtcgctctagccaatatctcttgcctctcaatggaaataacatcacctatatgagagatttttcttaatgctcaaatcagactaatgtactgtccaaaggttattcaagtgaataatagcaactgtaaattagcatctgtaagttattttgaattcataagacattcaaaaacttttaaaatccctagctttctgtctatatgtgtctgtgtatgttttaagactcagtatacaggccaggtgtggtggctcacacctgtcagcactttgggaggaaaatctcttggggcaagtagttcaagatcagcctgggcaacacagagaaaccttgtctctactaaaaatttaaaaaaaaaaaaaaattagcctggcgaggggcctgtaagtcccacctactcaggaggctgaggcaggaggattacgtgagccaaggagttccagtttacagtgagctattagagcaccactgtacgctagtccaggtgacagacggagaccttgtcttaaaaaaaaaaaaaaagacctagtatataaccagtattttcttttttattgaaacggagtctaactgtcacccaggctggagtgcagtggtgcaatctccactcactgcagtctcctcttcctgggttcaagtgattctcctgcttcagcctcccaaatatctgagattacaggtgcctatcactaggcctggctaattttttttgtattttttgtagagatagggttttgccatgttggccaggctggtcttgaacacctgacctcaagtgatctgcccacctcggcctcccaaagtgctgggatacaggcgtgagccaccgcacctggcctaatcaggattttcttttctgttgtttgtatacaggcttgtgctatgctacccaggctggagtgcagtggctgttcacctgtgcgatgattgggcactacagcctcaaacttctggactcacatgatcttcctgcctcagcctcccaaggagctgggaccacaggcacaagccaccatgcctggcttaggatcagtattttcaatgacccattggctcttgaaaagttggagtttttttcgttttcatctttaaaaaagtttttaaagcatatgctgatagacctttcctaaaagcacttctgcagaattctgtttagatattattacatatttccacttaaaaactatttattcaaattagttacatcttttctgtcccttatgtaatatttctctctcaatcctttcataagtccaaggtgaggttaatgttatttagcattgctaaaggtagagacctttaaaattgttgtcttgcaaatatgccaaatatgtaatctcactccttttacatgtaaacttcttgtattagtctagaggtttttggcactactgaaattaaacaggtgttaatgctcttaacaatgatctattaaaggacagtgagccttggatctgagagatgacaaataaccctcatttcaggagaaaaatactatcaaaaggcctgccatcatgtttacaagagtttgactcaattaggtaaaacatagtgattaagaaaacatgcctgtcatctataatgtctatgttccaaatgactaattcaactggtttgttcctaaatatattttaacatataaaaaggtatctgcacatccaagaaggcatttagttcagctcaaataggatgcttgatatattcaacatggcattaatatttaacccaaaataattagtgttctctatcattttggctgtgactttcttttggaattgggaaagggggttatgggggtttgcaggacaaacactcctgagattctctcattttaatcctgctgacaaaaatataccaaacagaaatagctacaaggaatatgtaaatgttctgatgttatcagtagttgaaaatttggaatagtgaaacccataaaataaattctagacctgatgtaaattttctttcaagagcccaaatgtttgttttctttcgaggctatgtcatccatttattttcccctcacgtctccggaatttgttggttccatctctatggaaaccattcagaaggatgataatgtgaaatctaccacccacatgtgcacagccctccctatcagcgctggtggggtgtaatatcactctctggttcagatcagctttcagagaatagaaagaaatagtatttaaaatgcacctgaaaagtaaatgaaaagtacaggacaacatcatctccttctcaaaacactggctgctcctacggtaaattaacatccgcccacagccagaaagcaatatggtgaatattctttatggccaccaagagcaaaggctgctggccagtattcagatggctggaatgctgcagcccgttcatgtacttttgaggcttttcttaagggggaagagaaacaggccattttcttttgaaattaaccttggaatttaccattcaaatttttaccaataccacaatgaaaaagaagccttcatcaatgcaaacgcattcacagacgctacagagaaactagttctttgattttcctgtccccttattaataaagtggagcatattgaaactaagagttatgtacagggacagcaatactggaatgattgtgctgagagatctggctcctataatgatatgataaaaataattgcatctacgacaaagcacatgcacccaccaggattacatttgcaatgatggaaaagcagacaaagatgcaaagtgtttatcaaattgttaacactcattgattgggagcatgtacttgggtatttcaaaagctcctgttggtacaacttatgatttcccacttagtgaagcctgcattcccttaagtaaagttggtttttacatatgttaatctaaaagccaatctgtgccccttgctaggaatactttgaattgcagaggcaaccacttactctgtcctcatgtcatgatgatcctgctagaaattaaagttacctcttccacaaactaacttttaaaaaatcacctaggaattatcaccatactccatctatgtctgatttgtttccatgctggaaatgaaaagtggacacctatattttcaaataagatgtcttccttttaagactaattcatcatttgaaataaaatttcaactcagtgtttctggtgtataaaatggcaccaatccaaaaagatgggaaaaaagagcctaggagtccccacctttcctcctccacagttagacattatatcccagtgaacagcagaggcagatgtccttaactgcccaggctggagtgcaatgctgcgatcttggctcaccacaacctccacctcccaggttcaagcaattctcctgcctcagcctcccaactagctgcgattacaggcatgcaccaccacgcccagctaattttgtatttttagtagagacagggtttttccatgttggtcaggctggtctcaaactcccagtctcagatgatccacccgcctcaacctcccaaagtgctgggattacaggtgtgagccaccatgcctggcctttttggttctttacatcatacagcaaacagcaatggaaaacaacaaaatagcatggaagtggactagaagtattttctcaaatgcaggagaaatgctttcagtgttgttctatcagtgaggaccagagtgggcaggagacacagacatggatggacagacacacacacacaccacacaatcagtgaggaccagagtggacaggagacagacacagatgaacacacacacacacccctagaagtaggagtgacttggctgggcgcggtggctcacgcctgtaatcccagccctctgggaggccaaggcgggtggatcatgaggtcaggagttcaagaccagcctggccaagatggtgaaaccccgtctctactaaaaatgcaaaaaattacccaggcacactggcaggcacctgtaatcccagctactcgggaggctgaggcaggagaatcacttgaactcgaagggcagaggttgcagtgagccaagatcatcccactgcactccagcctgggcaacagagtgagactctgtctcaggcaaaaaaaaaaaaaaaaaaaaaaaaaaaaaagaagaagtaggagtgacttatctaactgttgaggtaagactggaataagtaactgagcatgcatagctcaggcctctctcatatcttttctagaagagcctgtctacagaatgcacatgttctctttctctagaaagtgctagcaataaagctgatattatgatctccaacaccatgtctttttgtcagtcagttgtgaatcaaaaattttgggggtgggaggggaagggaacacaattatctgtcccccttaaaaatcctgacagaagggccaggcgcagtggctcatgcctgtaatcccagcactttgggaggctgaagcgggcggatcacctgaggtcaggagttcgagaccagcctggccaacacggtgaaaccccatctctactaaaaatacaaaaattagccgggggtggttgtgggtgcctgtaatcccagctacttgggaggctgaggcagaagaattgcttcaacctgggaggcagaggttgcagtgagccaagatcacaccactgcactccagactgggatacacagcaagactccgtctgggcagggtggtaggcggggaatcctgagagaagacagtggaccaagattctctcccagactccaccaatgactcaatgagatagctcagaagtagcctatgtcccagggtctccaaggaggagtaaaggcctgaatctgcccacctgcaggtttcacatcttactcaaatacagcacagaaattaagctgcagaagaggaagagatgaccagatccacaatttagcatcctagtagattttatgggactggaagtgggaagaaacttctatttcctcaacatttgagcaagaacatttctcgatccagagaaacccggtaggttcccggacattggagacagcactaggaggtgggtgtcagtgtggaggctctgagactgcaaggggacagatggaggatggagagaattatgcaaatcacagtcatcctgttcctgaactgagaaatacattaccatcctgagttctccagtaagttccgcaaaatcgtctgtggcactgagcagttataatagcccatgccaatatacgatctccagatctggtttttgcttgaaatggcatgcagagttgcaaggatttcattttcacctaattgtgggaaaaagagaaatgttacagacagatgtctcagaaaagagctctaattacagtttaaatccctcattttgtttgagtatttatgacagaataactatatggaaaatgtaagagtcatccatccaaccaacactaagtactgtatgcgacatctcaaaaaaaaaaaaagtccccaaacaacactcaatttctcctcaaggttggcccccccatcactgttttgactgttccttattcggttctgtttgctagaactgcccattttaacacttgcctcattccaggctttttctgttccctttctatttctgctgtatatacgctaaataaaaattctgtcttactcccagtaaaatactgtgttttaccttctaaactgcctcatactctctggaagtaggcacagcttcagtctaattaacacataatctacattttctctaaaattgttctactcagttgcacattcctcctttgtgtcactgaaagggcaacttataaaaaggccatcactcaacaatagaaaatatcagttgtaatcaaagaccctcatgcagggctgtgaacagtggctcacacctgcaatcccagcactttgagaggctgaggtgggcggatcacctgaggtcaggagttcaagacaagcctgggcaaggcggtgaaaccccgtctctaccaaaaaaggcaaaaaattagccaggcatggtggttcacacctgtggtcccagattcttgggaggctgaggtggaaggatcacatgagcctgggaggcagagattgtagtgagctaagatggcgccgctgcactcaaacctgagtgacagagtgagacccccatctcaaacaaaaacaaaagcaaaaaaacacacccttatgcagtttctaccagcattctcatgaaggcactttggttattaagaagtataaatgtacttggatgcaggtgggaccctttctcgggtcattcatataatcacaaaataataatagcatttgacatttattgaacattattccaccaggaattgtaccatatgcttttcgcacagcctagggtactgaggattgaagacggtcacttggctgaggtcacacgactttaaattaaaggattactaatccaatctcacactttaactcactggactaagttgagagctgctacatggacagctcttatactgaagggtccttttttgtttttttgagagggagtcttgctctgtcacccaggctggagtgcagtggctcgatcttggctcactgcaacctccacctcccaggttcaagcgattcttctgcctcagcctcctgagtagctgggactacagtcgcacatcaccacacctggctaatttttgtatttttagtagagatggggtttcaccatattggctaggctggtctcgaacttctgacttcgtgatccgcccacctcagcctcccaaagtgctgggattacaggcgtgagccaccgcgccctgccactgaagggtactttttagatagaaatgacatcatttggttctttctttacctctctgcatagagatagatcatgctactaaaatttaactgggatttaactacttaggcaaatggctgtcttctttaagatcttcttggggactcagtcacttaaccctgggaattgattattttatttttcctctatcagagaaaaacgtaggtaaagcaaaacctaagacagcaaactggcaaggaagacacttaacattgttttaaccctattgaactctatctgaatattatttgcatcaatctttatcctcaagtaaaatactttcaccctccaccacacacacacagacacacacacacacacacacacacacacacactccgcactccacatgctttcccaggaaataaattcacaagagatatggtccccctccccctccccctctccccacggtctccctctccctctttccacgggccgaagctggactgtgctgctgccatcttggctcactgcaacctccctgcctgattctcctgcctcagcctgacgagtgcctgcgattgcaggcacgcgccgccacgcctgactggttttcgtatttttttggtggagacggggtttccctgtgttggccgggctggtctccagctcctaaccgcgagtgatccgccagcctcggcctcccgaggtgccgggattgcagacagagtctcgttcactcagtgctcaatggtgcccaggctggagtgcagtggcgtgatctcggctcgctacaacctccacctcccagccgcctgccttggcctcccaaagtgccgagatggcagcctctgcccggccgccaccccgtctgggaagtgaggagcctctctgcctggccgcccatggtctgggatgtgaggagcccctctgcctggctgcccagtctggaaagtgaggagcgtctctgcccggccgccatcccacctaggaagtgaggagcgcctcttccgggccgccatcccatctaggaagtgaggagcgtctctgcccggccgcccatcgtctgagatgtggggagcgcctctgccccgccgcccggtctgggatgtgaggagcacctctgcctggccgcgaccccgtctgggaggtgaggaacgtctccgcccggcagccaccccgtccgggagggaggtggggggtcagcccctgcccggccagccgccctgtctgggaggtgaggggcgcctctgccccgccgcccctacggggaagtgaggagcccctctgtcccgccaccaccccgtctgggaggtgtgcccaacagctcattgagaacgggccatgatgacaatggcggttttgtggaatagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccgtaatctcaagtacccagggacacaaacactgcggaaggccgcagggtcctctgcctaggaaaaccagagacctttgttcacttgtttatctgctgaccttccctccactattgtcctatgaccctgccaaatccccctctgagagaaacacccaagaatgatcaataaaaaaaaaaataaaaaaagagagagatatggtactttgccacagtagagtaaggaaagagagtcttgaagttattagtttcatgagtaatataatctaactaccttatggaagatgatcttgccttcttccattgaaagtttaggaaataagtaaaaatgcaataaacccacatctgagaagataggcaaggacaacatccctaggaacaatcatgcaaaaagtccaatcacctcccaaataatcttcttaggggcagaatgattcagacgcccagtaggaggaaagattaattagcagtgccttgtaggcgagtccggcttcaattatgatcctgtgcaggggggacaggtccctgttctgcgttggtccagctctccaatgacaacagtctgtgaagggctctgtctgtcaaactgagtttagcctttggaaataaagctggatagtatgattctttttacaatacagtaagataattctactgatggtgtggaaaggtcactgaggggagaccccggcccagggagatacagtaagaggccagcactatagtccaggagggagatggataagaggagtgttacaagttgaattgtgttcccaaaaatgatgctttgaaatcctaaccccatggtacctctgaatataaccttacttgaaaatagggtctccactgatgtaaccaagttaaaatgagatcatgctggattagggtcagccgtaatccaatgattggtgtccttataagaagagcaaaattgggacacacagacacacatgcaagaagaatgccatgtgatgatggcagcagagactggagcaatgtatccacaggccaaggaacctgggagagaggcagggaactgattctccttcagagcttccagaaatgagccaaccctgccaacatcttgatttctgactacggaactgggagtgaacaggttcctgttgttttaagccacctagtttgtggtactatattacatggcagccataggaaactaattaaaaaaactgtatcagtcatttttaggagacacgataatactcttgggcccagctggccagttaaaaaaggctcaggttggtggggcacggtggcttacacctgtaatcccagcactttgggaggctgaggcaggaggatcacttgaggtcaaggagttcaagaccagcctggccaacatggtgaaaccctgtctctactaaaaacacaaaaattagctgggcctggtggcatgtgcctgtaatcccagctacttgggaggctgacacaggagaatcgcttgaaccagggaggcggagattgcagtgagctgagatcacgccactgcactccaaccggggcaacagagcgagacactgtctccagaaaaaaaaaaaaggctcaggtgaactccagcactttgccagagacatggtttcccacacatcattaagattctactagtggaagtaatcgaccccaatagcatcattctctttactaactaacattatcctctggcttaagagagctggtgctatggttctgggatatgttggaagtctgtgcagaggggtgcagcagcctccccaacaatccctcagtgacccggccggaggtcaaaccagcaccgccagttatccagcccaaagatttgcactgattgctctctcactcacacggcctggcatgggaaagggaagcaatatggccttgcagtcacgttgttccacaagcagcacggctgagagaaccaactcaatggctgactttatttggctgcatgcctggagaaaaataatattatagtagttgaaataattagaaatagctaaatggacattgatgggagccaaaagggttactgaaaccaacagtcctcatagtaagtgaaaccgctaaggtaattcttccagtgcaggactctccttcctcatacccagccccaggagacacaataggattagagggataggaatttggctattgtgccaagagccaaaattacagtccctcactaggtactgtagcaaaaatctagctcccgctgcatatagaggtgctcaaatgtgttgttttgattttgcttgtagacttttggaaggtctctttactatggttttattttccactcctatgatagtagccctagctgttatgttcattcccactgataggaaaggtggggttaacgttttatgggtctgcagcagaggccacctcctgagaaggagtagataggatctcacccaaaggaaggggaagagtaggacccaagttttctgaaaaatgcacttcaaggactcagattcaggaaagtcatggaggtgatagaagccctggagctcggggctagaagctgagaagaatcctgaactaaatcaaactccagatcgcttccctctgagaacacaaaatgccacccctctgcctgccttcagcaaaaatctatgctctcgccccatagagaggtgctcaaatgtgtttagattttgcttgcagacttttggaaggtctctttactatggtttattttccactcctgtgatagtagccctagctgttatgttaattctcactgataggaaaggtagggttaaagttttatgggtctgcagcagaggccacctcctgagaaggagtagataggatctcacccaaaggaaggagaaggctaggatcccaggaagggggtggggcaccaccccagtcctgacaattagctccaggagaccagtcaagaagcgcaattgactacagaaggagcaggattgaaataaaaagataaaaaataaaaagaagcagctcaattgaatgggagtattgcggaagataaaaatggtagtttattttttcacttgacagaagaagaaacacaagaactaagatggtgcctgccactgtgtttcaagactgtgggtctttataattaattattttgttcttcatttatactaattggccttttaaaaatttcaagtgtttcattcaaatgtgaaaatcatcagagctgctatgggggatggtgatgtctgaagtccctagactctcaagtaaagagagatttgaattttcctttcacaagaaaacccattctctcatacctctccgcacaggtgtccaggaggtaataggtaaaggtcaagccccttgcgagagagccctgactacagcccagttcccatctccctcccttcagtcaccacctgccactcaggcactggtcatgccctgccccatgtcctcaaacagtaaggaagagaagatgccacattagaccagccaggaacccactggcccaattcatcagttctgggtctccagatacaaatcagcatcctgcagagcagccactgatgtcttacacactttaattaaatacctgaaatttttaaaaggcaaactagtgggccgggcgtggtggctcatgcctgtaatcccagcactttgggaggctgaggcgggtggatcacaagatcaggagatcgagaccatcctggctaacacggtgaaaccccatctctactaaaaatacaaaaaaattagccaggtgtgttggcgggcacctgtagtcccacctactcgggaggctgaggcaggagaatggcgtgaacccaggaggcagagcttgcagtgagccgagatcacgccactgcactccagcctgggcaacagaacgagactccatctcaaaaaaaaaaaaaaaaaaaggcaaactagcttaaataaagaacaaaatattaattatctgtaagacccagaagcataaaaactgtcaaacatgagacaaagaagtttctaaggtgataaatatatactctagtctctataggaccacccaaacttctcaagcacctgtggactctgcccctatccagcttgggactaatgagttttcctggattggttctcatgatagcttggtagttatgcccaattttaccttctgttgagaacaaagtgagttaatagaatgagctgtcccctatacaacaagttaatggacattttcgagccattaagagtaggtccctagtcacgcttctttccattcactcatccattgcccaacactacaaaacttcccaacaaaaacttcccagctagaagccaagacagtctgtgacttgatgaacagaggggtaagctgcttcttactgtgataaaatctaagacctcaggcttccacacccacatataataaaaagaattccccaaacatacagcctagtgagtgtctgaattgtttcaaatgtttgttcactggttgccatttctcagacccactcatgaaatatcactttggccagatctgcaggagaacaaacccagtgtacctagaagcccagagtttgagtaactttggtgtcaagatagcaatagatgcagagaaaaggagagaagacagaaaagtccatgatcagagatctacctgctgaaccaacctgaaactgaacttcacagaatccagtgtctaagtccaagttaagggacatgatgatgtctaaataaaaccccaaatcctaactaaggacacaattcctaccactgtacacctcttctcccgtggaaaagagctacctttctagaggaaacagtatggggtccttcaatcccaaagtggcagccttttcctcctgagtagtaaaagaagcattctgagaaggtgattgtgccatccaaaccttggaaagcaaatgggaaaagggaaaaagaaaactagattttccccccagagcaaagctcacagcagagcacattcctcacccttttcctttcaactggacaaaaccagcttgctcctgtgcacaagcctaattcctgaacatgaactacaatgaaactaaccaggggggaaagagaccaaatgagaaaagggggaatccattaagaaacgcttgaaggctgggggcagtggctcacgcctgttaatcccagcactttgggaggccgaggcagaaggattgtttgagcccaggagttcgagcctgaccaacatagtgagacctcgtctctacaaaaaaaaagtcaaagaatgagacaggaggattgcttgagcctgggaggtggaggctgcagtgagcagtgattgcaccaatgcactcccacctgggtgacagagtgagaccctgcctaaagaaaaagaaacacttggagacaagatggcatcttccggatccttgcctacagctatgcagggcagccagcagctgtgcattattttgcactctcagccatgaaggaattcaggcaatccttcaggaacctacacagtaaattcttttcttgcagaataaatgcctgcttctgaccttgtttattctgcctcagagcattgcataatctcctggtcctaatgtaccaagaacagagttcagtggcctctaggcatcacttcctaagaatctgcaggtaagaacttgcgctgcttctgcttgctaaattctgcttctcagaatttagaatgaatgcttcctctttacatcattccacataagagcccttctatagcaactcctttgccactgcgcctaaaatagcaacagttttgcactaaccactgcatcaaataaatactttccaatagcaataagatgattttgctgttaaatattcattttttttttttttgagatggagtcttctgttgcccaggttggagtgcaatggtgcgatctcggctcactgcaacctccgcctcctgggttcaagcgattctcctgcctcagcctcccgagtagctgggattagaggcacctgccaccatgcccggctaatttttgtatttttggtggagacagggtttcaccatattggacaggctggtcttgaactcctgacctcaggtgatctgcctgcctcggcccccaagtagctgttaaattttcaatacattactaggactaggttttaatatcctgtttatgtgaatttccacaagaactggaaaaatgtcattaaaatggacaggcaatctgtatgagtcaagatacctgctacaactaaacacacacacacacacatgcacacattgtttcccatccttaacccattaccccaaacataaccctacaatttcttttggcctcaattataagggaaaatgtattcaggttttgctttttgcttctttgacaatctaaaaatgctatacctaaagttttacaccatatatatatatacccacaatattgttatcatttatattttaaaaataattatatgtgcatctgtttatatattagcagaacatctttgtgatgattcacaagaaattgataataaatacaagataatagatgtgggagggaggcttgcttttcactatatatatatatatgtatatatatatattttttttttttaagagagacaaggtctcactatgtttcccaggctggtttcaaactcctgaactcaagcaatcttccagtctcagcctcccaaagtgctgggattacaggcatgagccaccccacctggtctccctgtatatatttttgtgcttttgagttttgaacaatgtgcctatattgtgtatttgtaattaaaatgttgggaggctgaggcaggagaatggtgtgaacccaggaggcggagcttgcagtgagccgagatcgtgccactgcaccccagcctgggtgacaaagcgagactctgtctcagaaaaaaaataaataaataaaattaaaatgttgcatgtagaatgaaatcctccttgtaaaatacatgggtacatgggtgtacatcccatcagtcccaggcatcagtaggccatccacagaccatgttctggggagcccagccagcagcgcctcacacacagcagccactaaccgcgtcagagcctccctcactcttcgccctccatgtgcttggcaagacactaggaaaaggtctccaaggaaatcatcaggactgaaaaccaacacactcatatttgaatttgcccaatgtcaccagtttgagaaaggcctttctctgctagagggtaaggggaaagctggggccagaatgtgaggacagagactgcctgggcagattgttcttgccaacatcctaatcctcagctgtgaagctgagagggaaccatggggtggggctggggtgtcaatcaagataaacagaccatgaatgacagcatggcaggactttctcatctttctgaagggaagtcagaatttggaagcagattccatctgcatgctgatcctttccccaacatcacccagtcatttatagcactcctttctctcccccatagccacctggatcaagcccacttacgcagtccatagagccaactccctgttacttgtcaagtttcctccctgggcagaggagggtttcactagccaagtcagctgaatcacggaatgtgttgaatcgttcgagaaagccaagccaatccatacgctacgctctgcacagcgtacagaggaaactgaacctaaaacccttgcagaccagcagagctgtgccacgtgtaaggatatggtcagggcagcggcacgcaggcccaacctggggctctgagtctccttgctctaagcctgccaggctcttccctgtcttcttgctcagccaattaataccacgcctcattcagtccttcctgaccctcaggggttaccgctctcctcaggacacctccactcaaaaggagctgaggcgtgtcccatctatgtttctgatgactccttggtcccttgtctccgtatgagtgagcagtctctgcagctcttcctgatcacccgagagatgcatagcttcaagaccctaccagctgtagcaaaaccaaaacaacattcactgtggggagtgggacaagggatgatatgtcttgttattttactccttgaacttggatcatactccttcctgtgggaggccccttttcatttaatctacaaatgttaagaaatgtacagagaaacattgcaattcatagtatttatctggaataccagctgacctatgtattcaggccaaatgctgagtttgaaatgagaatcagtgcaggtcccagaggatttgttttccctctttgctgccccaaaggtacattgtcatggcctacagagcaagaacaagaagggaagactgtgtcctaagagtccaactcaaacagtgtatcatgcttgagaaaaagataattttttatagatcaaaggcatatgggctgggcacagtggctcatgcctgtaatcccagcaatttgggaggctaagggaggaggatgttttgaacccaggagtttgagaccagcctaggcaacacagcaagacccccgtctctacaaaatgaaataaattagtccatgtggtagcacatgcctgtagtccagatactcaggaagctgcagtagtgggaggatctgtttggcccaggaggttgaggctgcagtgagccatgatcatgccactgcagtccaacctgagtgacagtgagaccctgcctcaaaaaaaagtcatatggagaaatttgcagtccaaccgagaatcacaccaagtaaattgtaatctcttatagtaaatgctcagaaaatacaggtgaatcaatgtgttgcaatgaaaattcacctaaactttcacgtatggctagcccaggaactcacccatcacagactcatgatgatgaatcaatgcataaattgttctcacatttggttcaactacatcccaaaatgtgtgagcctcagagaaacatttatcagtggaaacctgcagctattaagaaagttgtataaaataatgcagtgtctacaataatttcagacttcccaaaattttatttcttcattgttcagtcagttagtatgttgatgatacaggcattgagaattcttactaaaattctcagtttgcatttttgtatgaatactctggacttacaaaaagtaaagcaaacttgagtcaaaatgagatcaaagttatccgtacatcgtataactgagacttgtttaagcaaggcacagtgctatttgatggagtggggaagaggacatgaagaatagaagtcacaacacagattcgcccacagcgactcacgtccctattctctagcacgcgccccggttcagcccgggccctcactcccagcctcctgaggcgggtcactgagcttgcaggcagaatgtgggtggggctgccccacctctctctcaacctcactgagctgactagtggaccttgaagtcctcccctcggctgaactcagtcaccacatttctctgttcctgcttccaagtcactgactgatggtggggtggaggacactcaaacaggccttacaaattcccgctattcaatctcagcagaccctccctgcaggccgatcgagggtcctcgccacccagatgctctcagcagaccctccctgcagaccgatcaagggtcctcgccacccagatgcacacaatagctcttctgaaattcacttttccctagtactcagtctcagccttcctgtctctcatgcagagagatcgtcagaaatgcagcccctcaactcctcccacctcggaggatccttatgtctttatgcagactttcttccctcttctgcctaagaaaggtcgagaatacgacacaggggtccgtaactccctgcctgaaaatatatccttctgcctctgatgacttcatctcagactgccctgcctctctccttctgcatgttttatttccttatatcctggcttttctttcttccccacactccatccctgggaaatttcactaattctcatgaatttgtcggaaaactcactaaatctgcaactccatctcttctctctctggatctctagactctactttgcaacttttgcttcaacttttccaaatgcatgttccacgaatacctcaaacccaattctgctcaagcaagacccaatctcttcttccacttctccctgttccccctctgttaatcaatgacatcaacatcactaccccatctagaaactgactgacagcctcatctcctgcctctctggatcaaccaccacgtctgtacaaaaaccatgcttctggccaggcacagtggctcacaactgtaatcccagcacttggaaggccaaggagggtggatcacctgaggtcaggagctcgagaccagcctggccaacacagcaaaactccatctctactaaaaatacaaaaatgagctaggcgtgtaatcccagctacttgggaggctgaggcaggagaatcttttttttttttttttttttttttttgagacggagtctcactctgtcgctcaggctggagtccagtggcacgatctcagctcactgcaagctgtgcctcccgggttcacgccattctcctgcctcagcctcccgagtagctgggactacaggcgcccgccaccaggcccagctaatttttttgtatttttagtagagacggggtttcaccgtgttagccaggatggtctcgatctcctgatcttgtgatccacccgcctcagcctcccaaagtgctgggattacaggtgtgagccaccgcgcccggcagaggcgggagaatcttgaatctgggaggtggaggctgcggtaagccaggattgcaccactgtactccagcctgggcaacagagtaagactctgtctcaaaaagaaaaaaacaaacaaacccaaaaccatgagtctcatgcctctaattccagcactttgagaggccaaggcaggcgggttgcttgagctcggagttcaagaccagcctgggcaacatggcgaaactccatctctacaaaaaatacaaaatgtagccgggcatggtagctcacgccagcagtcccagctactagggaggctgaggagggaggatcgcttgagcctgggaggcagaggttgcagtgaactgagatcgcaccaccgcacttgagcctaggtgacataaccagaccgtgtctcaaacaaacaaacaaacaaacaaacaaaaaacaaaaaaaaaacccgccatgcttctcctgggctgcccgaagccagtgactaagctctgccggaaaactaatgcagactcattcattctctggagatataagactcctcccatgggcagctgtagctccaggactccatgtgggcctgatggaaactctcttagatctgttctgtactgtaagactcttcctacccagtcttcattctgcttctctccccttccaccaaagttagacctgcattagtttggaggctccccttccctctcccgcttctccccctccctctcctctgatctcagaggcactctgcaaaacacaggatcaatccttccacttccctctatagtaacttttcctgtctacccattacttagaggggggaaaataaatcccttttggctctgagccctccatattgtggccccataccttgtttttcatgtccctctgcaatctaacattctaaccacatggtctattcaccgtccctcaaataaccacgtatttccacacttccatgcctctgctcatgccataacttcagacgaagtctccatcctatttgcagacccatcaaactattcaatatctatttccttataagttataacctatagctggggatatctttatcatcttttacctcctgacttttgtacaccaagtgcctgaagcagtatcttatcttctacatctgactctcaataagtgcagaatggaagcagatggaggaagctgtagaaggagatttggcaatagtaccttaataacccactgataacaaaggtgatagcaaacaccaatccaaaaaccaaaagctaagcagtctagggcactttatgtatgggcaaatggtcctatgtaccataatagccctcaagaatagcactatatttataatacagtataattgatttcagtttgatagcactgaatatgttttgaggttagagtaagttatagtcataccgctgcactctagtctgggtgacagtgcaagaccctgtctctaaataataataataataggatctgggtgtggtggctcacacttacaaccccagcatgttggcagaccaaaatgagagaatcatttaagcccagaagcttgagaccagcctgggcaacatattgagacccccatgtctacaaaaaaatttaaaaaattagccaggtgctgtggttctccttgtggtctaagctacttggaaggctgaggtgacaggactgcctgagccggagaggtcgaggttgcacagagctgtgatcattccactgtagtcgagcctgggtgacatagcaagatactgtctcaaataaaataaataaaataaaataaaaataaaatgttttaaaataaaaatgataataatgaacagatgttatactacagttgtctaaacccctagaatgtgcaacaccaagactgaatcctaacgtaaacaatcttcactttgggtgaggccaggcgcagtggctcacctataatcccagcattatgggaggccaaggtgggtagatcatctgaggtcaggagttcaagaccagcctggctaacatggtgaaacccccgtctctactaaagatacaaaaattagccaggcgtgatagttcatgcctgtagtctcgcctactcaggaagctgaggcaggagaatcgcttgaacccaggaggcggaggttgcagtgatctgagatcgtgccactgtactccagcctgggtgacatagtgagactccgtctcaaaaaaaaaaaaaacactttgggtgataatgatgcattaatgtaggttcaattgtagcaaatgctctggtaggcaatgctgataatgggagactctacgcttgtgtggaggcagtgggtttaatgggaaatctttgtagctttcactcagttttgccatgaacctaaaactgctctaaaaaataaagttggtcgggcaaggtggctcacgcctatgatcctagtattttgggaggcagagtcggaaggatttcttcctgagcccaggaattcgagaccagcatgggcaacacagtaagattgtctctagaaaaaatacaaaaattagccgggcatggtggcatgcgcctgtagtcccagctgctcaggaggctgaagtgcgagatcacttgaacccaggaggtcgaggctgcagtaagctgtaatcacaccactgcactccagcctgggcaacagagtgagaccccatctcaaaaataaaattaaaaaacccaaaatagtccaggcacagtggctcatgactgtaatcccagcactttgggaggctgaggcgggcagatcacttgaggtcaggagttcaagaccagcctgaccaatacggtgaaagcccatctcaactaaaaatacaaaaattagctggctgtggtggtgggtgcctgtaatcccagctactcgggaggctgaggcagaagaattgcttgaacccaggaggcggaggttgcagtgagccgagatcgtgccattgctctccagcctgggtgacagagcagaactggttttgtttgtttttttttttaaaaaagtccgggcacaatggctcacgcctgtaatgccagcactttggaaaatcccagcactttggaaggccgaggcaggcggatcacttgaggtcaggagttcgaaaccagcctggccaacatggtgaaaccccgtctctactaaaatatacaaaaattagacaggcgtggtggcaggtgacttaataccagctacctgggaggcagaggcaggagaatcatttgaaccccggaggcagaggttgcagtgagctgagatcgagccattgcactcaaacctgggggataagagcgagacttctctcaaaaaaaaaaaaaagatactttatcaagattgagggttttttaattttgttttgtcttgttttttgagatgaagtcattctgtcgcccaggctggtgtgcagtggcgcaatcacagctcactgcaaccttctcttccctgcaacctccacctcccaggttcaagctattctcctgcctcagactcctgagcagctgggacaacaggcatgcaccaccacagccagctaatttttgtatttttagtagagacagggttttgccacgttgcccaggctgatgctgaactcctggcctcaagtgatccatccgcctcagcctcccaaagtgctaggattacaggcatgagccactgtgcccagccaagactgagatttctagtttgggattctaattttaataagaaaggaaaaactgatcataatttattttaggactcaacacattaaaaatttttttttactttttttttttcaaagagacaggatgttgcccaggctggtcttgaactactcggctcaagcaatccacccaccttaacctcccaaagtgctgagattacaggtgtcagcctgtaatctcatcacttttaaaacaaatattttcacccctccacttttaccatgatatacttcgacatttatctgaatatcccccaaataattgatagcataattatttaagattccatcagggatgatcccgcaacaacattcaagtgcttgccgaattatgtcttgcacattgcatttctccatttcctttttctcagtgaaggtactgcctttgcttgagtttttgtttgtttgtttgttgtttttttttttgagacagagtctcactgtcgcccaggctggagtgcaatggcgcgacttagctcactgcaacctccaccttccgggttcaagcgattcttctgcctcggcctcagcgtcccaagtagctgggattacaggcatgcgccaccacgcccaggtaatttctgtatttttagtagagacggggattcaccatgttggtcaggctggtcttgaactccggacctcagatgatccacccgcctcgccctcccaaagtgctgggattatgggcgtgagtcactgctcccagcttcatctttgcttctttacattgagaagatatattccaactcttaactctgtctttccatcccatttcacatcatttctgaacgctcatgacattttacccacagctttcatggcacctagaactttttaactgtctgtctgatctatttatattaagaaggtaagatgtaagccccttggagatagtgactatgtttattcaaatgtatatcctcactgggcacggtggctcccgcctataatcccagcactttgggaggccaaggcaggcagatcacgaggtcaggagtttgagaccagcctgaccaacatagtgaaaccccgtctctactaaaaatataaaaactagctgggcatggtggtgcgtgcctgtagtctcagctactcgggaggctcaggcaggagaatcgcttgaacccaggaggcagaggttgtggtgagccaagaccgtgccactgcactctagcctgggcaacagagcgagactctgtctcagaaaaaaaaaaaaagtatatcctcagagtgtctttcaatagtagtcagtaaacatttaacaattaggcaacaaggtgacagtccaatctgcctattgagaattaatgacaaaaacagagctttttcacaagatggcgccgaaagcgaagaaggaagctcctgcccctcctaaagccgaagccaaagagaatgctttaaaggccaagaaggcagtgttgaaaggtgtccacagccacaaaaaaaaagaagatccgcacatcacccaccttccggcggtccaagaccctgcgactccagagacagcccaaatatcctcggaagagcgcccccaggagaaacaagcttgaccactatgctatcatcaagtttacgctgaccactgagtcgccatgaagaagatggaagacaacaacacacttgtgttcattgtggatgttaaagtcaacaagcaccagattaaacaggctgtgaagaagctctatgacaatgatgtggccaagggcaacaccctgattcggcctgatggagagaagaaggtatatgttcgactggctcctgattatgatgctttggatgttgccaacaaaattgggatcatctaaactgagtccagctgcctaattctaaatatatatatatcttttcaccataaaaaaaaagtatatatatatatatatatggacaaaacagattctgctgtgagggactacatatacaaatagacaattaccagaccatatttaaaaatagaactttcacccacacctgtccaggaaactaacccgcttacttagaataaacaatcaaggaagccagcctgctacaagttagacttacagagaaagccagattgctatctctagtgacaatccaggaaaccgaacaacaacttccctaacaattggccccaaatggccagaactcgattaataactgatagcttccctaatttttgtcccacttccaacataggaccaaccaggctaagccaaacatgtacccataaccaatcacatcagttgcccgacttctagtaaatcctcagacagcttcccttgtaaacaacctccaatcagaacacacctaaaggcttcccttttttccacaataaagctttcctctcctctgccaatatgcaagtctgactcccttgctacagcaagctcattacagcctttgtttctctcatttagctaatctttactgttacagtcatttaatggaaatttattggaatcatcctaaagaagaaataataattcctataagctgggaattgaatgagtcgggaatggccaaaggaaagccttgtcacagactgcggggcctacaggcaggacctggcaatgggcatcatctggctaaagacaagtcgtggcctcggcctggggaacagctgccacggcctagttgcccctggggtcagttcaggagagtgcgcaacccaactagggtgacaaagccaacacctgcagctgcattacacaatgctccctccctccgctcactgccctccattaaccatttagtagaaatcactctggaacattcagctggcacaagtccatcattctgacaactcatctcctcagttctagttgaataatgtgaacattggagggtttagtttctcctctctcttccacaagcaatgtgcaattttgtgtaaactttaatccctgcagtttatctatgattagttcagtctagttcagtctagttgccttgagatgaattcactgaaaagactacacagcgaggcataccatagctaaaagtaactggctttggtcataaagtaatttttaactttgaattaattataaaatgaatacctacactgcagaaaattccaaaactgcaaagtaattaaaggaaagctaaaaccactaataagggcaccattcagagaaatcagtgttgccagtgacacatatccttctagtccttttgttgttgttgagtgcgtgtggatggggaatgcaggattcacttgagcaggacaggattttgaactgaatagctttgcttgtttctctgaataatgacttacttagcagccagttcatgatcaaagtattttgtcaaggcactttctgaattgtccaagaagagggggagcatccttagtgactgatgaaccacccgtcctcccctggttctgtccggccattctgtcctatacatgttaatcccactacctccagcagcctcccccagatttatctagcagagcatcactgctcattcttcagtattgcacttccgtgaccccttcccttgccctagcagcaggcttgagtgttcccacgtctgtgctgccaggaagctgctgcgtttccactggggcagttggcatatggcagggtgattctagtgcaactgggtttgtgcacatctgtaaactggatattccaggtgagtcaggacagaagttttccactttgtacacccacgaccttgcaaaggacaaaatgaagagagagcaaagtagtggatggagtgtggacagtggagctgggctgcctgggtttgaattctgcctccatcacttaccagctatgaccttgggcaagtcatgcatcatctgaatatcacggtttcttcatttttaaaacagaagtattaatggtattttcctcatagggttgtaatatacattaatacatgaaagcacgttaaagagtgtccagtacatggtaagcactacataaatgtctgagattactgagttatgtgtaataagtaacccaagtatttccaaactgatcacaatctttactctgcaatgaagacatttaacactcctataactagctctcactacagttttctctgtacatggcaaataaatatttaatccagaattcctttctgactacactagaacacaggcattcacatgaagccaagtttgagtaatggtgctccactattaaatggaaatgctactaccagagcttacatgcaccaatttgctctccccacctggagaatattcattcaccatgacacgtgcacacctcagagtcaaaattcatcctttgcagatgcatcctcctccactctcccaacacccccagctcactattccaagaaacaagctttgttggagaactggtccatttcagggaatggggggacttctgattgtgcaatattttctgcgtgaatcatcccaaactagatggaacaagctcaaaatgtcacagaagctgctaggtttaaaatttatatggcatgggcatggtggctcatgcctgtaatcccagcattttgggaggccaaggtgggtggatcacctgaggtcaggagttcaagaccagcctggccaacatggagaaaccccatctctactaaaaatacaaaaaattagccgggcatggtggtgcacgtctgtaatcccagctactcaggaggctgaggcaggagaatggcttgaaccggggaggcagaggttgtagtgagtagagatcatgccactgcactccagcctgggcaacagaacaagaatccatttcaaaaataaaaataaaaaataaaaaaattaagtttatattcaagttgcaaattacttttcaggagcccacttccacagtgaagaatcagaatcccttaatgttcaaattattcagctggaaccaagaactaaactaaaaaaggatacacaactttgccatgtttcccaggctctaatgctctgaaaagaacactttattttagagtatatatattataaaaatagctaacctaaacattccctgactttgaaagtctcaggaagggattcacttgttcaaatattcacctaaaataccctgctttaaagatacacaactcttcactcttcacacatcaaatgaattaggattctgattttttcttttcttcctttctcttttttttttagacagggtctcactctgttactcaggtggaagtgcagtggagccatcttggctcgctgcaacctccactgcccagctcaagtgtttctgccacattagcctccggagtagctgggattacaggcgcacaccaccacacccggctaatttttgtattttttgtagagatggggtctcgcaatattgcccaaactggtctcaaactgctggcctcaagcgatccacctgcctagacctcccaaaatgctgagattataggcatttgccaccgtgcccagccaggattctgattttctaaaatggaaatagataaggcttccctccgaccatccctaaatctcaattagttcaattcagcaaaacatgcaggttttcaacgaccatcagatttgaaaccaacaaaggcagcagccctcagcatagcctgagcagccaacctgaagcagataggctccatacctcaaatgtccaccttcaaacaaaataaagcttgccatctgcacactagatcctttctatcatagcaacaaaataaaacagctgctctctcttcatttgactctagaagaaaaagagataagtatctccatgattgaaagtgagataaccagatgagattttttttaagagctcagcctgtgcccttgacttatggattgtccccccaccccatggaagtcaaatacccacataaaaatacccctgaaaagcaatcttggaccattaaaaatattttaaacctaaaataaaattctaagaaagtctatgactaaactgacctttcttaaacaaatgtaaatcttatttgtgtgtttttctagaaaaaccattcggggtagggcacagtgactcgtgcctgtaatcccagcattttgggaggccgaggcagacggattgcctgaggtcaggagttcgacaccagcctggccaacatgaagaaaccctgtctctaataaaaatataaaaatgagcctggtgtggtggtgcgcccctgtaatcccagctagtcaagaggctgaggcaggagaattgcttgaaccagggaggcggaggttgcagtgagccgagatcaagccacagcactccagcctgggcgacagagattctgtctcaaaaaaaaaaaaaaaaaaaaacgaaaaaaaaaagaaaagaaaagaaaaaccattcggactcgaaaagtactgctgtctttcagttggtaaataataaaatttggacgtgaggtaagaaaacaattggaagatactgcgatctaaagaagcctgggggagggaggcgagatgtctggtcacttccccagttgcacgaccttaggcaattcctagatcctttgagtctatccgggtctgcgcaggtaatgacacctctcaacccaaagtatgagagcaccctggccggtgagagggtgcctgggaagtggggaatctgctacaaaacgcaggggaagctcgcgggggccctaggataaagaccaagaaccgcacaacaccgactctctcctaacacaaaactgtctgctccgagaaccaaatatcccaccttcccgcggctccggaggtacccgccactgttttattttaatccacacattcccagtcctgagcaatccttaccccagagctcgattttcagggaaccacaaaagacaaataggccagaataatctaagtccaagggagccctcccggccacttacaaacagggtcttccattttcaagggtcttttcaaacggatgttggcagggaccgtcttctcgatcaattcatcaatgctctaaaattaaaacgcaaggcagaggaaagtgcctctgagttaaaagagtcacctctgtgttttgcgactacaaagccttgtgggaacctcattgaaatcgcctaattagggttctttttaaaagaaaaggaaaactctgagcaagccagaatgatttggaggaaagaaaatcgtgaagtggggtggagattccgccactcggggttggatttcagttgcaaccggagctaaccggtaagcccactcttaatcagggggtcttcctcctcttgcaaagtttaggtccatccacagggccacttgggctgggggtggtttaaaaatgtacacttttgaggcacgaagactgggtgcaggagaaagtaagctgttaagaagtaagaaggcacgaggaccaaaggcacgaatttgcttccacgccacggcccgggacccagggtgcggggaccacgcggagcgcagcagagctcagggtaggagccgggaggccgcgcaggcagagcccgggcagggcggaggggaggccgcggagggccgggtggaggtccttaccgccagccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggccgcggccaccgtcccctgccccggcccgcaagggtcagccgcgctcttggcccctctcctggcctcggtcccccgggtggcggctgcgcccggcctggagcccctttcgctggacagtcggccggacagatggatggacgctcgcgggcaatgaatgggcgctgcgctcaaccaagacactcgcgcaaag

SEQ ID NO: 1665 - DNA, 24062 bp, Homo sapiens
tcttaacagtttgttttttttaatgagacataattcacataccataaaattcatccctttaaagtatacaatttcagccgggtgcagtggctcacgcctgtaatcccagcactttgggaggccaaggcgggtggatcacgacttcaggagattgagaccatcctggctaacacggtgaaaccccgtctctactaaaaatacaaaaacaaaattagccaggtgtggtggtgggcgcctttagtcccagctacctgggaagctgaggcaggagaatggcgtgaacccaggaggcagagcttgcagtgagccgagatcgcgccactgcactccagcctgggcgagagagtgagacttcatctcaaaataaaataaaataaaataaaactaaatatacaatgtcatgatttttttttttcctgagacagagtttcgctcttgttgcctaggctggagtgcaagggtgcgttctcagcttactgcaacatctgcctcctcagttcaagtgattctcctgcctcagcctcccgagtagctaagattacaggtgcccaccaccacgcctggctaattttttgttttttcttttgtatttttagtagagatggggtttcaccatgttggccaggctggtctcaatctcctgacctcaggtgatccacctgactcggcctcccaaagtgctgggattacaggcatgagccactgtgcctggcccaatttcatgttttttagtatacccacaaagttttgcaaccattgccactaattccagaacattttttatcaccccagaaggaaaccctgtatgtgttagcagtcactttctatttccccccaatccctctccatttctagataaccacttccctactttctgtcccactgggcttgcctgtattctggcatgaaaagattcaaacaatacgttgtcttctgtgattggcttctttcacttagcgtaatgtttgtgagatacatccatgttgtagtgtatgtcagtgcctcacttcttcatggttaaatgatatctcattgtatcaatatatctcattgtgattatccattcatccgttggtgggtatttgagttgtttccacttttttggtcattatagataatgctgttataaacattcatgcacaagttttcttgtggatatgtgttttcacttctcttgggtatatgcctaggagtagaatttctgggttatgcggtaattctatgtttagccttttgggaaactgccagattgttttccaaagtgactatacttttttccttcttttaaaattgtataaaatatatgtaacataaaatttgccaccttggcccaggcgagtggcccacacctgtaatcccagcactttgggaggctgaggcaggcggatcaactgaggttgggagatcgagaccagcctggccaatgtggtgaaaccccatctctactaaaaatacaaaattagctgggtacggtggcatgcgcctgtaatcccagctacttgggaggctaaggcaggagaatcacttgaacccgagaggcagaggttgcagtgagcccagattgcaccattgcactccagcctgggcaaaaatagcaaaacccagtctcaaaaaaaaaaaaaaaaaattggccactttaaccatttttaagtgagagtttagtggcattcagtaaatttggaagctcttttgggccaccttagctctcctctgtcctgttttgtttgtttgtttgttttttgttttttaagatagattctcactcttgttgctcaggctggagtgcagtggcatgatctcggctcactgcaatctctgccactcaggttcaggcgattctcctgcctcagcctcccaggtagctgggattacaggtgcccgccaccacgcctggctaatttttgtatttttaggggagacagagtttcatcatgttggccaggctggtctcgaactcctgacctcaagtgatccacctgtcttggcttcccaaagtgctgggattacaggcgtgagccaccatgcctggactgccctgggtcttaaaggtgaatagggagcctctagagaccagactgttctcccaaagccccagagcaggttccccagtagatgtgcatctcagttttgggccttgaatagcaggtccttctctctgtctgttccctctcatgctgacaaagtcctcctcctctcggttttcctgctacttcagcttctattccctgctggtttttgttttttggtttttgtttgagatggagtctctctctgtcacccaggctgaagtgcagtggtgtgatcccggctcactgcaacttccacctcccaggttcaagtgattctccagcctcagcctcccaagtagctgggactacaggcgtgcgccaccacgtcaggctaatttttgtattttttggtacagacagggtttcgccatttggccaggctggtctcaaactcctgacctcaagtgatcctccggcctcggcctctcaacgtgctgggattacaggtgtgagcccctgcgcctggcctgttccctgctgtttgtagcggaggtcctgtgggagcgtccctgctgcctcaggtcttgtagttccttcctgcattccttacttctggtgtcctcctctgcccctgggctgggttagccttggatctgcaggtactgtcttgtttgaagaaggacaatgcttggttatctccttctgggggacctatgtctctgaacagctttcttcatcttgcctctctgcatttcattgtcataaaaaaatgtttctcctgtcatcttgtcatctgcctatactaataatcctcttacaagttcctgccatttacacaggccatgcggaatatgcatttgtgagggggaaggatggtcaagtgtcagcagcagcccaggggttttgtgggtggaaggatgaaaaagatgaagggtcatctggtcccagggccctggtgacagtagcctctgttactctgcagcagtcagcataggtgaccagaaagtcactgagggtaggcactaaaaagcctcaggagtggccaggtgcagtggctcacacctgtattcccagcactttgggaggctgaggtgggcagatcacgaggtcgggagttcaagaccagccggaccagggctgcccctcatgggctgtggactttggactttggattggcataaataagaaccgggacaattcccaggaagggatttgggggtgggagtaaggtggggaggaggtagggctcaaacaccaagctttctcaggtgtgtcaaggcaagagaaacttacgcagtatgaggcgtccacacctctgctccttcagtgtcttttctgggagtgagatcaagaagagagggtgtcccgtcccagcagatggtgaaaccccgtctgtagcaaaaatacaaaaattagccgggcgtggtggtgcgtgcctgcaatcccagctactcaggaggctgaggcaggagaatttcttgagcctgggaggcggaggttgcagtcagccgagatcgcaccactgcactccagcctgggcaacagagtgaggctccgtctcaaaaaaaaaaaaaaaaaagtctcaggagctcgggcagccaggtggggagctggcccatcaggagttggcatgcaaatgagccacgtgcctcccagcgggggaccagaggccaggtcagggcaacagcctccagggctgcccgtcatgggctgtggactttgtataggcataaataagaaccgggacaatttccaggaggggatttgggagtgggagtaaggtaagggggaggtagggctcaaacaccaagctttctcaggtgtgtcaaggcaagagaaacttacccagtatgtggcgtccacacctctgctccttcagtgtctttcctgggagtgagatcaagaagagaggggggggtcccgtctcagcaggaagcccaggctgcccacccagtctgaggggacggcactgactgggcaggatctggcaagaggggagtttagggtgcagatttgggtccaattcagcttgtgaccagaagagggatcatcaactgggatcccagatcacatggaatcctgtggttcccttgagaactgcctggacccccaggtcaaccatatgggctggaaaggaagtaagttctagcaaaaggaccttcatacaaggactaaagccgtgggaaccacacttcaattcatgactttcagcatatcttgaaagcacttagatagggaaggtttggaaaggcagaactgctactgccgctgctgctgcctcttctttccattttgtgtctcagctcaaagatagagcttctctttaccctctcagcccagataaatatcttgttttgcctttcttgcatttttttttgtttaaagaaatttggaggctgaattgggaggatcacttgaccccagaaggtcgaggctgcagtgagccatgattgcgccaccgcactccagcctgggcaacagagtgagaccctgtctcaaaaaaaaaaaaaaaaggccgggggggggagcataatagtggaaatgctctgtcttgccctgaaaatgaatgctgtagagagccagggctgccactcttggctgctccacaggttgcttctccagatgcggagatggggagaagggacctgtggccccaggctgaggtctgtgaggggcctgctgctgtggctcacttgctgaccaaggaggatgccatacggccccccactggggtctgagggcgcaacccaagccaccctgaaggggtgtgtgcacaaggagctctcaggagaagcccccaaggtggcctgttggaaggctctgatgggaacatttccttccaccttcaagaaagaagcaatgggaccctgaagaatgcagcccagagagatccaaagggtcagaagctctggggcaaatctggtaaacttcctgggggtgccacagactcatctccaccttgccctgtggtctggccccgccttctggtggagcctgcccccgccttctggtggagcctgccccgtccccaccctgacacttgacctgtggctgacagtgggccacctctgctccactcaggctccgtggccggagagtctgcagcttctctggcattcctcctccccgtctgggtcctgtgatggaaacagtctcattcagctgccccagagactcacaagtcctttactcattcagcaagtattttccagtccctgccatgtgttgggcccctgttaattctatagtaatatttgttgtggtaaataaaattgccttcatagtgatgtcatggtggagggaggaacactcaggagaagagggtgtctctgagcccacagagctcccactgctatttctaagaggccagcaatacatctttgcatttcagaaaactgggtctattcaagaaataaagatggatggaggtcaaaatgggaatggatttggagaacagagtgggggtggggatggagcaggatggaaatgagagggggtggagagggaataggggggaggttggtgatggggaggggacaggataaggaacaagatgaggaagggggaaggtggagttggagtggagatgaggatcaaagtgaggagggctgggtcatcctctggcctctcctaccatgccccatctacacggatgcaaagaaaacttcattcactcatcgaacgtttctgggactcttcctgaatgccagacttgcattggtacagaaaaatgactctcttcatacttgccttcaaagagctcagagtctgggctgcggagaggtctttttataaacaaaaacactggccgggcacagtggctcacacctataatttcagcactttgggaggccaaggcgggtggatcacatgaggtcaggagtttgagaccagcctggccaatatggagaaaccctgtctctactaaaaatacaaaattagccaggcgtggtggtgcatgcctgtaatcccagctacttgggaggctgaggcaggagaatcacttgaacccaggatgtggacgttgtgatgagccgagatcgtgccattgcactccagcctgggcaacaagagtgaaactctgtcaaaaaaaaaagagctatgacagacaagtggggcacagaatgaggagccatctatccctggtgggagtctgggaggacttcagagaggaagtgatggttatgtgtgtttaattggattcatttatttaattcaattagtaatacattcacatgttcgaaatcctaaaggcacaaaagaacttgtgtctggtcatggttgcataattctgtgaatgtaccaaacaccatggaaaccattgaattatgtactttaaatgggcgaatgatacagtatgtgacttatagctcaataaaattgtatttcagaaaagggtttatgtctccatcccacatctgataatagttcctccctgaagtcaaataatatggtgagtttcttctgtatcttttttgttgggagttggggagtgacatttgaagtggtgaatgagctgaatttagtcaagtagtggactgcggaatacagtgttctggcagtgacagaggcacgaaggctcgtggttctgtgaatgccccaatggttggagcatggggtgagggtggcagaatggcaaaggctgattgggggtggggtgagcagagccttggaggccatgcgaggcagtgtgtacttcatctgtaagcagtgatgatccagacctttaagctgcatgaaaaacaatgtgacaataatttaaagacacccaaatctccttccaacatcccgttgtcattcacctaagtgaaactgcagttcttgtctctatgcactcatgcgtttacctagttaggtaagcacagtctaaatacacttttgtattctactttttccatttaatattaatcataagcatctttacaggttgtcatgtaatactcaaatggatttttttttttgagatgaagtctcgctctgttgcccaggctggagtgcagtggcacgatctccgctcactgcaaactcagcctcctgggttcaagcgattctcctgcctcagcctcctgagtagctgggattacaggcacccgccatcgcgcctggctaatttctgtatttttagtagagacagggttttgtcatgttggccaggttgtctcaaactcctgacctcaggtaatccactcgcctaggcctctcaaagtgctaggattacaggcatgagccactgcacccagccaaatggatggtttttaaaggataagaggtactctatcaagtcgatagtaaacaaatcattccccattgggcaattgggttggttccaatttgctatcaagtggaagaatgacccagttggatcttggctttggacaatggcttttacatggccaactcacaggctcagagctaaaagggattcagggagtcagctgggctcatccttagggtttctgtggccgtgagtaagcaccccatctgaacccatttcttcatctggaaagtgataatgtatttaaatcactcaaaagctttttaggccttggtagatttctctgacactggaaggtccaaccacagcctacctgttacgcatcaaaggaactatctgaagacactggaatcctagccaggcagggtgactcgtgcctgtaatcccagcgctttgggaggctggggcaggaggatcgcttgaggccaggagttcaaggtcagcctgagcaacagagtgagattctgtctctacaaaaaattattaaaattagccgaccgtggtggcacatgcttatagttctagctacttgggaagcttgagataggaggatcaagtgacaagcccaggagtccgaggctgcagtgagctattattataccaccgtaccccagcctgaaggacagagtaccccagccttgtctaaaaaaaaaaagacataagactttgacgtccagatgctctctccatattctggcctagaaaagtgtccccatcaccctcttgccttccttggtcagatggcaaatgagtgtctggggcagatgcactctggaggctcaagaggaaacattcggggctgcctgcagcagtgctgaggctgcagtttaattttctttgacatcagtggtagaatttgtccactaggggccgggcgcagtggctcacaactgtaatcccagcactttgggaggccgacgtgggtggatcacctgaggtcagcagttcgagacctgcctggccaacatgatgaaaccctgtctctattaaaaatacaaaaaattagctgaccgtggtagcaggtgcctgtaatcccagctactcgggaggctgaggcaggagaatcgcttgaacccaggaggcagaggttgcagtgagctgagattgcaccattgtactccagcctgggcaacaagagcaaaattccgtctcaaaaaaaaataaaaatagaatttgtccactaggtactgtgctaggtgctggcgggggagacagtgggtcccagacagacagacatggccccccgactggcttggcccaggggagatgctgctggaacaagaaaacctctctgatggttcttggaagtgggagctggcccgaggccctccatctgcccctcatctccctctcagaggctgttgcttcttctctcagaccctctggccccagcttccctgtagctgccacagaaacctcatcatatgaagggaaagaggctgtagcattctcagtagggcccgggtctcaaacacctccatgctgcatgtctcttataccactttttttttttttgagacggagttttgctctgttgcccaggttggagtgcaagtgccatgatctcggctcattgcaacctctgcttcccgggcttaagcgattcttgagcctcagcctcccaaatggctgggactacaggcacgcaccaccatccccagcaaatttttgtatttttagtagaaatggggtttcgccatgttgcccaggctggtctcaaactcctgagctcaggcattccatctgccttggcctcccaaagtgctaggattacaagcatgagccacagtacccagccccttatgcctcttaactttacatctccgggtcagaatatgatggggaattctccctttctcgaggacctccaaggaatgtgatgtctgtcactcccaattctcctattgagaaggaaaagccagtacaggacagaatactctgggccagataatttccatctttgtttcacttaatccgcataacaaccttgaaaggcagatgttaattacacccatttcacagatgcagaaactacaattcagagagattaggaaacatgcccacagtcatctggctggtaaaaggtggggctgggagtgaacccagatctttgcagaattacacctcacggccttccctgggccgtggctctttttccactgcctggtaggcctgtttgaagaattaaacaaggtatcagactcatctgaatattgtaagaaaaaaaaaaagaatgaaacaaggtaatgcttgagaaacccttggcacctgatccatattaagtgaccctctcagagcaaagtcatcactcaaatgacaagggcagaaatatgcagagctgcttttcacaaaggtgctcaaccttgactgcacattgaaatcacctgggaagcttgtaaaactccacatactcggactgcgcctcagcctgatatgatcagagcctctgggggcaaaccacagacatgactggcttttaaatttccccgggtgattctactgtgtagccaaggttgggagaactctggagatggtagttcagttccaagcctcccaagaggaagctgactagagagtctaagacataaagaatgtgtccatcagaaggtgcagaaaggggccaggcacagtgtctcacctataattccagcactttgggaggctgaggcaggcagatcacttgagtccaggagttcgagaccagcctggcaacatggcaaaaccctctctctacaaaaataccaaaaaaaaaaaaaaaaattagccaggatggtgacatgcacctgtggtcccagctactagggaggctgaggtgggaggatcatttgagcctgggaggcagaggctgcagttagccaagatcatgccactgcactacagcctgggcgacagagtgagaagaccccgtctccctcagaaagagagcatcacagagcctgccctgacagtgacaatcagccacatttggagcagaggacctggccagggccaggacacgtcctgtcctagaggcactttagccatgcacatggagtcatcgggccttattgaagctatattgtgaccaactgctggttctgattcccagctcgacaggccagcttcccaccacatcatggtgatgggaagaaaatggacacatcacttacatctctttttgtaaatgaactaattgacattctaataagaattacttttgctttgacagttacagtaaatcaacagattgaccttcaggtgtaattttggtatatatagaccttccctgaaagacaattcccattggtgagctgaggaatctggtttctgattcaggcttctcccttggagtggggtgaattcaccaataaaccatcttgagatatcttgggagatgtcagccagcctcatctgatgcaaccagcctagccacggacttcacgtctaactttcagagcagagactccatgtcagcaaattcctcgcctccttccctcctctcctatagttttggctttttgtattgttttgtttttgttgttgttttgttttgtttttgtttttgtttttgagacagagtctcactctgtcacccaggctggaatgcagtggcgcgatcttggttcactgcaacctccgcctccaggttgaagtgattctcctgcctcagcttattgagtagctgggattacaggcgcccgccaccacgctcagctaatttttgtatttttaatggagatggggtttcaccatgttgttcaggctggtctcgaactcctgaccccaggtgatctacccaccttagcctcccaaagtgctgggattacaggcttgagccactgtgcccagcctgtttgttttctgagacaaggtgtttctgtgtcacccagactggagtgcagtggttcaatcttggctcactgcagcctaaacctcctgggctcaagtgatcctcccaactcagcctcctgagtagctgggactataaacgcatgccaccaccactggctttttttttttttttcaacagggtctcgctccatcactcaggctggagtgcagtggtgcgatcacagctcactgcagcctcagcctcccaggcccaagcaatcctcctgcctcagcctcctgagtcactgggattacaagtgtgcaccaccatacccagataatttttaaatattttgtagagacagagtctccttatgttgcccaggctggtcttgaaccttgagctcaatggatcttcctgccttggcctctgaaagcactgggtttataggtgtgagcaactatgcctggccccctcctatagtttttccctggccaatatccctcttataaatccacagagcttctcactctctgcagggaatattaggtcattcacatacctgggttcagtccctacaccgcagtcatcgtgatgcttacaccccagacaccccagacgtgtgtcctccttcaaacagcctattcccacccactaagcctctgcccatgtgttccgactcctccctcccttccttcctctgcttccttcctctttcctcttccttctccatctagtgacagcttattcactgtctaaaacccaactcgaatcccactctctcgacctttccctgaacaacattatttactttgttgtctctgctcccatagtactttggacagaactctgccatggaggttcacaaactgaactctagttccttgaccacgtgtgtcctcccctcactccccacactgaacctggctttggtggcctggtgcccagcatggtgttgtgcccgtgtgtggatgcttaaatacatctttgaaatttgaataaatagtaaacattgttatacatgagtcatgtttttctctttaaaagccacatcatatccatttgctcattggactacttcaaaagagaagctctaaggacatccaaagatcctaagtgaaaaatcaccctggctgcacgggtcaagccaggacacagggccaaaggtcggtcagcactgacacgctgagcccaggcgtttgctttccagatgagacctgcaccgctggaccagcaatgcagcagaggcagcaggaagagggagatggagccaaagggtttctggacaggcggttgctggcagatctataaatcgatgccccacaatgggctgtcactgaaacaggccaggagtagcccagagcctggaggtagacctgagagggcagggtgtgggaagattagaagcataggctaggccaggcacagcggatcgtgcctgtaatcccagcactttgggaggccgaggcaggtggatcacctgaggtcaggaggtcaagaccagcctggacaacatggtgaaacccatctctactaaaaatataaaaaaaaattagctgggcatggtggcacatgcctgtaatcccagctactcgggaggctgagccaggagaatcacttgaacctgagaggcggagtctgcagtgagccaagatcgcgccattgcactccagcctgggcaacaagaggaaaacgctgtctcaaaaaaaaaaaaaaaaaaagcataggctagaaattggaccacaaaataatatagaatttgacatgtgggtgaagatgggtgttttgggggctgcaaatcagtcatgttctcctcaatctgcgtaagcagaggcaatgcggtatagtggtttacagtgtggcttctggaactaggttcctggggtttggatccagcacatgtgacacatgtgaccttgaacaagttatttaacttctctggacttcactttcctcacttgtaaaaggggaacagtaataaaatctacctcaggatttttatgaaaattaaattagtaaatccatgtaatttttctttttttttttttttgaaatggagtctcgttctgtcacccaggcttgagtgcagtggcatgatctcggctcactgcaagctctgcttcccaggttcatgccattcttctgcctcagcctccggagtagctgggactacaggcgcccaccaccacacctggctaattttttgtatttttagtagagacggggtttcaccatgttagccaggatggtctcaatctcctgacctcatgatccgcccgccttggcctcccaaagtgctgggattacaggcgtgagccaccgtgtctggcccatgtaatttttcagaacaagtccctagcttatagtaaatgctcaatgaatgtgagctattatttaatattttattaagtagcatctatgaggtattgaagtgactgtgtaaggaaaccacggtagctcacatctataatccccatactttgggaggccgatgcaggaggattccttgagcccaggagttcaagaccagcatggacactccagtaagaccctgtttctaccaaagaaattttgttaagttagccgggtgtggtagcaagcacttgtagtcctggctacttgggaggctgaggcaggatgatctcttgagctcaggaattcagggctgcagtgagctatgatggattgcaccattgcactctggcctaggcagcagagcaaaacactgtctctaaaaaaaaaaaatagaaggaaagaaaaaggaaaccacccgaaaacatagtggcttaaaacaacaaaccaataccttgctcacagttctgtaggtcagcaacctggctcaggctctgttgggcagttctgccagattctcctgggattgctccatggatcactcacatggactggggctgggtggtctaaggcggcctcactctcagcgctggtgactgggggtggctgtcagacaggccccatgttgtagtaacctgtctccaggaggctgcccggacttctcccccttgtgagctggggttccaattgtagcccaaagagggtaagccctggcttttcaagcttttgcttagatcacatttgttttttgttgtttgtttgtttttctgagacagtctcactctgtcacccaggctggagtgcagtggcgcgatctcagcccacggcaatctccgcctcccaggttcaagcaattctcctccctcagcctcttgagtagctgggactgcaggtccccgccaccagagccggctaattttcgtatttttagtagagacagggtttcaccatgttggccaggctggtcttgaactcctgacctcaagtgatctgcccgcctcggcctccccaaagtgctgggattatgggtgtgggccaccacacctggcctacttatatcacatttgttaatgtcccattagccaaggcaagtcacaagatcaagcccagattcaaaggatgaagacatttacatcttgatgggaagagaggcaaagtcacaatgcaaaagagcacacgtcagggatgggagcattttcacagccgtgcgaacagtgtactatactgggcaccagacatgtaagcagagctcagttctggaggctggaaggaatgctttcttggccctcggggctcaggatagcaggttaagatgcaagcaaaaccattatgatgcaaggtctgaatgcgataagtgccccaacgtaggagttcaaaccagacagatcttttgcagctaatgaggggtggaggtcaatgggttgagaaggctttattttcttgaccttgaagtgtggttagaatctggtcatacagacatggggaaaatgatattccaggtggaggaaaaagcaaagttggaaaaaccaaggcatgtttgggaaatccaaacttatctaatatatctggtgtgtggccatcaaggggaactgcacagcataaaactagaaagataagctggggtccaatgcaggtgagcttgtgtttgaacttcagtttgaacttcattctgtaggcaatggggagccactgaatatttttcaggtgacaagtgaaaagaactgtattgtaagaagactccttggcctgtattctataggatggcttggggtggggagcaagaagaggagaggtgatcacaggtaatgaagggactgtgggcgggcggcggggagggggcgggcctaggcaatggggttggcccggggcagcacgagtagaaagtatctggacagatcctgatgagtgactgcaaatgtgacatgaagaggtgtcaaggttggctccgaagttgccaggctcactgcccagaggatggcagagagcaggagattcatttacaaagcaggggagtctgagcaacaacaggtgtgaagggaccctatggatgtggggactgtatgggacatccaggtggtgtccaaccaaggtctaacgtcatgctaaggaaggaggaggaagagaaaggagaggagactttgtcaaagcaacactgaacacagtgtttcaaggtgcttaacagtcaagtattagatgtggccaaatgattaaggaagaagaaagatgagtagaggccaaccagctgatttgacaatgaggaggtcacaggtgacttcctaggagagcagaggaggctgaagtccccaggctttcttttctttttttctttttttttttttgagacggagtctcgctctgtcgcccaggctggagtgcagtggtgcgattttggctcactgcaagctctgcctcctgggttcacgccaatctcctgcctcagcctccctagtagctgggactacaggcgcccgccaccatgcccagctaattttttgtgtttttagtagagacggggtttcaccgtgttagccaggatggtcttgatctcctgacctcatgatccacccgcctcggcctcccaaagtgcccagggtttctttttttattttattttattttatttttttgagacagagtctcactctgtccccaggctggagtgcagtggtgtgatctcggcttactgcaacctccgctttctgggttcaaggtattctcttgcctcagcctcttgagtagctgggactacagggcatgccaccatacccagctaatttttgcatttttagtagagacggggtttcaccatgttggccaggatggcctccgtctcctgacctcgtgatccgcccacctcggcctcccaaactgctaggattagaggcgcgagccactgcacctggcccccaggctttatttttatttgttagtttgtctcactctgtcacccaggctagagtgcagtggtgggatctcagctcattgcaacctctgcctcctggctcaagtggttctcccacctcagcctctcaagtagctgggactacaggcacatacaaccacacccagctaattttttttagggggttttttgtgggtttaatttttgtgggtttcttttttcttttttttttttctttttgtagaggtggggttttgccatgtaactgaggctggtccaagctttattttttatattttatttattttaatttaaattttgtatggaatgcttcacgaatttcacgacttgtgcagggcccacactaatcttccctgtaccactgcaattttagtatatgtgctgccaaagcgatgactgaagtccccaggctttgaggagggagcaacaggcatcctgctttctgggattcgaagttggagagaacccctagacttacatgaccctctctttccacttcacacccactagagtgaatgaaatgttaaaaataaacactgctgttcccttccaccctaaagaagagaggcacgctagactctccctgctcctctccctgtctctctggcctgctggctggagatcaggcaccaccaggcagacaggcgctggcgggacaggcggctgtttactgctagtagagtactgctgtgttttcacagctcagaatagctctatagccacccccaggcctggggacctaggagcctcactgtttattttcatgacaattctgggcctcacctcttcccttctctgagtcaaggtcctcatttgagaactctcagagggggtaaggtgtgggttaaagggtccaagactactaatttcctaattatctgtcccagctggctctggaagaggggaggacgaataactgactgtacaacacgggcgttttggttgggatggaatttcccctgcttttaaagaaagagttgattaaaggactgcatggccagagccggtggggaggaaaacgtgggaatgaaagagggtagaagggatgaccccatctggattgcgacaggttctgtgtgaggagctttcactagagaattatgggggcttctctgactcatggtgcccctcaaatcaggctgggttctggctgccctggtgtttaaaaggtattcagaggtaggggaagactggcttcacagaatactcttttgaactctgaatttttttaataatgtgagtgtattacttttgaaaatattttaggctcactcctgtaatcccagaactttgggaggccgaggcgggtagatcgcctgagtttgggagttcgagactagcctggccaatgtggtgaaaccccatctctactgaaaaaaaaacaaaaattagtcaggccctggtggcctgtgcctgtagtcctggctactcaagtggctgaggcacaagaatcacttgaacccgggaggaggaggttccaatgagccaagattgtgcccctgtactccagcctgggtaacagagtgagaccctgtctcaaaaaaaaaaaaaaaaaaaaaggccaagcatagtgactcacacctgtaatcccagcactttgggaggccgagatggatggatcatctgagctcaggagttcaaaaacaacctgggcaacatggtgaaaccccatctctactaaaaatgcaaaaagttagccgggcgtggtggcgcgtgcctgtaatcctaactactcgggaggctgaagcaggagagttgcttgaacccaggagccggaagttgcagtaagcagagatcgcaccactgcactcaagcctgggcgacagagggagaccctgtctcaaaataataataataataataatttttaaaatatgaacacatttatctttttgttctggcaatcattaatcatttacttctgttagataattcaaagccaggcaccacttcattggaactacgttcaaaggactgccactactcagaatatcaaagctgaaaagagggtgagggtccctgggtctcattttacagttgacaaaagcaaaccccagagactccagtgatttggccaaggttgcacagttgttaaattttatttcttttttaaaatccggtgatgcccatggcgggggtacagtttcctgggctgcctgctggaggcttgagagtgtttctgagagtctgctaaggaaaaggaaggagcactttctgccccctgcccacctcctacccaccagcccccacctctctcccgtccacaaccaggctgagcaacagctgggcaattgatgacttggtttctttccctccttctttagtcggtctcaattattccaaagaatccttgagttgaagcaaggagggacagcggtttgggcttagctcaagtcacacttcccttctctcctcaaatagcccttctttgcctctgggatacagaccaggaccaaggggaaagaaagccttttaaaaatagtcctggccacacttttgcaggtttccttcccttgcctctgcctctctagtgcaccatcagcaagtttaactcctggcaggaaggatgaaatttgacagcaagaatgtttcttaacttccttcccttgcctctgcctctgtagtgcgccatcaacaaagtttaactcctggcaggacggatgaaatttgacagcaaaaatgttttctaactgcaaaggtggtttggcactgcaaagggttgattaagaatgggagaagaggttgggcgcggtggctcaagcctgtaatcccagcactttgggaggctgaggcaggcagatcacttgaggtcaggagtttgagaccagcctggccagcatggtgaaaccccgtctctactaaaaatacaaaaaattagcagggcgtggtggcacgcgcctgtaatttcagttactcgggaggctgaggcaggagaatagcttgagcctgggaagcagaggttgcattgagctgagatcacgccaccgcactccagcctgggcaacagagcaagactctgtctcaaaaacaaaaacaaaaaacaaaaaacaaaacaaaaccagaaaagtctaccatctgtttgtgagggaactagttaaatgttcgtggaaacaggttacttcctggagggaacaacagcttcttttgggaagggggctaaggaagagcgaggtgaagaagaggaagggcagttcgtgcttcccataaaggttctggtgactcatttgattttggaagaaggcaggccctgggatggcaggaggaaggtatctagtggggagttctgagatgtttacaatgcggcaaatgacttcaggttttcttctgtgcacaaaatgtgcagcccatcctgagacacgctccacgcttcccctacctgctcagttcaaggtcctaaagctgaactttctcactgtgccagagagaagccagccctttgcactggcgaacaatgattaacccgcctctccctccacctgtttttctcaacatgtttttctaaaacataaactgggtcactcacttagaaggtgacagcagttgatctggccagtttcccatgtccaccatgaaacacttcctccattgatcacttggtagggaaaaaaaaaagcatacaaaagaaaagtaattaaaaacaaaaataaaactgtacattttgcactttgggctgtagccctgctgctcggacgaagctgtgaactggagctaggtttcgaatcccatctatagtatgtagaaaacacccattctaggtcaggcacagtggctcacacctataatcccaacactttgggaggctgacagaggaggacacttgagcccaggagttacagaccagcctgggcaacaaagtgagaccctgtttctacaaaaaatacaaaaaattcgccgggtgtggtagcaccggcctgtagtcccaggtactggagaggctgagctgggaggattgcttgggacccaggaggtcgaggctgcagtgagcattgatgggaacagtgcactccagcctgggcaacagagtgagacccatctcaaaaacaaaacaaaacaaaacaaaacaaaacaaacctattgtaggatgataactgagtaaaggaaaggtggctcctctctcaacagaatccagagcccccacccagaatagaagatacagcttcaggtaaaatcagactttctttttggtagtaaatgcaatttttggatgaggtgtgtggtaagttacagctccttttccctctttgctttctcgtctgcaaataaacttgttcgagtgaatgagtcaaccttgccctgggagaatgtgccagggccctgggcccagctgcacttactcatcagcagaccagactgtacttcctggcatctttccttcatgttcttctcaagatccaaagcctctggatttctagttgtggggaaaatgcctgaggagtggcttgcttgggtacctaccaaagaggagcccaaatgattttccatcctcattccttccccaactcagctggccatttccctagagggtgttaacgaatcttctctaccgaggacaaaataatagggaactcactgatatttctacaaaggaaatcaaaatatttcatcccaaactatggctcccaatataataagtactttttttgttcgtttgagacagggtctcgctctgttgcccagcaggagtgcagtggcacgatcacgactcactgtacctcccgggttcaagtgatcctcccacttcagcctcccgagtagctgcaattacaggtgccagccacctcactgggctatttttttttttttttttgaaatagggtctctttctgtcacccaggctggagtgtaatggtgtgatctcggctcgctgcaacttccacctcctgggttcgagggattctcttgcctcagcctcctgagtagctgggattacaggcgcccaccactacacctggctaatttttgtatttttagtagagatggggtttcaccatgttggtcaggctggtcttgaactcttgaccttgggtgatccacccacctcagcctcccaaaatgcttggattacaggcgtgagccactgcacctggccaatttttgtattttttgtagagatggggtttcaccatgttggctaggctggtctcaaactcctaagctcaagtgatccaccaacctcagcctctcaaagtgctgggtttacaggtgtgagccatcgcaccaggccgtgactattttaaataaaaaacccttgagaggttttttcacccttgggagcctggaagagattttttcccctatctttcacctataaagataggactggccgggcatggtggctcatgcttgtaatctcagcactttgggaggccgaggcgggtggatcacctgaggtcaggagttcgagaccagcctggcccaacatggcaaaaccccatctctactaaaaatacaaaaattaatcgggcctggtggcacatgcctgtaatcccagctacttggggggctgaggcacaggaatcggtggatctcaggaggcagaggttgcagtgagccaagatcatcgcattgcactccagcctgggcaacaagagtgatactccgtctcaaaaaaaaaaaaaaaaaaggactgacacaaaagaacaattgttcttctccttcctttatcccattatccatcacagaaaagaagaccaaaaatgtaaccataaaaaagtctcaacagaccctttttcaagacaatgactgtctctgaggaccatttaaaatccagggagaactatttacaagttaatttctgttcctcgatccaatcattctccctctgcccttcgacagaattcctcttctcctccttcccataacctgtttttaacaggatccaagccacccattctttctgcaacctcaagatggtggatgagcttccatacctcactgggaagttggatcttcattcttaagcctcccatgtatacatgttaaatacatttgtaatctttttctcatattaattaatctgccttatgtcagtgacttttcagcgaacttgtaggtagtcactcacataaggatcctccagtttacatagttttgtaaatgtcaggtcaccctgtcccactagaccaccaaggtcctggaggacacctgggatttaacttttttttttttttttttttttgagacagtctcgctctgtcactgaggctggagtgcagtgtcaggatctccactcactgcaacctccacctcccgggtttaagtgattctcctgcttcagcctcccgagtagctgagactacaggtgcccctcatcatacccggctaatttttatatttttagtagagatggggttttgctatattggccaggctggtcttaaactcctgacctcaggtgatccaccctcctcagcctcccaaagtgctgggattacaggcgtgagccaccatgcccagcctggcttttaacttttaattcctcagagagccaggcatggtgctttgctcaggaaatgttggttgaattaaaccggagcacttcttgaaaagggaaaataacaaagagttagaaggagatggcgggaacccctctctggagatagttctttaaattagtggattctgcagggcactgttgctcatacctgtaatcccagcattttgggaggccaaggcaggaggaccacctgatgccgggagtttgagaccagtctgggcaatgtagagagacccccatctccacaaaaaataaaaagttagctgggtttggtggtgtgcgcctgtaggcccagctacccagagactgatgcaaaacgatcccttaagcccaggagactgaggctgcagtgagctgtgatggtgccaccgcactccagcctgggtaacagagtgagaccccgtctcaaataaacagataaatgagtggattctcagcaaaacttctagccactcgcctcatatatccacaagacctttgagaatccacggtgtctcgatgcagtcagctttctaacaagctggggcctcacctgttttcccacggataaaaacgtgctggaggaagcagaaaggggctggcaggtggaaagatgaggaccagctcatcgtctcatgactatgaggttgctctgatccagagggtccccctgcctggtggcccaccgccaggaagactcccactgtccctggatgcccagagtgggatgtcaactccatcacttatcaactccttatccataggggtattcttcctgaggcgtctcagaaaacagggccctccccatatgctgaccacataatagaacccctcccaactcagagaccctggctgctagctgccctggcatgacccagacagtggcctttgtatatgtttttagactcaccttgactcacctctgaccatagaaactctcatcccagaggtcactgcaatagttactccacaacagaggcttatctgggtagagggaggctccctacctatggcccagcagccctgacagtgcagatcacatataccccacgccccagcactgcctgccacgcatgggcttactttacacccacccacagtcaccaacacattacctgctctccaaggttaggcgtggcaggagaagtttgcttggaccagcagaaaccatgcagtcaaggacaactggagtcagcatgggctgggtgcgagccctt

SEQ ID NO: 1666 - DNA, 85412 bp, Homo sapiens
gtatgattttaaataaaactcaaaaacaagcaaactgtattgtttaagtttacacacataggtggtaacactataaaaacaaagagacaattatcatacaaggtaggatagtggtaattaccaaagggtacgtggcagggagctggttgtgactgggaaggaactacatgtgtaatttctgaactgctgtcaatatattctactaagctgagtgctagttatatagttgctttaaaattattccttgaactgcatatttatattttatgtatttttgaatatatatgtgtttttgaaaaatatatatttctcaataaaaaaacaaagttatgacatagagcaaaatgaacacatattatcaatggatacttaactctgatcctcaagagctcaactctgattttttttttttcagagaaagcattcagattatatgtttttgaatctatgaaaagtaaaatcgctaaatccatacacagtgattatataaaattagatatttgcaatcacaatgaatattcattatagtggaaagatttaggtcacgagattttttttttccctaaaaatttcaaaagaacaattttctatcttcattttactaattataaaataaacatagttgcttttttaatgttccatgaatatcaccagagtgtgacatagtagattaaaaaataaagatatacatttatttccatgtcctacctttgggacaatttatgaggaacttatggacaagtaacagaactgctttgaactctaaaaagaaatggactttacaaatccctaaccagtagtatgggatttaccagatcctctaggttttacatggtcacgactatttctctccaactgttttaaaagaatttcctggagccatctgaggacatttgaggtaatgtccttccacacctaataactgctgtatctccatgattgcaaacttgaaaatcaggaaacaccaaagcaacattactcacaaaataaacagcaaaatcagaatctctggagtcaacttatgaaacatgatttacaaagatattcttacatttcttaatttatttttaataagtaaaaaatactcattgaaactgtacaaaaatcaaatcattaatttttgcacctggtatttcagtcatcaacagcaatctcatggtacagaaataaaataatgggaattatcattaacttcaccctggctttctagcttagtagaaccaaacagaagaaatcatggcaataaccattaactatagaaaaaaagtaatggaaaaatggttgcaggtttaatcacaaaatgaacttaatttttgttgattttgttttatctgctaaaacactaatatctataaatatgaactgacagcatcgttctaaatttacttctgaagagctgtcgagacttcaataaaatataagcaagttactggatcatatttatggactgctgaattaactacccgaaaagtatcagttactttcaaagaacacaaaacaaagtgaacgtggaaaaaagccttctttgcaaaagtccttttattagtcctatcctctaaaattccaagccacagagccttgatattcctggattctgttttaagtaaccttagttttaaatatgacacttgggatatgcacaatgggaaagggtaggatatgtgaacaaaatttaatttcttttttccaaaggtagtcattttctttaaattcatcctatccacttttgcccacttccccatgtacagattatcctttagtcatacaaattcactctccacttccacatacattttccccacttgatggtacttttacaagagggaaacaatacagctggttgataaagtaatttaaactatttgtaaatgaaataaaaagaaagtaggtataatacatagtgtaaaagataccaaattggagtaatattgatgttaatctagttttttatttaacaaagtacctactaatggtctgagcaggagagtagaaggaaaggagctagagggaaattacttcctatggttaaaaaaaagccaactgcttcagaatgcatgacagtcttagtaataaaagaatcatttactattttcactgagtttacagtgttgggtactactgtttacatcattttaatgaaagtatttataaaaacatctgcaatagttcatatcagaaaacaaagtttctctcaataaagaccttaaaaaataaatttttatcttcattaactccctttctgggaatgggaatgaaataacatgcttctgtttaaaaaaaaaaaacaaaaaaaacacaaaatttaataccctaattaggtttctggaaaaaaaaaagactaccctagcaataatttttaacattctacatttcatctatttctaaagacactccctttacaaaatcttttagttttatatattaggacaatcaggtttagagtctcacataaataaaatagccacattagaaggcatactgaagaatcaaatggttagccacatttgtctgttcacattcacggattctctaagagcgttgtgagagtccatataatactgttcacgtttagtctaagttaatatgtctcatctgacctattgctcctacaacactgatgctatcaacaaaaatcctgattttggggacacagtgatataacaaactggttaaacgagcagaggtaataggacagtaaactgtaactgcacaatttaaaatatccacccttcatccaccactaccatacttcttcccagtggtattaaattctcaaagccaaatcatatcagaggtgcaggatgccaaacactatttgcatagaaaatcagtcttcaagactaaacaaaaaagaaattcataaaattaaactttttgaatagttgcattcgttgctttcaatttcttcatccatatctgttctggtcatacatattttttccttctttttatccagagagattaatacacagattaatacacaaaacttttgtaaatagcattccagttcaaagttgcttgtgatcatagccacgtgtgaaccgttagacaagtgtatgctatgccccaaaatgttttataattcttcagtgcagtttcttactgatgtttcccttaaaattaaggcttaatgaaagagaaatccatagtattatgaactgattttctttagcttctgaattaagtgcactctttccaaaatcaagtggtcctggagtaacgttaagacaacttgtattaatcagtgtcatgactgaagtagtatcttactggaggtcccggcaaatcttcatctccatcaatgtctggagcaaatgacacagtaagatccacatatttcttttcagtagtaggttttacaagtttatgcattctaagaaaaataagcaagaatgaatactttggtaaattctataaaatgaaaaaatgatttgctgactaatgccatccagagaacctggacttgtatctagactttaacatctaataataatctgctttcacatattcatttttctttactaaaaggtctgaactcatttatactcaagacactcatttacctaacagtgaataaatttggacacactggtcatgataaagaatacaaaccatttattaaaagacaaaaaaaggctcagcgtggtggctcacgcctgtaatcccagcactttgggaggctgaggcaggcagatcacctcaggtcaggagtttgagaccagcctggcccacatggcgaaaccccatctctgctaaaaatacaaaaacgagacgggaacagtggcacatgcccgtaatcccagctactcgggaggctgaggcaagagaattgcttgaacctgggagacagaggttgcaacgattttaaaaaattgattttcctcctaaacttcctcttaagtttggaggcatcataaattcaagcatttctctgtaaacagtaaaaaagcaagctagaatttaaaccttaaaatgtaagctagaaatacaaagtaaaagacattcttagctttttcccttatgtccaatctttatcctatttactgaaaaatcactctttgctatagccactactgccttaaatgaagtcatcatctacacaccccttacatcattgtattggcttctagctagctttctctagtctcttttctacttccaatctacactgctcctagaattctcttaaaatataaatttgatgtattctcctgcctaataattttatcatacactgtgtacctacttcatgccaggctctgaactatatcgatttaatcctcagtagctctttccatttcacaaagatattttgtcccgtacataaacttttcattctttccaccattcatgatcatcacctcatacttgagtcattccaaaaaaaaagtgaattctaaattcccaaattcagaatttagtaggaattctaaatactactcttaatttatccaagatacttaggtatcctaatgaaaatcaatataaggcaaattaatgccttagctaatataacagtagctttacttttgtatgtatgctctttttagctgcaaagactgttgcttttgcctggaataatccttcttcaaaggtagctcaaatgaaatctaccctgaactagaggtctgagttagcacaatactctgtaaaaattttcattatcacagttattcaattatactttaatgattaacatgaccagaggtgagacctagccaggtcactgtctcaagagttacaagcagaggaaacaactaaagcaaaggtcctacaatggagcatcattagagtgagtattcaaggacaaataagtaggccagtgtagctggaatattgtgagggcaaagtagggaaggaacttagaaggataactaggaatcaatttcctttaatagactgtgaactgcttgagggcagggcttgatgaccatgtatgataacaaaatattaacaggactaacatttatggaatacttcttacatgccattacactattagcccttactattatttcagtgctcaactatgggcacagtcatccctatttgtggatttgtagctttttgaaactaagtttcaaaagctactcaaggtaacaaaactaagcagctgagcaagaatgtgaacccaggtctttctaaagccaacctcatgctattaatcataatcccactgactgacttaatgtgttcagtacttaacaggtactcaataaatacttgctaaaaggtcaatgtaataaaatgaaaaatattatcatgctggaggtttcaaatattggccaaatcttaaaagcatttttaaataacctgccgcaaattttaaactccactagtcaatacactttatgatcacgtacagtccactgcagcataaaataaaggaattctaaacactagccttgcttgatccaaaagatactgagggatcctaatgaaaaataatataaggcaaattaatgccttagctaataaaatagtagttttactttttaaggtacagataattcagactagatcataatttaagaatgattaacctcaactgattatcatagttaaagccaatagatacgttaaacacaaccatcatgcagagattcatttactagtctgacaaatatttgttggtaaccttttatttgccaggtattgatctaagtgcttgagatacaacagtgacaagatcaaataaagattcccactcttgtgaaatatatgttctagtagcaggtaaatagctaatatacagtacatgggccgggcacagtggctcacgcctgtaatcccagcactttgggaggctgaggcgggagaaatcaccttaggtcaggagttcaagaccagcctggccaacatggtgaaatccgtctctactaaaaatacaaaaattagccaggtgtggtgttgggtgcctgtcatcccagctatactcgggaggctgaggcaggagaatcgcttgaactcaggaggcagaggttgcagtgagctgagatcgcgccactgcaatccagcctaggcgacacagtgagactccgtctcaaaaacaaacaaacaataaatataagcaaaatacacagcagcacagcagtcataggacagtaataagtgctctgaaaaaaagaaaaagtagagaagagtaaaggggactagacatactagactggggctgaggacaggttgcagtattaaatgaggcctctttaggaagtgcaaagaccaggggtgagacttggccaggtcactgtctcagagttacaagcagagggaacaactaaagcaaaggtcccatgctggagcatgattagagtgagtattcaaggacaaataaggaggccagtgtagctggaatattgtgaagggaaagtaaggaaggaacttagaaggataactaggaatctaaatttagagtcttgcagaccacgataaagactttagctttctttggttctttcttcctttcagtctctgctcaaattccaccttaacaggtgagactatgataggcaaagggaaaacctagactactcagtataatatagcaactcaacacccccaactccccatatttccttttctctttattcttctttaatttctccataatacttactatcacctaacatacttgccttattgttatgcaaactccttaagtaggaaagaactttggtttgctaactgctatctccctaatgactagaatagtacctggcacacagctggcaccttaaacaataatttgttgaataaatgaacaaaaatagtgatttggcagttagattactcataagcctggtcattaagtgtctcaacataagagacggatccacttttacttaagtgtactggccaaatcaggtttctaaacctattaactgaagagctgaatctctcgagaggtagcctgttggccttcacctggcagattcactgtctttattaatgtcattagacaagactaatgcttttatctgaattatagtaacctctatatttaattttttagtgtgcatcaacttacatttaaattcttgttaatcgctgcatataatgttgaatacttacgttaacttcaatctttttgcatgaccaggcattacaggaacataaagcattttgactccctgtaccaccattgttggctcaattccatacttctcctaaaagtgaatatccaaaaaagaaacaatgaaagcctcgctcaaacataaaatgcttatttaacattgttcgtaaacaatgttttatgaccagtaaaaaaagcaaattcatggtaaataattataacttccaataaaattataaataaaaacaaaacagaaaccagacataaagctactaatgaactaaatgaacaaaagtatctcactttgactgcatttatgaaatccaagagggtgaaatcttcttttccatgtacggtccatcgatcccaaattgtaaatgatattccatttctgttacagaaaaatattcagaacagaaacattgaaattttcttccttttagtgatgacacacacacaaaaaaaacccactttcagaagtccattatttgtgatcaggctagaaattaatgtggggaaataaaggataatatatcttctaaaatattccataatcttatttcttcatcacatcatatagataaccacttttaatcagtaccttgctgatccttccagtgtattataaatcagtatgttttagcaagacagtgttgtctctctctttttaaaatgggtttcactgtgtggatgttccagtaccccattactggacacttcggttattctaatcattggccacgataaataatgccagaataattatcttgcaaatatatagtttgagacttgtgcaaatgtatctgaaatatagtgctatatatcccttactgtggattatagtattttgtactctcattagtaatgtatgagagtgtctgctttctcacacccttgttaaggtaggttttttttcaagtttttggttgttgccaatctgaaaactaaaaagtacaggcccaggaattgttctgctttgtctcaagcttgtggaattcttctaaatctcatgacctacagtcagacaccagggtaccttctaattcatctggcagacacagatgaaaccataatgccaaataatgtggcagataaagtgctgtaagggttctttggctactttagtcagaaatatttaatgaagatgaggtttgagctgatcttgaagtgatggcaaaaatttacacatacacaatagaagaaaaaagaggtgaagctagtatttttcccttttaaaaggtaaaatattttatttcattctcattatacaagagaaatagactttcatacatacctgattttagttttccttacttcagttgtctctgtaaatactacaattggaatggctaagttaagaaaacaatttttgtaagcttcaaatggatagccaccagttactttgatcatctccaaggcaacctagataaaagaaggtgatctgataatataaacagcctaaaactatccgtgattttaattgcatctattcaactttcacgttttcaagcatttctctgtggatagtaaaagcagctatgggactatagtaatataaatttcttattacaggtctgtatacttttagtatattttatactttcaaactttcaacctactctatacatgttaacagttatttaaaaaaatattaattcaaccatacagtctccctattttgaaagcacatgctgtaactcaaaaaataacaacagtctaaaatcacttaatacaggggtaaataactacatagcttcatagataattacatagagtaatgatgtaatatggtataataactagggccgcacttaaagattctgaatcattatgaataaagattagggaagttcattttattcaagaaaaacagagtacctgctttgtatgaatgacgtaaagatcagtgaaaagattattgcctataagaaaaatcataatctatcttgagcttattttttattttaaaaatgtatatttatgtaatacttcacaatacagatgactgcattttcagaaaatattttgaaattttaaattatgagatccaatatttatccttccctctctaacatctctgagtgactgggttggtatgacggggaagtcagggaagaggcaatgaaaaaggagcatttttattcaaggaataataaacttaccaagccagaaactgtagcagtggttgttgctatagcaggtataattttaccagctatgcgctttgttttgaaacggtcagctggttcaatgctgtacattttggcacgaagatttgatgcagctgtgatgaaatctatgtgtccattatgatcatcatctttttcaaatgaaagcactgccatctgaaggtcacctgattataccaaccagataaacaaagttccacagcaagcagtaaagattttactaggtaaaaagcaatgtgaatttactaactttcaaagattcctttttatattttttaatgactgagaaacataagaaaaattcaggcaactaatgttattgaaggccacaaaaacagcttttcccatgattaaagagagccaattttttttaattaaaaaaaaaaaaacgatggttttaatgccactaaactagagacgtttctgtatttaaaaaaactttttaataaatagcaaaataagaaagttgtgtactgcacatctcctatcaagtggtttacaataaaaaagccaacattaggtatagttcaaaaatttattccataaatccgactctgaaacattttccctctggtaactaagaacagggtcagttggtcaaattaaaataagtaatttctgaaatctttgtagatcagtggttcccaagatccttctaattattgttattctgggttatttttcctgaaattctactggtccatgcttaaaatctcaaaagtttggaaaccactgatttataaaactaaaagacggtgagcaggtcaaaacagatgagtgtatggctgcttttaaggaattaaaaattcagttttcctgtatttttatatttaagtccatctagcaaggaagtatatataggtcattctgtattccctgtcagtaattatgaacctaattactaaagactaagaacctaagaatatttctgtttatagttctttatcctaaagtgatttaaatgggtctgtccaaagattagtttccacaaggaccccattaaactgaatttttaattccttaaaaacagagcttttcattcatggttttagacctgctcaccatctaaagaactaaaacaatcagaaaaacaacaacaatgcagttaatgtgatttggagaattagacttcaatctttgagagtagggcaatagtggggaagatgatgaatttagtcacagttaaagatgaacactgactttaatatgatcatgaaatcaatcaatattgtcatcattattattgttgtgattaaattccacaaattcttaggtgtagagcttagtgaaaataaaaactcatccagttcaaaacatttttataaagattttcccttacttttggtggcttcattagataaaatagccttttctagttggaaaattgcattcctctcatcttcactgctaataggaacatggtctggtttccttgcagtttcatctgtttgaacaacctttgaatatatgaatatatttttattaatgttatcatttcctgcatctgtttggttaccatttaactgttttatcaaattacaaagagaaaatattttctctatatattttgatcagattattaatcattggtccaatgtattttatacgttcctttagaaggtattattatgttattcatgtatgtattttattatctatcttctcgcacaggcatgtaagctctataacaacagggatctttatgtatcttgttcactgacagaactccaatatatctaatttttaatacccacaatgatacagtgggcataaaaaatatttactgagtagctcatacaatctaagtccatactgatctttttaaaaattccacactagaataaaattagtattaatcaacactttgtgattctgacaaatctactttaaacgcatgttgctttgctctaactagtacagagctgcttcacatcaaggaaactaaagcaatccataagatatataatatggccatcctttaaatattcactgactgctgttaagttttttccttaagaatatgccttctttcatatagaaagtttggtaggattaagggagtacataccacaagtaatttaaccttaagaaattacttattagatattccctgagggcacggaaattaatattctcaaaccaagaaattagcttcattatcatgaagtaatatttatttaaaaatacactcaaatcatcgttttacaaattaaacattattacaaaaaattaagaaatattaaggagtccaggaaggagaaacttttgtttgtctgaatggctagttgatatttttggctgtgacatctgtaaccagcagtaccatacctgaaacttcggtgtgagctcctttagggagttgtgaaaaagcccacagttcatgttaaaactgtagttaaattgctcaggagaatttattaccctcagactttaacacagatagaagcaatgcaagccagaaaacataccgaagcaagagcaataacggaaagtaaagttaaagcatttttccttggcttctctctagttttgcccttggaaacatgggctgggaaccttctttgggatttctgtttatcctcaccctatttttattctttataggctataagtcataaacattgtgttctgcaaatccatctacctgggcaaaatcaactgccctacaagtcttttttttttttcctaaaataaaaacgcagaacgaaagactgcacacgtcacttctttcttgaattttgcagggaggtggtcattactccaccttttctggtatagctaaattttgtggatgatttttagagaacatacaagaaaggcatatactgaacatgtaaaaaagaaaaaaaagttttcaaacttttttatttacattgcctaaatttcatgttccatctttaccaatactccctattgcttttttttttttttttcaatgtatttgcctggcaaaatcccaaccctagttatatccaattttccatccattatacagtataataccacccaagcagctaaattctggctggagaaaagatcattaccctttctccagccacatttagtaggatacattaagcagattaacattaagtggatcttcagtattgtcttgcgttttactacatcttttaattaagtgactcttccacttcactggacaattatttcataccttcttttctttgctcttacttcctttatcttcttatccccttcactctgagctactaagctagcttcttatttcaactaagaaaatattctttctttatcatagccccaactatctctgtaatttcctcatttaagactcttccccttgtatattctcttctagacgagtcctgaccttaaaagcttttcaaggcctttctctgcacttatttctgctgcctacattgctctttcactattcctttacttccttcaggtttctgctaaaatgttactgttatcagaggttttcctcacttccatcccatataaaattataccagctccatcactctttcttttccctgttgtatttttccttcttagcacttacactcacactgcaatattatgtacttattagcatttttgtttatagtccctctccgcccaaaatacattggtccaatgtattttatacattccttcagaaggtattattatgttattcatgtatgtattttattatctatcttctcacaaaggcatgtaagctctataacaacaggggatctttatgtatcttgttcactgacagaactccaatatatctaatttttaatacccacaatgatatagtgggcataaaaaaatattaactgagtagctcatacaatctaagtctatactgatcttttttaaaattccacactagaataaaattagtattaatcaacagtttgtgattctgacaaatctacttcaaactcaagttgcactgacaagagcaagagcaagaaccattcattgtgatattctccaggtttagaatgggacttggtacaagtccaaattcccaaactatttgctgaatgaatgattttttaaacataccttattggaaggcttgaattcctgaatctttacttctgaaagaatattcaagagggcatctgctgataagtcctgtttttaaaaaagtaattttaccaacaaacatattcttctaaattctaaagctaaaaatatcctacaaaaggtccttaatcatattacaatatatgaatatttcattatctgaatatgtagacatccatttgagacatttatctttatttctataaaaatatccccccataaaggttatgggggaggagaaggtaaggggtaaaaaagtacttattagtcaacaaacttgaaattttagtccttctgcaaattttttaaaaggcatttttaggactggttgtaaatataaaactgagtgacttgatcagtcagttttaattcccttagctttatgttttatgtttttaatgttttacaaagttccctgaagtaagttatactcaataagtaaaataagtaaatggaattcataccttaagaaggagggagatatttaaatggttaaagatgaacttatatgaatttaaagctatgggttgtatttacatttgtcattgagaagttgcttggcaaaggctgagacttagtgcttttgaggtcaattaccacactcaccactaaattaccactgattttcccaaaaagaatatcagactgaatgccactatttttaccaaatatttacagtttatttgtatgaattccaaaaaggattaatctaaaacagatattgttatctgaatccaaaacagccagtgttaattatgggatctgattcatgtttctctatttagcccacctaaaagtacagcaatttacttagctagaatatgcatttgtgaagaaaagagatgcctctcaaaaccgtatgaggctctttagatgttagtcaatgaagatgatgtttaagagaatgagtatgatgctaaagtaagaaatgtcaatataagggagcattttcagatttcctgaaaagcacataaattatcacaaaataacaaacaaatgttaacaaagaaaatctctacgcagtatttcaaaattgcgatgaaatggtttgctgtggctttttagaataactaggataactgaagctgctaagcaggttataaatattcttaaaacaaagtttaactgcttttaacaaataatgctgtttcactgcttcaattcagaaggaaaaatccgacttctacttagcaatactgcaatgagcttttagcttccattatgttagtatgggtaaaaatacaataaaaattctgtatcaaaaagagtgattcttataacaaacaaacatgttttgatgcaattagtgcatcagtcatctaattctaatttggttttgcatcacttgctaaggcttaaagaatatcttacctcttctgcaaatggaatacaatatactgtagcatatagttttgcagcattctgaaggaaactgaggtgccttttgaaattaaaaaataaagcaaaatttgaatgtacagttttaaagacgatatttaactcattatgaactatagcctttaaatgtagtttgaagaaatataaccacagaattattatttcaagtttttttttttaagttagacaaaaatattctggtctacaccaaaacactacagaagttataaaagacaaaacatcaaacagttattctcaaaaacacttaacattcaggtagtgatcatgactaccttgggaagaggagtgagtggacagaaccagaaaactcagaccagtgaacaataattcattttaagtcataagaaatattatacatttggtcttaatgagtatatatcaagttcaaactaagtaaatgtgtttatttaaaaacaaaaaaagaaagtcttatagaagaagcagtccagcataaggtgactggaagcctaaaaccaccaccagatgagaaaattaagcatagagttatctgctgaaaggaaggttagtgaatgcaagctaagtgtttaaaaatatatatacataaggttgggtgtggtggtatgcacctgtaatcccagctacttgggaagctgaggtgcgaggattgcttgagcctaggagttcaagaccaggctgggccacatatgtgagaccttgtctctttcaaagaataaaaactaaattaaaaaaatagaaaaaatatacatatacacacaagtgtgaatctaatgtgtatctaatatagtgtttccaggtattcacacaaagaccaactcctctgaaaataatttgagatttagggagttattcagtagtaattatttgttcctccatataactgaagattcttatatttgatttcattaaatgtaaaaacacattgtcattttactaatttatggataaagtaaaaaaggtgattttggtttcaccttagatatttattataaataatgaggttatttaccatgtaaatgaatggattcacatttgtgtgggaagggttgtggctggctttcttggtcagaatgacttgttaactcttaaatgaacagggatgaaataatttaacattaaagagcctaaggttttcactctgcaatgtacagttaaggaatttacagtaaagaaatatataatgaaggatacataaaactaaatataaatacttacaaaggctcatttaaatcaaattttattggagagggtggcctctttggtgactgccaaaataaacctggcaaaaagatacaaatatcattttcaatgtatgtagccagtaataaatgtcattaaaatttattctcaacatttatacttactgccatcttttaatcgtatgtccagagggaaacagtgaagaagctgaagagcctaaagaaaaaaaatgaattaaagacacccactacttaatattatctgaggaaaaattaaaaaataaaattaaaaaatgtgtgtagtaaatatatgcacatgattcaaaaatcaaaacacattaaaagagacacagtgaagtctccctaccacccttgtattccatctgtccattctcctgtcaatgtccctcataaatgaaaaattcaaatatcattttctatcactatttgtaggtttattgggaggtggtatctacagcaaacaaatgtagattacttcactcctttttatataaatggcatattttacatgtcattctgttctttttaaagagctagtacttaaataacaaaaccagaaaaaacacacagtactttgtatttttgaaattgatacatgtttgagatttgcttcaaaatcacctgggggaaggtaagaatgaacgggaatggtgatgaaacaagatttatctatgaattgataactgctaaccctgggtgataggtaattgacaattacattagggttcattatactatttcctctacatttctatggctgaatatttttcattataaaaaaagtttaaaaaaaatgcacagaagataagaactaaagagttccttagatttttgaaacgggtcattgataaccatgttaagaacaatctgaagagtaatgagcaaagaagtcaaatttactgggtaaagaagtggtaacattgagtagtacagaccacttttccaagaagtagagctctgttgaaagtaaaaagaagaagtataaacgaaatattttttaagtggggtgtggtggcgtgcacatgcagcctcagctacttaagggctgaggcagggatcacttgagcccaggagttccaggccagactggaaaacatagggaaaccctgtttttttgtttttttttaaagttgtttctaaggaagatgaacttaagatcctaaagagagggaaagactaaagagaaggcaacacacattccagcaactatatttaactggaggtaagaataacagctaatatttagtaattttttatgtgccaggctctgttctaaatgctttgtgttacctccttttatctttaccactaccttatgtattaggtacaaatttattatttctattttacagatggggaaacagacataaaatgtgattatcagatatgggtggaaatggcaaaatctcagcaaaatttctgactaaatgtccctattttctcagtttcttgcttcttctattctgaacaaacttcttttagattagcatgtgttctcatttaacttactactaatttctgaaaagcttgccaaaagaaagaatacacatttcaggtcaatgaaattaatttgttaataactaaataagccaagatcagaccttttcttaatgtctcacaatgcatacttaccttatggttaaaatatttttcaaactttaatcttgctaattctacacactgggaccaatttctaggtcttctgctaagtaactttataacttgaaaacagccttctaaactgtgtccactctgtatcttctagaatgggagagaaaaaaaaaatcaacatacttccaattacaaacatatacacatccctcaccaaaagttagcctaagtttgaagtgtcaactcatgtgttttatgcttttcttttttcacctcaagctccttttcccttccttcttctttaacctttcttttcttttctgtttgagaaggggaatggtaagagatagcatacaaaattttaactctgatttcttatcttacaagttatcctcatattttcctagctgtaagttattagtactataatatatgtactcactataagtgctatgaatatttgatactaaaaagtgggccttgttagcaaaagattaaaagaaagtgagaaaacatctttaaagttgccttcactataagagtaataagtcttggagattattgttccctcatgaaattttaactagaacttacctcaattttttctttccaaagggcttaataaaagcccttttattatttgtagcccttctatcataattatcatatctttattagctcgcaccatacgaattgctgttttgtgagtcgaacatgctcaaatatcgacaattccatgtagttcaaacaaccaaaatgataatttgtgacctaatttcaagattccttatgtatcatttcattttttatatacaatcactctttatggaggtaaaataaatcacttgtagatgacttgaaaataagattacactgacacaaagtgttaagtttgtattaaaatttactgatttttacctgtaagacttcttctgcagatgaataggtttgccaaaatttgttaaacaatgaaggtttgtgggaaaaggaactttcaaactgtaacagagaaaagaaaaaaaaaattacaaatagaagtctgtttaaagtcagaaatatcttctttctcacttcaaagaaaataaatttaaaaaggaacttttaccttatctcttgcccactgtatggtatgttcaatagcagctggaaaggattttagagtacaaaatggtatttcctcttctgggggatcccgctaatttataaaatatgacaacaggtacttaaggggaagcaatgaccaatttttattgatttaatctagttttgagctttaagcctattaaaaatccaaaaataaataaaatccaaccagacatttttatatcttctctctcttaggcaataagagaagttaattcttttgacatttaacctatttgttaatagctatgtaatgccaaacatgaatcttatttattatttgtgtactcatttaaagcaccatgtagtactcatgacacaccatcatctataaatcatttttttcctcatgaatcaaggtgacatttaaagttttataacactgccccgctttgaaaagtaattcaggaatacccagtatagtgctcagaaaagcatgagtttttccatggagaaaaacatctgggagcagaaatatgtcctcaatgcttgaggtttcttgcagaaagcatgtattaaataaatggtaaatacctaagtcgttttttgtggataaagtaccattgaagaaatccacattctattatagagtacattttgcctaggtttattggtttacctaatctaaaatgactcactttgtctcagcaagtgaataaaattttatgtctttgttgacagttctagtctcaatctaatagtttgttcttatcaaacaatcttaaactcaaagggtattagaaaactaagcagctctgagaaataaatagtaaacagaagaataatgctccagaaacaccagacacaaaattctgataattaaaaaaaagttcaattatattttaaaaaatgtacatgcacatatgtatgaacatcattggcagagcaaaatcagaaggattaggaaagctaaatcaaattgttgattaagacaaaaattacaagatataaaaaagacatctatttcaaaatattgattcacttacatgactattgtaagactcagtcaaatgcggtacaataacttcagtgtgtcccttagtgcccattgttccagaatctaaaagaggccttagatttgctaagcaacgactatttgaaaagacagcaagtaaaaaacaaaaaagtgagcaataacaatgtaaccaaaggacaacctacaactttctattgaccatttcacatactgatcacttcttgaatgcagtattttaggaaaacagatatactactatcaaacagtggatcattcctgttcccctattctgcaatatacatatacatctagtagtaccctaaatctggggctttcttaacctttatctctaggttaattcctaacaatattactccttttcccttgctttatatttcttctttggttattttctaactacaagttctaccacactatctcttctcaatattttctttatcccaaataatattaatcttctttctcaacacttacaatacctatattctacaaatttttattttttaaagttttattttcttcccctctttggcccaagattacatacttttcacatttttcaactgataaattctcccctgttaatatatctgctctacaccctaacattgaggagtcatataaagatgtaaggtgaacacatttatagtcattcattcatctacttatttaaggaatatttactaaatgacatcatatgttgggcactgaggatacaatgacggaaagtaaatggtccctggatgaatgatttagtgaggacacaaacattaaataaatatgcatatcagtaaaaatgagtgccatgaaggaaaaagtacatagtgttatgaaaatcaccataggaggatttaatttagaatttgggggaaaagaaagtctgttttgataaagaaatttaggtccctctccctctcctgctcccgctccccacggtctccctctccctctctttccatggtctccctctgatgccgagccgaagctggactgtactgctgccatctcagctcactgcaacctccctgcctgattctcctgcctcagcctgcctagtgcctgcgattgcaggcgcgcaccgccacgcctgactggttttcatatttttttggtggagacggggttttgcagtgttggccgggctggtctccagctcctaacagtgagtgatctgccagcctcggcctcccgaagtgctgggattgcagacagagtctccttcattcagtgctcaatgttgcccaggctggagtgcagtggcgtgatctcggctagctacaacctccaccccccagccgcctgccttggcctcccaaagtgccgagattgcagcctctgcccggccgccaccccgtctgggaagtgaggagcgtctctgcctggccgcccatcgtctgggatgtgaggagcccctctgcccggctgcccagtctgggaagtgaggagcgcctcttcccggccgccatcccgtctaggaagtgaggagtgtctctgcccagcagcccattgtctgagatgtggggagcgcctctgccccaccgccccatctgggatgtgaggagcgcctctgcccggccgcgaccctgtctgggaggtgaggagcgtctctgccctgccgccccgtctgagaagtgaggagcccctccgcccagcagccaccccgtctgggaagtgaggagcgtctccgcccggcagccgccccgtccgggaggtgggggggcagcccccacccggccagccgccccgtccgggagggaggtggggggcagcacccgtctggccagccgcccagccctggagggaggtggagggcagcccctgcccggccagccgccccgtccgggagggaggtgggggccagcccccacctggccagctgccccgtccgggaggtgggggcgcctctgcccagccaccccttctgggaagtgaggagcccctctgcccggctgccaccccgtctgggaggtgtacccaacagctcattgagaacgggccatgatgacgatggcggttttgtagaatagaaaagggggaaatgtggggaaaagatagagaaatcagattgttgctgtgtctgtgtagaaagaagtagacatacgagactccattttgttctgtactaagaaaaattcttctgccttgggatgctgttgatctaatctatgaccttagccccaacccggtgctctctgaaacgtgtgctgtgtccactcagggttaaatggattaagggcggtgcaagatgtgctttgttaaacagatgcctgaaggcagcatgctcgtcaagagtcatcaccactccctaatctcaagtacccagggacacaaacactgcggtaggccacagggtcctctgcctaggaaaaccagagacctttgttcacttgtttatctgctgaccttccctccactattgtcctatgaccctgccaaatccccctatgcgagaaacacccaagaatgatcaatataaataaataaataaataaataaataaataaaaagaaatttaggctgaaactgaaaggatgaagaaaaaaagctaaactagatgaagagtagataggtagattagagatcaggaatgttaaagcaagaaaaacagaacttcctgaggctgaagaatactgtgtgcaagtctctaaggtaaaaaagtgctgaaggcctggtaaggaaaaggcacagacagaaggaggggtggcaggtcagagctgctgcgggtaaccagcatgagcttgcctggtagaagaacatgaaaaaacagaagaatatgcaaacagttaagggaaagtgccaagaagacagactttctgctgctgcccacaagcagagggacctgaagaccatgcagctgaagcagaaaagggaaaacgagaaggaagaacctaagtagctttgtggtttggtgtccacccccgtgcccttcgcctctgtgcctgaagccagtcccaccatgctcacgtttcctcctctagtactcacaggacccaggactgatggcattccctttgccctgagtttgcagtgggtcctttttgtgcttccttctcaggtagcctttctctcctggggcatttctgggggtgaaggagttactccttctatgttttctattgcagtgggactcaccccaaagtattaaaaatagctttacaattcagaaaaaacaaaagacagccaaaaaactgaaaggcacatacagctagaataaggggagccaaggaagactggtaaatgttactctggcatggtgaacaggtgaaaagtactccatgaaaaacatttaggttatgttacagattttgaatttcattctaagtataatgagaaatcatcaaagggtttgtgtttgaggagtactacaataggaacataaggaataatcagataattccgtaacttttcaataagtaatgtgggaaacagaagtgaaaactaaagacaattctgtaggaacatgaatttcaagaacatacctgtctacgtatctcctggcttccacattatctaatgctgtaataattacatcttgtttagtatagaactcatcattgtaaatggtctcagtggttggacatactttgttcaggtgtgcatctatctttatttgagaatttattttcagagtagcatcagcagcagtgtagcttttaggtttctaaacaaataatataagcagaaggaatatgttaaacaacaaaaaaaggactatgatttttctatatattccagagtgataagaatgtgtaagttcagtcatagtccatacatatataatgagagtaatgagaccagttttcatttttggcttgtagaaattacattcactgtaatcacactacattaataatgcacattagtccaaataatttacaaattattaataaaaatctaaacaccttctatcttatagttaagtactttacagttcttaaaaaaagttaaaaatccaattacaatttttccctagtaatgatgtttgacttggtaagtgcctagaaaaaaatgagaacacattcagtaaaacattggaaatcaactctgcagaagataagttcttagaggtatgcgagttgaatactttggtactaacatattttaaaattattatttctggatggaaatattttcagaaattatttgtgttccattttataaaaaacagtccagtagttcctcatctgccttccacaaccccccaaaatgcctaaaactacagacagtaccaaaccctatatatactatgtattttcatatacacacatacctatgataaagtttaatttataaattatgcatagtaagagattaataacaataaaacaatacaatcataacaatatacattaacaaaaggcatatgaatatggtctctccctctcaaaatacagtatcttattgtaccacactgtactcacctattttcagatcctggttgaccatggctaactgaaactgtggcaagcaaaactggatactgctgtaaggggtactactgtactctaaatataatttattctttcttttcttaaaaagatttagtgactatttttaaatcatgattgttatttcaggtgctgtcactgttcatctgcatttgctttggcattaaatatctttaggccattctgtttaaattcacacatctagttttaacggtatttctgtctcttctcacattcttaggctgacacatttcacttattagtgttctaagtgtacaaacaaatcaaaactttgttagaactcagtaaaataagaatgaacaggactttatagttcttctctaagtaaaatgcaccaagttaagcaaatacactttgcaacatattttagttcacaacggaccctgttactttgtctattatatttggataagcaaggcaattagattaactatgacatctgttttagttactttctgttcatgacattactaagcttagtttactaagacttgcaatgagttgttgaacaataaagaaaaaacttctttttgttttaatttttttaaaacttttttttagggtagaactggtttttccctaggttgcccaggctggtcgggaactcctaacctcaagcaatcctcctgtgttggcctcccaaagtgctgggattataggcatgagctattgtgtctggctaaacattcctaaagtaaaagcaaatctgcttgacttaaaatgctttcttgcctgacttaaatattttgatttatataaaaaaggagaaaattgagaacaagcattattttacaataaaaacggatgttggtcaaacgatcaaaagagcacaaaaattctaagtgctaaacttttatctgatttatgacaaagataaaaaaagacactgccaaatttgctaccaaaacctcaaattagaaacatatttctatatacttcctttctaaaattgaatgaatgtcaacataccctggtgattacaaaatgaaaaaaatactgcctgtttcacaactcaggtttcaattccaaaatcaatgcaaaaatcaatattgtgcattaaataatttaatattttcccttttgtcatttccattaattgataatttgaaagtttctaataaaataacacgattgttcaatcactattttctatttattaaaaggaaactcttttttgtataatacatgatttaaatttgaaacagaatagcaacatacctgtatgtgatgaggacgaaataggaactgtctatttaagttggatttctctatcaagtcaggatctgtaactgtaatctaatatcaagaaaatatggctgaaattacataatggataccttttaatctatttttcttttctcagtatgactaaaaaagtcctgacaaattattctaaattagtctggttggtaaaggtcataatgatacaaacattcccaaatagttaccaatactactcttttatgttttatttaattgtaattaatgttttacataggagcacatcaaacaaaatagctgaggccaattgcaattcctgttcaaaacttttttctaattattcataacaaaacaaaactttttagaactatgaaatggattacctgcagaggagctagctcttctttctaaactggtatttattcttaatctcaactaatttgggaagaatgcttatatgtatcaatttgaaaggaactctggctaaagcagaggcatacaaactttggtcttgaactcctaaccccctaattaggcatgctgcctatttttgtaactaaagttttattgaaacactgtcatactatttaagaattgtctaccgcagttttcatgatcctaggggcagaactgataagttgtgacagagatctttggtctgcaaagttgaaatatttgcaatcgtgtcctttaagaaaaagtctgcagactcattctaaaggacgcaagatgaaagtaaactcaagatcatctgaagagtattcaaaatgcatttgccactttagcatttttaaacaagatttgcctagatgtagaatgtctccgactatattccacattcattttcttttagttgttatttccctgatatttttaatatttctgtgtaattatgttagggagtgtctcttttaatggaaaaaaaatcaaacagaaaatatcttttaacaaaaaagcttaatcaattcattgttcactgatattaaggctttttctttctacctcctccaattctgcttttcattcccctgtatttttgccttgtactggactgaccaagttttcttgattcctactgcccccaactccccaaactggtttagaagctaagtgcctaatgttatgtggttatgctcaaaattttaacatgcttatgtgacttaagatctaaaatttattaaaatttctatcttcctgaaaaccgagaatatctaaatcatttaatttggaactctccagtctgctttccatgagatcagttacacttaaaacttttaaccatctcactctaaggttttaaaaaatcaatactcatgtaaatcaaagaatgctgacaaatgcctctatataccctttacacactgcccacacaacctaacatctttcagtaagaaccaataagtggtagtaatctttcatcattttatttgtcagctatctttactttgctctccctcttgaactgagtataggttaatagtaattttccattacactatgaagatatgcttccattatcttctatttattgctgacgaaaagtctattatgcaatctctttttttaatctttgcttttgatttgtttggtactagtttatctttccaatttgaaaacacttgtctttctttaactctgggaacttttgtcattatctttggaatatattgcttcttctcccttatctttatctctggaaattctactagacctatgttggaccttgcaaacgcacttctttcattaaaaaaggatatctttctgcactacattctgggtatttatatttatcttcgatttgtccattctcacctcagttatatttaaattttaatattagcgattatacagaaattcttatttggctttatgtaaaaatttcagtgcctttttttcccgtttctagctctctttatctctgatcatttttaactttaaagtttgttctattttctgtaaaatattctattattcaccagcatggcacaagtatatatatgtaactaacctgcacattgtgcacatgtaccctaaaacttaaagtataataataataaaataaaattaaaaaaaattctattattggtagcacttctatcatctataattcttaggagactaattcttttatttgccatggctgattcttgtggtggttccctttctagtgaatagtcattttttaatctgaattgtctttaatgaaggctgactttttctgcatagtcctgagtgtgttattatcatcatgatgcagttttacatttgctttaaaggctgtaagttttagtggtcttaaatttgttatattccgttctctgctttaagttttatatgatataattttggaccccttaccctggtgtggtacatgctctgagtttcaatttctcattagtgacttctgtttttacttaaagttttggacaaacattcaagatagaaacacttgtaagtacccatggctttcaatttaggattttttcttctctcttggttcctgggacctgggaatttctcttttcagcttggctacattacacttaaaaaaatgtatacagtaagtctgtgtttccagtagtatagaagcatgtccacattaacttatcttgttttgttatctgaagtcagtaggtttcttcattacagttcttttcctgacctttatatgctaatgtgcatcatgaatttccaaggagttaaagcatttaggtgattcctaaactgatgtaaccaaagactttcttctttttaaaatcaacacaagtaatagtggtttgtgaagcagtatttaggaaatgttaatataaacatagaacatctgcctgttaactatgatagtaatgtatgatcttttgaattggaataataagctaagtttaataaacttttataaaaggtgatccatcatataaattttagccatttaatcagtcttctgttagtcaccttgatatatctatgaaatcactaatggaagacagtttatcttaaaaggcaaacagcaccagtgaaataaatttctatttaaatatatgacatggcttgcaattaactcacatttagagtcttaagaatttaaattgtacactgagctttatatttttcccactacttttaatactctttaattgaaactacatctgagtcctctgcaactttgtaatgttagcttcagttatcttaaacatttaacaataaacactatctaacagaaataacaacatattttatagcttgcaaagccctttcacatttgatcatcacaataacgttatgagataggtagtacaaatgtcagtttcacagtagtagagaaggaaactgagaaaagaattaatttgctacaaggggaagagaagtaatttgctacaaggtaacataagttttgaaaagtggtcagaagggcatgacaatcttccaatttttagtttaatgctctattttcaaaaaactgatacttcagatttatgcagtcaaatatagctgaaaaagggcaacaacagaaatataaacttttaactctcaagaattgatatcttaccattcctttctctttgcttgtgccaacaccaagtaaagcaaaatttttcaacatttcacagcctatggctccacaccctacctatggaggagaaaaatggtatatatcagattaaaataacctatctgtgaatcattttactttgaaatatttaacaggtttattttaccactgtttcaacgaaaaaaaaaagtataaaccaaataaggaaaagcataattgtacaatttctttaaacagaagacatttaaaaattccaaataaaatttaaacattgaactgcttatgtaagatagaaataaacacaatataatgttaatacaacatttaaaaaaaagattcctcccttttggacatttctcaaaactcatttactgaataaaactattctaagacttctactattatctaaaattgataatactagattccatatgcatgtaaaaagctcagtaacagttgattttcaaaacattattttaaagatgattaataagaataagcagtaattttcagggctaattttaataattaaaacaataaatggcagggagagttgttttatgttattggggaaaatttccctgccaatgcactaagacaattaagaaatacagaataggctgggtgaggtggctcacacctgtaatcccagcactttgggaagctgaggagagtggatcatgaggtcaggatttcgagaccagcctagccaatatggtgaaactccgtctctattgaaaatacaaaaattacctgggcgtggtggcacgcccctgtagtcccagctactcgggaggctgaggcaagagaatcacttgaaccagaggcagaggttgcagtgagccgagatcatgccactgcattccagcctgagtgacagagcgagactttgtctcagaaaaaaaaaaaagaaatacagaatacacttctatattccttcatttagtgagaaaaaaattaaaaacccaccaattttcaaacatatttctagaatttaatttttgaaattatcatactcatacttttactttaaagatattaattagaccagaggatggaaaactttttctgtaaagggtcagacagtaaacaatttcagctttataggctgcaaggtctcagttattacaactactcacctgtactctacacacttagactcaaatttgttttaatgaattaagttgatatacgatagcagtttgaacatactattcccatgattattgatacttactaagaagatgtttaaattttgcagtttctgacacaaagtgtctccaatgcaagctcttaaggcatcatatctatctcctctgaaaaaaataacatataccaaaaagcagaaataaaaaacattaaaattagtttcactgtcattaataccaatttaatgttgtactttaaaaggaaatattctttaaaagtttcccctaaccaatcttaattgaaaaagaaaagcctccataaagaaatccatttttcctttttccacttggcttaatagtctaaatacaaatgacttaagtgaaggtgactttggtttatctagaaaaaaaattttcctaagccagagatttttaaggaaagttcttagaggaatctacggatgggctttggagctgataacccacttaaatcaaaggcagaaatttgggttatgtgtattttagggagaataattctaaacttttcattctcaaaaagatttatgacccaaaaaggtgaagaattacctatataaataaagactgcagatagcagtttttttccatctaatgtcattatggtattttaaatgctaaccattctcatgggatacaatttaaaactttgcattcactatttatcaagtagtaaagagatatgacattattatgacacttaaaatgattcctaagtagagaaaaaacaactacaaaagtgatttgggagaaaagacacataaaacaaaggtatgtttagacaaaacttttaaaatctatttgcctgttagtaaaagcaagagaaatttcattattaccgtgggagaaattcttcacattcaggtttgcctagtgattcaacaatatctgctgcttcaagatataacttaaagtagaagattaaaaacacaattattatgtataaaacaaattactataaaaagaagctcctttatagttatttaatagtcatgaagaaaaaaatgataaaataaggcaattcagagtaaaatatttaaaaatataattaaaaatatataatatacatttctatatctctcattaaaataatggtaaagcctgaaggaactgttgacagatataatttgattcatgtcacttagccatcacaaacatgatgtatcctaattttaaaccaaaggaaatttcacctccaaatctatttttcataactacacaaaagctttagaagcccccattcaatttcagctacatttgaataagcaacttgattactttttgttttttgtttttgattttttgagacagagtctttctgttgcccaggctggagtacagtggtgtgatctctgcctcctgagttcaagtgattcagcctcctgagtagccaggactataagtgcgtgccaccatgcctggctaatttttttgtatttttagtagacatggggtttcaccatgttggctaggctggtcttgaactcccgacctcaggtgatctgcccacctcggcctcccaaagtgctggtattacaggcatgagccactgcgcccagtcataatttgattactttttgagaagaaagtacctactctgtatttatttttcagcttggatatataatctataattatacatactatgtgtatgtgtatgtcatctataatttcacacactataggaaaataatctaggaaaccaaaatttcagcatttttaaaaataccaaagataattaatttaagttaatgaagaaaagaactgagtcttaatctcattttcatttaagtaacttgtgtggctaaatttgaacatgaacaaatggttatttattttattataacacagaatctatattaacaattaatttctattatttctcatggtgttttttttttttttttgagacagagtctcactctgtcgcccaggctggagtgcagtggcacaatctcggctcactacaacctccgcctcccaggttcaagcgattctcctgcctcagcctcccgagtagctgggactacaggggcgtgccaccatgcccggctaattttttgtatttttagtacagaaggggtttcaccatgttagccaggatggtcttgatctcctgacctcgtgatctgcccgcctcggctgctcaaagtgctaggattacaggcatgagccactgcgcctgccttaacggtcatctttaaaccagatttttactaatgtacttgtattctgtgttgaaataaataattcagcagcaaaaatagcattatgtgagtaccttttaaaatataaaaaaatgagccgggcgcagtggctcacgcctgtaatcccagcactttgggaggccgaggcgggtggatcacgaagtcaggagtttgagaccagtctggccaacataatgaaatcccatctctactaaaaacacaaaaagttagccaagtgtggtggtctgcatctgtaaccccagctacttgggaggctgaggcaggagaatcgcgtgaacccggcagacagaggttgcagtgagctaacatcgcgccattgcactccagcctgggtaacagtgtgagactctgtctcaaaaaaaaaaaaaaattaaaaaaaaaagataaatggtatattcaaaatgtttatggtgtttcaacagagagagggcctggaggcagtatcctttcacaccttgtgccaattatttctgctggcaaaagaaatggggatttttattccatcttgtgatgttcataccccatgtaactctaaaacctgtaccactcccatgttttccacttttgtaagtttatacctagaaagggaacctgaacgttcatgatagtaaaagattccatggaacaaattcaagagtcctgagagcccgagaatgctaagcttatggtactggagaacaattacctataaggatagaacattcattcccttactatcacaactaagggaaatatatttgagaaggcaactttgggttatatctcaatagccctaaaatatcatcctgttaatttcaatcatagaatcaagtgttggaggcatactgcttgcatctctttcatgcatcaaaaagtattttaaggtcgcttttctaatatattaatactacattataatatgtaacacattccatttcacgagtaaagaattcaactttaaaaactcagaactaacccactggcacaaaggagaaaattttcctgttacagctttcaatacttcttggctggcaacacctcctactgctgcagcaagtggagataaaaagccttgggcagtccaagagagccaatgcacaatgtcagcatttacatcaggctaaaacaaaagccataaaagacaataacattaacagcatttacacagtacacttaaaattccaatgactaaatgtgagaattagaacttaacttctaaaaaagctattcagttcccctactaaatatctctaaaaatgtcccaatttcatgataacagacccatttgcgtgttaccttaagtagtgtctccctttactagtatctgcccatttttgtctttggattctatatgtcactctagggcatcatttataattaactcgaatatctaccatttatagtttttgtcaaagaacagttctgtgatgccagtcagacatatttacaaataaacagattttttttaatttaaaaagtttgttaatgaaaactactatgaaaaaaccctgaactatgataaaggaaaataaaatgatcttaaaaatgataagctatcagtttgtgttgaaagttgtaaataaaaactgcaattaataataacacaatacacttagagataatgttttcaattacacttaaaagttatgtatctcaaaacagaacattttaaaggaaatattggaaaactgaattttagatctattatttcagcaatttcttatatgtgacaaagatcttttcacgagccctgttttctttctcttcttattctttaaacattagtaatcttaattttatcactaaacttcaagtttgcctaattaatcttttgaaatcctatgtaaaagaagagttcttgtacacagaggagaggacagagaagagtttttattacactctcaaaaatatttgtgacacaaaatggttactacttactattccacccctccatttcaactttctatatctcattatttacaactattgagcactagcctcaaccaagatcaattacaatttaaattctgcaatttttgaatgcagatattgttggtggtgataatattaaaaacaatgatgagaatgataataacagtataagtgggtacttaccatgccaggttatctattaagtccttacacaaccttcaaaataatccttataaatataatttctattatacaagtaagaaaactgaaacattgaaaaattaagtaacttattcaatattttatagctagtaaatggtgaagccaggatctggaccgaaaaagtccaactttataggtttattctcagcattaggttatgcaacctcccaggattccttattttttagtacacaaacatctaaattttgggaatttttggttaccataggataaagacggcagcctatagctaaatttccccaaataatctccaaaacatatgcataatcacaagaagagaaataaaacagtgacagggcttcagtattactagaaaacagaatattataaatttcaaattacttgtaagtagaaagacagattgcaaactccatcagcactctctctggatttcacattgttacaatctcggacagagagcagaaaatacgaagagatcacagaagagagtgaaaggccttatggtaacaaaacacagtcctaagaaaaagaaagacccacactaagtgcagaaaatattgatgagaggtataaaactggtggcagatatcagctgtcaaagaatgtcatcctgggagagaaagatgtaaacaaaagaggggagacattctttgagagagaaagctaaagagagagatgttaagagtttggtaaaaatcaaagagacctacaaaacacaccaatacctctccaccacaaaaaggtcatccattagaagctccttttcagtatcctaagagaagagaatactacaaaagtaggaatctaaaaagcacctaaaacccttatcctgtccaaaaagtaagcacaaaaagcattctactttacaaagctaatgtaagaagaaaacagaaaaccagaatcaaaacatttcagctactgaaaatccacacccccacaactaaccaaaagtcagaggatatttaagtgaattacatattcttaacaagcacttggcaacgtaggggaaaaaaacaacacaaaaaaccttgaatcaggaatttaaaaactaagaacagaaatgatccattctacccttccagaaaagaaaagaaatacttaaacaacatttgactctgcatatcaaaatgggcttatggtgtacgtaagaaactttactgaataatcaactctgagatataacctggtaaaactattagatgaagacaaagattaaacacatagggccttaaagcaaaaagaccagattacttctaacagtatgaaaattcggctgccatctgatttttcaacagtaaaatataaagcaagataccagtgaacaaagtaagagcccagaattttacatctagccaagcttacaagtatgaaaactacagaaaaaatatgaaacatataaaaactcagggaataccataattctgagctctttttgagaaacagactaaacctgacttcaagacttaatataaaagccacaataagcaagacaggatggagctggcaaaaggacagaaacaacatgaagacaatagagtacagaaatagacctacatatatatggttaaaaaaaactgttgacaaaaatgccatgacatttcaataaagaatagccttttcaacaaatgggctagaatagctggacattcatacacaaaaaaattaactttcatctatactttgtgcagtatataaagacaaactcataaaactacaaaagagtgcataaaattagtgtaaagtcatgtacactgatctgtactttgtatgatcatgtctttatcaatactttgcaccatatgcaaaaatgaacttataaaattacaaaaatatgaattgtctagaagaaaacagctttttgaccctgtgttaaaaaagctcttaagacaaaaaagcacaaaccacaaaaagtattctttttgtgatttgataaattgaatttcagagactattgtaaaacacgtatctgataaagaactcatatccaaatatataaagacatataaaaaccctctcaaccaataattaaaagctattttaaaaacaggcaaagatttcaaaagacagtttattaaagaagacatatgaatggcaaataagcatattaaaagatattcaaattcatggccagtgatatgaaaatgaaaaccaaaatgagatactaccacacacataaaaatgtttaaaatcatataaacagacaacacagagtgtaaggaagatgcagcacaactgaaattctcatacacttctggtgagaatacaaaacggtacagctactttgcaaaacagtttggcagtttcttataaaattaaacatggtcttggtcctcccagatggccgaataggaacagctcgtctgcagctcccagcgagatcgatgcagaagacaggtgatttcagcatttccaactgaggtatctggttcatcccactggaactggttggacagtgggtgcagcccatggagggcgagccgaagcagggcggtatgtcacctcacccaggaagcacaaggggtcaggggatttccctttcctagccaagggaagccatgacagactatccttggaaaaacggtacacttccgcccaaatactgcactttcctcaccatcttagcaaccggcagaccaggagattctctcctgtgcctggcttggtggatcccacgcccatggagccttgctcactgctagcgcagcagtctgagatccacctgcgaggctgcagcctggcgggcatacaggtgtccgccattgctgaggcttgagtaggtaaacaaagcagctggtaagcttgaactgagtggagcccaccccagctcagcaaggcctactgcctctatagactcaacctctgtgggcagggcttagctaaacaaaaggcagcagacaacttctgcagacttaaatgtccctgtctgacagcactgaagagagcagtggttctcatagcatggcgttcaagctctgagaacagacagactgcctcctcaattgggtccctgacccccatgtagactgactgggaaacacctcccagtaggggccgacagacacctcatacaggtgggtgcccctctgggacgaagcttccagaggaaggatcaggcagcaatatttgctgttttgcagcctccgctggtgatacccaggcaaacagggtctggagtggacctccagcaaactccaacagacctgcagttgaggggcctgactgttagaaggaaaactaacaaacagaaaggaatagcatcaacatcaacaaaaaggacatccacaccaaaacgccatctgtaggtcaccaacatcaaagaccaaaagtaggtaaaaatacaaagatggggagaaaccagagcagaaaagccaaaaattctaaaaaccagagtgcctcttctcctccaaaggattggagatcctcgccagcaacggaacaaaactggatggagaatgactttgatgagctgacagaagtaggcttcagaaggttggtaataacaaacttctccgagctaaaggagcatgttctaacccattgcaaggaagctaaaaaccttgaaaaagggttagaagaattgctaactagaataaacagtgtagagaagaccttaaatgacctgatggagctgaaaaccacagcacgagaacttcacgatgcatgcacaagcttcaatagctgattcgatcaaatggaagaaaggatatcagtgattgaagatcagattaataaaatatagcaagaagacaagattagagaaaaaagagtaaaaagaaatgaacaaagcctccaagaaatatgggactatgtgaaaagaccaaatctgcgtttgactggtgtaactaaaagtgacagggagaatggaaccaacttagaaaacactcttcagggtattatccagaagaacttctccaacctagcaaggcaggccaacattcaaattcaggaaatacagagaacaacacaaagatactcctcgagaagagcaaccccaagacacataattgtcagattcaccaaggataaaatgaaggaaaaaatgttaaaggcagccagagagagagattgggttacccacaaagggaagtccatcagactaacagcggatctcttggcagaaaccctccatgccagaagagagtgggggccaatattcaacattgttaaagaaaagaattttcatcccagaatttcacacccagccaaactaagcttcataagtgaaggagaaataaaatcctttacagacaagcaaatactgagagattttgtcaccaccagacctgccttacaagagctcttgaaggaggcacaaacatggaaaggaataactggtaccagccactgcaaaaacatgccaaatggaaaagaccattgatgctatgaagaaattgcatcaattaacgggcaaaaaaaccagctaacatcataatgatgggatcaaattcacatataacaatattaaccttaaatgtaaatgggctaaataccccaattaaaagacacagactggcaaattggataaagagtcaagacccatcagcgtgctgtattcacgagacccatctcacgtgcaaagaggcccatagtctcaaaataaagggatggaggaagatctaccaagcaaatggaaagaaaaaaaaaaaaaaagcaagggttgcaatcctagtctctgataaaacagactttaaaccaacaaagatcaaaagagacaaagaaggccattacataatggtaaagggatcaattcaacaagaagagctaactattctaaatatatatgcacccaatacaggtgcaccctgattcataaagcaagtccgtagagacctacaaagacttagactcccacacaataataatgggagactttaacaccccactgtcaacattagacagggcaacaagacagaaggttgacaaggatatccaggacttgaactcagctctgcaccaagtggacctaatagacatctacaaactctccaccccaaatcaacaaaatatacattcttctcagcactacatcgcacttattctaaaattgaccacataattggaagtaaaacactcctcagcaaatgtaaaagaacagaaatcacaacaaactgctctcagactacagtgcaatcaaattagaactcaggattaagaaactcactcaaaaccgcacaactacatggaaactgaacaacctgctcctcaatgactactgggtaaataatgaaatgaaggtagaaataaagatgttctttgaaaccaatgagaacaaagacacaacataccagaatctctgagacacattcaaagcagtgtgtagagggaaatttatagcactaaatgcccacaagagaaagcaggaaagatctaaaatcgacaccttaacatcacaattaaaagaactagagaagcaacagcaaacaaatacaaaagctagcagaaggcaagaaacaactaagatcagaggagaactgaaggagatagagacacaaaaaacccttcaaaaaatcaatgaatccaggagctggtgttttgaaaagatcaacaaattgatagactgctagcaagactaataaagaagaaaagagagaagaatcaaatagatgcagtaaaaaatgataaaggggatatcaccatcaatcccacagaaatacaaactaccatcagagaatactataagcccctctatgcaaataaactagaaaatctacaagaaacggataaattcctggacacatacaccctcccaagactaaaccagaaaaagttgaatctctgaatagaacaataacaggttctgaaattggggcaataattaatagcctaccaaccaaaaagagtccaggaccagacggattcaaagccgaattctaccagaggtacaaggaggagctggtaccattccttctgaaagtattccaatgaacagaaaaagagggaatcctccctaactcattttatgaggccagcatcccctgataccaaagcctggcagagatacaacaaaaaaagggaattttaggccaatatccctggtgaacattgatgcaaaaataaaatactggcaaactgaatccagcagcacatcaaaaagcttatccaacatgatcaactcggcttcagccctgggatgcaaggctggttcaacatatgcaaatcaataaatgtaatctatcacataaacagaaccaacgacaaaaaccacatgattatctcaataggtgcagaaaaggccttcaaaaaattcaacagcctttcatgctaaaaactctcaatgaactaggtattgatgaaacgttacctcaaaataataagagctatttatgacaaacccacagccaatatcatactgaatgggcaaaaactggaagcattcccttggaaaactggtacaagacaaggatgccctctctcaccactcctattcaacatagtcttggaagttctcgccagggcaatcaggcaagagaaagaaataaagggtattcaattaggaaaagaggaagtcaaattgtctctgtttgcagatgacctgattgtatatttagaaaaccccaacatctcagcccaaaatctccttaagctgataagcaacttcagcaaagtctcaggatacaaaatcaatgtgcaaaaatcacaagcattcctatacaccaattatagacaaagagatagccaaactgtgagtgaactttcattcacaattgctacaaagagaataaaatacctaggaatccaacttacaaggaatgtgaaggacctcctcaaggagaagtacaacccactgctcaacgaaataaaagaggacacaaacaaatggaagaacattccatgctcatggataggaagaatcaatatcattaaaacgcccatactgcccaaggtaatttatagactcaatgccatccccatcaagctaccaatgactttcttcacagaagtggaaaaaaactactttaaagttcatatggaaccacaaaagagcctgcatagccaagacaatcctaagcaaagagaacaaagctggaagcatcatactatctgacttcaaattatactttaagcctacagtaaccagaacagcatggtactggtaccagaacagacatagagaccaatggaacagaacagaggcctcagaaataacaccacacatctacaaccatctgatctttgagaaacctgacaaaaacaagaaatggggaaaggattccctatttaataaatggtgctgggattagccatatgtagaaagctgaaactggatcccttccttacaccttatagaaaaattaactcaagatggattaaagaattaaatgtaagatctaaaactataaaaaccctagaagaaaacctaggcaataccattcagaacataggcatggaggaagacttcatgactaaaacaccaaaagcaatggcaacaaaagccaaaattgacaaatgggatctaattaaactaaagagcttctgcacagcaaaagaaactatcatcagagtgaacagcaacctacagaatgggagaaaatttttgcaatctacccatctgacaaagggctaatatccagaatctacaaagaacttaaacaaatttacaaaaaaaaaaaaaaaaagaaaacaaaaaacaaacaaccccatcaaaaagtgggcaaaggatatgaatagacacttctcaaaagaagacatttattcagccaccagacacatgcaaaaatgctcatcatcactggtcatcagagacatgcaaatcaaaaccacaatgagataccatctcatgccagttagaatggcgatcattaaaaaggaaactacagatgctggagaggatgtggagaaacaggaacgcttttacactgttggtgggagtgtaaatcagttaaaccattgtggaagatagtgtggcaattcctcaaggatctagaactagaaataccatttgacccaggaatgccattactgggtatacacccaaaggattataaatcatgctactataaagacaaattcacacgtatgtttattgtggcactattcactatagcaaacttggaaccaagtaggtagggtaggtatataagagaaacaaagatatatgtccacatcaaaatctatatgcaagtatttgtaataactgtattcataattgctcagactgaaaacagcccatatcttccatcaagtgatgtaaaaacaaactgtagtacatctacacaatgaaacagaaaaccaaataccacgtgttctcacttagaagtggaagctaaatgatgagaacacatggatacactgaggggaacaacacgcactggggcctactggagggtgggaagagggggcggaaatgactaacaggtactaggcttaatacctgggtgatgaaataatatgtatgacaaacccccatgatgcaaatttacctatataacaaacttgtacatgtaaccctaaagttaaaagttaaaaaaaatgaaatgaacatgtaacaaaatggataaaactcaagttaattatatttagtgatagaaaccagactcaaaagactacacatactatatgattccatttatatgacattctagaaaagaaaaaatctatagtggatgctaaggtttggttatgggctagggaggtaattataaaaaggcctgagggaacttttttgcattacggaatggtttacatttgattgtagtggtggacccattactgtacactttgaattaactgcgtacatctgaattgattgtgtacaaaattttttataactacacacccaaagagtgaaaaatttactttatgtaaatttcccatcaataaacttgataaatccctaatcacattcttctgtttaatcacagacttctacaatctatttctagcttttcatacattttattttctcaaagcactatatatgcaataaaaggtctttcattatggctagtgagtcactgttttcagtacatttattatttctttctttgtgtaattatagaacatatgatattaaagcttttaccactgatgttaagactctcacttcctgagatggtttggctgtgtcaccacccaaaatctcatcttgaattgtaatccccataatcaccacatgtcaaggtgggaccaggtggaagtaactggatggtgggggtggttctcccatgctgttctgatgatagtgagtttcacgagatctgacagttttataagcgtctggtagatcccctgcttgcactcactctgtcttgccaccctgtgaagaagctgcctgcttctcctgtgccttctgccatgatggtatagtttcctgaggcctccccagtcatgtgaaactgtgagtcaattacctctttcctatataaaatacccaaaactgggtattttatataggaatatataaaatacatatattttatatagcatatgcagtgtgacaacagactaatacagtaaattggtactgtagagagtggggtgctgagataaagatacccaaaagtgtggaagtgactttggaactggaaaacgcagaggttggaatagtttggagggctcgtaagaaaggaagatgtgggaaagtttggaacttatcagttttgaccaaaatgctgatagtgatatggacaatgaagtccagcctgaggcggtctcagatggagacgaggaacctgttgggactagaataaaggtgactcttattatgctttagtaaagagactggtggcattttgcccctgccctagagatctgtggaaagttgaacttgagagagatgatttagggtatctggtagagaaatgtctaagcagcaaagcattcaaggggtgacttgggtgctcttaaaagcattaagttttatgcattcacaaaaagatggtttggaattggaatttatgtttaaaagagaagcagagcataaaagtttggaaaatttgcagcctgatgatacaatagaaaagaaaaatccattttctgaggagaaattcaagtcagctgcagaaatttccataaataacaagcagccaaatgttaattgccaagacaatgggaaaatgtctccagggaatgtcagaggtcttcaaggaagctgctcccatcacagacctggaggcctaataggaaaaaatggttttgtggggtgggcccagggccttgctactttgtgcagtgtcaggacatggtgccctgtgtcccagctgtggctaaaaggggccaatgtacagctcaggctgttgcttcagaggggacaagccctaagccttggtggcttacacatggtgttgggctgtgggtgcacagaagtcaagcgagatttgggaacctctgcctagcttttagaggatgtatgaaaacacctggatgtccaggtagaagtttactgcaggggtggggccctcatggagaacttcttgctaaggcagtgcagaaggataatgtggggttggagcccccacagagagtccccattggcactgcctagtagagctgtgagaagagtgccacagtcctccagatcccggaatggtagatccaacgaaagcttggaccatgaatccggaaaagctgcaacactcaatgccaactcatgaaagcagtcggaaggggggctgtaccttgcataaccacagggtgaagctgcccaagaccatgggaacccacctcttgcatcagcgtgacctggatgtgagacatggagtcaaagaagatcattttggaaccttaagatttaatgattgccctatgggattttatagtgcatggggcctgaagtccctttgttttgtccaatttctcccatttggaatggaagcatttatctaatgtctgtaccctcactgtatctaggaagtaactaacttgcttctgattttacaggctcataggtggaagggacttgccttgctcagataagactttggacatggacttctggattaatgctggaatgagctaagactttgggggactgttggaaaggtgtgactgtgttttgaaacgtgagtacatgagattcagggggtaccagggatgaaatgatacattttggctgtgtccccacccaaaatctcatcttgaattgttatccccataattgccacatgtcaagggcaggaccacgtggaggtaatcagtgagtgatagtgagtgagtctcatgagatctgatggttttgtaagaacctggcagttcccctgcttgtactcacactgtcctgccaccctgtgaagaggtgcctgcttctcctttgtctcctgccatgattgtaagtttcctgaggcctccccaaccatgaggaactgtgagtcaattaaacctctttcctttacaaataacccgcctcaggatttcttcatagcagtgtgagaatggactaatacagttccctctcatttttataaaataagaacaaaaataatagaatcttcaaataattgcacaaacatcaccatgtttatagctgctcaaataaaactgttgacaagcaggcactggcatcataacacacacaaaaaaaccattttctaggtgaaatgtttaaatctaaatctgatgtacgaaatgtgataaagagatatgaatgtataatatataaaacaggtgacttatataagaaagctaacatatataagtttaagttaacaaatcaagtaaatcataacagaataataaagaataatagtaacagttaaaaaaatagcagcaaatattaattactatatgtcacatggcatttctaagtactttacaaaattaaattatttaatgttcacaataaccctatgaaggtaggttaactctattttatagatttataaattaaaacagaacaaactgaaaaaagttgtctaatgccacagagtagcaaagctggatgtgaaggataagagaatactaatatacagaacacttatgtattaacaaacaaatattcggacagccataaatttcaatagtcaccttctcttccaaggtttcacttatagatgttgctagtttcaacagttcttctgaatcttgttggcatctacaactcaaaacagaacaccctaactttaattttctcaactgccataaacagtaggacatactcaaaattaaaatttaggaaatatataaaagaatgtgggatttttgccaacaggtagcacaaaatgttgtactgatttaaagatgattggcttataaatacattacttcaaaatcacacttatatcagtatataaataagtttagttttttttgtttttttttttttgagacagtctcactgtcacccaggctggagtgcagtgatgcaatcttggctcactgcaccctctgcctcctggttcaagcgattcttgtgcctcagcctcccaaggagctgggattaccggcatgcaccaccacgcctggtaatttctgtatttttagcagagacagggtttcgccatgttggccaggctggtcttgaactcctggcctcaagtgatccacctgcttcagcctcccaaagtcctgggatcataggcgtgagccacaacacccaatcccaagatttaatcccaaatataaaaagcaaaaaccttctccaacagtactctgacttaacaggatataaagttaaaaaaaaaattactatgtgttaataattcagtaattctcagaattttttttgttttaagaagctttaatttttaaaggcttcaaagtggaaaaattcacatttagtatgattccacttttataaaccaaatttctccactcccaccaggaaaaggaccagaaagtcataataaatgtttgcacagcttggtatatctattggtattgtaattacaaagggcatagttactttttaaattataatttctgaactactacttttataaaaaggaaaatacttatttttaaacttaaaacattacccaacatttggcttgcgactgtatttctcctgaaactggtccaaggcaagcatagctgtgtgaatctctaaaggtgcctattgagaacattaaaaatcggccaacatttactgagtggttgtatgtcccaggcactgggctaaatacttttaaaacattatttaaccatcataataaacacattagcttaatactgttattaactctatttaacaaataagaaacctgaaggttagaagttaaatgacttaacctcaaggccatgaaggtaaatgatctaatcccctttccttattaaaatttacaaatttggaaactgttagttccttccttatcacatttactgctacaaaattacatccattttaaaaaaaaatagaatacatactcaaggcttttttggtaagaaatatgtattgtataaaatggtacgattcagaaaatcttttaataagatcatctttgtacaagttattgaaatcgtcttataattatcaaagttggcaaatcattataaaagtgaaactttttcctattactttatcatttttttctatgagacaaattcacatttttaatcctcagaagtcaactttagatatgtgagtataacctttattatactcacattataaggcccgacagccagatacctacatggttattccattttaacttcataatcactcactaattctcatctctgattctgctgcctctctcaaacctgcaaagtgtttatttacctcagggttgctaaaatccacaataaggcactttggatgttttaactgcctctccagtgattcctgataggaaggaaaaagtcattacttcagagtgagtgagtgattatttgacaaaatatactgttacatgtcagtgcgctaaaaactagggaactctcccaagggtctgaaataaagtagggttgggctggtatgttttaactgaaatataaactagctaccattattatgaccatacttaaaaaaaaaagttaaatgcaataaaacaacctgctctacataataaatttgggaacaattagtaaaaacatttgcatactttaaaaaatttattattttaatctaaaagctaccatatttttataataccaggttgtcaagacttattaaattctgtgtgaagaactcaaaggtaaaacaaatgaaaccccccctaaaaaaaacccaaaacacccacccaatctaaaattgagacatatccaattaaaaattggagacaaaacataaggagatatgcaggagcacatctgactagatatagtattttaatttttttttttaattctaactttgggttgaacaaagccttgtaaacgactggagttgttaatagttctggaaaagaaaagacaattatgttaaaaccttgagaacttgtaagaaaaaacagagatgtgctagcttatcctgagaaggagcccaaggattttagtagcacaagatcccttagttccctgacaccacattctctatattcagctatttacattttgctttcaatgccagtcgtttttagaaattattttacatttccaacatatatactgttttttgaaatttataaaattaaattaaaatttaaaaaccaggattaacaagtataatttgaatatcttcattttagaaaattaaataataataaagcaaaacaactcttgctaaatcttgaaaatacattagttttatttcttgtcttagaaagtaaattgtaataagtatgataaactctttgataattcacaaagatacagttcctttcgggtatacccatttagctcaactatatgtatatggtattctggctataaaagatgtgtaagttttttgttaatatccattttattcatttatttcattagattaattccatttccctcaaagtgggtacaaacaaaaaaataaaaataaaaacaaattctgttccacatttaatctgtttggttaactgagtagttatttgtctcttctgcctttctttttctgtaaaaaaatgttttttaagccgaaaaaaaaatacttacaaaaaaaactgttttaggagtcttaacttggacagctatgcctccatgtaaatatggttccagttctgtggtgtcaccaatactaaaagaaaatggcgatatcactagaagacaaaaaatttaaaaaatcattacacagggatatagatatttaaatttcaactcttattgtcataagaggttaattatccctaatttacaaaattaaagaattccagcatagtgtttttttttgtttgtttgtttttttttttttttaatgaagagctgggaggagtgtggggaactaggcagagtattttttccaatgtgaaactccaggacttaaaaataaccaaggaaacttacagaaaaagagtaatgagggctactcattattagatattaaaatatatcataaagcctcaataatataataataactacctatcataataatataatatggtactggttaataaacagacaactggaaaagattagagaattcagaaacagtctcaagtacacaaaggacaaaatcaaggtggcacctcaatcagtaatgaaaagataagattattcaataaatcttatagagaaaaaagacaactgggagaatacctattgcaaatggataaaagttttaggtttcaaaaaagatgctcataatttctcagataaaagcatgggagaaaaattcctttaaaaccatgtagtaaggaaggcttttctaagtaacactaaataacaaccataaaagaaaatatttaaaatttgactataaaaacataaaaaagaaaacctcatgacaaaaacccatcataagcaacatcaaaagataaatggcaaaccaggaaaatattatgctctgtctgggcatggtggcatgtgcctgtagtcccatctattcaggaggccaaggcagcaggatcacttgaacccaggaggctatagtgtgctaaactgcacctgtgaatagccactgtactccagcctggataacacagtgagaccctcatttcttaaaaagaaaaaacatggtccgataacattttcatctatattatgacatattaggtagctataaaagaaaatgtttctcatttctaaaccatttgcttattcaaaaaattaagttaaaaaaccaagtaagccccccctttacttaatatattatataatacaggcatatatactatataatatgtaatatatactatatatgtgtatatatagtaaacatataaagtagacagaatggtcagcagagtgaacaccaaactcagctgctgttacctctggagaggaaaggaagtctgaagtaggattcatttttaaccctatttaaacatatacacacatatatatatctagaataagtatgtattattttagctatttaacaatgttttttggctggtcatgaggtttttttatcttcatacctgtaatgccaacactttgggcagccaaggcgagaggatcacctaagccctggagttcgagaccagcttgggcaaaatagagagatcttgtctctacaaaaataaaaaagttagccaggtgtggtggcacacacccgtggtcccagttacttgggaggctgaggtgggaggatcacttgggcccaggaggctgaggctgcagtgagccatgatcatgtcgctgcacttcagcctgggcaacagagcaagatgctatctcaaaaaaagaagcaaaaaacaaacgaaaaaacaaaaaaacaaaacaacattttttcatgctagcagaatattactttagatcagtaagtagcaatttataaatgttaaggaaaaaaaagcttcataacagccactctatttaaacttattcatctctccctccaaagaatttttggcacaaaatgtgggttttctttctctttatttctttacatgctgtggctcctctttatacaagcagcctcataatgtgaactatcaccacaattcaccacaacatggaccccgaaattacaaataataatcctaaatgattaattttaataaaaaacagatatattatttaatatctatgatatgaacctgtattcaaaataattagatatagtcaggaaacaaaattaaacagttttgttatacaacatgcatgctaaaattacaaatagtaatcctaaatgattaattttaataaaaacatattctttagtatctatgatctgaacctgtatttaaaataattagatgtagctggcaaacaaaatcaaatagttttgttaccaaaaatacttaaatatagattcaaagttatctataaacagtttgtaataagaattgatttttccctctcctgaggatatattttgccgtcattaaaaaaaaagtaattccatttactgtctataaactaaatacagttatattttcaaatgccctaaagataaaactgaatcaatttcccctaaataggtgtaagcatgccatatagttatgcgttgtccagtactttgactcttttaaacatggctgaaggaaaaacacaaactacacagattaacgctgctataaattcattatattaaacttcaaatgggccctatatgatgcctgacatctttccatttttaagaatgtctactttcctcctggtttcggcacctttcatttccttttggcaatgacttcgcattagtccagtaaaaaaacagaccccttcaacttcttgcgaacaaacctacaaacttgcctgcagacacgacattcatcccttttattcaagccactgaaaaagaacatatatcccaaccaacatctagacatcttcctttaaatacttcattgccacctcattttacaaagctaaactatactctttatcttatctccaaaacctactccctttcttgcattccttaagtgaatatgttgactgaccatgtagaaatcttcactcacctatagtatgtgatcaagtttcctcctaaatatcttaagacttgtgagcttaattctccctgccagccctgctgtattaaatttcttgtagttcctttagttctgtcttgcatctgcgccttttctgtttgtctctgcataaatgatcttttttcaataccttcctaagccaatgcaaccttcacattttaatcaagacaccctgtcccactgctgctgtcccaaaactgggtaggtttccctgctaagttcagtgtccccagaatgagtatactctcttaatatcatcagtgtttaacaatgtcttcacttggatcgaatattttgaggccaagggctttggatcatgtctctctgagttgacattctgttcccaacacttagtgtctgaactataaatttgctgaataagtataaatgaattaataaaacacattgacttacccgttatttgttgtatagatccatttaaacctgtcattccattaatttctcgaaatgttaggaattgtcctgtctccagtttgtgaggatgattttcaaggcaagtaacaatgccaggatttgcctaaaaataagagtaatctattaaaaaagaacttcttttttgtattctttgtgtacaaattcaaatcttaagcaaaaatgacaaagttaccataaaattctcaaaaccgaaattctaagctattcttctgttagtaaaagcaagcctttaaaaagctatcacaaaataatgatcaaattattactattttttaaatgaatgctgaaaatataatttctatgtttggtaggagatgttcaaaaattccacagaaaggatcaaatatttaatagattcaaaaattcatgtaacttgtaaaaaacattccaagttacctaatagttttaaatgtgagaaaaaaccatgggcataaatgataaaagcctaacactgaagatcaaagaacagtaaagaaggaggatagaaattttaaagatgggaatctggtagcttacagcttgctcaacactttaaagaaatattgtgtagcttatcagctatatttcctatagtattcaataaaagataacaccaatgcaataagaatccataccatattttggaatttattctctgtgtttttctcagggacaaactaaaatcaactagagaaggtaaaaggttaagtcttaatatgcctgaaagaataactcaggtagataataatcactctttgagcagaaagatatacagattgactttttgataaatttttcctaaaaggcatgacagagacagtactgggtctccatcaccatgagattaaactgggtttaaaaataaagtgtaaagacagaagtacaaattacaaatactattatgttaaagtatattatcattcccttattttgtcttcttttggacttcaatgtaagttgattacaaagagtacaaataaagtaaattatttaggtaaaataatattaaaaggggatcataatgatttctccagttcttttatgcaaaaaaaaattgagcttatgcatgatcaagagtgcggttagaaaatttagacttttgaatctgaaggttaatcaaaactttctacaccttctaaataatgctttagaaatataacaaattagaaatgcttttctctaatatgatttaagtgtgcctttttagagtattaggctaggtgacttacaacatacttagtgcatccactatctaacacaataaacaattcagtaaacactgaatcacaattcatgacccacaggagataacatagaataaaattaaaattaaaatttatgacaagcaaatgttgctctatcaagtattattattatttttctttctttatttttgagatgtggtctcactgggtcacccaggctggagtgcagtagcgtgatcttggcttactgcaacttccgcctcccgggttcaagtcatccttccatctcagcctccttagtagctgggaccacacaccaccaggcccggttaattttttgtatttttggtagacatggggtttcaccatgttgcccaggttggtctcaaactcctgagctaaagtgatccacccctgtcagcctccaaaagtgctgggattgtaggcgtgagccaccatgcctggccctatcaagtattatttgttagagaaaatccagaatatttttaacaataatgttccagttttaatacaatgcagtcaagaaattagctacatattccctcattatcttaaaacactgtaaaataaattttgcacactgcaatactttgctgataccacctttctgaaaacagcattcacatcaactttaacaaaatttattttaaaagttcattaatataatcatacttgcgttatgtttgaaatgaaaatttcttttggttcttctcctgttgtatctaaaacttcaaattcatcaccgaaatcacaaaataaccttgaccaaattccatgtacatctgcactgataaactgtaaaatggcaaaaacaagttcaatcttatttatataaagaaaaaaacactctagtatcttaggccatttcataacaatttaatttataattaagtataccttacacaacctatagaatacaaagtaaatcataaacaggataaactgatgcagaatagtttaggaatcaaagattttcagtacttttagtaaatggatgtccagtataacaaaattagaatatcagcatatcatctttataaatttttaaataacaaaaattctgtgactttaaaattttgtgcttgtcacaaaattcaagcacaacataaaagaaatagataactctggcttaatagtccagcagtgaattcttacttgttattttaggaaagaggaatgaagtgctcatttaccaaaagcagcagagttaatggaaaatagaatagagctaaaagctgagagcagagtctacagaaaaaaaaggctgaaaaactgacatcacaaatcaaagccatgaaaggtaaaacattaagttcttaaacaaatcataaatgttttattaaaagcaatttttctaacacatgcattgtctccattctgagaatttgtaaagaaattatttttgggcttaaagctatttttagagctactgctaataaagagaaatcctcattctgtaatgcacccaatcttgcataaaataatgtttttctaacataattaagtatattgatattacggtataagaacatattaaaataatttataatcccaattacatgaagtagtgatatggataacagaagaccacctcccacttgatcatatattgactttactgatcaaaatggatacatatagcttttttttttttacaagacataaaactgggcagaaacttagaagctttttttttaaagtttaactctaaagagcatataaattacgtaaacaaaggttttaatttataaccttgtgtagttattttgtaatactgctgtgccctattgtaagttcagtggctattctgtcttaatcacatgcttaaattgtaaaccacaacacgaatgctctagagcataaatatgctatataaatacaacaatccaaaaattttcaacacacctacatcataaattatgattttgccttggtgcctaactcaaagaaacaagtagctttttcctttttccagtggaacaaccccaaaaacaaacgagatgaggttagtaatgaattcaattacaagcgaagaactgtgatttttcccatctaaacctcttcccaatgtcactgtgcacctaattatgctggaggtttaaaaatctatgagtaattcttgatcactcactctttcctttacaactcacactcatctatctacaagttctgttaggcccccaccccaccccaccttttttttaaacaaaagatacctcaaattcaatgacttctgactatctctcttcccaactcttttgtctaagataccagcatctctcagctgaactactgcagtaactgctaactagtctagctgcctctactctactcttataatccaacagttctatttcttttggttatctttcatgacttcttcatactcttttgaattattgaggacccaaagagcttttatgtaagttacacctatcaatatttactgtgttagaaattaaaactgagagaaatttaaatcacaagaatatacatattccattgtcagagcaaggatatcaccacacatcatatagactctggaaaactccactctgccgcctaagataatcagaatgaaaaaggcaaataacatcttagtaatatgaaaataaaaagttcgagtgtgcagaaccactgaaagggtctgagggattcttagtgtccctggaccacactttgaaaactacaattatagtcttctctccatacagcaagccatagtgatcctttaaaaatataaaacagattaaaactcacaggcctaaaaactcaaatgtcttcgaagatcttgtaacgtatggcccccaacctacttctcccaaactaatcttctggtatattttattcctactatcctctcctctttaccactctattttggtcctgtttgcctcttattgttcctcaaaaccgccaacctaatttttacacttgcaaatgtttacatttgctgattcccctgctttgaatgccttcccccagatctttatatagcctgttctttctcattactcggagccctactcaaacatcatctccttagtgaagacttctctaaccttctaatctaagagaaccagaactgtccttctccctacatcatgcagatatcattctctatttttctttactcagatttttcttcttcataggacttgaaactatttaaaaacgcatgatgtatttattttcttgtttactgtacatcttccctagcagaaggtaattttcatgagtaaaaaaatttgtctctattcactaatgtatttctagtggctataactgtctccaatacatagatagtcaatgaatattcattgaatgaaccactgaacctctagaaaatcaccatcataacgacatttaaaattagaggctgggcgcagtggctcacctgaggtcaggagttcaagaccagcctggccaacatggtaaaaccccgtctctactaaaaatacaaaaaattagctgggcttggtggcgggtgcctgtaagatcccagctactcaggggactgagacaggagaatagcttgaacccgggaggcggaggttggggtgagccaagattgtgtcactgcactccagcctgggcgatagaatgagactctgtctcgggaaaaaaaaaaaaaaaaaaaaattagatgatgatttcaatgtttatcatcctttccattcctaacattaattcttccttagttttggcaatctgtctataaaccaaacttagatcctagttttaaaaacaggaaatgaatatatcaaaattaatgaaaaaaatgattgtgattaatatgtaaaaagtttcttatataacccatcaatgagttaaaaattctactagtgaaagtgttcttccttggttaactacatgtcattactaaatgatacaattaccttaattggagggcactgagaacggcaaaagtcattgatcttcttctgcaatggaagtttcatctcagtcaatactacacactgttgagaaaacaacaaattaaaaactagaaaatacataattattttttgtagtatacaataatcagaagcatgtcagtttgcgttgtgctaaagacacatcgctaatctcattgaaaagttataatcctacggaattccattccaaggttaataccttcacaaagtataggtaacagaagtaaaaataacatatacaggggaaaacctgcacacataaaacttgataaccatcacacgctttatgattagaagcaaaccttaatatcctatgcagtatttatggactctaagtgattagatttgtttcatctattactatcacacaaatattaacctagctaccagagtattactttcatgctagcttaaaaacctgacaacatttttaagagacacattagttggctactagaacatgtccatctgtggatttagtttttttaaatctagcttgcaatatggtttgcttcctgtagggagacattcctccatgggcctctcagtctatacagtctcacaaggtatgccatgaatgcaaggcccttaccgctctttacttgaggtcatttctcagaattgtatttgctgtgtaaaaacttgagggatgaggtaaggtcttcctcagggacaaagagacgtcttagcttgctttaaaacagccagttccccaagctcagtgttcttctctaaagcaacctactgcatgtgcattcactgagccctctgccttgaactagagggacttgggggacgggggcgaggaagaaaatgcaatatatgctcatattttttattatgcactgagtaataaacttcttagtctctgacccaggaatctcatatttcctgcatctgtgaaacagtaacaggatagtttgcaaataataaaaaaatcaaagactcgacccatcacatattgaatctgatttgtgtttgatcaatgttagaaaattctcagccacaatttctttgaatattgctcttttctattgctttctatctagaaatccaatttcataaattggaccttttcattcaagctctcatttattttaacttgtccataatattttctcttatttctgttttgggttttttttttgagacacagtctcactctgttgcccaggctggcgtgcagtggtgcgatctgggctcactgcaaaacaacctctgcctcccaggttcaagcgattctcctgcctcagcctccccagtagctgggattacaggcacatgccaccatgcccagctaatttttgtatttttagtagagacggggtttcgccatgctggccaggctggtctcgaactcctgacctcaggttttctgcctgccttgacttccaaagtgctgggatattttctttatttctatgtgctatagctttggtaatttcctcaggtctatctttcaattcactaatgtttattccagctatatctattcactgtttaatctatccactgaattttaatttttaagacttcatgttcatttccataagttgtacctggttctttatcacatctgcctggtctttttcaatagtgtcttatttgtatattatatatttaatcccttcttttacgatttactagttttgaacatctgtattttataatctttctcaaataattctattctcctaaattcttggaggtttaggctgggcacggtggctcacacctataatcccagcactttgggaggccaatgcgggaggatcacctgaggtcagaagttcgagaccagcctggccaacatggtgaagccccatctctactaaaaatataaaaattagcagggcgtggtggcacgtgcctgtgatcccagctacttgggaggctgaagtaggagaatcacttgaacccaggaggcagaggttgcagtgagcccagactatgccactgcactccagcctgggagacagagcaagactccatcagaaaggaaagagaaagaggaaagaggaaagaagaaaggaaaggaaaagaaaggaaaagaagagaaagaaagaaaaataaataaaaattctttgaggtttaatagtttgttgactcttggtcatattgagctgctttttcccatcttgttattttgtactgtgaactcaaagggactttatatactggaataccctgtaacttagttgagggtatatttctctagatttgtttaattttgtttttgtctggcactttagggtatggccattatggccattatagtactacctttttttttttttttttttttgagatggagttttgttcttgttgcccaggctggagtgcagtggctcaattttggctcactgcaacttccgcctcccgggttcaagcgattctcctgcctcagcctcccgagtagctgggattacaggcatgcaccaccacgcccggctaatttttgtattattagtagagacagggtttctccatgttggtcaggctggtctcgaactcctgaccttaggtgatccgcccacctcggcctcccaaagtgctgggattataggcgtgagccaccgcgcccagcctatagtactactttttacattaagttctcagtttaggaatttccagatcacaaaagataataaagtttaatctctaaacctatgtgacagcacgcctaatggttatgaattccccaggaaaacctttacttttcatccagagcttaagagaaaacaaaacagacaagattggtaaagattgttcttgtccaccctttcactgagggcatagctctctgaggctccagctttatgaagaaggggaggtctcaattcaatttctctagtttatgtagttctaggtctgaatcttctgtttctatgtgaacatcaattcccaagaactttggttactgtgacaggcaactcctgtcgctaagagtacctacagataacagttcactagtcttttagctaactgttcatttgtggcctctgagcattttccttacattattttgagctcggatagtcatttaaaagaaagtctgtttagaaattctaggtgctttgtagcaggatgaattttaagttatctactccagaacagaagtctatacccatttttaaatggatcacagcataatttactcacagaaaaaaaaaaaaaaatcagggtcaacctagtcacttttacaatatccaaggtcctgggaattttgttgttgttatttaaggaattgttacctataatagattgaactactgatccatgtatttttactcccctgtaattgtactgcttgcccatggctttaggaagagtacttttctgcttcttgactttaggcttgataacattgacttgctttggccgacaggatgttaatggacacaacaaaaacagaagcttgaaatgtgcatgtgtggctggacttgaccttctgtttctcctactaccatgagaacatgacctaggtagcctcctggtcccagaagagagacacatgggggagaacccaaactctggagtttaatccaggctgagttcagcctagaaaccccaactgacatattcaggtacacaggaaagaaataaatgcatgttgctataaaccagagttttgagtagtttttaatggatattactgagaaaaaagccaactgatataactactttgtcagtagttcttaggtcccttccttaaaatggagaatttgaaaggttttattctaatatgtcttctaccttgaaatttttttgttctgtttctcaatacactaggttaaattagttaaacatattaatatttaacaattttgccctggaacctgtcaataacatttaatacaaaatggagtactaacctggtatttatctaaaaaggagagatctgtggtctcattgaaaggaacagaagatgatgtgacatgaacgtatggatttagttctgcaatatgtttaagtacagcttcagccctaaaaaaataaaataaatttttactgttctttaattcaatatactcaaatctcttcaagttggacactgtaatgacatcagaggaacctgacatgttacaaaatttcaatggaaacttaccttgtagaagaaagaaaccaaaacttacttgtctttacaggtaaccatacaatcttgaaatgatatactatcatattctacaataaaccacacaatctcaaagtgtaccctaatagttccaagctccaggctccttaactttcttaataatttagcaacactaaagtccttctttaataaattcaaggaaatacatttctaggtagcagtgtaatatatatatatcttttatatatataatatatataaaagatatattatatgtaatatatattatataatacatattatgtaaatatataaaaaatttgacaaatacaaataattaagtatatatcaatatttatttagccacagtagtaggaatttatggtgatcaattaaataactatgactgattggtgttctagataaaggaaatattctaagtaaatgagttaaaaaaaaactcataatacataaaaatatctttacctgtataaagtagagcactttatatttaaacaactatgactgattggtgttctagataaaggaaatattttaagtaaataaatttaaaaaaactcatgataatacatcaaaatatctttacctgtttctcttattaacaacatcatcttcactgagaaagaagttggttcctagatcccatgcttggcatttttctgtatcatgaattgtaactgccttcaaaaaagaaaaaagtattggttgaagtcaggagttcaaggatatgcactctctccagtattactgacaatgtactagaactattattttgtgtaattagacaatgaaaagtaaacaaaggcataagaattaaaatatgtaaagatgttcaaccttgcccagaaatgaaataacttttctcacttgttagattggcataaatccacagtttgacaacatagtctattggtgatggtgaggtgaatgagcgactctcattattactgattaacaaggtaaactggctcaacctcaacggaaaggaatttggcaatctctagcaaaaagacatatgcatttatcctgtgatgcagcaatcccacttttaggactccatctcaaagacacactgggagaaatacaaaaagctatatatacaagagtattaaatatagcacactatttgtaagagcaaaagactggaaataatcaaaatgcccaccaatggggaactggctttaagatgatacatccgtacaatgtataatcatgcaactattaaaaaaagaatgaaagatgtatttataaatatggagtaatctccaggatatgctataaagagatagcaaggtaaagaaaagtagagcactttatatgagaaaggtgggaggagataaacatatatacccacacataaacagatacacatgtatgtgtgtatgcatttacctatctacaaaaacaaatgaagaataaaccaaatataaaaagacagtaacctaataagtgaaggaggaaacaaggtaacaagaagctagacttacctgaaaatactttgtttaaaaaatctgactttgaatcataaatctcacataatagtaaaactaaattttttaaaaagcaatctctaaaaatccaaagcaaaacaaatacatggactaaactgtttatggagtctgctacacacagagatttatttaaagtgacttttaaaagcagttaatttgcctgccaaatccaggtaggatcaaaaaactctaaatttttttcaataatacattattattaacaatattggaattggtattctgaaactatgccatacaagtaaaatataataggataaagaatatatagcatatataggataaagcacgtaatggatcattagaaaccaaaatcctaataagatacaaatataaaatcacagaaataaatatcctataatccaaagtaaaaattagaaattttagtaatactttataagcctaaacctgaaaatcagaaatttcagtatttactcattacgaacgttctagctctgcccactgaaaagactttgtaaacagcgacaaagactactgggggctgtgtctcaaagcctcaaaaaacaggaagagaaccacaataaccaaagatggaacaatctgagcatcaatgaaaataactataatagatcaaaacacatcaaattatgtttaaatccatgagtttatcataatgtacacatacatataaattcactggtcaatactacgaaatgatgacaggaaaccactgattttgaaaactggtaagttaatggggaaaaatgtagtatttatcctgcattttgtaaatgtacaatccatactttcgtgaaaccaagaaagtcatgactggaatttttttctaaaatataattccagctaataaatgagaaaagaatgataaaacatcatcactgcccctaatgaaataatgaatctaggcaataataattaacagctaataataatcacaaaaagagagacaacagaatattactgtctcctgatgggagaacagctatgaaacagtcttgccaaaaagaatcaaatctgaactggattctctggctataactaccagtttacaggaaatacacatgtagaaatacctgtgacaaatgactagtttcttcaacaaataaattgcaagaaaaaacctaggcaaggaagggaaatctatagattaaaataaaccaagttcagtatacgaattttacttggatcctgattagaatgatacaagctttcaataaaatgtcttaagacatttgggaaaatttgaactctaactagacatttgatgactgtggtagacaggcttttaagatggccacaatgtttcctgcttcatagtatttaggctttcgtgtgatctcccaccttgagtgtggcctggacccacttctgagattaggttacaaaagactgacttgtcttgttaacacactctcttctcctgtcttacttgtttactctgatgaagcaaactgccacactgtgaactgccctatggagaaagccatacaagcaaggaattgagggtgacctttggtcaagagccagcaggaactgaggtcctcagtttaacaatacatgaagaactaaatcctaccaagaaccacatgagccagcttgggaagcagatccttccccagtctagcctcaagatgactgcaggccctgctaataccttgactgcagccttgtaagagactcccagagaaaccccaaccagagtcatgcccgaatcctgactcacagaaactatgagacaacaaatgttgcttaagctacaaattttggggtaaactgttttatagcaacatgtaaactaatacaatggtattaagagcttgttacattttaggtgtgaaaattatattgctgcttcaaaagatattcttatcttttaaagatactactaaaatatttaaggatgatataatacaatgtctgaaatttacatcaaaataatttggcagttgggggcaataaggaatgggaagaagatatatgaaacaaatgtccccaagagttggtaactgatgctttctgatgggtatgtggggttttgttacacaattctttctttgtatattttttaaatttccatgattttttttaaaaagtagagcattaaagacaataattaaaacaaagtataaacaatattaccataacaaatgagccaaaaaaaaaggctcataacaatttttcttacagaggacatttacttaccttaatccctgcaagaacaagattctttgctagaaaggcaaaagaaaaaggaatagctcaatattgggaatacacactagatatgtcttcacagagcttagtcacatatctgactgcatacttttaacttctttttttactacttaatacaagttccttgtcttaaaaaagttacaaaatacaggttaaaagtgaaaaaattaaaatgtgcataatcacaacacccagagataatcactcctaaaatttcaacgtattcttccagatatgtttttatgaatacagtatatgtatgtgtgcttataatgaattaatggatatagagaatgataattaatggctattaacatcacaaaaagaagcaatgagtcattattggttctttgtggaagaatataacatcacgaaatagtcttgacaaagattaaaaactcaatctgatcaacattttggatctaacttcctttataggaaatataaggggatgaagttaagttatttaaactatcttcattgctcaaaagtgtcaaaaattaggaatataaatattgcttaccaatttccaaaccaagaccacccatcccacttaagaaaacatgggacttggccatcttctgcattgctgtgtctccaagaacgtacctctgtcgactacacggaaaacacaataaaaaacaaaaaattatttcactgaaattataatatctcttaaagttgtttgcaaactaaaagcctaggaactcaatccggcccacagacttgttatgaatgatttgcacagtgtttaaacatttctgaattaaatgccaaatatatgacatattttgaaaaatcagataatttggcaccacaatccatattccctcaaggcaatagacagatggaggtgagtaagagttgccctgtttaggcaggaggattatgtgctccagatttgccacaatcaattccttcctgttcctctcatttattacctcagtggccactataagcatttgagtttgccatttccaccttaaaactttcactatcaacaggatttctgaggcaacaacaacaaaaaaaatttggttctcttcttggagttcagatgttatataaaggaccttgttaagttatgcatcctaatagccacaaggtagtaacaggatgggaatttcaaaaaatatacgttagtaatttaaaagtctgatatagtaataaagtcaattgtaagtgtttatctgaaagaacaatgagaaacttgatgctatctttggagataatataaattccaatgaattcttatgagaaacattttaaagattagttcgatataaataaataatttcagaaccccttgggttataagtatttactttcagaattaacacatacatgtttaatgcacatttgttttaaaaataaatatttaatttccattatttcagcttttcatattcaacataaaagcctgaaaagggatttcttatctagagagacaaaactttataaacacaagctatctttatttccttccctgtttcatacaaaatataataaaacctaaacttttctttttaaattggtactcaagacttttgttttagaaagtaaaaactatccatttacacatcaaatatttattgaaaatctactatagtatgtacgaaagttcttatatagtcttaccacccttatgcgtacccagaaataatatacttaggttttacctgattttagactttgtatagatggaatcactttgagtgtcttttatcttgtttcttttgaatgaaattatttatgagatggacttatactgatgtctgcaactggtcattaatattcatttatattgtattctgaccattcttataaacatctcctggtacacacttaagagttgtttctctgatacaagcttgtccaacccacggtccacaggctgcatgcggcccaggacagctttgaatgcggcccaatacaaattcgtaaactttcttaaaacattatgagatttttttgcaatttttttttttttttagttcatcagctatcattactgttagtggattctatgtgtggtccaagacaattattcttcttccaatgtggcccagggaagcaaaaagattggacacccctgctctaatgtatatccccagagaggaaatgcaggatttaagaatatgtatacttcaacttcattagacagtgccaaactgttttccaaaatggacgtaccaggacagttgtggtggctcacgcctataatcccagcactttgggaggcctacatgggtggattacttgagctcaggagttcaagaccagcctgggcaacacagcaaaaccccatctctataaaaactacaaaaattagcaggatgaggtggtgggtgcctgcagttaagtcccagctactcggatggctgaggcaggagaattgcttgagccaggaggtggaggttgcagtgagccaagatcatgccactgcactccagcttgggcgacgggaatgaaatcctgtttcaaacaaaacaaaacaaccccctgcccccagcccaaaatcaaagtggatgcagcaagttacccttcttttggcagtgtatcaaagtctctgcaatttcacaacctggctgtgcaggcttggtctttagaagggcatgcttacagggctggcccttggttggcacttgtaaacttggctcttgaaatatttcctacactaataaatctaattttcttttttttctagttacctgaaataaaacccattaatatttagattttagtttctcaactactaatgtaaaatgtaacattaagagcatctcaagttttgataagagcacttcattattttcccattttaattatgattctttttttatgtgttaatccaaagtatattttgaaatttctaattttatgggacatttttaagttatcgtttgtattaatttcccgcttaaatgcaatgtgaatagatatcacaatctgtgtaactctttaatatttgagaatttctttggtcaattttacagttgcatgtgttcctgaaaagaatgtggattctacagctgttaaagacacaagatatgcattaggttaattttaataatcatgttgatgaaatctatacctgtttgggttttttgtctgcttgttttcttgattactaaaagcaacatttcaaaaatcttccactacaaccataaatttgtctactgtctttgtatctcagtacctgaactgtgcctggcatgtaataataactgagtttttactatgcaccacatgttgttttaagtgttttacttgtattaactcatttattcctcacaaaaatactatgagataatttctattattattctcatttttacagataggaatacataagcacctagaattaagtaagtagtggaggttaagagtcaatccaggcagtctagccttagcatccatactcttaactattatgccacaatgcatacagattaagaaagccaaatcattcctcaaggtttatgagagagagaaaaaaacaaccatcagttccctgacctaattctttcctaccctgattcccactccccaaagataactagtctcaattttttagtcatttctcttaatatttactcccatatttctaaataacacgtgtatacttttatttcttgattttttgagttttatatattacctattaacttcctactaagaaagataaatgatctttctgaaacagatctagtcaaaccattttcttgcttaaaaaaccccagtggttttctatttcctttacaataaagtctaaattctttagtcacaaggcattcatgaactagtccctgcttagttctctagtgtcatcttttgcctcaggatgaatcatacccaatttagatgagactggacttttttgagttgatgtttgaacaagttcagattttttttactactgggaggtaataaaagtattttgcattatgaggacaaaaatttggggggccaggagcaaatgctacactttgaatgtgtttcccggagtttgtgtgttggaaacttaaaccccgttacgtaggacctaatgggaggtgttgcctagtgggaggtgtttaggtcatgagggctctaccctcgtgaattgattaataccattattgtaggagtggtttcattattgtgggagtgggttatatctaaaagtaggttcagccccctattgccctctcttactcttgcccttctgccttccaccatgggacgatgcagtaataagcccctcaccagatatgaccccttgatcttacacttcctagcctccataactgtgagccaaataaatttctgtttagtcaccaaagggaaaggtactaattaagtgccttctttgtaccaagtaatatgtcaggtactttgcagttaaatgacacttaaatgctgtgaagttcataatgttaacaggtagtaaagatgggattaaagagctgagagtataactgcaagtccagcattgttacattacagctgactcatactaagtgaccatatagcagtgaatgtagcagaaatccctatcgattaaaaattcacccttttatgaaagaacaacatctccctatagtttttacccactagtcttagttttattcccttggggccatagagaacttgtctaaatccttctttgatgtaacacccctccaaacatttgaagatggcattcaggttctagagttttctttctctaagctaaacatctccagttccttaaacaattccaagcataacatcattttgagtccccctcaacattaatcactttcttctggacacacttcattatcttcatcatgcacgcatatatttattaacataccgatttcaagccagtcactcgcttggggttcactgtgcagagatcataataacaacaacttcgtatggctgctacgaggattacatattaaataaaatatgtaaactactagaatccctgtgacatggtactgggagagacagatagacaaaagatgagtggttgcctgaagaaatgaaagttggagtgagaagaaaagaattataaacgggcataaataaaatgtttgggtgtagtagggtgcgatggctcacacctgtaatcccagcaatttgggaggctgaagcgggaggatcacttgagaccaggagtttgagaccagcctgggcaatacggtgagacacccacctctacataaaaatgtgaaaattagccaggtgtggtggcacacacctgtggtcctaccttctcaggaggctgaggtgggaggattgcttgagcctaacagtttgaggttacagagagctatgatcacgccactgcccccaagcctgggcaacagcaagatcctgtctctaaaaaaaaaaaaaaaaaaaaaaaaaaaaaaaaaaaaaatcaaaaacaacctaccgtttttacataaaatctttaagactatgtttttttttttttttttttgagacagagtctcactttgtcgcccaggctggactgcagtggtgcgatcttggctccctgcaacctctgcctcccgggttcaagtgattctcctgtctcagcctcccgagtagctgggattacaggtgcgtgccaccatgcctggctaatttttgtatttttagtagagagggggtttcaccatgttggtcaggctggtctcaaactcctgaccttgtcatccgcctgcctcagcctcccaaagtgctgggattacaggcgtcagccactgcacccgaccaatattatccttaagatataaaatattattattcctatttacacatgagaaactgtgtaaaagaaagattaagcaactagctccagttcatataaaagtcaggattgggatatgaactcttacatctgtctccaaaggccatgttaattctactgtaccaatgtttctctaacaagtagatatttgctgaacatctactcattttacatttaaagtatgtagttgtatgcagttaaaaatgaaggtcttgaacttggaaggaaaaatctgaagagagactcaaatatcactaacataaagagatacctaaaatcatgggaataaatgatgtgaactagaatatgaactaagaaaaatcctcataatttagctcccagtcataagttagaatatgtggtatttggttttctgttcctacattagtttgctaaggataatcgcttccagctccaaccacgtccctgcaaaggacatgatctcattcttttaaataatcagtaccacaaacccacatgacgcaagtttacatatgtagcaaccctgcatttgtacccctgaatttaacagttaaaaaagaaaaagaaaaatcctaaagttggaacctggcatttatgatgcaggaaaaaagaatttaagaaaaatatctgagaaagaagagtcatagtagtaaaagcaaattcaaaaagactggtattccggaagctagaggaaagcgtttcctctaggattacactggaataaaaggtttagatgcttaaagtagtattacatctaaagacctaggaatgtcctgattctgctttgatattaaccctttcttcatatagtgatctctacaaaggaaattatatgcaaggaagaacagaatagataaaaataccatgttattatcatctgaatcagccttaatcacattcaatggagggtactttcataaaagcagctagaaaaccaagcctggagtcctaaattgggactcattcatttcttcagatacatcttgtgatcagcagactcacgcacatcttcagagaaaaagaaagaaatggccagagaataggctcaagtctaattcacctaacaataaagaccaaaaatagagagaactcagaataccatcagaggtagtaaaaaaataaaacccctctgagagagacagaatgcagaatactatcagaggcagtccaaaataaaacccctttgagagagagaactcagaataccatcagagtcagtccaaaataaaacccctctgagattctaagaaaaagtttagaatctgttgatcagtaaactatgaggtggcttaagattcagtagtaataagaaaaataaaatttttctccagaaagatgctttgttcaactgggtactaaaattgctctaaaagatatttcctagttaaatatatatgtacaaatattaaaaacatcttagttgatatttaagatttgtagattttttgaaaggtttcgttttatagggaaatctaattgtttagaaggaaaattataacctaagatgcagttatttatgcctgtaaaaaacctgtgtatctagtaaatactaactaaatttcaataatagcatccaggaaaacaaaaacaatactggatatttactagatttcaattacacagagttcctgacttatgatggtctaacgtactgatttttcaactctacaatggtgcagaagtgacacaccttcagtagaaaccatactttgggtacccatacaaccgttctgatttttactttcagtacagtattctcaataaattctatgagatattcaacactttattataaaatagtctttgtgttagatgattttgcctaactataggctaatgtaagtgttccaagaatatctaagatacgctaggctaagatgtaatgttcaggttaggtgtactatatgcattttcaacttaataatattttcaacttatgggtttatcaggacataactccattttaaatcaagaagcatctgtatagtatacaagtatctaggaggaaataaacaacatttgaagtatcaaccttacatatctcaacatataagatgccagaaagttacactctttaattttcaggaaaaatgaatttacatgtatctgggctgttataaagacactcatttgctcaaaatgccccaaatgccccaattcctgagaaaagagaaatgtttgtttctctatctaacttttttggctgtcagaattttccagatataaaggatggtcttattgtagcagcttcatgtcagaattcagaagtcagggaatgtggtacctggccagtaatactggtttttgcttaaggatggaatgtgtaagtgccttcttagtatcatcacttcttctattgttagtaccatctgcacctttttcagacttttttgtcatatccttagttttggttcctgccaactacttaggcaacgtacctagtcttaggttccagactacaagccaatctgaacccactgtcttccctaatcattcaataatcatttaatgagtatcttctaagactcagacactgtcacagtctacgacttagaaaagctcatggtctgacagagttgacatacatgtgaacaaatactatgtgataatgtgcttatttaatagcaataaaaataagatgctttagggctaagcagaaaggaggagaagtaactcaggcaagatatcacagagcagacataggagtgagttcttaaaggatcactggaaggtatttttgaggcacaaaagagcattacaggaacagacagttgaggtaaaaaggtataaactgcaattacctatcttatctttgataaaaaagtagtctagtatggccagtgtattcagaggaaaaggtggttggggccttcaataaatggtgctgggaaaactagatttccaaatgcaaaagaatgaaactggacccttataccatacaaaataatcaaatcaaaatgaatcaaagacttaaatgtaagatctgcaactataaaactcccagaagaaaacaggaaagaggcctcataacactggtgttggcacagatttcctggataacaccaaaggcacacacaacaaaagcaaaaattgtcaagtgggactatatgaaactaaaaaccagtaaaggaaacagtcaacaaaatcaaaagacaacctacagaatgagagaaagtatttataaaccatgtatgtgataaggggttaataatatccaaaggaatgcctataactcaataccaaaaaacccctgaactgacccaatttttaaaaatggacaaagagtttgaatagatctttctccaaaaacatgcacatagccaacaagtatatgaaaaggtgctcaacattcactaatcatcaaatacaaaccaaaaccacaatgagagatcacctcacacctgtatggatgaccattataaaacaaaacaaaacaaaacaaaacataacaagtattggcaacaatgtggagaaattggaacttttgtgcactgttggaaatgtagaatggtgcagctgccatggaaaacagtatgaagcttcctcaaaaattaaaaaatagaattaccacataatccagcaattccattttgggttatttctccaaaagaattagaaacaagatcttgaagaaatatttgctacacagatctgctatatgacaatgtacacagagttaaaaatatagttgtcccgtgaacaacatgggtttcaaacacacaggtccatttatatgcagatttttttcaataaatatactgaaaatttttttggacatttgtgacaacttgaaaaaaactcacggatgaactttgtagcctagaaatacccaaaaattaagaaaatgtcatgaatgcatgaaatctatgtacatattagtctattttatcatttactaccataaaatatacacaaattataaaaagttaaaatttatcaaaactatgcgtacacttacagaccatagatgtcgccatttgcagttaagaggaatgtaaacagatgtaaagatgcagtattcagtcataagtgcataaaagtcactgtagtacatactgcactactgtaataattttgtagctacttccagttgctattgtggtgagcttaagtgatgtatctggttaaagcacatgtgactctattcatctttgcctgagcagttcctctctccagtaaattgaatattgcaggaaaaagtgatgtcttgagattcttgcatattttttcatcatgtttaatgtgcaatactgtaaaccttgaatgacatcatgggacccatacaaagtgccaccagtaatgttgcaagtgctcccaagaagctgagaaaagtcatgacattacaataaaaagttgaattgcttgattatgtactgtagactgaggtctgcagctatggttgcctgacatttcaagataaaatgaatccagtggaaggaccattgtaaaaaaaaaaaagaaaagccatcattgtaactacaccagcaagtatgaaaaccttacactttttgtgaaagatttttttatcttatattgaaaatgcagcactgatatgggtgcaggattgctgaaagaaagtcatagactctaacatgatttgagaaaaagcgaagtcattataagaccacttaaagcaaaaagaaggtaaaggatataaagctgtagaattcttttttttccataggttactggggtacacaggtggtgtttggttacttaagttctttagtggtgatttgtgcgattttggtgcacccatcacccaagcagtaaagctgtagaatttaatgccagcaaaggatagtttgataactttagaaagaggtttgtcttaaaaaaaagtcagacacaacatgagaagcagcttctgccgatcaagaggcagcaatgagtttctagacgccataaggaaaatcactgaagagaaaggatatctacctgaataggtttttaatgtagaagaaagtgctctattttgaaaaaaattgccacaaaggacatttattagtaaggaagagaagcaagcaccaggatttaaggcagaaatggatagttaactctactgttttctgcaaatgctttcaggtttatgatcaggactgcccttacatataaagctgctaacccctgagcattggagggaaaagataaacaccagcggccagtcctccggctacataacaagcaggcctggacaagaaccctttttctggattggttccattgatgctttgattctgaggtcaggaagtaccttgccagcaagaacttttaaagttcttttgctattggacaatacacctggccacccagaaccccaaagttcaacaatgaaggtgctgaagtggtttacttgcttcaaaacacaacatctcaaattcagcttctagatcagggcatcataaaggacctttaaggctcattacacaaggtactctatagaaaggattgtcaatgctatggaagagaaccccaagaaagagaacatcattaaagtctggaagattataccattgaagatgctatcgttgttactgacatcagacaatctggcagaagggttccgacgattcaagattgcattgatttctttaatgacatggacccttctacaacaggggcaccaaaaagaaactaaagaaaatgacaggaggatcagtattgtatagaaacatttttccagaaatgagaaagcaaaaaaagtcacatagtagttacatatttccatagttacactgtgtgtgcctgcctctctttccctacccttctgcctccacctcttttgattctgccacccctaagacaacaaaaccaactcctccccttcctcctcctcagcctactcaacatgaagacaacaaagatgaagacctttatgataatccagttccatctaatgaacaataaatatattttctctttcttacatgattttcttaacattttattttctctagcttactttattctaagaatactgtgtatatatatatatacagtatataatacatataatattaaaaatgtgtgttaattgattatttacattatcagtaaaatttccagtcaatagtaaggctattagcatttaagctttgggagagtcaaaagtcatatgtggattttcgactgcacaagaggtagggtggtaggggagttggcactcctaactccttcattgttcaagtgtcaactatactatactacacacttaaaaacttgttagtagggtagagttcatgttatgtgtttttactacaataataactttttagaaggtaagttggagttatgttcaaaataactcggtaagctatagtatttggacttgtactatgagacaaaatggtcggaactgtggctgtgtgaaagagaacggagagaaaagagaacttctggaatttatctttatcttaccctaccttcatcaagcttactgatgaaatctatctccctgagatattaagaggctaaggatcctcatttcatgccttgtccctaaaataaatcattgtccaaagtcctaggtcttatactagtccccataagcaacagatacagatttttaaaaagagaaaatacagctgggcacggtggctcgcgcctgtaatcccagcactttgggaagccaaggtgggcagatcatgaggtcaagagactgagatcatcctggccaacatggtgaaaccccgcctctactaaaaaaaatacaaaaattagctgggtgtggtggtgcatgcctgtagtcccagctactcaggaggctgaggcaggagaattgcttgaacccaagaggcggaggttgccatgagccgagatcgcgccactgcactccagcctggatgacagagcaagactccatctcaaaaaaaaaaaaaaaaaaaaaaaaaaaaagaaaaaatacaaaactaccaaatcttcagattcagtcactataaaaaaaaaaaccctcaaacatttaagttaatttttaaaatctaagaaaataagagctggttattgtgtgaaaatctcacattttggcattttggtctttgtatttctttttttttttttcttgacatggagttttgctctgtagcccaggctggaacacagtggtgccatctcagctcactgcaagctctgcctccccggttcatgccattctcctgcctcagcctcccgactagctgggattacaggcgcccgccaccgccaccacacccggctaattttttgtatttttagtagagacggggtttcactgtgttagccaggatggtctcgatctcctgacctcgtgatccacccgcctcggcctcccaaagtgctgggattacaggcatgagccactgtgcctggccacatctttgtatttctactaagaaaacctatatgtagtcagtaactcttttagtattccctaataattcactcttttagtacccacataaatttctggcttcctgccctcactatgacaaattcttaaggaagatattaaaactcaaatatgcacattggtaaacaactagatgtttgcaataagacacgcataccaagtgctaacagctacaccaaaagatactctccgtcaaacaaaagaaaatggcttacctctaataataacagctaaactgctatattctataactctcagtaaagcaaactgcagcctacttacgtagcattgtaaatggaaagtttagtcactggcctactgaaaattatgtttatcagcattatagggttggagggacattaaaaaagtttcacaaggattaaactaaaaaatgaataaaattagtcaatactatctcaaagaggtgccatttgttaaaccaagaaaaacatgaccaaaaggacattaagaatataattatagattaagaatcccaacgtaagagtcccactctccctttttgcttattatcttcaagccacactgacctgcttgctgttttgcaagaaggcaagcttgctctcatttcagagattttacactatttcttctgcttagaatgttctttcttaaaaatcttgaaatagttgacttcttatcacttaagcctctattaaaatattgtattacaaatatcacacacatcatttctgatcaccctatcaataaaatggctactcttatccttaggtcactgcctaactcattaacctgtcatagtttcttcaaatcacttaccattaactgtttgtctgccactcctatcaaaaaaatgtatggtcttaaaaactcactactgtaatccaaatacctaaaacagtaccaggcatttaataataatagataaccctgtgctacacactgttttaagtgctttaaatgtactaattcagttaacccttatacaacaacttaaggtgacttctaaaccatattttataatcaagaaatcatctttaaaataattttcacatgagcaagattgttagtcttctatctcttttcccaagcatagagtacaaaacaggatttggactcaacatgccagatggtatgtattagctcctaataaagtgcccattattgactctgcatctttttctttactttaaaaagtattcaaatttcatgaaaaagtatagtttaaaaagtctcatcaaatttcattcaaatcacaactattcaatcatacaatactttaattactaaaaaagtattccaatttcctgaaaaagcatagttttaaaagtcccatcaaattccattcaaattacaactcttcaatcacacagtatttctccactgtctataaattacagaacaggaaatattttaatgagattacaatgaagtaatattctctagatgttattgtatgactaaagtgaaatattattcttcatcaactcctgcactatcaagaacttaaatacgtattattgtccaaaaatgaaagggttattttgcaagggcagcaaaatccttcttagtcctatcacctaaacctaaaacaactgagatttaaatattatccgaatgtagataaaaaaaatcacagaaaccctaattttaacttgagaggaactctttatatatatgtgtgtatatatacacacacatatacatatatacacacatatatatacacatatacacatatatatacatatacatatatacacatatatacacacacatatatatacacacatacatatatacatacacacacacacacacacacacacatataattctgcataggctgaatggtatcttcaaagagactacttgattatttgagaacaattaatggggaaaataagtttcagtttctatgagattcttacctatacaatgcatcatcgatttccacagatgctgttgacataatgggcaaatttttatttgtgctggaaaaaaaaacatggttattaaatattcacattttataatgtaatatttgattacttgtgtgatcagattcaccagttactaaaggttttcacaaaccaaacatatattttattaacaaccactttacttatattttttaaatggcctgaaattaaattatcggattgcttgttctatcctgtgtaaattttaagattacagagctcatcatcttttattctcagatctcaggtgttgttttatcactggtacataaatacatatatatatattttgttgttgttgttgtttgtttgtttgttttcttttttgagatgggagtctcactctgttaccgagactggagtgcagaggcacgatcttggcttactgcaacgtccacctcctggtttcagacgattttcatgcctcagcctcccaagtggctgggactacaagtgcacaccaccacatccaattaattttgtaattttagtagagatggggttttaccatgttggccaggctggtcttgaactactgacctcaagagatccacccgcctcagcgtcccaaagtgctaggattacaggcgtgggccactgtgcccgcctgtttggtacatatattctaatggatctgtatttcagcaattctgtaccatgaactttctctatatatacagtcttcccagataaactcattcaatcctattgatgaatatatattgattatattgaaacttatttctccacgtgtgatctttcctctgacctccagattgtatacaactgccaaaacaataactattctgatgtcttaactggtatcacaaacataacaaactccaaagagaattcaattacccctgcttaatctattcttcctgtctttcctaactcattttccgctaccatcatttactgggttgggcctgaaatctagggatcttcttgcttaaatcattccccagttttctccatctgagacctgttagctctaccttcataagatatctcaaacctgatcatttcttactatttcaatcagtacaatctcaagccaaaccatcatcacatttcacctgggctatttcaaagacctagctagtctccttatttccagtattgcccttcccctttattctccataaaacagtctaaatatcttaaaatgcagtcagaaattattccctgaatttggactacccttcagtggatttcctttactcttaaaacaaaattcaaacacctcactatgcttgagagggccaatgtgtcctgtctcccaattatctctccaatttcaactcccaccagtctccgttttcgcttactatcttcaagccacactgacttgtttgctgtttcgcaagaaggcaagcttgctctcatttcagagtttttacctatttcttctgcttagaatgttctttcttaaaatctcggaatagctgacttcttgtcacttaagcctctattaaaatattgtgtcacaaataccacacacctcattcctgatcaccctatcaataaaatggctactcttatccttaggttgctgcctaactcattaacctgtcagtttcttcaaatcacttaccgttaactgtctgccactactaccaaaaaaatgtatggtctgttaaaaactcactactgtattccaaatacctaaaacagtaccaggcatttaataataatagataaccctgtgctacatatttaagtgctttagatgtacttattcagttaacccttacaacaaccttgtccaaacagtgggcaagcactattgctatctccaacgaacagatggaaaaaagaggctgagggaggttaacttaaaatttgcccaaagtcacagagcaggcaaatggcactgccaggatctgaacccaggcagtctagctcttgactaccacacatactgcctactgtttctgatattagacataaaggaaacacttaaaaaaacctgttaaatgggatgggcgcggtggctcatgcttgtaatcccagcactttgggaggccaaggcaggcggaccacctgaagtcaggagttcgagaccagcctgaccaacgtggtgaaaccctgtctctactaaaaatacaaaaattagccagatgtagtagcaggcgcctgtattcccagctacttgggaggctgaggtgggagaatcgcttgaacccgggaggaggaggctgcagtgagccaagatcccaccactgtactccagcctgggtgacaagagcaagactctgtcaaaaaacaaacaaacaaaacaaaacaaaaaaaccctgttaaatgaataaattttaaaggaaaaaaactaatctaaatatgcaaatctgacaaagtatacttattatagtaacatattatttatagcagtgctcgtcccattttcacagcatggccttcaaaaaacgtatctgtactaaacactggcaagcagagataattcccaggtacagggaaccagtctggagcatttggagctgaaccactgtgagagctgagatcaatatactggcagaagtggaggccattcctagttctgagaagctctagttgtcaattaaaagattctaaaaacaatgcgatggcatcaaattcaggcttggaatccaactttctagtcctagcattgataaataagccaaagaatttgtaaacaaaggtaattaaaatgttatcatttatctcaccaaacactggcacatatcaaatgataccagcttctagctaattaaacggatagctattaaaaaaactgattccaattaccaaggcaaatcagaagatagctgtgttctaagagatcacctacctaataaaaaacacacacatacacaatataccctgtttgggcattgtaacaaaatataaaaattaacaaaatttgtttcttttctttttttttgagacagggtctctctctgtcacccagactggagtgcagtggcacgatctcggctcactgcagcctcgatctctctagactcaagcgatcctctcatcttagcctcccgagtagctgggactacaggcgtgcatcacctacgcccagctaatttttttgtattttgtagagacgcggtttcgccatgttgcccaggctagtctaagaactcctgagctcaagcgacccgcctgcttcgacctcccaaagcgctgggattgcaagcgtttgagccactgcgcccggccaaagttttttattatctactttcctatcattttatccctagtacactttcacttgctgttttccttgcatggcgggggcaataggcctggtgggtaaatctgaataaaaacgagaacagctgcagtctaactagctctgccacttaatggcgtgactggcccttttcagaaagttgtgcctcactggaatgtttcaaaaatatgtaaaaataatatgatctataagacaatcaaaaacgcttcaaataaggcgcgggttatattacataatatccctccactctggcagtgttggcaatggcagacaacaccatgaaactgaaagcatcccttcagtctgaaactggcgaaaaggctacaggtttacaaagtctcacatcagctgaaaataatacatccatcaattctatctttggcatggtgtattctgacagtggtggatagaatgtaaccacttgctttattaattatgagatgattgaaagaggaactactaaccaagaaattggtaaaggcctagcacaaatattttccccctaattttacaggggcgggaaagacctgaagaacttcaaaaccaagtgggaaataagaatgggtaacttgtgtatttttttttcctggctttttttttttccttcttccgaagtcaacaaaggcctcagggtgtccagattgctactgattcattcttaccaagttccttctggtaatagttttcaaaagaggatctcagtggaggtgcacagtggcgctcctagctttctttttacggaaaggaggaaaggtgcttggcaccagtcggggaagctcacgccaagtgaccgagaccagaactcgctctcgaccggagccccccaagtctggtgacttggaggaaggaggatcccgaatcccagccagaactgagaaagccctcaaaggtgcggaaaggggacttttccctcaggaaagccggcaacagcagaggccctagcccacgtcgccacacccactccgcgcgcgcccctcgcctcccagggccggctctgctcggccccgcggcctctcgggcgcccccagcccgccggaaagaaagaagcagaaacccggagcctgggtcccacccgcgacccctcaccttcgcccttctcgtcctctcacctgccagtcccccaggaagaacaggacgcctcttccccctgatgggcggccacaggctcggatccttccattgccgcctgagacaccgccgccggctactggaaggtaggaaggggcgggacc

SEQ ID NO: 1667 - DNA, 11013 bp, Homo sapiens
tttgcatattgcgtttattttgcagaaaatgctttctgctgattgtctttggctactttgtcaaaagaaaaatatgaaacagttatagtttaacaacacaagagattagctacatatgcttaaaatacacacattctagggggcagagcagtcaaattttcaattcaactaaaacctgctgtcctcaactatgattttattctgtccttaacagctcaactctaactacttgaaagcaacaaggaagaagattaagagtgtgctttttatctcactaaagtaggactggtggagtttacaaattctggtgtgccaaagttgccaatacactgtatgagaaataaaccaaaaaaagtttctggaccctggcaaacattttttcaccgtcagtgaggttgggccaactgcatcatctccacagttgggttcatctgtaagccacctgggacagcaccgctactgcaggtgtgagcaagggatgctggggctctggggaaaggtgccgtgtgctcctccactgctttgaaaaggaagttactgaggctgcatttccttcttaacctgagactgccactgggtacctagtaggtcaatccagtcaccactggctgccacgacaaaaagtcactgcatctttcgggacctgggccttgctgcttcacatggaaggtggcgacacaggtgtccatgaggctatgaggcggccttgggctgcggcgtcgtactggctgtccacgatgtctgtggccgcggccgccccttcgtacagtggggatcccgaggaagagggcgccgagaccggatgggtgaggggtgtgtagtgcgcgggggagccccggaagaactgggcccccagcccgttggacacggctgctgcctgggagcccggggtgacggcgccgttgctcacagaccacaggctggggtactgactgcaacagaaagacaccagtgagcagggcctgggcaggggctgcaggccagctaaggatggaaaaacacaccagaaatcccattcggagtgactgtgtaatatgacagttttcttctttcaaacaggtcattttctccaaattattaaaggactcacaagcacattctgtgatgtatagaagttattgtcgtatctattaataagaaacaaaatcatcaggaagatgactgaaaagattattcacatattcagagctcatgaaagagcgctgttaagtttcactgcgaaagactcataccaggccagccgcagtgggtgatgcctgtaatcccagtactttgggaggccaaggcaggtggatcagctgatgtcaggagttcaaggccagcctgactaacatggtgaaaccccgtctctactaaatacaaaaaattggctgggcatggtggcacatgcctgtaatcccagctacttgggaggctgaggcaggagaatcgcttgaacccgggaggcagatgttgcagtgagctgggattgcaccattgcactccagtctgggcaacaagagtgaaactccgtcaaacaaacacacaaaacagaaaagaaagactcagaccagtagttttgcactctcattcagaataaaacttttcagatagtctcaaccaaaagttactgaggatgggcttaagtacacatgtttttatctaggacaccccacccccaccaccgcagtgattctcacgatgaagaccagcctctcctcaaacactaagcagcagacattccttagagtaactccagtacagacacaattccctgcactttgtcctgttcagtacataggtgtgctagcatggtgcccagcagcaagaaaagcacctggcagtcagactaggaagccattcccagttccgcctttacctagctgtgtcacattacactttgcctgagactacttataggctgtgtttctcaaggcataaaatgaggaaggtggaaatgactattgaattctccagtctaagcacatggaagtggatagcattcaattatggtaagattttattttgggaaataaccttgtctttctacaagtgaataatgagaccttatgttgtatcaccatactgttttaaacaagtctgagttaatcaaggcagatttttatgccattttacaaatgaaagcttcaggttctaagatgcccaattagagccacactgagaccctcgggtggggcctctgtcaacagcttgcagtgtgcgggtcatctgatcgggtgcaggcttctggggcgatgctcttggagcccctgaaagcttcgcttgtttacgcattgttgctctgtttctaaccgcgggcaattgaattcttattatgaaggaactgttttctagacaagaattaagatcgcaggcatattttggtattctagaaaatgaagtgcattgcctttgaggtcaagatcacttaattccaggctcactctgctgtgagctggtccaatcatttaatatctctggccctccttcctccctagaaagtgagggttgacttctagctttggtattttaggtttttatattcatcctatgaagaaatgtaagacatttaccagcctgcttaatttgtaagcctttttccctctgcataacttgcaagttggtaacaaaatagtcatcattgtttaccagttacctagcacatatattaaagacttcgagcctgtatccatagaaaagccaataaactcatttccttcatttactagcttttgttggaaaaggttccgaaacgatctctttaagctctacctactgaccccaacaaccctgtaggagacaggccgaggctgggttatttttttaccaccttccttttatatgtgaggaaactgaggcccagagaggctaaaagacttgtccatcacgtgaaccagtaagtggcagaaccaggatggggaccctggtttcattcagggatgggatagcgcagctcccattccacacctgggttgtaaaggagcccagtccttccagcgaacagactgcaaacaggaactcggcagtcatgtcacctgcaatccctgggcatagctggctaataaagaattctaaataaagacccaaccacccacagggaccaaggagaataaggactaagggcctatgggaatggaaacagcgtgaagtcacaggcagagctcccaggatgctttgcaccaggtcctggacatacattacctggagctggtaggtgggctggcattgtggctcacggggagcatgctgggatgggcaggcattccaaggctggaccaattgtcatgggattgcagcatggataaacatgcaggtgagttgtcagaataggctaaggggggaaggtaacaaagtgcaattatagatggtgtcttccaagaacaacaaagtacagtgaaataccaccaataactgaagctacgtaacactgaaaacaaaatgtacatgggatattaactgtagaaaacaatccattagtctatttacatggttatcaggggcaagatttattgccaaatatatgtatttgaaaacataccctggtaaacccaagctttttcccttatcatcattatcagtagatgccctgtagacattgaatcttacttacaatcactgacttggaattacttatctttaaaaataaatataactttaccctgcctttttaccagtgattacttcataagaatgggcgatagaaaccattactccaggcaaaattagaaataagatcttcctgcctcagagtctagcctctggttgaacaagtcccagtgacttcctaacccaataaggtcctttcatttcaaatcagctttaattgcttaattgttttatggtattctttagctattttccttcttttggagccagacaaaattaagtctagacatatacagtgttatagagagaattaggccaggggatctttatggtctatcccagtgttcctaatattggagcatgcatcggaatggcctggaaggcttttaaaagcacactggccaggcgtggtggctcacgcctgtaatcccagcactttgggaggccgaggcgggtggatcacgaggtcagaagatcgagaccatcctggctaacacggtgaaaccccgtctctactaaaaatacaaaaaaattagccaggcctggtggcaggcacctgtagtcccagctccttgggaggctgaggcaggagaatggcgtgaacccgagaggcggagcttgcagtgagccgagatcgtgcgactgcactccagcctgggcgacagagcgagactccgtctcaaaaaaaagcacacattgccgggccccaccaagagctgctgcctgtcagtctggggtggggcctgagactgtgcccactctcgggtggtgctgaggctctggcctgggcaccgtatttggagaatcactggtgtagtcaggaattcttgagcctggctgcccatcattgtcactttagagaggttcatagaagactcaaacctgggctctcctcctaaggatcgaccatggttctgtggagaggcccaggaatctgtcattttcaaaacctggagcagcagctctgaggcctgtgcaaggatgcaagcctctgatctgggtgtccgtggttgttccgccagcagcggcagtggcggagacataaattgaagatcttctcttgagctactaaaaaactgggcttgggtatgtgttccagaaaaccgtctccatttttttagattctagactcctgcagaatgcctttcccaaagtggtcttgcagccacccaccaacccctggcagaatgaggctgaggactcacttggagaattgttccgatgagcataggggctggggtagggtgaggaccggtggctcctcagggttgggtacctgtcacagctgtgcgtggaggggagggagagggcacctccaaactgaggatgaggatttgcaggtggacacagggtgctggttccaggaagaagccacccccctgctgtgagaaaagacagtgctgagtaacctgcattagtgctccctccatctctccagagagcagagcccaggccagggactgtccctccatcactccagagagcagagcccaggccagggactctccctccatcactccagagagcagagcccaggccagggactctccctccatcactccagagagcagagcccaggccagggactgtccctccatcactccagagagcagagcccaggccagtgacttcccaccttcccctcaggggcccctgatgggggaagcaccctgagtgtctcatacttaggacacagtctgcctcacaagacatctgaggccatcagccccacactcactaccacaggtaacccaaggcttccaatcctgtgtgtacctgagtaaacccaggagcctggcctcaggcaacctaagctgtttcctcctgagaatcctctggattgctttgagatctactattccccaaggcaggtgagctttcctccactgagcatgaatacaatgtaaccacaggcagagagcaggtgagagatgctgagagaggtggggtggtgcttagacaagggtgccctccccttctcctcctgccacccacagagacgggaggtgccttcctagctgggggtagacccttttactgctcactctcctggtttaagctccccccattctccccaggagaatcagaaagttcttccaagactccccttccttcctctaaaactacaatttcttgtccactcatttttttctcctctgagactgggagtttcattctgtcacccaggctggagtgcagtggtgtgatcttggcttattgcaatctccgcctctcaggttcaagggattctcatgcctcagcctcccaagtagctgggattacaggcgcccaccatcatgcctgacaatttttgtatttttagtagagatgaggtttcaccatattggccaggctggtctctaactccctgatctcaaatgatccatccaacttggcctcccaaagtgttgggattacaggcgtgagccaccgtgcccgtcctcttctacactcttcaagctttgttgttttgattgagaaaaagcaacccctagcgggacaactactgtggcttcaatttccaaactactaacaattctccaggcagcactggaaggaagggtgcagacgtgccctggctgcccagccggccctggccagagcagtggctcactctactcaagtgactgcctttctggttgttcaatcagcctaggaaatgatgaaaaatctacagaatagaaaatgcctgtgtaaggaggagtgtgccctgttgattcatccagcctcttgaccagccagtgctaccgcgttcattgtttaatatctccaagtcccttccccgggtggagaggacggaccaggatgagagagagcgtttctcccaacaaatgctgccgtataatcctctatcctgcactctgactcctgaaagtcctagagggagctagacttaaatccaactctctcatcctcagagccacaggagctggtgagacattcctagaaccaaagggctaaggaaaaatttggttcctaagcatcattggaaagatggctcttcaaccattaatgaaagcctcaaagaggaggtaatgagctagattctcctgttgcctacctaatacaggagagtccaaacacccagctaggtctcaatgatccaccccaggcatggtggcagctgcctcacggcaaaacaaaagcacccaggagagtatccacagccccgattagagcagaggttagatgggcaacacagcttcaacatcacagggccaagagcctcgcatggcaaaaaggcaatcttacatcccaggcacacccagaaacacccttgtcttctccatctccacttcccagctctcagcaagtctagtcccgatgacgcagaatgacatgacagagtgcaacaaaccgtacattgggagtacccaggttgctggctgtctccgggttcctccatcatctctttgtgatcacttctatcaaaatgaaaaaaaaaaagtatatcgaattttcaaaaataaggaaattcagaaaagagtatgtgcagcaatatttcatctttctgcatacttctttgcccaagggtatttatagttagaattctctcacctttcctttgcatcaaggaaagcttttgcaaatggattgtacttaattttaagagctgtgatctgaaaaacaagaaattgcatttactagtatattccctattagccaggggatttaatttggcaccaagaaattgagaaatgccagtaccacttttaaatattcaaatataatcagacttctttccacatacagttttctatttggaactgaaaatagctgagtaattgtacagagtagcatgcttatgaaaaattttcaatgtcaatgttctgagtgggattcacaataaatttaacctactactaacaatgttccatgtgtataaatcagaaatggctgaaaacacagtctggggctgcttaggaaatagagacctggaagttctagttttcggtcaacgtcaacaccaacaaggtatccaactaatgtcgaatttgcagtactttggggttgggcttaggcatagatttacaggcacctatgcagtagcttgtatctagttgagtcttcacactgcagagatttgaggggttgcccccccaccctttggggaagatttccaaggaaggacatgcccctctctcactcaagtcttgttctcaagaaattctcacaccatttaacctgaatgctttttggatcttttcattttgagcattgagaagttgtttctagttttaaacacttgtatggagaattcaaggggaaaatgtttgaatggggacttaatttaaacagttctctcctgtgcttccatttcaagttccggaatattatttgaaagggcaggaagccttcctctcagtgcgggttagcgcgtctccccgctcctccagaatctccacggagcagcacaccacaccgcagcacaccgggaaagcgatccgcctctgtccttctcacctcctcgttctgataagcagtcaccgctatgaactgggtctcagggaagcagtggctggtgatcatgcgctgtggacccccaactctcactatgtggattcgaggctcatacttatgcaaggagttcagcatgatctgagggagacagatacaggattggtggcactgaaaggcctgcgttaaaacagcaaaacatccatttctccaggatgcagaaagtcctctggatcccaagaaagtgtctctgctgttgagggaagtggggttccaccaggggaggcttctccgcggtttatatgtgctattcccacagcttgtttggaaaagggatgtgagatgctacacaccattaaaagcaatgaatgctcatcacaaaatcctttcacctggtggaataaagtactaaggctttcaggaaggctatggtcatttttaaaagactgagcttgtttgcaacttgcctaacctggggtcttccaggaacaatccccgactaaagaatgttctttagaaaagcacgactttacaagtttgttccgactccacgcagtaagtactgtggcgcatgtttaaatttaaatgcgactttgccatcaaggctgatatcttttccacccccaggagagtttagggctagacaacggaagttccccaaaagctccagtccttcaaaggggagtgctcccgctccccgttcgccaggcgtggatgttatcagcttagtataaacagcgctaaaggccttattagagaaggctgtggcagtttctccagggcagacgtcgcctcccgttcaagcagcgtcccttcccacaacccccgtgcagaaggcgcagcgcggccccctcctcgctggtcccagacctggcgggctcctcacacctacctggccccctccgttgagcttgttggtgagcttgactttgctgaaggagacgggagccttcatccagtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctcctggaaaacacggggcgggcgcaggaggaccccgacactgaccaggtaggccggaggcagaagctgggcacagaggcctcagttatttcggggcacagaggagccccctggggaacgtccgagggtgactcccaagctcccccttccccgagccctgccaggtccaggtggcctcctcaccatctccacggcctcgggagggaggggaggagaggacctggcgaagggtttcagtgcaggaggccacatcccgcggggacaggcggggaccagggcgcgcctcgcgggtcccgggatgcctccgaggtcgggacaccgaagtgcgcgttcctcctccccaagcttccgcggagaaagccccagaagaggggcttgtagaaatgcactcgagggagttaaccagagcgggaacaaacacaaagccctcctccaggagaaaaagggttcgacctccgggaacttgccaggtcccccaggctgcccaggcgctggagagcgcggcgcgcgcgggctccggacgcgcacccacctgccgttcttggtcacgatcatctcattggtgagctccttgaagcgcagccacagctcgctctcctccaggcccacgcgcagttcgcgctctgtggggtcgcccttctcgctgcccgcctgcagctcattctccacggcgctcagcaggtggtccactcggtactgcaggctctttcccgcgctctcggtgccaggggagctcatcctcccgtccggctcccctccccgccgtccccgaagcccagactcgctacctgagatccaccttccctgctcttggccgccgcccttccgagaaaaggggccccttggaccgagacctgcgacggctcccgggtcccgggtcccggcacagacccgggaggagggcgcggaccaagacttggggggaggggacgggggcagaggggtggggagaagttattccacttgaactccccaaggctctactagtgtaggtctctggggaccgaaattcagtgccctccccataaatagagccgcggcggcagcgctggggtgctcggcggattgggccgcgcacgctttgaagtgccgggcagcctcccattggccgagagcggccatatcagacccagccgggcgggtctgggaggccgggggccaacaatgggctcccgcacgcctgtttcatgtaaatccggggccccagccctgcgagccccggcccagcccctacacccccgcccttctccaaatgtttgcacctccatcaaagcggcggggcaagccccggaggaaggtaagctggacgccccggcctgccccagcccgccccagcccgccccagcccgcacttccgcgaggggctgcccggcagcctgcgatgctccctgattcccgcgcggggtcctcctcgctttcccagcgcgcccggatcccgcagccgcgccaggctggaacgttcgcgcggcctcacctgtccccgctccaggcgcgcctccctcccctcccagggacgagcgcatttggccgggctttgggatgcgccgcgctcgtctcgccgcagtagtagtgctgttctcgcgcctccgatgcctcaactctccagtctggcagtttccggtgcacctgtccccacacgtccctcgcccacggagccccaggcggcgttacgcacacccaggatcgtggatcagcctgccccggcgtcgggtgtccccgcggctctcaccatctggaaaaggaaggtccgcgcgcagagagggaaatggacggaaataagcaaaagcaaaacaaccccttctgagaagtgtcctcc

SEQ ID NO: 1668 - DNA, 11013 bp, Homo sapiens; identical to SEQ ID NO: 1667

SEQ ID NO: 1669 - DNA, 75064 bp, Homo sapiens
gacggttcctatataacgtttatttctggaagttaaagtagatacagcaatataccaaaaaaaaaaaaaaaaaaaaaagacaaaaaacctcacaataatataaatttttacactatgaagtacacattggaatttgaatgcagtggccaggacagcagcttataaaccaccttataggtaggtaagcaacccacgggattccctcggctgggctggggatggggagggggcagtggacaggaagcgggcagggcctgaggaccctgttctttaatgggccacaacagggctcagctcctctcagaacttttgctacaatcagagttaagaccagatacatgctacctaaggccatgaacttgacaatatctgctccagagaagccctgaaccctcgccctaggtccctatgatttaaacccaatggtaagcccaagtctcacctttctaaatattctgtttatcagttaagcttattatgtactgaagagtgttgctggagaagtaagagctctgcatgacacatcaactgtctccaggcaggaggactggggcgaaccctgttcatcttagagaaggtcgtctcccccttaattcagagaccagctaatttgatttaacaaacagaattccacagaaactctgatcagctgaggcaaggtggttttgagttgccaaatccggccatgcctctgagtcagaggcagcccatccagcacgtgctaggtgttcccatacgcacaggagaggcgagctagccagccaaggcgggcaggcggggaggccctctagctgttctgcctcacctgtggggccccagcagggaggagtcaccagcctcagagggaggccaggtatacaccctcatacgagggcagactcaagtttatcagtaagcctttgccctgcatgaactgaatgaagacgccattacaagtgccactggatatcaccaagaaactggctaagaaccatattccctgagctcaaccagacacgtcgctggggccccatagtgtgcatcatgtccaacctgtaactctctccccctcttcttccatgaggtcctgagaccaggattcctaaaacaaacaggatgagggacctttagacacgcaaggagacatgcctctagcaggatcagggggactggggtcgggagggtggggcaggaaggaagccagaatcagaagtatcccagccctgataaggcacccacagaaacaacctagcctctgaaacagcagatcaagtccagggagaaagggagtcaaggttgtaagcaccctctgcccagccttactcactaaaaggccaatacattacaaaggaaaataagtctatttataaaaaaaagtctaaaatgcttagattctccttaaaccttcctatttcaacaccaaaggccaggttgcagcttcagatgtcttaagggtttgacctgaagcccgtttcagggattatataaattaccagcctgaaggaagctgaatgcttaaagcaccaaggaggctgttaactgaagtttcttttttttttttttttttttgagacagagtctcagactgtcgcccaggatggagtgcagtgtgcagtggtgcaattttggctcactgcaacctccgcctctcaggttcaagcgattctcctgcctcagcctcccgagtagctgggactacaggcgcccaccaccacacccagctaattttttgtacttttagtagagacggggtttcaccgtgttagccaggatggtcttgatctcctgaccttatgatccgcctcggcctcccaaagtgctgggattacaggcgtgagccaccatgcccggctgcttaagtttcttaaatacagaaaggctatgctgatacagtgttttttgccctttaattgttattatttcttaatttaaaaagaaacctagggcttagatagtcctatcttctatttggatgtcagcaaggttaaaaagtgcaatgccaggagtatgtagctataggtggcctgtggcatttgcttacagaaacaggcagaaggatgccgcaggcaccaggaggcacttgtctaagaacaacaacaacaataacaaaaagctgctgagaaaggagggcaggggaacaaaacaacacaagacatttcctttttctccctctagccaccccccgccacatcccctgatcatgggtctcagagaacacatccttatttgcatttagataaaagcagatcacccacattcactcatttctctatttttaaaagtgcccagattgctcaaagatagcagaagtaggagattaaaaaaaatctggaaccacaaagttagtagtttcagatgatctggggtttggctgtgtgaggggtggcagaatgcaggtaggcgcctcagtcgtatctttctgcagcttccgttctcagctcctcacatgggggaggtagcgcactccgaggtcaactccatgtcaaaggtgagggactctggagggacagacagggaaaactagttcagttgtccaccctctgcaactggcaggccacgcccccagcccttcagaggacagggcccaggctaccactgctatccaatctcctgccccttaaggcccagggatggtcagaaaagccagatttaccctcctccctggaggaccctgcctcgggaagggtcctttctcattcccaccttaactgattcccagagctccatgtttacagaagctctaaggctgtcctgagatcttctgcccttgatctactgtttaattcaggagccccgagacacacgtggccaccaagcatttgagatttggtttgtccaaactgagctgtgctgtggctgtcaaaagcccactggattttaaaggcttagtatgaaaaaaaagaataaaaaaaggtctcaactttttctttttagtttagttttgtttatttgagatggagtctcactctgtcgcccaggctggagtgcagtggcacgatctctgctcactgcaacctccacctcccaggctcaagcgatcctcccacctcagcttcttgagtagctgggattacaggtatgcgccaccatgcccagctaatttttatattttagagattttggtcagactggtctcgaactcctgacctcaagtgatccacccacctcggcctcccaaagtgctgggattacaggcatgagccactcacccagcctcaactttttctgaaatgttaaattgagagtatgttggatttagtgggttaaataaaatatattgtaaaaattaagttcgtctatttccagtgtggctgctagaagatttatactcacacatgtggcattcataccatctcttttggaaagcaaagctctagaatctcctaccattccgagtgaccagctctcggtgtgtacatgtgagagcatcacacaaaggggaccaacttcccttatagggacaaagtctgtcaaccaaatactcaccaaactgccctcctgctgagggttcagcaccttcaccattatttccaaactgcatcaatgaatctaaagtgcggggggacatcggcaggtcaatggtattgctgcaggtcgttctgtaggaaatggggggcagcaggaggggaaacggggggttgacaagacacaatggaaaaaaaaaaaagaacaaaacacacacacacaagccatcaaactctggtctccaacagaaaaataaaagctcaagctttttaaacacacaaggtcactttgagtactaaacatagcccaggggcttccaacctttggcagattaactctcacccagtgtcccattcccagggataactgaggatattagaaatgaaggcaaaacggggaaaggaagccacttacggtgtcacacagataaacttggtcttcaggtatggggcagcgcctgggaagaagaaaaccagttttcttactgactgtgacttcgcattcagtaagcagagctggaggaagccatctgcctcggcaggactgatttgaaactcactcatcctcatgccaagattgtctggaaagctccatctgcccctcagggttgtctgccctcatttatactatttgatctcccaggcactagcagctgtgaacttcagttctttgcacaaagctgtcctgagctgcagagacttttcagcataaccttttcccacctgaccctagactaatgccaccttgtgtcccttctttccctagattatgtaaaagtttaacagcctccacgtggtctgagcattctattccggcctggtcatatctcttagataacttctctgcatgcaggaaccgagcctgtgtagtctttgcatggtgtccagcctaaataccaatatcaccaagtctttaaagaacatggagactgctaatgcttgtggttccaaagccaaaggttatatctcttattcctaccagcactaatctggcctctaccacatttttggatgagggcatgagtaactttctagttggataaatacgtcaatcaaaaagcaccaaagagaatgtgactttgtaaggcagtacaattgcttcaactagaagaccggagacctgggtccaggtacatcttcaatagctaagagacctggagcaaggcatggtctctctcttttgttgctgttgttcttattgttttgagacagagtctcactctgttgcccaggctcaagtgcagtggcacaatctcggttaccgcaacctcctactcccaggtcaaaacgattctcctgccttaggctcccaagcagctgggactacaggtggcaccaccatgcctggctaatttttgtcttttttttttttgagacggagtcttgctctctttcgcccaggttggagtgcagtagcgccatcttggctctctacaacctctgcctccagggttcaagtgattctccttcatcagcctcctgagtagctggattacaggcatctgccaccatgcctagctaattttttttttgtaattttagtagagatgaggtttcaccatgttggccaggctggtcttgaactcctgacctcaggtgatccatctgcctcaccctcccaaagtgctggattacaagtatgagctatcatgcccagccttggccacaatgcccagcccatattctcttttatgtataaaataagagggagggggaagacaaggtgccaattttctatgagctttgtcatttataattcttgttctacagttagaaatgcgttgacgggaataaaatgaattttagatgctgaatgcttacaccaagaggtcaaggaaccttggggatactggcatgaaatctggggaattcaggtgaacaaaccattgagaaggcatggggcagggtgaggtgggctgagaacagcacggtcataaaacatgaggcttagacagaacctgagggatcagagagcatgatgaccatgtgaaagaaggcactgcagagtggctcttgggctgccatctgagtttactttgggccaagaaactgatcaattcagtgcagaattcaaaggagctactgaggcaagactctagtgtcttataaatccaactgttttggcccagcccttagggagctgacaccctagacagaaaaggatttaattctccagcattcaagatagctgaggccaggcacagtggctcatgcctgtaatccctgcactttgggaggctgaagcaggtggatcacttgaggccaggagttcaagaccagcctcaccaacatggggaaaccctgtctttaatgaaattacaaaaatagctgggcgtggtggcacgcctgtaatcccagctactcaggaggctgagacaggagaatcacttgaacctgggaggcagaggctgaagtgaggtgagatcgcaccactgcactccagcctgggtgacagagtgacagactgtcaaaacaaaacaaaaacaaaaacaaggctgggcactgtggctcacacctataatcccagcactttgggaggcccaggcgggaagatcacttgaggtcaggggttcgagaccagcctggccaacagggtgaaacccggtctctactaaaaatccaaaaattagccaggcatagtggtgcatgtctgtaatcccagctactcaggaggctgaggtatgagaatctcttgaacctgggaggcagaggtttcagtgaagcaagatcgcgccactgcactccagtctggacgatagagcgagactcaggctcaaaaaaaaaaaaaaaaaaaaaaaaaaagctgagaaaaatgacttcattgtgtggctttgtacaagattgtaaatgtactttatctaatttgtaagtggctccgaacctctccctcaagccataaggaaatgctatgtgggcttccagtagagaaggaagagagaagagtcttgggaggataatctaacctgagaccctcataccataatactcttgtgatggaaatagagaggaaatggtcacatgctcatcgtcctgaaggcacccattttaaaataacacagggacacccccacacccgtcaccacactcacatggagtccctcagggcacactcctctcagcaaggcaaggcaaattactcaagtaattagttcctttctcctgatgagtgcctggcccctgaggaaacgctgacatcgctgggcaggaaaggacctggcctcccagcccacaggaagggcgatggtaatggaggatgcagcctcagactgggaggtgggaccttgaaagcaaaatgagtcaaaaggaccagccgtgggaccccaacgtcctctgcagaaggaacaaagagccgtgtggcaggggctgataaacagatctcccaactgaagcacacatgcaaagggagataggtggcagacaggaagtgagtaactcttacagcaggaacaagactcaggaccccaacaaaggagaaaggcaacggtcaattagctccaactccctcttccaagccccattctgccccatctcaagaaatccctcagaaggaattcctaggaaaaagtgggagggaagttggtaggtttctgtgtgtgtgctatttggacaaaaatagttttttcaacagcaactagggcaaggcgccaaccctaaaggatcacattaaagagcccatcattaggccaggcacagtggctcacgcctgtaatcccagcactttgggaggctgaagtgggcagatcacctgaggtcaggagttcgaggccagcctggccaacatggcgaaaccctttctctacaaaaaatacaaaaatcagctgggcatggtggcacaagcccataatcccagctactcgggaggctgaggcaggagaattgcttgaaccgggaggtggaggttgcagtgagccgagatggtgccactgcactccagcttgggtgatagagcaagacttagtctaaaaaaaaaaaaaaaaaaaaagcccatcattggctttatgattacagaaagttaaatcaaacaaagaatggcaaaccagagactccccatcaagacctgcacaaagaacccagagagtcaaaacagcaagtgctgaaggggaacagacagggctaccccctccacactgaggacagctgcagagattacagttttgtttcgtttttttctttctcttctttgtgtgtgtgtgtgtgtgtgtgtgtagtggggtcttgctatgttgccaggctggtcttgagttcctggcctcaagtgatcctcctgcttcagcctcccaaagtgctaggactgcaggtgtgaacccccatgcccagctgagattacagtatttttaatttctctctcttttttttttttttttttttggtgagtcaaggtcttgctctgtcacccaggctggagtgcagtggtgcgatcatggctcactgcagcctcaacctcctgggcttaagcaatcctcccacctcagcctcccgagtagctaggactacaggcacaaaccaccacacgtggctaatttaaaaaaaattatttttgtatagatagggtctcactatgttgtctaggctgttctcaaactcccaggctcaagtgatcctcccgcctgggcctcccaaagtgctaggactataggcatgagccacttcacccagctaaaataatttatatataacatataagtacatgtcctcttacacattaaaatataccttattttcaatagttgcacactctaaatactaatcccttgcccctccacccagtcactgtcttccccttcaaacgtgatgctcccagctcttctactctagtgtaaaccatactcccatgcagctaataataatttcctccagaaaccctttcttcagaccatctggcacactgacatggttcagttacaggcaaaaagccatatgctgggctgaaatctgggcctcaaaccttctagcatctactaagaagcactgtgccagcagggcatcctgttaactgccctcactttcccttctcgtgtttcaggcatgttttgggggacgtatgtgtattgatcccctctttatttttattttttgacacagtatctcactctatcagccaggctggagtgcggtggcatgatcaccgctcactacagccttgaactccttggctcaggtgatcctcccacctcagcctcccaagtagctacgactacaaatgcgtgccaccacaccgggtaatttttttggattttttgtagagacgaggtttcaccatattgcccaggctgtatcccctctttagactcatgcactctctgtggagcaggaactacactactctaagtgattctgattctcctctcaaatcccatcggtcaccccaacaaaagcactcactacaattctttcccataaggagaaataattatcccccaggttattcaggcatttgcctatctatcctccaaggatcccaaaatttccaacttttcccaaaaattaaatgccaggaacatggaaaatcaacaactacctgggtcagcttcaggatgctcctggctctctggccgacaatactttccgaatgcctcctccttgggaatgtcaggatagagatagaccagtggagacaccaggatattggtagcatccatgatcttatagcccatgatgatttcagcaaatgacatgttgttcagctgctgctttgtgtatggttccacggactggatctgggtcttacctgtcacaggacatgggaaggaaagatcatggaacctacagctaggtcatctcagagaaaactgcccattttttctttcctcgaaggggaaaagacttaagccaccctagtgttgagaccctgaacaccctgttcagtggcctggcactgtggaaatattcaggctggcttctaattaagaagaggctactagttgggtcatagaaaataaacttgaatataactacttgcgtaagatatattaacagggttaagtagaaaaagagatgaagaatacaatttaaattgcaaaattctcaacaaatagtcactggagcaagcaaaacaaagcaaaccaatccttcagctggaaggatttagaagtcacgcaaatgtgttttgcgagtctgagtgaaacagggagtcaaggccatctccacccaccagggggcagtaggtgcttgcaactagaagcagtgatgaggcctcagcagccaccagcaggtggggtgggtgggagcctcccttaccgctgatgtccttctccacccaagtgaaagtgacgcctccttctttgctgctttcactgaatcttagcaggaaggtgcctggaggcttagtgctcaagatggcccgctcccgctccttactgataaagcccatgatgtacctggagccaaggaggaggaacaatgttgttattgctaacagggcatccatcccctgccactggcttgctgagagcaggggacttggttacatctgtgcacactctgtccaacctacccttcgttccaaagggccaggatgtactttttcacaaggtcaatgatattgtccagccagacccagaaggagaagcccttgccagccatgttttcctggagaaaagagtaatgggaaagccaagtctactgccatcccagcccttcccttcctaggggtgcagtgcatcacccaaatcctcaggcccgtctaccttcaggcaggtcctactggccgctggaccaagagttcagggccttcaagccagagccctcaacgacagccgtgcaggtgagcattcccattcccacgagaatttaacaagattgcttactttgcaaaatttagcccatgtgatctgacaccctgaataattcacaccaggtcctgaaggaaagaaaaagagtcaagtagtacattttcagcttggggtcaagaggttatttcttaaaacagaacacacacacattcatcccacaatgggccacaaaataatcagctttcacatctttgaaggtaggcactgttgtgtgtgtgcacatgaggacaaacactatcccatcatttgactcacttgtgttgctgggtagcccagcagggatggagggtgatataacaagtccccctgctcttcccaacctcgggtggtaggctgggaaccaacagcagcactcactaacaagctgacatcgggtgtcagacaggtgtatttggtggcaacagctttattagaacaaagctacttctagcccaggtggcacataaaatattccactaattcttttttaaaaactagcctacgctgggcacagtggctcaagcctgtaatcccagcactttaggaggccgaggtgggcggatcacgaggtgaagagacggagactatcctggccaacatggtaaaaccccgtctctactaaaaatacaaaaattagctgggcgtggtggtgagcacctgtagtctcagctactcgggaggccgaggcagaagaatcgcttgaacccagaaggcggaggttgcagtgagccgagatcacactactgcactccagcctgggcaacagagcaagactcgtctcaaaaaaataaataaataaataaaataagacaaaaaaaaccaactagcctatagtttattaaaaaaatggacagggaatgtcaagcctttagtgccaccttccaacacacacttaaaagatcttctaaagttagatagagtgggtgaatgagacagcaaccaggagaaaagaaatctacctcccacctcaaaaatgatcacctcgactgaaaactgcaaactgtctctgcaccccaactccccaactcccctgtttcctggcaccagcacagcgccttgctcaggaaagaaacatggcctaatgctcagtagacatggcccaaatgaacagccctatgggccggatcccttttctgggcgggtgggcgggagggagaaggggtgaaatgcggacccaagagtttctctgccagtgtagtcagctgctcgatgctcagtcctcgcttggtggtggaggagaactgccagctcaggacctcggccacttgatcccaggttccaattgggggcttggtaaaaaagtttacattctattggaaagaacacatttgcttgtttagatgagggatggtgctcattgtctatactaggtacccctaagtcgcaagagatcccggggcaccaactaaaaggagggggcactaaccttgggattgttggtcagcatgttgtaccacaggatggacgcccaggcatttggcatctgacagatgttggagatcaccacaactggcaaggagtgggtctgcggagggagtggggactgagctggggaggcagaggggctctcacagccttggaaatctcttcacccgcatctcacggggctcagaatgaaaggacatgccataaaccacacctgctgccaactctaggcgaggagtgtgagtgagtcagctcagtgagcactcatagtggaaagaatgcccagcgtggccacacaactcaggctgcagtcggaatataccggtcccttgtaaaacctgacttgctcaaagcttgactcacaatccacagattccccatttttaagaccttggaggcattctccaagacttgaagctgtatcttcacatgaaacagggaggtctcaggaatcaaagaccaggattcctgcttttctaggtatatcttaatttaaaaatcaagaaagttgggaaaggagaatgtcattgccacaattttctgtatactaaacacactggctgctaagactcttatgcccaaactttataaagtcagttctaatttcttttttttttttttgagacggagtctcactctgtcacccaggctggagtgcaatggcacaatctcagctcactgcaacctctgcctcccaggttcaagtgattctcctgcctcagcctcccgagtagctgggattataggcgtccgccaccatacccagctaatttttgtattttagtagagacggggtttcgtcatgttggccaggctggtctcgaactcctgacctcgtgatccacccgcctcagcctcccaaagtgctgggattacaggcgtgagccaccgcgcccggccaatcaatttctaaatagagattttcatatcaagtttgctgaaagctgaatatacacacatcttctaagcattcaagcaagactttattgccagatgggatgccaaggatttttttggagaaaagtaagcaaaaataaacacagtgttaagcaaacagtaatcattccaccttctcttgtaaaaatcccagtggaagtttttgtcctgagtcacccctgtacgtagcctctcaccgattctgctgcagaacttacctctaggtcaatcttgaggccttggtgatacacctcggtctcaaaggtgatcaggtgcagctcctcagtcacaatcagggaagcctacagtaacgagaaggacactcttaggccaggtgtggtggctcatgcctgtaatcccagcactttgggaggccaaggcaggaggattgcctgagcccaggagttcgagaccagtctaagcagcacagcaaaactccatctctgcaaaaaatacaaaaattagctgggtgtggtggtgcacacctatagccccagctactcgagaggctgaggtgggaggatggcttgagcctaggagatggaggctgcagcgagctatgattgtgccactgcactctagctggggtgacagagtgagaccctgtcttaaaaaaaaattaaattaaataaaaaaaaaggctgagcgtgatggctcacacctacaatcccagcattttgggaggccgaggcaggtggatcacatggtcaggagttcgagaccagcctggccaataatttggtgaaaccccgtttctactaagaatacaaaaattagctgggtgtggtagtgggcgcctgtagtcccagctactcaggaggctgaggcaggagaatcgcttgaacccaggaggcagaggatgcagtgagccgagatcacgccactgcactccagcctgggtgacagagtgagactctgtctcaatcaatcagtcaatcaataaaaaagagaaggacacttttcctcagagagaatggcattcagtactaacagccacagccaaggaaagtgacatgccaagcctcaccacaccaagaagggtaagccaccaggtggtcacaaacaaactgccagggacacaacttgctcggcacttactctcttcaacaccaagaacttccaatgctgtgatcctcaacctaatcctttactcagtttgtattataatattacatagatccaattggttatttgtaaaatacgtaaggcacaaagaataacaaaacaatatgaacccaccattcaatttaaggaaaagtccatcactcctaaaattctctgggtgcccttccccaaccccatccccttccctcctccctcagaaataactgctattttgtcttttgggtttatcatttcctagccctttttgtcttgttttgttttgtttttttacagttttaccatatttgtttatctaagcaatgcaggtattgtttagtttgggacatttgtgaaccttacacttatggactccaatgaattcttttgggattcacttttcacttgatgtgaaatgaatccacatggttatgtgtatctgcagtgtattccttttcacagctgcggagtattccattgtgtctataccacaaataatgtattcattctaatgttgatgggtatttatttgggttgcatttagagcttataatcaggctgatgtccactttatatatgtctcctgggacatatatgcaaagatttctctgctattaaatcctgggaatggcaccgttggtttacaggtatgttcatttttatactgccaaattgttttccaaactgactacaacaatgtctcacatcagtacagcaaccttattttaagtaagagttgtcaatgaattctcaaaaattgaattctagtctgggcacagcggctcatgcctgtaatcccagcactttcggaggccgagatgggtggatcacgaggtcaggagttcaagaccagcctgaccaatatggtgaaaccctgtctctactaaaaatgcaaaaattagccaggcgtggtggcatgcacctatcgtcccagctacttgggaggctgagacaggagaatcgcttgaacctaggaggcagaggttgcagtgagctgagatcgcaccactgcaatccgatagaacgagactccgactcaaaaaaaaaaaagaaaaaagaaattaaattataattcatttttaatactatttttctgattataaaagtaatatattcagtttaaaatgcaaatatcacagagacagtctagaatagccatggataccaacagcagcactaatacacatagcactgctggtatattcctccagaatttcttaatatacatatgaatacacataagagtatagtgtatttttaaaacacatatactaataatactattcaaattattttacattttgctttttcttaatatgtcatgtacattttcccatatcattgcatacaggctacttcactctactgtcaagtaaaattccacatttttaaaaaggactgctacattttattttatttatttttttgagacagagtttcactctgttgcccaggctagagtgcagtggcaaaatcttggctcactgcaagctccacctctcaggttcaagcgattctcatgcctcagcctccccagtaactgggactacaggcgtgcaccaccacacccagctaatttttgtatctttagtagagacgggctttcaccatgttggccaggctggtcttgaactcctgacctcaagtgaccagcctgccttggcatcccaaagtacggggtgtgagccagcacgcccagctaggactgctacattttaaagaggaagaattgttcaggggacaaatgtaagaaaaagaacggggcatcacaatttttaaaaatgactgaaaactagccttccgtcacatttacctttttttgtttgtttgtttaaagtttattcttgacaataagaatccaataatctgaatcaatgaaaagcagaaaataagggggataaagaacaagatgggtttttgtttgttcattttattttatgtactcttttcctaagcaagctaatgcaaggtggtcatttattttaaagtttaactcaaatctgttgcttttacaccctctatcccacctcagtgggagagaaaaacagggcactaaaaatggagccaagcagggtcagccgcaggagctggatggggaatttggaaagccccaggcaaggtggaaagctgctttataccacatgggtgtggagaacaactcagcaagggactttccacttctccttaaggaggagccaactcccagatattcacggaaatgttccaagccagagagctccatggcacatggaacttctgttcatgtcactttggcctgaagtgactttttggaataactacagctgaaagaacaggttgatgtttctaattctggggattaagaaggatctttacccctctctccctcaaggaaaacaccccagttgtctttcatccccaacaaaacttacatcacaattggctcggcccccattcccacatctctgctccctcagggtctgtaagaaaagaaaaaggcaggtgtcctgtgaggctctccctagccctctccggcagccagaggccctttgtgaaggggagctcctcccacataccaagtgtttgaattctgcagagaggctgccgttgttggattcttccatgttcatcacttttgtgtttgtgcccagaatgttaaatttccgggatctgaatcacaggggaacaatcaactatgtaggtgaccaagtagccggaggatgaagttaggttaaacggaacaaaaggaagcctctaggctgaacttaccctctgagagctgcaacgtccccagagtctctgtaagaacacagactgttgttaataaaataggctctgtgtttcttcaaaaagcctactttgaccacctgttatttactgtcatgaaaaaacctctgtgctcctgggcatttctttaaactattcagttacagttgatcagcgcaacataacacctctgcgtagcaggcacagttggttgcctccccataggaaggggaacctatgtttcatattgcatatgtacttattaaacctaccaccttcgtcaactcccttatttcattattttccagtgcatcctcatgaaatttccacataattacatcaactaaaaataagaatgcattttatcttttcttttttctttttttttttttgagatagtttcgctcttgttgcccaggctggagtgcaatggtgtgatctcggctcaccacaacctccacctcctgagttcaagtgattctcctgcctcagcctcccgtgtagctgggattacgggcatgcgccaacacacctggctaattttgtatttttagtagagacaaggtttctccatgttggtcgggctggtttcgaactctcgacctcaggtgatctgcccacctcagcctcccaaagtgctgagattacaggcgtgagccaccgcgcccagccacattttctcttttcttttctttttttttttttttgagatggagtctctgtcgcccaggctggagtgcagtggtgtgatcttggctcactgcaaactccacctcccaggttcatgccattctcctgcctcagcctcctgagtagctgggactacaggtgcccgccaccacgcccagctagtttttttgtatttttagtagagacggggtttcaccgtgttacccaggatggtctcgatctcctgacctcgtgatccgcccgcctcggcctcccaaagtgctgggattacaggcatgagccaccgcgcccggcccacattttctcttttctaatgtcgtcaaagggtatatgtattttacatcctgaaaggtattgtgaaattttgcgtattccattatatggtaaagtgtggaacaattaaaaaaaagagatctattctttccacatgctatgtatggaaagaatatataacgacgtttcggtcaacaacaaaatgcatatatgatggtggtcccataagattatcatggagctgaaaaattcctacttcattgagatgtgttacaattgcctacggtattcagcacagtaacatactgtacaggtttacagcctacgaccagtaggctctgccacatagcgtaggtgtgcagtaggttctgccacccaggtttgtgtaaggactatatactctacaacatttgcacaacaaaattgcctaatgatacattttgcagaacgtatcccagtcgttaattaacacatgatctcagtcttatatataatatgcatgaatgacatgtacaagtaaaaaactaaacaaggaaaagagggactggttgtcacaatagcaaccacaaatcaaatctgtacccccagctttgtggctttgttcagacacgtaaatgacaatgcaccccaaggcttttgaaaacttttgtccacaaaatgaagatctctgaataaagacagagtctctagttcaaatgatgtctgtcaaagttctcatttttctattcctcatttgaaaaacagagctaagataggagtacttacttgtcaatgcacactttaattttaagctgataattcaactcagggaatttgaccagcaacctatttaaaaagaaaaaatccaaggaaaaaaagtcagtaactctcccataaccttttcttgaagaaatgtaaaattcataattcttcatttccaacaggtaaataggccaagctgtctataattacaggctcacatctataatctcagcactgtgggaggccaagctgggaggatcccttgagcccaggagttccataacagtctgggcaacaaagtgagagcccacatctataaaaaatttaaaaattagcggggtgtggtagcatgtacctgtagtcgcagttactcgggaggctgaggcaagaggatcacttgtgcccaggagttcaaggctacagtgatctatgatcatgccactgcactctagcctagatgacagagcgagatcctatctctctttctctttttttttttttgagacagtttctctcgttacccaggctggagtgcaatggcgcaatctccgttcaccgcaacctccgcctcctgggttcaagtgattctcctgcctcagcctctcaagtagctgggattacaggcgcgcgccaccacgctcagctaattttgtatttttagtagagacagagtttctccatgttggtcaggatggtctcgaactcccgacctcaggtgatccacccaccttggcctcccaaagtgctgggattacaggcgagagccaccgtgcctggcccctatctctctctttaaaaaaattaaaatagggctgggtgcggtgactcacacctgtaatcccagcactttgggaggccaaggcaggtggatcacaaggtcaggagttcgagaccagcctggccaagatggtgaaaccccgtctctactaaaaatacaaaaatcagccgggcatggtggcaggtacctgtaatcccagctacttgggaggctgaggcaggagaatcacttgaacccaggaggcagaggctgcagtgatccgagatcacacctcagcactctagcctgggtgatagagaaagactccatctcaaaaaaaaaaaaaaaaaaaaaaaggccgagcgtggtggctcacatctgtaatcccagcacttttggaggccggggtgggtggattactgaggtcaggagttttgagaccagcctggccaacatggagaaaccctgtctctactaaaaatacaaaaattagccgggcatggtggagtgtgccggtccagctactcagggaggctaaggcaggagaatcgcttgaacctgggaggtggaggttgcagtgagttgagattgcaacacgcactctggcctggccgaaagagcgagactctgtctcaaaaaaaaaaaaattagccgggtgtggtggcacgcacctctattcccagttactcaggaggctgaggcacaagaatcacttgaacctgggagatggaggttgcagtgagctgagatcatgccactgcacaccagcctgggtgagagtgagaccctgtctcaaacaaaaacaaaagatgagtatcactccttcaagccaaaggtactgagaaaacatctaagaactaacaacttaaagttgtgagagattcacaaaaggataatcaaagccatataatgaaaaatattacaggaacacatgctgtgcagctggcattttgttctattaatcctgaaaccgaacaccatactaagtttctgaggagggaaattttgctgcagaaggtcaaaaccccagcacacctgttctgacttgagtgtgaaagtaacacctcaccctacaggcccaccacccacctgccctggggcctctcagcttccccatcactaagccttactctttcccttaaaatccacagggaagagtagcctcaaagaacagaaaatagatgacattattttgtcccttgggcagaaggagaagctgtggcctgagactccaggtctacaatcataggaatatgcccaggtaccttcaaaaagatgactgctcttttgcttttgacatcagaatcagagagcaagcagatagtatggcaacaaatttcaaccccgcaacagtgtactgcctgtgacaccacacctggaaagaatgaccctggccaccaactctaccctcaccctaacagtgtccctcagtaaaatctctactggaaatggaagtggcatggcctacctgactttagtagtgaactggacgccggtcttgatgacgaggggccggtcaggatgcatgggcatgcagggctgccgctccaccacaaaggcactgaggaaagagaagatgggctcacgcgccacggccatgaccagaagtcagcccgcctctcactctaccacgtgagtctttaggtattttttagatgagggaaagggacaaggatgctaaattaccttttcattaagtttctaaacagctccacgattctctcctccagcatcggccggtgctgtacaatggggtcccctttgtaggaaactttttgctgcaactcctccagtttcttaatttgttgacgggtctgaagttgagattctgctaatgacgttatcctgccaataaattaagaaagatgctaattaccaaagtgaatgtatacaggtgagatggagaaggggaaggaaatactgaagacatggagaccactacaataagaacaaggaatttttttattgtggtgaaatatatatagcatgaaatttacaatttttcatcttaagtttacagttcagtgacattaagaaaagaggaatttttcaccatgttgggtggatgctgaaaaaataaataaaaaaagaaaataatttatttatttatttattttttgagctggagtgcagtggtgcaatctcggctcactgcaacctccatttcccgggttcaagtgattctcctgcctgagcctcctgagagattacaggtgtaagccactgcgcctggcctttttttttttttttttttttttgagatagagtcttactctgttgcccaggctggagtgcagtggcacagtctcagctcactgcaacctccgcctcccaagttcaagtgattctcctgcctcagcctcccaagtagctgggattacaggcacccaccaccactcccggataatttttgcatttttagtagagatgggattttgccttgttggccaggctggtcttgaactcctgacctcaggtgatccatctgcctcgacctcccgaagtactggcattacaggtgtgagccaccatgcctggccagaaaataatttattttaccttttattactagtcccttcctaaaatctcaaatttctaagagggggctgggcacacaagaagtattaaaatttataccactaggaggcattgatggagttatcactggaaaatgacaagcatctgagcccagatatgcagaacacgaaatatggaatttagcacttactttactcatcctaacttgtctatgaacataaagactcagaaaaagagattagacagctcccaaagatgggtttgagccagctctgtcacacactatctgtgcaagctttgccaggcccttcaccatcatgggccttagcatccccttgcatgaagagaagggcttgaactacatgagccctttcttttctttctttctttttttttttttgagacagggtcccactctgtggcctagtgcagtgcaatggcatgatcatagctcactgcctcctccaactcctggacatgagtgatcctcctacctcagcttcctgagtagctagaactataggtgtgtgccaccatgcctgtttagtttagtttagttttttgagatggagtctcactctgtcacccaggctgaagtgtaatggcacatgtctagttttttaaatttttgtagggatgggatctcactttgttgcccaggctggtctcaaactcctgggttcaagtgatcctcccgactctgcctcccaaagcattgggatttacaggcgtgagccacaacacccaatccccataagccttttcaatgtcagccttcaactgatcaaaggacatgacattatgtttcaaaatattgataacatgcacaaggaataagtgaatagagagggagaaaaagctcattaaatctatctccaagaatagagatattaggccaggtgcagtggctgacacctgtaatcccaaaaatttgagaggccgaggcaggtcgatctactaaaatacaaaaaaatagccaggcatggtggcatgggcctgtaatcccagctacttggaaggttgtgactaagaatcgcttgaacctgggaggaggaggttgcagtaagccaagatcatgccactgcactctaacctgggtgacagagtgagactctgtctcaaaaaaattaaaaaaagagagaagttagcatcattccatcattctttgatggtttatcactagtgtaacaaagaccaaaagaccagaaagacagaaagtgaaaggagagggagggggaccgctgcagggatttctgaactcctgagctcttttctggcacttctatcctcccattcccagaacttaagcttcttcgttccctggtcaggaagcatttaaaactgctttcagtaaattaacaacactcagggttagtgaggatatgaatagacaggcattctcatgtagagttgcgctaaatttccagtgcaggctctgtatctcaagtttctcctaaggcaagctggtgcaacatgctcactatagggccttgcacaggaagggttgcagtaagatatgctggatgaaggtaaaagtgcaaattacagaaaagcatataaaggaagatcctgggctgggcacggcagctcacatctataattccagagcttttgagaggccgaagtgggatgatcccttgagcccaggaatttgagaccagcccaggcaacaaagtaagaccctgtctctataaaaaatttaaaaattagccaggtgtggtggtgcatgcctgtagtcccagctactgagaaggctaaggtgggaagactgcctgagcccaggaggtcaaggctccagtgagccatgactgcataactgtactctagactgggtaacacagtgagaccctgactccaaaaaaagaaaaaaaaatgatcctaatataaactgtataaatttctatctttatgtgtatatacataatgtgtatatacataatgacagatgtctagattgagcatcaactaaattttaactactagtactgctgatgatttcatttaaaaattttttcttctcttgattaattttctgtatttgaattttttcccttaaaaagggcatgtgtcattttagattactaaaataactaaaattaaaaggtttgtctatctgttaaatacagttaaaccaaaagccttaattgaattattaagtaaaatatacttaaaatataataatataaatacattttttaaaacaaagtttctccaaataaagtaaaaactttattttatttttatttttttgagatggagtctcactctgtctcccaggctggttggtgtgcggtagtaagatctccgctcactgcaacttccatatcccaggttcaagtgattctcctgcctcagccgcccagagtagctgggactacaggtgcgcaccaccacgcccggctaatttttttatgtttttagtagagatgtgttttcaccatgttggccaggctggtctcaaactcctgacctcaagtgatccgcccatcttggtctcccaaagtgctgggattacaggtgtgagccacagcgcctggccgaaataaagtaaaaactttaattcttgggctaaatttgaatatggaaaagtccccacgttggagatatagtaccaattctgtgggcctgcagttaagatcagaattcaatctagctttcgagaaagaaaggaaaagcttctttcatcctttaccagttttctagccgatctaggcagatgttgggcgggcctccaatgcaggcaatctgttgccgcctcttccagtcagccagctcctcgtccgtgagagttttctgcacgtactccatcgctgacaaaagccccgccagctcactcacgatgctctggttggaaaccaaaacaaagtcagaaaacatttcctcagactgtctctaaccacattctttagtcaactccagagcaggaacttcttagaaaccaagcaagttctgccacaagacgctgaaatcccgcaagtgagcgagacacatgggggaagtggtccgacctatgcccttactctccgcatctggtccagcgcagtgagcatctgttccagctgctgcatcttctgcctggtcactgactggttgtttccattcagatcttgcatgtctgcgaaggaagaaaaaactccttgacctgagggaatactccttgacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactccttgacctgagggaatactcctggacctgagggaatactcctggacctgagggaatactcctgtccttaatgaccaggctcctttgaggacccgtacctcccttgcgccccgcccgccttaagatctaaacagagttaagacaaatgagtctttcaactcaacaacacaaactcactttctagagattttaacatctctaatattcacttgcctccttgactcttgagggttttatagttgaaatcaaagtcatcctggagattctctaccactttcattttctgttctagatcctgtttaaaataagcaaacaaaaaaacagaagtaaagaaagatttccttgggaacagaaaatataaagtttctgaggagaattcaaatgaagccaaaacctcaaaaaagatacatgcaggacctgcaggcagtatccccaagagaaggctccctgttggccaggtgcagtggctcacgcctgtaatgccagcactttgagaggctgagttgggaggatcacttgagcccaggagttcatgatcagcctggacaacacagggagacccccatctctacaaattttttttttttaattagctgggcgtggtggtgcatgcctgtggtcccggctacttgggaggatgaggtaggaggatcgcttgggcctgagaggtcgaggctgcagtgagctgtgatcatgccactgcagcccagcctgagtggcagagcaagaccctgtctcaaaaaaaaaaaaaaaaattaatgaaagctccctgcccgaggcttgtaacttgcatcacctgcactctcttccggacatcctgaaggtgctgctccagcatctgctgcttctccgtcaccacggctgctgtggggtggttggcctggcccccttgctgccaaaaaggaggtcaatgcacatgtgaacacagaactatggggagaggaatacctctacccagcttccatcccaccctaactacccttcttgtttggcttgagacgctgctgccatcacaagaggaagggaaacagaggcagtggtgctgtcactacacaggtgacactacacaggtcataccataaaccccctttatggcactaagagaccacatgttcagctaagacatggtctatgccttcaaaaacctcatgggcaagtatgtcaaaaaattcaaaacaatttatgacagcagatgttggatgtctacttaaacgtggtgtccagtatatttctgagggataataaaaaaaaagtcctgccctagggatgaaattccatattaaaagatattatcttggggagaaggggaggctggtaccttggaaaatgtcaaatagcacatggaaaaagaaaaagaagaaagaaggctggatgtagcagctcacacctataatatcagcacttgggaaggctgaagtgggaggactgcttgaggccaggagttcaaaactagcctagtcaacatagtgaggccccatctcgaatgaataaatgaatgaatgaattaaagaaataacaaaaaataaatagcatatgaaacttaaaaattacaggttcgtgccaggtgcggtggctgatgcctgtaatcccagcactttgggaggccaaggtgggcagattacctgaggtcaggagtttgagaccagcctgaccgacacggagaaacccatctctactaaaaatacaaagttagctgagcttggtggtgcatgcctgtaatcccagctactcgggaggctgaggaaggagaatcgcctgaacccgggaggtggaggttgtggtgagccaagactgcgccatgcactccagcctgagcaacaaaagtgaaactccatctcaaaaaaaaaaaaaaaaaattacaggcttgggctaggcatggtagctcccacctataatcctagcactttgggaaaccaaggcaggaggatcacttgaggctgggagtttgagaccggcccagggaacatagaaagagacctcatctcaaccaaaaaaaaaaaaaaatttttttttaactagctgggcatggtggcatatacctgtagttctagctacttgggaggctgaggtgggaggatcatttaagtccagaagtttgaggccacactacagccagttttatgggcaaccattctcttcctttcccatggtccctatccaagcccacagaatacaaacttcttagaagttttgggaaggtgacccatgcccctacttcttcccacagtgacagtgactcatctgattggtaagatggagagaaagactctgtgtacacacagatcttcaaagaacccagcacctaagctggtgcctccctcctctcactcttgccttcctagggcccaccataagcaagagcagcagcctggtttctagaagcaggtctagaggcctatccctctgccttgttggtctatggcagctgaagctccatatggatggctggggtggggtgggggtgctgctctgcacatccagtctctctaccccaagatctaactcagggcacaggcattggaaagcccctatggttaccagctcaagccacactttccattctagttttaccaacaatacagctgatgttttaaccttcattcctttctcatgtctatttctcaagcaggactacacttaaagggagaaaacatgattaacgatcacccacagaaacccacctctaataccttcgtaaaaaactgtattggctccccactgcttccagctataaacatctcaggccaacacagaaagctgtttcacacaattgataacttcaactttccctccctgtgccttggtcaccccagactcccaactcttccctgcatgcagtgtgtttccacactctcttcccacccgctatccactcagcatggcctgggcttcagcccaaacacacctgaactcactcaccttcaaattcagttcaaatgtttcttttcctgagaaatcttattcaacttccttagacaaaatgacacacatccttttctgtgtttttctcactttgagtgtttgtgtacttataatcccaactagcctgacagcccttggtagcagggattacatccactcttctatctttaaccaattctagacacttaagagcatgccaggtattgtaaacagaaaaaatagcagtgaggcctgggttgaggccacaaataaccaacttatagctttatatcaggggttgcaaactttttctctaagggacagagggtaaatatttttggtttcctgggtcatacagtccctgccacaaatagccctgccactgcagcaccaaagcagccacagataatgcataaataaatgagtgtggctgggttccgaaaaaacctcatttacaaaaacaagcagcaggctggatttgggccacgctcacagtttgcagacccctaatccgtacgattgaaaacatccttgggataactttggctttcctacctcccatggtaagttggagcctctatccaaattgacttaaaccacttatttttatcttgtggagcaggataaaatacaaaggttttccacagcagaaaatcctagtgctgcctgagcaaatgcctgtgtgctaacctcttgggctacagggcactgcacagtaagtgttacctaccacctcgctcacacctgagcatatcagttttctgcttaaaattcctcactagggccggacacagtggcttatgcctgtaatcccagcactttgggaggccgaggtggatggatcacctgaggtcaggagtttgagaccagcctggccaatatggtgaaaccctatctcactaaaaatacaaaaaattagcccagtgtggtggctcatgcctgtaatcccagctacttgggaagctgagacatgagaatcgcttgaacctgagaggcagaggttgcagtgggccgaaatcgcgtcactgcactccggcctgggtgacagagtgagactctgtctcaaaagaaaaaaaaaaaattcttcactgggtccccatttcctacagtaatggtgagggtgatgatagtgatgtcagcagcagcagaaagcagttaaattattttgcatttatgtgtcagatactgttctaagcattttacatgtatgaattaattctatgaagaaggtattgttatcactcccattggaggaacagagagagtaaaaattgtttacttaaggttacagagcaagtggcagggctgcgggttcaaaccgaagcagttggccccttgtggtaaactgctcttccagggccccactgttaggcatgactaattaaaacatcatgtggccttgactagcttgtcttccccgacccaatcagatgctgaactttctacacttctcccaagaatacacatttctgtttctgtctttgaacatgatcttctttctgcctggagagctctttctcatcagttgatgagcccaggagttcaacaccagcctgggaaacatggcaagagcccatctctaccaaaaaaaaaaaaaaaaaaaattagctgggcatggtggcatgtgcctgtagtcccagctactcataaggctgaggcaggaggatcgctagggcccaggtggttgaggctgcagtgagctgtgatcacaccactgcactccagcctgggtgacagagtgagactgtctcaaaaaaaaaaaaaaaaaacaaaggttacaaaggtaaatttgaaatgtaatgttatgtgtatttcaccacaattttttaaaaagcagggggtcacggagaaaaagaaaaaatgtccctgattataggatattaaagacggtaaaacccctcacagaaagtaaaaaagtctcctatgaccgactactttaatgatttagtatatgtgtttccagatattttcccatacataccaatagtatatgcaaattgcatacatttagttttactactatgaatcagatctttctttttttttttttttttttttcagtcggagtctcgctctgtcgcccaggagtgcagtggcgcaatcttggttcactacaacctccgcctcccaggttcaagcgattctcctgccccagcttcccgagtagctgggactacaggcgcgtaccaccacacccagctaatttttgtatttttagtagagatggggtttcatcatgttggccaggatggtctcaatctcttgacctcatgatctgcccaccttggcctcccaaagtgcttggattacaggcgtgagacatcgtgcctggcccagatctttactttcattacatcttctaacaggttactgctgctactgattaggggaactgcagattctaaaaatatttatcttgtatacaatggcctttctaaaccttgctagttccaattgttattgttagttttgtttctcttggatcttcgaggaagacctatctatctgtaaataataagagttctgtcccttgctttccaatatttgtaccctcatttctttttctttttgcataggctggatccctcagaaaagtatcaatggtaaaagacatccttatcttttgctgtttttactgagaatagtgtttcaccactgtgcatcatgctccctttggtttctgataaatattctttcttgtgtttagaaagatccttaattaagccaggtgcggttgctcacgcctgtaatcccagcactttgggaggccgaggcgggcggatcacgaggtcaagagatcgagaccatcctggctaacacagtgaaaccccatctctactaaaaacacaaaaaattagctgggtgtggtggcgcgcgcctgtagtcccagctacttgggaggctgaggcaggggaatagcttgaacctgggaggcagaagttgcagtgagctgagatcacgccactgcactccagcctggcaacagagcaagactctgtctcaaaaaaaaaaaaaaggctgggcgtggtggctcatgcctataatcccagcactttgggaggctgtggccggtggatcatgaagtcaggagatcaagaccatcctgcctaacaaggtgaaaccccatctctactaaaaaaaatacaaaaaattagccaggcttggtggcacacacctgtagtcccagctagtcgggaggctgaggcaagagaatcgcttgaacctgggaggcggaggttgcagtgagctaagatggcaccactgcactccagcctggacgacagagagagactctgtctcaaaaaaaaaaaaaaagagagatgaggtctcgctacattgccccagctggtctcgaactcctgaggctcaggcaatctgcccgtctcagcctcccaaagtgctgggattacaggcgtgagctactacacctggctgttttttaggttttgatatgaggatttttccagcctcataaaataagctgaaaacatcccttgttttcctatactttggaaaagtttgaatgatattggaataatctgtactatgaaagtttgtcagaacaggccgggcacagtggctcacgcctgtaatcccagcactgtgggaggctgaggcgggcggatcacctgaggtcaggagttcgagaccagcctgaccaacatgaagaaaccccgtctctactaaaaatacaaaattagctgggtgtggtggcacacgcctataatcccagctactcttgaggctgaggcaggagaatcacttgaaccctggaggtggaggttgcagtgagccaagatcgcgccattgcactctagcctgggtaacaagagcaaaactctgtctcagaaaaaaaaaaaaagaaaaacaaagaaaatttgtcagaacaaaacaaaacttttaaaccattgggtctgttggattcttttggtggaactttcttttttttagagtttttcaatgtattttggggggtggaactttctttttttttagagtttttcaatgtatttttatgattattgatctatttaatttcttttccttcttttttagtagatctaataatttatctcattataaagttgtttgattttccattcctcccagaccagggatttgttttgtctcaggtctcacctgggccgcagtggctgcagtctgtagaaggcgtgattcttcccacaggcaccgggccacaatccgggcaatctccattggcttctcaagatacctgctctataagtaggagagaaagagaataaaaatcagcagcagaccatggagatgtggactgaactgtggcaccttaaaactaatgtattcatcaaggaaagcatttattctaggaaacaacggaacaaaggcttcagagcctgggtgaaggctctctgtcggcggggggcgaaggggaggtcgttactatttctgtaacagaaggcacattagcctgagtcttttttttttttttttgagactggctctcactctgtccgccaggctggagtgcagtggcgcaatcacggcttattgcagcttcgacctcccaggctcaaacaattttctcacctcagccttctgagtagctgggactacaggtgcatgccaccacaatcagctagtttttaaaaaaaatttctgtagagatggtgtcttgttatgttgcccaagctggtctcaaaactcccaggctcaagcaatcctcccacctcaacctcctaaggtgttgggattacaggcgtgagccaccatgcctggccttgtctgagtctttacacagtatactatcctggtcttgcagggaagctactgacttagtcaagaagtatcccattatggtcaaacatttaacatgtaacagtgagagtcatcttcctatcagtggaccgcgttaacatgctaacatgtatgattaacataacaatcactttattacttcaactgtgacaagagaagtgattctcaggtaatgatgctcacgggtaagtatacagagctttgagaaagggctaattacttctcctgtgattgaaaatacaagatagattctcgttacttagccaaatgagaaaagagatgcttccaggaaagaacactaacacccgactctgcgggtcctgtttctccttgtcctcagtttctcatcatacctgaagaaactgcttgattcttcgtagattgtgctgatagagaacattcgactcttgcaggaagcggctatactgctggtcaatctctcccaggagattatgaaacaccaaagtggcatgtgattctttgctggccgcatatgccctaggaaaaggaagaatgataaagaatggctctgaagccgacgcatacacacaaacacagaaatcaccatcaagaaagaggaaaaaaacaaaaaaacaaagcaaacctgatgctataacccattcatcatgttagattcttcttgctcagcaataaaatgccatcaatgtaataattattaacaattattccaggccaggcatggtggctcatgcctgtaatcccagcactttgggaggctgaggcaggcggatcacctgaggtcaggagttccagaccaacctggccaacatggtgaaacgctgtctctactaaaaataaaaaattagccaggtgtggtggtgggcacctgtaatcccagctactcgggaggctgaggcgggagaatcgcttgaatccaagaggcagaggtgcagtgagccgagactgtaccactgcactccagcctgggctacagccagactccatctcaaaaaaaaaaaaaaaaaaaccacaaaacaaaaaaacaattattccagatattattacccactctcataatctgttgtatttgtaaaatatttgagcaaagtagacagatatgctgttttgctttaaaccctcaattaactctggtcagatttattagtacaaataagtaatcccaggctgggatggcctatctccaacatctgtgaatcacctcctggcccttcaccaaatcagagtatgcattctggaaaaaccaggtcatattaacactggcctgaattaaaccaaaatcagtagtgagcctgagcatattaaagtgaagaaaatagttgctggacatctgtgccattatctgctctatgaatggaatctacttcccttatcctgtgatctagtttggatctacatccctgcccaaatctcatactgaaatgtaacccccactgtttgaggtggggcctggtggaaggtgactggatcatgggggtgggtttctcatgaatggtttaataccatccctgttgatactgtcctcgagacagtgagttcttgtgagatctgatagtttaaaagtgtgtggcacctcccccttgctctcttgctcttgctgtggccatgtgacctgcctgctccctctctgccttccgccatgattggaagcttgctgaggcctccccagcagcagatgctgctatgcttcctatatagcctgcagaactatgagccgattaaacctcttttcttataaattacccagtctcaggtatttctttatagcaaattgagaacagactaatacacccctgtggctccttcctttaactaaaggggaattacaagtatcaacccaaagttctagctatgacagaattcacattcagagaaaaaatatgtctaccacatcactggattatcagaatatatagaggatctgcccaagtaaatgaggtccaaatcaaccttcaagacatccaccaccatacaggcggtttcaatgtgtcaaagacagttgcccacatgcccttctaagataaaaaaggctttacaagaccaaagggtgcccctttatctcctgatctcattttccccatcacctgtacccatacattttttaatggaacagcaaggcatgacattaagagttcatgtctcttgactcaaactgaaacctaacaatttggagagtcacttaagaaggacttaccaatcttgactctcaatccaaggggccagaaactgccgcagctccattgggaagctgtcactgtagagctgatggagctgctccaggtaccgtgtgtcaagctgctgtagctgattccattgggccatcctgctaaaatcaggggtcccaactgtaaaccaaagtgtgcatatgttcaccacaagtcccagtaggggtaaacaatctagaagtagccattgcccaacacaggtgtcaggtctgtgactagggataaagatgctctggggaggaccctgcttctttctcccagtttattttatttttaaaaaatagagatggggtctctattttttgcctgttgcccagggtggccttgaactcctggactcaagtgatcctcccaccttggcctcccaaagtgctgagattacaggcataagccaacacacccagcctgtttctcccagtttagaacaatacaaacacattcacaatccccaccttgggataatcacagctcctttttattattttttgaagacagagtcttgctctgtggcccaggctagagtgcaatggcatgatcatgggctcaagagatcctcccacctcagcctcccgaggagctgggactataggcacacaacaccatgccacactcattttttaaaaaatgtttcgtgagacaaacaaaacatgcccaggctggtcttgaactcctgggctcaagtcatcctcctgcctcggcttcccaaagtgctgggattacatatgtgagccaccccatctggccacacatctcttttacactgggatgacaagtggctattatgccaggttctagaatccattatctaccagaagtgtgtgaaattaaaaaattacttaactcccagatttctattcccttgtctataaaatagagataataattcccactcctcagaggtattgagatattcctacagcatccagctcagtgcatggcacataacagatgcccaacaaatgtcggttcctttctttctcctccacagcccttttagttatacacagtaaacctgtactgtagccaaaatgtagaaattggatgtttggggttgggggacagagcactaattccaagactacaggtttaaaagtataaatgaggatccaggaagatctgcctgagattctcctactcaacaaataataactattttaaaaattgcttagtctgggacaacagagaaggaaagaaaaatgccaggcataaaagttgtcccaggttcaggaacatcccagtgaaatgctctggtatgagaaacccagccagctaattacctgtaatcctctttctgaatagcatgggtcatggaaatatcaatagaggccaagttgttttaacaagttctaaaattaggccaggcgcagtggcttacgcctgtaatcccagcactttgggaggccaaggcgggcagatcacctgaggtcgggagtttgagaccagcctgaccaacttggagaaaccctgtctctactaaaaacacaaaattagccaggcgtggtggcacatgcctgtaattacagctactcaagaggttgaggcaggagaattgcttgaacctggaaggcagaggttgaggtgagctgagatcgtgccactgcattccagtctggcaactagagcaaaactctgtctccaaaaaaaaaaaaagagaagttctaaaaataattacaagtcagagccaaagatgaaggtatgtacagaccaaggtccaatgagatggttctctgggatagtgagaacatttaatgagagactgaacacacgcaaacatactagagttcttgattctcagagaaggcacgaagaagcacctagttagcactggctttttcataaaaatgactgagcaaactggcaacaaaaccagcaggtcttctgttctcaaggcagcaaatgtaacggaatgaaaggtgcgatcgtggaacctctaactcctgcaacctctaactcctgggctcaggcaatcctcctacctcagcctcccaagcagctgggagtacaggcagcattgctgcacctggctaatttttttaaaaaaatttttgtagagatagggtcttcactgtgttgcccaggctggtctcgaactcctgggcttaagcaatcctcctgcctcaacctcccaaagtgctgggattacaggcgtaagctaccacgcctggcctgggatcaggttttctgacagaacctgagagggctgcacttctccctccctctttgggggacagactcagaatacccctcttgctactgtgaagacggctggtggagctctcaagcatatattcagggaagtgcaggtagtacctcccagcagtctttacattgaataattaataatctaaggcagcagcatccaacagaaatagaatacaggccacacatgcattttaaattttctggtagccatacttaaaaagttaaaagaggctgggtgcagtggctcacgcctgtaatcccagaactttgggaggccaaggcaggcggatcatgaggtcaggagatcgagaccatcctggccaatatggtgaaaccccgtctctactaaaaatacaaaaattagctgggtgtggtggcacatgcctttaatcccagctactagggaggctgaggcagaagaatcgcttgaacccaggaggaggaggttgcagtgagccgagatcgtgccactgcactccagcctgatgacatagcgagactccatctcaaaaaaaaaaaaaaaaaagaaaagaaaagaaacaggtgaaattaattttaatgtattttatttcatttaatatatccaaaatgttattgcaacatatgaacatacaaaacatattattatttatttatttattttttggagacaggcactctgtcacccaggctggagtgcagtggttcaatcacagctcactgtagcctcaacttcccagctcaaacgatcctcccacctcagcctctcaagtaactgggactacagatgcgcaccacatctggctgattatttttgtagagacggggtcctactgtgttgcccaggctggtctcaaactcctagactcatgcatctcagcctcccaatgtgccaagagtataggcttgagccaccgtgtccagcccacaaaaactattaatgagatactttacactcttttttttgctacgaagttttctaaatctcctgtgtactttacatgtgcagcacagctccaaggtattttccctcctcatgtatcaagggcttaaattccactggtgaaaaagctcagtaaagcaaatagagagaatgtcagaataaggtatttgccccaattaggccaatacgcttctataaattaactaaatattccaacaatgttattttgttgttattgtttttgagatggaatcgcctaggctggagtgcagtggtgcaatctcacctcactgcaacttcagtctcccgggttcaagcgattttcctgcctcagcctcccaagtagctgggattataggcacgcaccaccatgcccagctaatttttttttttgtattttttagtagacagggttttaccatgttgcctaggctggtcttgaactcttatcagttcaagaccagtctggccaacacagtgagatcctgcttataattaattaatttaaaaatgtaggctgggcacggtggctcacacctgtaatcccagaactttgggaggccgaggcgggtggatcacgaggtcaggagttcgagaccagcctggccaacatagtgaaaccccgtctctactaaaaatacaaaaattagccgagcatggtggtggccgtctgtaatcccagctactcaggaggctgaggcaggagaatcacttgaacccgggaggtggaggttgtagtgagccgagatcgcaccactgcactccagcctgggcaatacagcaagactccctctcaaaaaaaagcaatgttacttgccaccttccaccctaagattcacctgccacaggacaaatgctgcctgggcagtggtacaggtacactaagcactagccagagtaaaagcagtggctgacgtgcatactatatgctgaagcattgtaaccatggcatgtattgattgccctctgtaagaaatcaaaggccattagatctctcttacaatatttgcattagggccaagttaaaatctgcctcacatggaggttgcagtgagccaagattgtgcatctacactccagcctgggtgaccaagtgagactctgtctcaaaaaaaaaaaaaaaaaaatctgcctcatagactaaaagcatcatgacctgacttatgctatgcaagaactgatgtgcatacaaagaaatctgcataatatgccaatttatgtagattctattgcatacaaatttactgaaactctaaacctacacagtccagtatggagtcactagccacatgtggctactgagcacttgaaatgtggctgcttcaaactgaactatgctgtcaatataaaatacacactggattttgaggacttagtgaaaaacaaaagaatgtaaagtatcttgttcatgttgaaatgataatattttagatatattgggttaaataaaatatattattaaaattaacttcacccatttctttttacttcttttaatatggctactagaaaacttaacattggtagggcatggtggctcatgcctgtaatcccagcacttagggaggccaaagcatgtggatcacccgaggtcaggagtttgagaccagactggccaacatggcaaagctccatctctactaaaaatacaaaaattagctgggtatggtggcacatgcctgtagtcccagctactcgggaggctgaggcaggagaattgcttgaacccgggaggcggaggttgcagtgggccgagatcgtgccactgcactccagcctgggcaacagagtgagactgcatatcaaaaaaaaaaaaaagaaagaaagaaagaaagaagagaaaagaaaagaaaagaaaaagaaactaaaagaaaacttaacattacatatgtgacttggatcttatttttattgaacactgctactctagacaatgtagccaaaaagcggtggttctcctaaaaaaaaatgatttaaaaaaagaaccaactgctttttgtaataaactccagtgtttaaaattaattttaaaaacagactttattttttgagacagggtctctctctgtcacccaggctggagtgcagtggcaaatatagatcactgtaacctccaactcctgggctcaagcaatcctcctaactcagggacctgagtagctgggactaggggcacaagccacaatgttcagctaattttttgtagtttttgtagagacaaggtctcattttgttgcccagactgatcttgaactcctggcctcaagcgatcctcccacctcagcctcccaaagtgctgggactgcaggcatgaggcatcatgcccagccaaaaatagactatttaattatttgtcttggatacaaatgcagaggcatcacagtctactccctgaaggtccaaattaaatcatgaaacagcatcccactatacctgctccatcatagattaacactggggtcatgcatgaatatttgcattttcaaactaacatatcctaaaaacgtgtaagttattgaaaattatctaattcatttccagtacataactaaggattttttggttgttgctgttcttatttttagctggggacagaggagggctagtaagtagtacaataattgtgttcttttttttttttttttttttgagatgaaatactgtcacccgggctggtgtgcagtggggcgatcttggctcactgcagcctccacctcccaggttcaagcgattctcctgcctcagcctcccgagtagctgggactacaggcatgccccaccacgcccggctaatttttgtatttttagtagagacggggtttcactatgttggccaggctggtctcaaactcctgacctcgtgatccgcccgcctcggcctcccaaactgctgggagtacaagcgcaagtcatggcacccggcctgtgttatttcttaaaacagaaaccagctagtagttttttccataaaattaaagcaccaggctgggcacagtggctaacacctataatcccagcactttgggaggctgaggtgggcggatcacaaggtcaggagtttgagaccagcctagccaatatagtgaaaccctgtctctactaaaaattcaaaaattagccaggcgtggtggtgggcgcctgtagtctcagctacttgggaggctgaggcaggagaatcgcttgaacctgggaggcagaggttgcagtgagccaagatcgtgccattgcactccagcctgggcaacagagtgagactctgtctcaaaaaaaaaaaaaagaaggcaccagggcaccaacaatgactgatttcatgttttacttcttagtctaatcaccataggtaatactttaatagttattctacaggggaaaataaaagtataacttaaagccaaagaccaggtagtattttcaaggagagaatatgcaaatacttccatagtcttctccttacaggctgcttagctacaaaccatatttaattaacagcagtcacaggagatgactagccaaagtgtctaggaaaatcactgccaagcagctttactgtaactgttttactggaaaagacctcaaagagcccatgttatttcacaatttcaattttggtttttcaaattacaagttaatctaaagaactccactaagttctaactacattacttcatatctacggaataattctaagcctgtgggtttttaaaaaaattttattagacattctagaattgggcaacacttcattcaatgccataggatgaatgttctccccaagcctgtgacttaataactacttcattgagccccagaacacacaaagttatctgaggaacaacttgagtgccaactaccactctgggtgcataagagagaagacaattcattactccatataggctgccttaggacattatatggggctcaattcaaagcatttactcaggttaagtcagcagatagtagatgcactgtacaaaggcaaggtgggtgtaatcctgttttctataactgaagagaaaagaaaaaaatgaaacagcaagtcatcaaagactttttggacttttcaaaacaggaatttctcagtcccttggggataacctaccaacagcaagtcataaaacaaataactattgtctaattgggaacttattaccgtaaagatgactgaaaaagtctgtccaaagttacagttctcatttatatacttgaatctaatgaaaccaaaagatatattgagaaacgcagtcaagaccacttacaaaagggatttactacacagcttcataaaactttttaaagttaagacttgtacttcacatccatgcactagtggatttacaacgagggtgagggaaggcggaaagagagacgaaaatcaggctcatacaataatccagaacagaaagtgatctaaagataacttctgttccactttgcaatgtgtcatgacattttcctttgggtaccacctatacttttattataaatacatgcattttaaatagagcatacctgtgttttatctgctgcctacactaacctcttctttgctgtcaggaaaggcccagtgatcaaggcaaccaaagtataaagaaacacagaagatttcttgcactgaattctataggaaccagtccttttaagagatatgtttgaaagattataaaataatgttcaatgtggaaaatttagaaaaatataaaaaagaaaataaaagataaaaacatccatatcccaccatcccactatgcagaacaaaaactgacatgttgccaggtgtggtggtctgtgaccccagcactttgggaggctgaggggggaggatcacttgaggccaggaagtcaaggctgcagtgagctgtgattgcaccactgtactccagcttgggtgacacagcgagaccctgtctccgaaaaaataaaaattgacatgttgatgtaattcctttaaatctatttcagaatgtgtttgtgtgtgtgtatatatatatatatatttttttttttttacattggagtcatagcattaatacagctgcatattcttttaaagtttattgtgtagtaaacatttttctatgaaaagagtattgtgtttgtttgtttgtttgttcaaatagagaccagctgcccaagctggtctcaaactcctggtctcaagcgaccctcctgttttggcctcccaaagtgctgggattacaggcgtgagccacagtacctggcctgaaaagagatgttttgttattgttgttgttgttgtttgagacagaatctcactctgttgcccaggctagagtgcagtggcaccatctcagctcactgcaacctccatctcctgagttcaagtgattctcatgcctcagcctctggagtagctgggattacaggcatgcgccatcatacccggctaatttttgtatttttagtagagacggcgcttcaccatgttggccaggcttgtcttaaactcctgacctgaggtgatctgcctgcctcagcctcccagggtgctgggattacaggtgtgagccactgcgcctggcctgaaaagaaatttttatttaaagcgcataaaagaactattttgtttctattggtgttttcaatacaaccctgctaatcccactgagggccacataatttattaagatttggaaaccccaatttatttgttctcaccataccacgttctaaaaataatctgaagtatctgcaagtagattaggaaggaaaaaaatgagaaaagtaagagaaagcaattcacgctagagaaaaacattcaatcttcataaaattttcaccacaggataaacagcataatggatgacagagagtccacattaaaatactgtaggccaggtgtggtggctcatgcttgtaatccttgggaggctgaggagggtaggtcacctgaggtcaggagttcgagaccagccaggctaacatggcaaaagcctgtctctactaaaaatacaaaaattagccaggcatggtgaaatacacctgtaatcccagccacttgggaggctgaggcaggagaatcacttgaacccgcgaggcagaggttgcagtgaaccaagatggtgccactacactccagcctgggcgacaagagcgaaactccatctcaaaaaataaattaaataaataaataaataaatactgtagctttaaactattagagtcattcataatttaaccattcataattactctagacattaagaatggaatttcaagtttaaaacataactcaaaataagtacacttatatagtaagcacacaatttcatagttttaagtccaaatagtacctttgtaagatttaagactagatacttgcaataagaagtctatatataaatctagttttgatttcctaaagagacaaaatattaacacttgagtgcccaatctgaaacaaattactataattactgtaatgttcaattacatataacaggatttgctttaaaattaaaaaccaatgacgatcaagcttgtaaaaatgaacatcaatctataagaaaacttgagttatagttccctactaatatgacaaaatttgaatatatgaaagaagtaaaggccaggcatggtggctcatgcctataattctagcactttgagaggccaaggtggaagagggattgcttgagctcaggagttcaagaccagcctgggcaacaccgtgagaccttgcctctacaaaaaaatttttttaaaattagcctagcatggtggcccatgcttgtagtcccatggaggctgaggcaggaggatcacttgagcagattgagactgcagtgagctgtgatcataccactgcgctccagcctgggtgacagagctagaccccatctctaaagaaggagcaagagcttaacaaacctaattccctctaaattaaaagtaacaaacatgatttgtcaattactgagtgcacagttgattgttaaagctgcctaagaacaggtctgagctctacaaaaactaaaactaaaacaagaaaacccacaaaacagaccaaatttgtgcatcagatgacctccccacttgggaacacttccacttccccaaccagacacattcctctgtatcagtgtggtgtgggggaaaggacagtagagacgggagctggatgggcctgggtgcaaaaccctgcctgacatttattagctatttgtctttgggaatggtatttcactaccaaatgggctttctcttcagtaaaacagggaactctctctcctttgaagaactgttgtaaagttaaaatcaataatggttgtacagcatccctctgtgctggtgctgctggtgccagatcctcagagctgcagttattgttcctttcccccagggtctccctttcatggacatttcttactttttttttttttttttttgagatgtagtctcactctgttgcccaggctggaatgcggtgggcacaatctcagctcactgcaagctctgcctcctgggttcacaccattctcttgcctcagcctcccgagtagctgggactccaggcgcccgccaccacacccggctaattttttgtatttttagtaaagagggggtttcatcgtgttagccaggatgatctcaatcacctgacctcgtgatctgcccacctcggcctcccaaagtgctgggattacaggcgtaaagccaccgcacccagccagatatttcttatcttaaacccatttccttagtgtcctggaaagcaggttaatccatcagattcactaggggttaagtgtgataatcactaatcagctttccctgctaagtaaaatacatgcatttcaatgcacactcttatcatatcgggagggaaggagtcagtgatgctgtgatttggcatgttaatttaaggagagaagggaggtcaggagagctgggtggtgacctgatcaaatatctccatacgtatttcacctaggatggctctaggtcctaaaaagagtaaaaggtgaaaacactaagtgatattcaaaacaaaagaaaaagatgaaaaataagaaccttggttaaagagcagtcgaaataagtaatgattatagctatgatttatatagcactttttacaagaagccaggcgctgttttaaacacttgacatacttatttgctcatttcataattgtaacaaccctatcagataggtactatttttatcccactttacagaggagaaactgaggcacagaattttaagtgatttggccgggtgcggtggctcacgcctgtaatcccaacactttgagaggctgaggcgggtggatcacgaggacaggagatcgagaccatcctggctaacacggtgaaaccccgtctctactaaaaatacaaaaaattagccaggtgtagtggcgggcacctgcagtcccagctacttgggaggctgaggcaggagaatggtgtgaacctgggaggcagagcttgcagtgagccgagatcgcgccactgcactccagcctgggcggcagagcaagactccgtctcaaaaaaaaaaaaaaaaaaaaaagatttttaagtgatttatccaaagtcacaacacaggtagtaaaggcatggagctggaatcataacgcacagtctgttttcggaatgtctgttcttcaccactataggagtcttgttttttcttttttttaaattagagatggcgtctggccatcttgcccaggctggtctcgaactcctaggctcaagcgatcctccagcctcagcctccaaaagtgctgggattacagatgtgacccaccgtacccagctactacaggagtattagaaagtgggaattttggccaggctcagtggctcacgcctgtaatcccagcactttgggaggctgaggcaggtggatcacctgaggtcgggagttcgagaccagcctgaccaacatggaaaaacctcatctctactaaaaatacagaattagctggccatggtggcacatgcctgtaatcccagctactcaggaggctaaggcaggggaattgcttgaacctgggaggcagaggtggcagtgagccaagattgtgtcattgcattccagcctaggcaacaagagcaaaactccatctcaaaaaaaaaaaaagaattttagttgatttttaagtaacccacaaaccaaccattgtaactagccaatgtgatcttatggtattttaatagacatactagtacttggattttgaaggatctagtagtctagctgtaacagacccacatctggatgctattctaattctgtgtatcaaaattgaaatggaacactaaaacaaccaaacacatccagggagggacaaccagggtgtgaggagttgaagaccttgaatattttgctcagcaagaagatgcaggcaacaggagtgaggttaggagagaaaaacatgaattacagaagagtggcccctcaaatacctggaaatctgtacgagaaaggataaatcactctaggactagaacctgtctcctcacaacatcttctcccaaattcttccccatgaagtaatacagaggtctccaccctggctgacactaaaaaatatatacagcaagaaagatgcctgggaaccaaaccagtgccaaattggaacctctgacagtgggaccaggtttcaaatttcgaaagctacggctgggcacggtggctcacacctgtaatcccagcactctggggggcctaggtgggtggatcagctgacgtcaggagttcaaaaccagcctgaccaacactgtgaaagcccacctctactaaaaaatacaaaaacattagcaggcatggtggtggatgcctgtaatttcagctacttgggaggctgaggcaggagaatctcttgaacccgggaggcggaggttgcagtgagctgagatcacgccattgcactccagcctgggcaacaagagcaaaactctgtcaaaaaaaaaaaaaaattcctcagatgatgctaaagtgaggccaaagaataataataaattttttcgtgatcattaataaatataacgagaacctcgaaatcagagcagagatcagggctcaactctgaatacgcctcagaatctcctgaggagctctacaaagccaggtgccagttcttagcccagaactagcaaataataatctccagggttctaatgaagcagtacactgtagagactgtacaaggagaccacggcagaagaggaggctggagaaggctctcctgtcaagatatctgcactttcttccaagggcaatggggtaagtctttgaaaagctttaaacagacaagtgatagtttgatttacatttcaaaaagatccctcaggctgcaataatcctggtgggaggtcgtggctgcccaatttaggtagcagcattgtaagtgttttgaggcagacatccatcttctgtgacattacagagctacatgtgatgggacttggtgactgactgaagggcaaaggtgactcagagaaagggaggagtaagtgacaacctcccaggttcctgtggcatttggtattcagatggcggtcacatgctcagcatggtaaatgtcatggcaggagtgccaacattgagagggcaattgggccacacagtctctaaaaactgtttgttctataaattactgtcaagctcgattccctcaagacattacagccacagcaactcaaaataatactgtaggaaaagcaagtagatatttaaccaaaaagggttcagggtttgtactccagctgaatggtaaaacctgccatcccctcaggaaaagaggcagaggcaagagaaaaatcaggcagaaacatcagagccaaaatgcatagggggccatggcaagagctgttaactgtctcccaacatctgtgtgcttgcctccaggccattttccacactgtgggtagagagaccttttcaagacacaaacttgatcttgccacacccctacttaaaaccctcctgatgactgctctgttcttaggctaaaaaacaagatttgttatcttaaggcagaatagcatggatttgaatcctggttccaccacttcgatcacttagcgtgtagctggtgccagttatttatcctctttgtgccttaatttcctcatctatagaaaggggagagaacagtgcttacctcacagggttgctgtacaaattcatcgagctaatgaacacgtagcactcaggagcccaatagcgtgcagcatgtaagtgtttgtactcattactagcatgaccgacatcctggctggctctgcccctctcgtatggctggtaccagctggtggctaagttcctggcactcactctgctccttcttcaggtcctcaaaaacaccaggctcctgcctgccactggccctcacacatgccttccttctatcaccatcaccatgacttgcacccaagtactgtgactccattaacttggactcataaccactatgctggactgaaagccccatgaagacaagaagagtcttggcttttgctcactagcgtgtcctaccctgaaccctggcatccagcatagtgtctggctcataataggtgctgaaaaaataggtattgaatgaatgaacgactggagtgaattacaactaaagtgtgtagccaggttctcccaagtgaggacactgcgcccaattagaaaatattctgaggaataggccaactcttccagttttgctgtttgaaaaattcaagaatgatcaagaatcactgattcaagaataatccttcagtgattcttcaataagagtaaaatcacagcactccccagctcaaaaacacacactaacatctcattgtccaatgcaaaatctttacccttatctcaggctctgtaactactcagccaactttagccccttccagttcctctctccagcctacagatgactttcattttttgagacagggtcttgctctgttacccaggctggagtgcaataatacgatcacagctcactgcagcctcaacctcctgggctcaagcaaccctcccacctcagcctcctgagtaactgggattacaggcacatgccaccatgtctggataattttcttttttttttttttttggtagagactcagtctcaccatgttgcccaggatggtctcgaactcctgggctcaagttgtcctcctacctcggcctcccaaagtgctgcgattataggcatgagccatggcacccagcctccaggtgactttcataagtgttgtcttccttcaagtcaacttatctcctccttgccccccacccacagactttgttcctttttcatatttgttcttgcctaaaatgcttttttctctgggtggcgttatccatccctttcttgtgtctgtcagacaggctctccctaaccccacccctagtccaatgactgctttcactctgaatccccacggtacatatataagcatctgaggctctttcctattggctttgattctacctccttcacttgaggagcagctctctgctggcaaccacgtaccatcctgatttagaacttcccacaggctaacttaagacaccaaataaacacttgcacacacacataaccaccacctcccattacagaagtacacctcccctactgaacagatgatggccacgatactgaaaagcatggcatcaacatgacaactgcatcctgaaagatcagcctatatataggtttggttatcttgaatttcgagtttggagagaagcaaagtatttttctaataaactgtgaatgctgaggaattcaccttcataggagtcagaaacaggctgccaaacttttcaaaagaaaaacagtggtaggttgagcaagcacattgtcatgtcagattttccaggctcgagggccactgaagggagaagagcgagtagctggaaaaaacctgtgggtactgttatctttggccaaagctcaaataaaagaatcacaaaaacatccactgatctaaaatgctatgtaagtcattaatattcatctaagagaggcaactgaaataaagcagataaagagaacttaagccattctcttacctcagcctcccaagtagctgggattacaggtgcccgccaccacacctggctaatttttgtatttttcgtagagatggagtttcaccattttggccaggttggtctcaaactcctgacctcaagtgatctgcctgccttggcctcccaaagtgttggggttacaggcgtgagccactgcgcctggccaagaatttaaatttctgagtctcaaagtcataaacctataatatggctcaatgcttacctcagtgcttactggagagaaggaagattcttttctcaaatttattcaggtcactttccctatacgaaatactaaggtagtcctggtcacttacatggaacaatatacctggggctgacgatgcttggatatatagaagtccttcagtcaaaggaactatgaacttttgaggcagaacctcaaattcagaaggcatttgtggtggttggataacatggccctaaattctctcattatgccccactctctgagaggagggggtctttgttcccttcctttgaatctagctaagtccataactgttccaaccaatagagcatgctgaaagcggcgagatgtcatttccacctgatttcattggaagtctcattctccagaaccagccacattctgtgagaaacccaaggcaaaaggggaggccacaagtaggcacgtggtctacagtctcagctgaaatcagcctttgagtcatcgcagcccagacatcagatacaggagtaaagaaaattccagatgattattacccccagccgcttgagttttctcagtgagacctcagacatcgcagagcaaagacaagccatccctgctgttatctaaattcctgcccacggcatcttcgaacatagtcaaatgattgctgctttaggccactaagtctgagctggtttattgcattcggcaactagaacaacatttttactaacatagtgattgaatgtagacttaataatgaaagagtccaacttccataagaaaaaaattcataattttaaaggaagaggctttgctgttaaagttttttttttttgtttttttttgtttttttttttgagacggagtcttgctctgttgcccaggatggagtgcagtggcgtgatcttggctcactgcaacctccacctcccgggttgaagtgattctcctgcctcaacctcccaagtagctgggactacaggtgcccggtacaacgcctggctaatttttgtattttcagtagagacagggtttcaccatattggccaggctggtctcaaactcctgaccttttgatctgcccaccccagcctcccaaagtgctgggattacaggcatgagccaccgtgcccggcctgttaaagctattttaatagtaaacttattttctctatgcactcctttctaaattattcagccccactttctttcaaaacaacgtttatacactgacaattctcaaatttatgtctctagccccatccgctaatatgaacatcagacacttatagccaactgcctcttcaatatctccacctggatgtctaaaatgcatgtcaaacttaatgtatccaaagccaaccccttcattaaaaacctctcccagccggcttctcctccagtctcccccattctagcaagtgacaactccattcctgcacatgttgaggctaaaaaccttgaaatgagccttaacttcaactccagtctctctctctcttcctccccctcctcctgccacacctaatccattaacaaatcctgttggctctgtcttcaaaatctggaagtgaccgggcacaatggctcaggcctataatcccagcactttaggaggctgaggcgggtggatcacttgagctcaggagtttgagaccagcctaggcaacatggcaaaaccctgtctctacgaaatatacaaaaattagccggatatagtggcgcaagcctgtgatcccagctacttgggaggctgaggtgggggtatcacttgagcccaggaggcggaggttgtagtaagctgagattgcaccactgcactccagcctgggagacagagtaagatcctgtctcaaaaaaaaaaaaaaaaaaaaaaaaggaaggtgagcctttctcacaacctcccactgacgcagccttaatccaggccaccagcatctcttacctagatagctggactaggctaactggcctggatgctttcatccttgtccctctaccttctattctccacattacagatcctttcaaaataagagtcctggctggcacggtggctcaaacctgtcatcccagcactttgggaggccaaggcgagcagataaattaaggtcaggagttcgagaccagcctggccaacaaggtgaaatcccgtttctactaaaaatacaaaaattagccaggtgtagtggcaggcgcctgtaatctcagctactcgggaggctgaggcaggagaagttgcttgaaccggggaggcagaggttgcagtgagctgagatcgcgccactgcactccagcctgggtgacacagcgagactccgtctcaaaaaacataaacataaaaataaataaaaaataaaaataaaaacagaaattcgccggcatggtggcccaagcctgtaatcctagctactcgggaggctgaggcaggagcatagcttgaacccaggaagtagatgttgcaatgagccgagattgcgccactgcacttcagcctcggcaacagagcaagattttgtctccaaaaaaaaaaaaaaccagagtcagatcatttcattcccctgctcaaaacccactcaggaaaaaatccaaagtcctaccacggcccaccagtcaatccattttgccccagatgtctctctttgcctccttccctacaactctccccttgctcacagctgtcccctctctgctcctggaacacaccttgcccgtttctgccctaggactcttctctccacctgataggctctttccctagatatctccatggcttgctccctcacttcgttcaggtctctgcacaatgtctcttgacacccctctatctaaaacagcaacatctcccctgctgaattctcctttacagtactcatcgccctccattgttcatatatttcttttttcatgtatctccttccaatatgatcaactaggaacttaagccccataagaacaaagacattcttcagttcactgctatttccccagcaactacagaatgctcaaatatttgaataaatgaatgaaaattaagtaagtttttcaaaaatctagaacacacttttagcatagagaaaactgaagtaccataggaggttaattcacttcatataacagcataaactgcccttccttaagtaggagacaataggtacaataatgcatgcaaatgttaagtggtaaagcaaacatacaaagtttcccaatagaagagtttaaattaaaatctaaacttccagccaggagcagtagtggacgtctagtcccagctactcaggaggctgaagcaggaagatcacttgagcccaggaattcaaggccagcctgggtaacataggaagaccccatctctaaaaacataaaaataaaaatctaagcctcaaaagaaaaaaaataaataaacaaaaggcatttcctataaagttaaactgttacagaattgtttttcttaaactgcaataatgagactttagcactctcttgtcctctaaaagacattatttcatgacatgtgcccattggcagtatttgagaatctaagaaagtagatcacactaaatattgatatgcagacactaaaatcgtacaaccacttggatgactaggtttgagatattcccaaagtgacaggtttttgttttgttttgttttgttttttgagacaaggtctcgccctgtcgcccaggctggaatgcagtggtgcaatctcagctcactgcaacctctgcctcctgagttcaagcaattctcctgcctcagcctccctggtagctgggactgcaggcatgcaccaccacacctggctaatttttgaatttttagtagagacagggtttctccacgttagccaagctggtctcgaattcctggcctcaagtgctctgcctgcctcagcctcccaatgcaaccagcctttttttttttttttaacttttattttaggtttggggttacacgtgcaagtttgttatataggtaaactcatgtcagaggggtttgttgtacagcttattttgataaaatattaagtattaagcccaatacccaatagttatcttttctgttcctctccctcctcccactctccaccctcaagtaaaccccagtatctgtggtttccttctttgtgttcacaagtccttatcatttagctcccacttataagtgagaacacgtggtcttcggttttctgttcctgcattactttgctaaggataatagcctccagctccatccatgttcctgcaaaaacatgatctcagccgagcacggtggctcacacgtaatcccggcactttgggaggccgaggtgggaggatcatgaggtcaggagttcaagaacagcctgcccaacacggtgaaaccccatctctactagaaatacaaaaattagccaggcatggtggagggcacctgtaatcccagctactcgggaggctgaggcagagaattgcttgaacctgggaggcggaggttgcagtgagctgaaatcgtgccacctgcattccagcctgggcaatagagcaagactccatctcaaaaacaaacaaacaaacaaacaaacaaaaacatgatctcgttgttttttatggctgcatagtattccacagtgtatgtaccacattttctttatccaatttgtcactgatgggcatttaggttgattccatgtctttgctattgtgaatagtgctgcaagtaaatctctttaaacagcaaatctattactgcctgcttttcaatgctttaccctcaagaaacttgggctacaactcaataacaaaaagcagcatttttgttcttgttgtttttaattcagtttcttttttttgttttgttttgtttctaagagacagggtctcactctgtggcccaggctggagtgcagtggcaggatcatagctcactataacctcgaactatcaaactcctgggcctaagtgatcctcccacctcagcctcctgagtagctaggactacaggtacatgctgccaaacccagctaattaaaaaatattttttttttggtgatgaggtctatgttgcccaggctggtctcaaattcctggactcaagcgatcctcctgcctcagcctcccaaaacattgggattatacagatgtaagtcactgcactttggccatgtgttggttttttgttgttgttttttgagacggagtcttgctctgtcgcccagactagagtgcggtggcgagatctcggttcactgtaacctccacctcctggttcaagcgattctcctgcctcgcctcccgagtagctgggattacaggcacccaccaccatgcccagctaactttagtatttttagtagagatggggtttcgccatgttcacctggcctcaagtgatccgcccaccttggcctcccaaagtgctaggattataggcatgagccaccacacccagccttttttttttttgagacagagtcttgctctgtcgtccaggctagagtacagtggcatgatctcggctcactgcaacctccgcctcccaggttcaagcgattctcctgcctcagcctcctgagtagctgggattacaggcgcctgccaccacacctggctaatttttgtatttttagcagagacggggtttcaccatattggccaggctggtctcgaattcctgacctcgggtgatctgcccatctcgggtgatctgcccgcctcggcctcccaaagtgctgggattacaggcgtgagccaccgcgcccagccatcttctcatttctttggtgagattgtttggtttttgcttctgaagattttcctgtttttctttttttgtttttttttttaagagacagaatcctgctctgtcacccaggctgaagtgcagtggcgcgatctcagctcgctgcaacctccgcctcccaagttcaagcatgcaccacctacaggtgtgcaccacaacacccagctaatttttttttttttttttagtagaggtggggtttcactacgtattggccaggctggtctggaactcctgacctcaggtgatccacccaccttggcctcccaaagttctgggattacaggcgtgagccaccacaccgggcctccctgttaagcccagtttatccagtatttctaggtgttttgtacaaaagagttttcagggcatttagcctaacataaagcagaaacaaaagtcaggatgagtcaagtaacagtatttgagaaaacttcagaggtagaaccaacaggatttgctgatgctttgaatgaaagcagagataagacagaacagggaatttaaggatgattcctagatttctggcttgcacaaaggagtagatggtggtctaccatttatttagatggggaagtcagacagggagagaggcacaaacttgcagagagaaaagtttaagagttatattttgggcaagtagacaggagacaactacaagttacttgagggaagatgtcaagtttgcagcaggatgcaggagctgggagcccagagcgactgggtggagggccacacttgctagtcatcacagcggctaacacgtcttcacagtaaaagccaaaacaggcggggcacggtggctcacacctgtaatctcagcactttgggaggctgaggcaggcggatcacctgagaacggggagttcaagaccagcctgaccaacatggagaaacctcgtctctaattaaaaaaaaaaaaaaaattagccaggcgtagtggcgggcgcctataatcccagctactcaggaggctgtggcaggagaatcgcttgaactcaggaggcggaggttgcagtgagccgagattgtgccactgcactccagcctggtcaacaggagcaaaactctgtctcaaaaaaaaaaaaaaaaaaattgaggccaggtgcggtggctcatgcctgtaatcctaacactttgggaagctgaggcaggtggattacctgagctcaggagttcaagaccagcctgggtaacacagtgaaaccccatctctactaaaatacaaaaaaattagcagaacatggtggcgtgcacctgtaatcccagctacttgggaggctgaggcaggagaatcacttgaaactgggaggcggaggctgcagtgagccgagattgcgccattgcactccagccagggcaacaagagtgaaactgtgaaactctgtctccaaaaaaaaccaattttaataggtataccattatacacccattaaaatggctaaaatccaaaacactgacaccactaaatgctggtgaagatgtggagtaacaggaactctcactcactgctgatgggaatgtataatggtacagtcactttgaatatagtttgatagcttcttacaaaactaaacatactcttaccatatgatctagcaattgcactccttgatatttatccagaggaggtgaaaagtcctgcactggaatgtttatagcagctttattcataactgctcaaacttggaagcaaccaagatgtctatccttcaggtgaatgtttgataaacaacatgtggtatatccatacaatagagtattactcaccaatgaaaagaaacaacctatcaagccacaaaaaaacatgaagaaacctgaaatgcatatcatttactgaaagaagccaatctgaaaaggctacacactgtatgtccaactatatgacattctggaaaagacaaaactatggagatattataaaagatcagtggttgccagtggttcagcagaggaatgaataggtggagcacagggggtttctagggcagtaaaactattttatataattgtgtactggcaaatatacatcatcacacatttgtcaaaatccatagaatgctcaacagagtgaaatgtaatgtaaactatggacttcaggctggacagagtggctcacacctgtaattccaacactttgggagactgaggcaggaggattgcttgagcccaggagtttcaggctatagcaagctatgatgatgccactgcaacctggcctggacaacacagtgagaccctacctctaaaaaataataataataaaataaaaatagaaataaaataaactcaggaatttggttaataataatgtatcgagttggttcattagttgtaagggacgtactatactaatgcaagatgttaataatagaagttgtgggagaaagtaaggggtatatggaaactctctgtactttccacataatttttctgtaaaactaacactgctttaaaaaataaagtctagactggccgcagtggctcacgcctgtaatcccagcactttgggaggccaaggcaggcggatcacgaggtcaagagatcgagacatcctggctaacatagtgaaaccctgtctctatcaaacatacaaaaaattagccaggcgtggtggcagacaactataatctcagctacttgggaggctgaggcaggagaatcacttgaacctgggaggcggaggttgcagtgagccgagatcatgccattgcactccagcctgggcaaaaagagtgaaactccatctcaaaaaaaagaaaagaaaagaaagaaaacacgtatctactaaaattacaaaaactagccgggtatggtggcaggcacctgtaatcctagctacttaggaggctgaggcaggagaatcacttgagcccgggaggtggagtttgcagtgagccaagatcacaccactgcactcagcctgggtgacagagcgagactctgcctcaaaaataaaataaaataaaaataataaagtctattaatttttaaaatatattaattgagccgggcgcggtggctcacgcttgtaatcccagcactttgggaggccgaggcgggtggatcacgaggtcaggagatcgagaccatcctaacacggtgaaaccccgtctctactaaaaatacaaaaaattagccgggcatcgtggcgggcgcctgtagtcccatctagtcaggaggctgaggcaggagaatggcatgaacctgggaggcagagcttgcagtgagccgagatcgcgccactacactccagcctgggcaacagagcgagactccgtctcaaaaaaaaaaaaaaaaaattaattgagctttatggttaagtttttaaaaagataaatctgacccataaagtttaaataatagtcaagatggaagatgagtgatctccccaaggagacaagcttttctatgaaaatcttatcaaaatgtataatgtacttagaaaactaagtgacctcattacacatcatagttttgcatgatgtaaccactcttcagagaatatctcattttgtccttcagctcccacacaagagaaggttaaggaaattccactactcatgaaattataatcccacaatgtaagtgaagtggtggctgtgcctaggaaagaaagagaatacacgcttagagagaatctagaaagaaacattatccagtttgtgttggggatagcccatgatctaaattctaaaaagcacacccatatagaacctagcctgggctgggtgcggtggctcatgcctgtaatcccagcactttgggagactgaagcaggtggatcacctgaggtcaggagtttgaaaccagtctgaccaacacagtgaaaccccgtctctactaaaaatacaaaaaaattagccaggcatggtggtgcatgcctgtaatcccagctactcgggagcctgaggcaggagaatcgcttgaacctgggaggcagaggttgcagtgagctgagatcgtgccattgcactccagcctgggcaataagagtgaaactccatctcaaaaaaaaaaaaaaaaaagaacccagtctgaagcatgaattcacattgcgttttccagtcaatcactcagccaaagagaacctgaggtggccaagataatgtaacaaccctatcaagtaggtgttattcccatttacagataaggacagaaatgttaagtgactacacatggatgcaaacttggaatcttcaaactcccaggctagtagccaaattacctgtttttaaatctcatctctgctatctgatctctgccaagcaaatttccctttgaatttgttatgcaaacaattaacgagaataaaggaaaatgagagctttatatacgttacatgtaataactggaagttaactttattaagacatctgaaataagtcaacacttttaaaacttaaaggctattctttaccagaatcgtctgtaggaattaaccccagcagtcagaaagtaccttaaaacaaaaccaacattaatctggtaatgtcatgacttcataaaatatccttaatattcaggtacgtgcataccaagaagagtaaacagaataaaaagaaatctctaaaacattttccctcattcactacatgtctactcttccacttacctttatctctaaaacaaaaacattttctaaaccctgtggacatgacttcactaatccaaagaagactttatattctatgggccttgtaaagccacatttctcaaactaaggaccaaggaccatctgaatcagaatatctgctatgcctgtgaggatgaccccagataaactacatcagaccctctcaggcagatccatagattctttcttctttttaagcaaataacccagggattcttatgttaaaacctttagaccaacctttctcaaactcttcgctctcatggcccctttatttattattttttaaatttaaaagaaataataagcaaaccgggtcaggtggctcaaaactgtaatcccagtactttgggaggctgaggcaggcagatctcctgaggttgggagttcgagaccagcctgaccaacatggagaaacccccatctctaataaaaatacaaaactagacgggtgtggtggcacatgcctgtaatcccagctactcgggaggcttaggcaagagaatcacttgaattcgggaggcggaggttgtggtgagccgagatcgcgccattgcactccagcctgggcaacaagagcgaaactccatctcaaaaaaaaaaaagaaaaagaaagaaagaaaagaaataatagagccgggcgcaatggctcacacctgtaatcccagcactttgggaggccaaggtgggcatatcatgaggtcaggagttcaagatcagcctggccaacatggtaaaaccctgtctctactaaaaatgcaaaaattagccaggtgtggctgctagcccctgtaatcccagctactcgggaggctgaggcaggagaattgctggaacctgggaggtggaggttgcagtgagccgagatcatgccactgcactccagcctgggtgacagagtgagactccgtctcaaaaaaaaaaagagaaagaatgattgataaaccaactgggatactggcagatattttctcaaaaatgaaagaagggaagctgtctgttcagggaaagcaactgacaatatttgttgccaatgataaaatttgagctttagagtaaaaatcagaatttgagaaagtttgtatccaccactgtgagtctgacagttgtctaatattaatgattattaatgaaaccccatctctactaaaattacaaaaattagctgtgcgtggtggcacacgcctgtagtcccagctactcaggaggctgaggcaggagaatcacttgaacccgggaggtggaggttgcagtgagcggagatcatgccattgcactccagcctggcaacagagcaagactccatctcaaaaaaaaaaaaaaaaaccggccaggtgcggtggctcacacctgtaattccagcactttgggaggccaaagcgggcggatcacaaggtcaggagatagagaccatcctggctaacatggtgaaaccccgactctactaaaaatacaaaaaattagccgggcattgtgacgggcgcctgtagtcccagctacttgggaggctgaggcaggagaatggcatgaacccgggaggctgagcttacagtgggcccagatcgcaccactgcactccagcctgggcaacagaatgaggctctgtctcaaaaaaaaaaaattggcggtttatgggtttgtggggggtacaattcctgcctgtccaagtgacagactcatttaattatccccaagttaatgtttaagtgcaatggggtaaaacatgcactctgttaactaaaaagccacatttccaaatagtatacatattacgattaaaacattaaaaatatatgtgtacagatttattcatataagcccaaaaacaaatgtcagacaatgtttctgtctttggaacctgactcaaaataaggttcctcctgttggcttcttcctgagacacagccaacgctaatttgccgcccaggcaaatcatctatgcctatcattaggaaatcaaatttatgatatgcatagcctagaatactactctgtagtttttttgtttttgtttttgttttttgagacagaatcttgctctgtggcccaggctggagtccagtggtgtgatctcagggttcaagtgattctcccaccacagcctcccgagtagctgggattacaggcacacactaccatgcctggctaattttactatgtagattttttaaacatgaggtatatacacatgtatttgcattgagtattctctaagataaagtgacaaaaagcaaaatacagagtttggtgtatttgctgctatatatggaaggaacaacacccagagaataacatgtttgcatgcatacatatgaagtaactcaggagagataaatagtaggtaactagctgtccctgggaaagagtcccaaggataaggtgcggactaactttccacttactacatatcttttgtactgattcatttcaaaatttactctaaaatattggtattacaataaagaaaactggagtctagaactgaatgacaaaactgatacattcttactacaaatctgtggttaagattagcattaatctttcctaggcaaagaggaaaaagtttaacccaaagactgtatggatcttctctaccctacatctccaatctcattcccattactcagaaaatattctcactgggtatagaggtatgaactcccattggaaaacttagggtaaacgtccgtggaatctatggggcactgctgacccaggacacctgggatatttctgcagaaacaggattttttttttttttttttttgagatggagtcttgctccatagcccaggctggagtgcaatggcgcgatctcggctcactgcaacctccacctcccaggttcaagcgattctcctgcctcagcctcctgagtagctgggattacaggcgtgagccaccgcacccagccagattattcttaatcagttgattatttctggctccagaatgcttcaattattccacctgcccctatgtataagcgttaccaccctaattatgcttgtttttgtttttttggttgtttgagacggagtctctgttgcccaggctggagtgcagtggcacgatctcgactcactgcaacctctgcctcccaggttcaagcgattctcttgctttagcctccagagtagctgggattacaggcacgcgtcaccacacccagctagttttttgtattttcagtagaaacaggatttcaccaagtcggcaaggatggtcttgaactcctgacctcaagcaatccacatgccttggtctcccaaagtgctgggattacaggcgtgagccatcgctcccggcctcctaattatgtttcattttggttaatgtttcaataaatgtgctttccctaaacatactgatgaaaagaggcccaaatgcaaaactgatttgtcgagaaagtcagtctgagatgaaatatttattatgtctaaaccacaagtagaaaaaaattcaaaggccgactatttcaatgctaactcaatgcaatattgcactttgtttggtttacgggagaggtaatttacacagctaacatttgggttttcaagattacattgtggggagagaaggggaaaacaagaaaagtctaatgcttttagattctgtcagaaaaagtgtttgctaaaaagcaaaacaaaatgaacatgagaaaaaatgtgaaaaaacatgcattttaggaagctttcaccgaagcaggtgctcaagttcagactcaaatcttccaactcttgtaataaaaatgagaggtcagaataccacaaactaatcaaatcaatcaaacaaagcgggaaacaggtggctgacaccagactgggcagggttttcctaaattgggcttaccttcactaatccaaatcagttttcagaaatggcttctacaaaaactacccaaacatccccctaataatttgcactcctcctccacaatagggaagccaagccgtttatttcccagaaggtttactttctctttcaagctctgctggcttcttcctgccccgcatacggccaggaaaaaagaaaagcactgccttttctttcctgccttctctaaaactggggagatggggtgagagaacctgtttcatggacaagctgggtggttcttaactgcaacactgttctgaatacagattagtttgcaaaggaaagttacaggacaggaaaataaaggtctacccctccaactaactcatacacatgtacatttgcatgtacgcacacacacagatgtgagggcacatttaattcagctgagtaatgtgcagcaatcagctcccagcttcatacctggccaccgggatgcctcctcactcccaccttctttacctgactcaaaataaggttcctcctgttggcttcttcctgagacacaaccaactctaatcattcctcttcccctcaaaccttcaacactacctgcactttctgggtcgggagcaattccttgggtggtaatccatttttaatgtgttaaatattacttaaaataagggagaggtaatcatggactgtgggcaatgcagagatttatcagaagggcatttgtgtaaacaggaatttacagtttgccttacctattccttttatatgacagcctcaatttcctctaacagaatgtaagtcccccatccctattcatttagtttttttcccattaggttagaatctgctaattattctttctctcctttgggtcattagtggctgccatgaatcataatttgcctgactttgtaatatctaacagatattaccattttagtttagtttttgatatgacagttttttgttttttgtttttgtgacggagtcttgctctgtctcccaggctggagtgcagcggcgcgatctcagctcactgcaacccccacctcctgggttcaaaagcaattctcctgcctcagcctcccgggtagctgggactacaggcacccgccaccacaacaggctaaattttatatttttagtagagacggggtctcactatgttgggcaggctggtcttgaactcctgacccgcctcggcctcccaaagtgctggaattacaggcgtgagccaccatgcccgacctcctaattatgttttattccacctgcccctatgtataagcgttaccaccctaattatgctttttgtttttcggtttttttgagacagagtctcactctgtcacccaggctgtagtgcagtggcacgatctcggttcaccgcaacctccgcctcccgggttcaagcgattatcctgcctcagcctcccgagtagctgggattacaggtgcccaccaccacaactggctaatttttatatttttagtagagacggggggggtctcactctgttgggcaggctggtcttgaactcctgacctcaggtgatccacccgccttggcctcccaaagtgctgggattacaggcgtgagccaccgcactcggcctgatattatagtttttaataagagtaattcagcctaggcaacgtgacgagatcctgactcaaaaaaattagaaaattagctgagggtggtagcacacacctgtagccccagctaccccgaaggctgaggcaggaggatcacttgagcctaggaggtcaaggctgtcatgagctgtgatctcaccgctgcactccagcctaggtgacagagtgagaacctgtctcaaaaaataaatagtaataatagtaattattagcacttgaatgttacctgtctgcccggcactatgcaaagtacttgatatgcatcatcttgcttcatcctctcaattactctacaagtggacctcgtttccacaattgtggacagagaaactgaaaaccagagaagtgaaaacaacaggcccaaggtctaagagaaggcagaactgggattaaagcccaataggtctgacctgatagtccactcttttaactgctatagtaactttggaccatgaaaccctcaaacataccaaccaagtgtttcaaaactacaatagcaatcaccttaggaatactcaaaatataagttctttggctgacgcagttaaaaattcaaaggtcaggtaaaatttcagtgatgagcaaggtcatttattcttatggctgggggtagcaggaaggaaagccggatcgtcgaagcattattttcttgtaggggcagatttaccttccttattattcttttgctaggctgttaaaaggaatttggaaggccaggcgtgctggctcacgcctgtaatcccagcactttgggaggccgaggcaggcggatcacaatgtgaggagattgagaccatcctggctaacacggtgaaaccctgtcgctactaaaaatataaaaaaaaaaacattagctgggcgtggtggcgggcgcctgtagtcccagctactcgggaggctgaggcaggagagtggcgtgaacccgggaggcggagcttgcaatgagccaagatagcgccactgcactccagcctgggcgacagagcgagactccatctcaaaaaaaaaaaaaaaaaggaatttggaataaatatgtctccaagataacctggtaaacagaaagggctgcaaaaaatctgaataaaagcaagtcaattaacaggatacatgtaaaacacacattttatattcctacaagtctttttttttataatagcatgttattacttttctaaaaaggacaaaataacttattttaatgacatttaaacccaattattaacagaaaagggataagaactgtggttccttggcctcctttccccttggtttagttctcctaaattaagaacttctacttatagctccctgaacacacaaggctgttttaagcctctgcaccctcatgttccttcagccttgaatgcaactttttgtaacgcaacttcgtggaaagaattcctattcatcctataaaaccctattcaggtgttcccatctgataaagcccctcaataatgatgactttctctcactcctgaaaagaattaatctcttttcttggatatttagtaagaacttagatttaccgagctcttactatgtgccaggcactatgctaagcattttatccacattatcttattgaatcgtcaacagtacctacaagataagcactgttataatcttcttttacagataagaaaatagaggctcagattctgactaggaagtggcagatccaggattcagtcccagatctgtttgacttcagagccagagtcttgaaccactcactgccctgtcgtctcccctgtcctacttccatactggcatagcacacacctcggtccctgcaacatctccagtttcatgaaaacggacaatatttcattatccttggatcctgcctgacgcaatacctggctctcaacatgtttgctgatctgaattaaagagttgcggtaatccttttttttttcttttttttttgagatggagtcccactctgttgcccaggctggagtgcagtggcacgatctcagctcactgcaagctccgcctccaggactcatgccattctcctgcctcagcctcctgagtagctgggactacaggcgtctgccaccacgctgggctaattttttgtatttttagtagaggcggagtttcaccgtgttagccaggatggtctcgatctcctgacctcgtgatccgcccacagcctcccaaagtgctggaattacaggcatgagccaccacacccggctgggtaagagttgcagtaatcctaacatgacaaatgagaactgaccataacagaaattcattcttccatatgttattcccaggcctcataacctctccttcctctgaagacatgtagcattcagtgtagcactgtcagaatgtctcactctgtcccccagtctggagtgcagtggcaggatcttggctcactgcagcctccacctcccaggttcaagcaattctcctggctcagcctccagagtagctggaactacaggcgtgtgccaccacacctggctaatttttgtatttttagtagagacggggttttaccatgttggccaggctggtctcaaactcctgacctcaagtgatccgctcacctctgcctcacaaagcgctgggattacaggcatcagccaccatgcccagcctgtttttgccttttttttttttttaaagaaacaaagtggtctcactatgttgcccaggctggtcttgaactcctgggctcaagcaatcctcttgcctcggccttccaaagtgctgggattataggcatgagccactgctcctggcccgatatgctactccttttaaaaactggaggcatctcaaacaatttaccaccaaaggaccatgtggccatactgactaaagcgcactacactttacgcttacgtcttgtaagccaaggtgtctaacaaagagtatataaccaccatattaattctttacaccataatcaataagggctgggccagcccagcaatgccatcctcctggatctcactgaggctgctccagaacaccagaagttcttcaggattcggggatgtccctcaagtactctttcagtggtttttataaatgactcaaaagttatggtgaaatttttaagtgccaaagacataaaatatgagtggtggtttgtatccaatcaaaaatcctcaaaaaacacttctgcacttaagcacactatacttttttcacccaaagtaccaaatcaaactagtcaggatacctacctttgtacaatgtcagactccagttaataactcccctagggcagagggcatatgcactgatttactttgtacaaattaaccagcatcaggcaatcaggcctgtgcctaacacatagtaagcactctatgattaaacatcagtgcttcggctccaaagttttatttatttatttatttatttattttttttttttttgagacggagtctcgctctgtcgcccaggctggagtgcagtggtgcgatatcggctcactgcaagctccgcctcccgagttcacgctcttctcctgcctcagcctcccgagtagctgggactacagacgcccgccacaacgcccggctacttttttttgtatttttagtagagatggggtttcaccgtgttagccaggatggtctcgatctcctggcctcgtgatccgcgcgtctgggcctcccaaagtgctgggattacaggcgtgagccaccgcgcccggcgccccgaaagttttaaaagcttcccctacaaaagaacagaactgaaattccttggtcctgtattcaatgtcttttgtaagtaatcacttctcccctacttaccctcctagtctaccgggctaccaggaattttttttttttttggagacagggtctcactctgtcacccaggctggagtgcggtggcgggatcacggctcactgcagccttaacccccggggcttgggtgatcctcccaccttagtctcaccagtagctgggactacaggtccacgccaccaggcctggctaattttttttatttttaggggagagggagttttaccacgttgcccaagctggtctcaaactcctgggctcaagcaatcctcctgcctcagcctcccaaagtgctgggattacaggcataaaccaccgcaaattctttacacctatcaaattccacccattatttgggacccagttgaaatccctctttggcaaaaagactttctagacaactccaggcctcataacctctcctttctctgaagatctgtagcattcagcctagcactgtccaatagaacgttctatgataacagaaaagttctacatctgtactgtatgttcttttatgtagaacagctaccttgttagcacaagtgtaaagtctcaccatctctttgatgacaacatgttacattggatggttaaaacatttatcagctcccccagtagactgcaatttctgtgaacaagatacaacttattcttcatagcaactctgacaaagttgcaaaaggtatatatatgttggccaggcaaggtggttcacgcctgtaatcccagcactttgggaggctgaggtgggcagatctcttgaggtcaggagtttgagaccagcctggtcaatatagtgaaaccttatctctactaaaaatacaaaaattagccgggcgtagtggcgggcacctgtaatcccagctactcaggaggctgaggtgcgagaatcacttgaacccgggaggaggaggttgcagtgagccacgatcatgccactgcactccagcctgggtgatagagtgcaactccaactcaaaaaaaaaaaaaaaaaagtatatatttgttgatttgcacatcacctaagaaaaccataagctaagaaggtttggactcaggcgtctggaaagttggtcaccacctctaccccacctcatatctgaatgtcaagagacacgtagaggcagagaagttaaagcaactttctagagacagaaatgaccactgatcaagccacaatgcactctggtttaaatgacatttaggtcatgactgtccttaatctaaaacaaacctagattagtatttcttttcattagtaaatagctaaattctgatggtaaattatgctgaccaaaaacagttcctcacttcccaagttagacatagcaattagaaaaataatctaagcaagctccatttgtatttcttttttcacctgtttattgaatatttacctcccatgaagtctttcagcctattggtggtattttactgttcagatatatgttagaatttcactgatacttactgggcgcggtggctcacacctgtaatcccagcactttgggagatagaggtgggcaaatcacaaggtcaggagttcaagaccagcctggccaatatggtaaaaccccggtctctactaaaaatacaaaaattagctgggcgtggtggcgcacgcctgtagtcccagctacttgggaggctgaggcaggagaatcgcttgaacccaggaggcagaggttgcagtgagccaagattgcgccactgcactctagcctgggcaacagagcaagactctgactcaaaaaaaaaaaaaaaaagaatttcactgatacttttcacaaaatatacagaaggaggcacaaattccaccactatggcactctgctgcgttggccaagtgtcttgatcctttggcctcaattttcttatctacgatattagggtaattgttatgtgaactacccacctcacaagtcctttgtgggttaattcataactgtgctgtgggtatttctttttctttcctttcttcctcctttcctttctttctttcttaaagatgggttctcattatggtgcttagactagactctagacccaattcctggcctctcaccatgttgcccagaccagactcaactcctggactcaaggaatcctcccacctcagccttcaattagctgggatcagaggtgtgcaccaccatgcctggcactgtggatatttctaagtgattattcttctcaaatgaactacataaaaaacaaaagattcatgaatttactaatggttctttgtgatggatgtgctaatatagagactaaaatcaaggctccaacctctaaaacatttttttttaaattccagacttgtttccccatcccactgtgcaaactgaacaaaaactgggctagcactcctgtctggaacatgtaataaggaaataaatgtgctgactcagagaacacagacatatttaatataaaataagatagaaaactggctgaaccaagtcataacacagtctaaatccacatataaaagattgagatgattttctgctttgctttattcaagcccaatgctttatcagcacagccagccaaaaatttacaacccatacacagactatgtaaacctttagttgcacatacagtaagaccagcaggtacacactatacacatttttaattaaaaaaatgactaaccactgattttgtcaccacacttaacaacgacctgatatggcacagagtgatgtgtaccaaacatggaaataccaacttgggcgacggtttgaatcttgttaacttcagtgcaaccacaccccccaaatgcatgtaaagtttgcacacatggttttttcaaggccagcctgtctttgtttccctctcctctgcatttacccaagatcttggctctgagacagaaaactcccactctcaattggttcattccgtcctatgcaattaagcaacaccacaatccagtaaatgcaatggctcaattatttatcttctggccgactttaccaggtatttggaaaaggacaatgtcaagaggtttatttctctctctagagctggcttgacgggttgatggggattttattttgtctttttttctcttttttacaaggcggggacgtggggggagcataatttaacctagaaaaagatgcgagggaatttagaaagagtaccggtctgtcaatttccctacaggaaacttgattcttatgcaataaagcctacccacgaccagccagcccgtaaggctgcaggcgacagacacacctattcctgcctccaaaagggcacagctgtctcctgaaggagcgggaacagggcaagcggaggaagtggctcagcgggagccgccgaccgggcggggaggaggcgctttccgaccccccactcgcgccggtgatccccgtcggcgtgacagtcgctccggtggccggaacgtccccagggccccagggagcaggaaatcgggggactgtccctcactcctgccgccgcaaccgagtgcgccctcgccccacggtgccccctcgagcgcgttctgtttctccgaagaacgaaacttccctccagcgccccgagtcccttccgaggcccgctcctgtcatcccgaagagtcttccctcagggcgaccctccgcgtctcttcatctctcccggccccactgcagcgtccatcacaacatccccaaggtcccagaggccccctgccgctgcggagcccccgggtccccaggcctccccaacggccccaccctgcacccccttcacctgtttctccggcagaggccgagaggccggggctgcgcgtgtgccggggacgggcggcgaggctccctcaggccgaagggcctctccgagccgagggggagagacagcg

SEQ ID NO: 1670 - DNA, 75172 bp, Homo sapiens
gacggttcctatataacgtttatttctggaagttaaagtagatacagcaatataccaaaaaaaaaaaaaaaaaaaaaagacaaaaaacctcacaataatataaatttttacactatgaagtacacattggaatttgaatgcagtggccaggacagcagcttataaaccaccttataggtaggtaagcaacccacgggattccctcggctgggctggggatggggagggggcagtggacaggaagcgggcagggcctgaggaccctgttctttaatgggccacaacagggctcagctcctctcagaacttttgctacaatcagagttaagaccagatacatgctacctaaggccatgaacttgacaatatctgctccagagaagccctgaaccctcgccctaggtccctatgatttaaacccaatggtaagcccaagtctcacctttctaaatattctgtttatcagttaagcttattatgtactgaagagtgttgctggagaagtaagagctctgcatgacacatcaactgtctccaggcaggaggactggggcgaaccctgttcatcttagagaaggtcgtctcccccttaattcagagaccagctaatttgatttaacaaacagaattccacagaaactctgatcagctgaggcaaggtggttttgagttgccaaatccggccatgcctctgagtcagaggcagcccatccagcacgtgctaggtgttcccatacgcacaggagaggcgagctagccagccaaggcgggcaggcggggaggccctctagctgttctgcctcacctgtggggccccagcagggaggagtcaccagcctcagagggaggccaggtatacaccctcatacgagggcagactcaagtttatcagtaagcctttgccctgcatgaactgaatgaagacgccattacaagtgccactggatatcaccaagaaactggctaagaaccatattccctgagctcaaccagacacgtcgctggggccccatagtgtgcatcatgtccaacctgtaactctctccccctcttcttccatgaggtcctgagaccaggattcctaaaacaaacaggatgagggacctttagacacgcaaggagacatgcctctagcaggatcagggggactggggtcgggagggtggggcaggaaggaagccagaatcagaagtatcccagccctgataaggcacccacagaaacaacctagcctctgaaacagcagatcaagtccagggagaaagggagtcaaggttgtaagcaccctctgcccagccttactcactaaaaggccaatacattacaaaggaaaataagtctatttataaaaaaaagtctaaaatgcttagattctccttaaaccttcctatttcaacaccaaaggccaggttgcagcttcagatgtcttaagggtttgacctgaagcccgtttcagggattatataaattaccagcctgaaggaagctgaatgcttaaagcaccaaggaggctgttaactgaagtttcttttttttttttttttttttgagacagagtctcagactgtcgcccaggatggagtgcagtgtgcagtggtgcaattttggctcactgcaacctccgcctctcaggttcaagcgattctcctgcctcagcctcccgagtagctgggactacaggcgcccaccaccacacccagctaattttttgtacttttagtagagacggggtttcaccgtgttagccaggatggtcttgatctcctgaccttatgatccgcctcggcctcccaaagtgctgggattacaggcgtgagccaccatgcccggctgcttaagtttcttaaatacagaaaggctatgctgatacagtgttttttgccctttaattgttattatttcttaatttaaaaagaaacctagggcttagatagtcctatcttctatttggatgtcagcaaggttaaaaagtgcaatgccaggagtatgtagctataggtggcctgtggcatttgcttacagaaacaggcagaaggatgccgcaggcaccaggaggcacttgtctaagaacaacaacaacaataacaaaaagctgctgagaaaggagggcaggggaacaaaacaacacaagacatttcctttttctccctctagccaccccccgccacatcccctgatcatgggtctcagagaacacatccttatttgcatttagataaaagcagatcacccacattcactcatttctctatttttaaaagtgcccagattgctcaaagatagcagaagtaggagattaaaaaaaatctggaaccacaaagttagtagtttcagatgatctggggtttggctgtgtgaggggtggcagaatgcaggtaggcgcctcagtcgtatctttctgcagcttccgttctcagctcctcacatgggggaggtagcgcactccgaggtcaactccatgtcaaaggtgagggactctggagggacagacagggaaaactagttcagttgtccaccctctgcaactggcaggccacgcccccagcccttcagaggacagggcccaggctaccactgctatccaatctcctgccccttaaggcccagggatggtcagaaaagccagatttaccctcctccctggaggaccctgcctcgggaagggtcctttctcattcccaccttaactgattcccagagctccatgtttacagaagctctaaggctgtcctgagatcttctgcccttgatctactgtttaattcaggagccccgagacacacgtggccaccaagcatttgagatttggtttgtccaaactgagctgtgctgtggctgtcaaaagcccactggattttaaaggcttagtatgaaaaaaaagaataaaaaaaggtctcaactttttctttttagtttagttttgtttatttgagatggagtctcactctgtcgcccaggctggagtgcagtggcacgatctctgctcactgcaacctccacctcccaggctcaagcgatcctcccacctcagcttcttgagtagctgggattacaggtatgcgccaccatgcccagctaatttttatattttagagattttggtcagactggtctcgaactcctgacctcaagtgatccacccacctcggcctcccaaagtgctgggattacaggcatgagccactcacccagcctcaactttttctgaaatgttaaattgagagtatgttggatttagtgggttaaataaaatatattgtaaaaattaagttcgtctatttccagtgtggctgctagaagatttatactcacacatgtggcattcataccatctcttttggaaagcaaagctctagaatctcctaccattccgagtgaccagctctcggtgtgtacatgtgagagcatcacacaaaggggaccaacttcccttatagggacaaagtctgtcaaccaaatactcaccaaactgccctcctgctgagggttcagcaccttcaccattatttccaaactgcatcaatgaatctaaagtgcggggggacatcggcaggtcaatggtattgctgcaggtcgttctgtaggaaatggggggcagcaggaggggaaacggggggttgacaagacacaatggaaaaaaaaaaaagaacaaaacacacacacacaagccatcaaactctggtctccaacagaaaaataaaagctcaagctttttaaacacacaaggtcactttgagtactaaacatagcccaggggcttccaacctttggcagattaactctcacccagtgtcccattcccagggataactgaggatattagaaatgaaggcaaaacggggaaaggaagccacttacggtgtcacacagataaacttggtcttcaggtatggggcagcgcctgggaagaagaaaaccagttttcttactgactgtgacttcgcattcagtaagcagagctggaggaagccatctgcctcggcaggactgatttgaaactcactcatcctcatgccaagattgtctggaaagctccatctgcccctcagggttgtctgccctcatttatactatttgatctcccaggcactagcagctgtgaacttcagttctttgcacaaagctgtcctgagctgcagagacttttcagcataaccttttcccacctgaccctagactaatgccaccttgtgtcccttctttccctagattatgtaaaagtttaacagcctccacgtggtctgagcattctattccggcctggtcatatctcttagataacttctctgcatgcaggaaccgagcctgtgtagtctttgcatggtgtccagcctaaataccaatatcaccaagtctttaaagaacatggagactgctaatgcttgtggttccaaagccaaaggttatatctcttattcctaccagcactaatctggcctctaccacatttttggatgagggcatgagtaactttctagttggataaatacgtcaatcaaaaagcaccaaagagaatgtgactttgtaaggcagtacaattgcttcaactagaagaccggagacctgggtccaggtacatcttcaatagctaagagacctggagcaaggcatggtctctctcttttgttgctgttgttcttattgttttgagacagagtctcactctgttgcccaggctcaagtgcagtggcacaatctcggttaccgcaacctcctactcccaggtcaaaacgattctcctgccttaggctcccaagcagctgggactacaggtggcaccaccatgcctggctaatttttgtcttttttttttttgagacggagtcttgctctctttcgcccaggttggagtgcagtagcgccatcttggctctctacaacctctgcctccagggttcaagtgattctccttcatcagcctcctgagtagctggattacaggcatctgccaccatgcctagctaattttttttttgtaattttagtagagatgaggtttcaccatgttggccaggctggtcttgaactcctgacctcaggtgatccatctgcctcaccctcccaaagtgctggattacaagtatgagctatcatgcccagccttggccacaatgcccagcccatattctcttttatgtataaaataagagggagggggaagacaaggtgccaattttctatgagctttgtcatttataattcttgttctacagttagaaatgcgttgacgggaataaaatgaattttagatgctgaatgcttacaccaagaggtcaaggaaccttggggatactggcatgaaatctggggaattcaggtgaacaaaccattgagaaggcatggggcagggtgaggtgggctgagaacagcacggtcataaaacatgaggcttagacagaacctgagggatcagagagcatgatgaccatgtgaaagaaggcactgcagagtggctcttgggctgccatctgagtttactttgggccaagaaactgatcaattcagtgcagaattcaaaggagctactgaggcaagactctagtgtcttataaatccaactgttttggcccagcccttagggagctgacaccctagacagaaaaggatttaattctccagcattcaagatagctgaggccaggcacagtggctcatgcctgtaatccctgcactttgggaggctgaagcaggtggatcacttgaggccaggagttcaagaccagcctcaccaacatggggaaaccctgtctttaatgaaattacaaaaatagctgggcgtggtggcacgcctgtaatcccagctactcaggaggctgagacaggagaatcacttgaacctgggaggcagaggctgaagtgaggtgagatcgcaccactgcactccagcctgggtgacagagtgacagactgtcaaaacaaaacaaaaacaaaaacaaggctgggcactgtggctcacacctataatcccagcactttgggaggcccaggcgggaagatcacttgaggtcaggggttcgagaccagcctggccaacagggtgaaacccggtctctactaaaaatccaaaaattagccaggcatagtggtgcatgtctgtaatcccagctactcaggaggctgaggtatgagaatctcttgaacctgggaggcagaggtttcagtgaagcaagatcgcgccactgcactccagtctggacgatagagcgagactcaggctcaaaaaaaaaaaaaaaaaaaaaaaaaaagctgagaaaaatgacttcattgtgtggctttgtacaagattgtaaatgtactttatctaatttgtaagtggctccgaacctctccctcaagccataaggaaatgctatgtgggcttccagtagagaaggaagagagaagagtcttgggaggataatctaacctgagaccctcataccataatactcttgtgatggaaatagagaggaaatggtcacatgctcatcgtcctgaaggcacccattttaaaataacacagggacacccccacacccgtcaccacactcacatggagtccctcagggcacactcctctcagcaaggcaaggcaaattactcaagtaattagttcctttctcctgatgagtgcctggcccctgaggaaacgctgacatcgctgggcaggaaaggacctggcctcccagcccacaggaagggcgatggtaatggaggatgcagcctcagactgggaggtgggaccttgaaagcaaaatgagtcaaaaggaccagccgtgggaccccaacgtcctctgcagaaggaacaaagagccgtgtggcaggggctgataaacagatctcccaactgaagcacacatgcaaagggagataggtggcagacaggaagtgagtaactcttacagcaggaacaagactcaggaccccaacaaaggagaaaggcaacggtcaattagctccaactccctcttccaagccccattctgccccatctcaagaaatccctcagaaggaattcctaggaaaaagtgggagggaagttggtaggtttctgtgtgtgtgctatttggacaaaaatagttttttcaacagcaactagggcaaggcgccaaccctaaaggatcacattaaagagcccatcattaggccaggcacagtggctcacgcctgtaatcccagcactttgggaggctgaagtgggcagatcacctgaggtcaggagttcgaggccagcctggccaacatggcgaaaccctttctctacaaaaaatacaaaaatcagctgggcatggtggcacaagcccataatcccagctactcgggaggctgaggcaggagaattgcttgaaccgggaggtggaggttgcagtgagccgagatggtgccactgcactccagcttgggtgatagagcaagacttagtctaaaaaaaaaaaaaaaaaaaaagcccatcattggctttatgattacagaaagttaaatcaaacaaagaatggcaaaccagagactccccatcaagacctgcacaaagaacccagagagtcaaaacagcaagtgctgaaggggaacagacagggctaccccctccacactgaggacagctgcagagattacagttttgtttcgtttttttctttctcttctttgtgtgtgtgtgtgtgtgtgtgtgtagtggggtcttgctatgttgccaggctggtcttgagttcctggcctcaagtgatcctcctgcttcagcctcccaaagtgctaggactgcaggtgtgaacccccatgcccagctgagattacagtatttttaatttctctctcttttttttttttttttttttggtgagtcaaggtcttgctctgtcacccaggctggagtgcagtggtgcgatcatggctcactgcagcctcaacctcctgggcttaagcaatcctcccacctcagcctcccgagtagctaggactacaggcacaaaccaccacacgtggctaatttaaaaaaaattatttttgtatagatagggtctcactatgttgtctaggctgttctcaaactcccaggctcaagtgatcctcccgcctgggcctcccaaagtgctaggactataggcatgagccacttcacccagctaaaataatttatatataacatataagtacatgtcctcttacacattaaaatataccttattttcaatagttgcacactctaaatactaatcccttgcccctccacccagtcactgtcttccccttcaaacgtgatgctcccagctcttctactctagtgtaaaccatactcccatgcagctaataataatttcctccagaaaccctttcttcagaccatctggcacactgacatggttcagttacaggcaaaaagccatatgctgggctgaaatctgggcctcaaaccttctagcatctactaagaagcactgtgccagcagggcatcctgttaactgccctcactttcccttctcgtgtttcaggcatgttttgggggacgtatgtgtattgatcccctctttatttttattttttgacacagtatctcactctatcagccaggctggagtgcggtggcatgatcaccgctcactacagccttgaactccttggctcaggtgatcctcccacctcagcctcccaagtagctacgactacaaatgcgtgccaccacaccgggtaatttttttggattttttgtagagacgaggtttcaccatattgcccaggctgtatcccctctttagactcatgcactctctgtggagcaggaactacactactctaagtgattctgattctcctctcaaatcccatcggtcaccccaacaaaagcactcactacaattctttcccataaggagaaataattatcccccaggttattcaggcatttgcctatctatcctccaaggatcccaaaatttccaacttttcccaaaaattaaatgccaggaacatggaaaatcaacaactacctgggtcagcttcaggatgctcctggctctctggccgacaatactttccgaatgcctcctccttgggaatgtcaggatagagatagaccagtggagacaccaggatattggtagcatccatgatcttatagcccatgatgatttcagcaaatgacatgttgttcagctgctgctttgtgtatggttccacggactggatctgggtcttacctgtcacaggacatgggaaggaaagatcatggaacctacagctaggtcatctcagagaaaactgcccattttttctttcctcgaaggggaaaagacttaagccaccctagtgttgagaccctgaacaccctgttcagtggcctggcactgtggaaatattcaggctggcttctaattaagaagaggctactagttgggtcatagaaaataaacttgaatataactacttgcgtaagatatattaacagggttaagtagaaaaagagatgaagaatacaatttaaattgcaaaattctcaacaaatagtcactggagcaagcaaaacaaagcaaaccaatccttcagctggaaggatttagaagtcacgcaaatgtgttttgcgagtctgagtgaaacagggagtcaaggccatctccacccaccagggggcagtaggtgcttgcaactagaagcagtgatgaggcctcagcagccaccagcaggtggggtgggtgggagcctcccttaccgctgatgtccttctccacccaagtgaaagtgacgcctccttctttgctgctttcactgaatcttagcaggaaggtgcctggaggcttagtgctcaagatggcccgctcccgctccttactgataaagcccatgatgtacctggagccaaggaggaggaacaatgttgttattgctaacagggcatccatcccctgccactggcttgctgagagcaggggacttggttacatctgtgcacactctgtccaacctacccttcgttccaaagggccaggatgtactttttcacaaggtcaatgatattgtccagccagacccagaaggagaagcccttgccagccatgttttcctggagaaaagagtaatgggaaagccaagtctactgccatcccagcccttcccttcctaggggtgcagtgcatcacccaaatcctcaggcccgtctaccttcaggcaggtcctactggccgctggaccaagagttcagggccttcaagccagagccctcaacgacagccgtgcaggtgagcattcccattcccacgagaatttaacaagattgcttactttgcaaaatttagcccatgtgatctgacaccctgaataattcacaccaggtcctgaaggaaagaaaaagagtcaagtagtacattttcagcttggggtcaagaggttatttcttaaaacagaacacacacacattcatcccacaatgggccacaaaataatcagctttcacatctttgaaggtaggcactgttgtgtgtgtgcacatgaggacaaacactatcccatcatttgactcacttgtgttgctgggtagcccagcagggatggagggtgatataacaagtccccctgctcttcccaacctcgggtggtaggctgggaaccaacagcagcactcactaacaagctgacatcgggtgtcagacaggtgtatttggtggcaacagctttattagaacaaagctacttctagcccaggtggcacataaaatattccactaattcttttttaaaaactagcctacgctgggcacagtggctcaagcctgtaatcccagcactttaggaggccgaggtgggcggatcacgaggtgaagagacggagactatcctggccaacatggtaaaaccccgtctctactaaaaatacaaaaattagctgggcgtggtggtgagcacctgtagtctcagctactcgggaggccgaggcagaagaatcgcttgaacccagaaggcggaggttgcagtgagccgagatcacactactgcactccagcctgggcaacagagcaagactcgtctcaaaaaaataaataaataaataaaataagacaaaaaaaaccaactagcctatagtttattaaaaaaatggacagggaatgtcaagcctttagtgccaccttccaacacacacttaaaagatcttctaaagttagatagagtgggtgaatgagacagcaaccaggagaaaagaaatctacctcccacctcaaaaatgatcacctcgactgaaaactgcaaactgtctctgcaccccaactccccaactcccctgtttcctggcaccagcacagcgccttgctcaggaaagaaacatggcctaatgctcagtagacatggcccaaatgaacagccctatgggccggatcccttttctgggcgggtgggcgggagggagaaggggtgaaatgcggacccaagagtttctctgccagtgtagtcagctgctcgatgctcagtcctcgcttggtggtggaggagaactgccagctcaggacctcggccacttgatcccaggttccaattgggggcttggtaaaaaagtttacattctattggaaagaacacatttgcttgtttagatgagggatggtgctcattgtctatactaggtacccctaagtcgcaagagatcccggggcaccaactaaaaggagggggcactaaccttgggattgttggtcagcatgttgtaccacaggatggacgcccaggcatttggcatctgacagatgttggagatcaccacaactggcaaggagtgggtctgcggagggagtggggactgagctggggaggcagaggggctctcacagccttggaaatctcttcacccgcatctcacggggctcagaatgaaaggacatgccataaaccacacctgctgccaactctaggcgaggagtgtgagtgagtcagctcagtgagcactcatagtggaaagaatgcccagcgtggccacacaactcaggctgcagtcggaatataccggtcccttgtaaaacctgacttgctcaaagcttgactcacaatccacagattccccatttttaagaccttggaggcattctccaagacttgaagctgtatcttcacatgaaacagggaggtctcaggaatcaaagaccaggattcctgcttttctaggtatatcttaatttaaaaatcaagaaagttgggaaaggagaatgtcattgccacaattttctgtatactaaacacactggctgctaagactcttatgcccaaactttataaagtcagttctaatttcttttttttttttttgagacggagtctcactctgtcacccaggctggagtgcaatggcacaatctcagctcactgcaacctctgcctcccaggttcaagtgattctcctgcctcagcctcccgagtagctgggattataggcgtccgccaccatacccagctaatttttgtattttagtagagacggggtttcgtcatgttggccaggctggtctcgaactcctgacctcgtgatccacccgcctcagcctcccaaagtgctgggattacaggcgtgagccaccgcgcccggccaatcaatttctaaatagagattttcatatcaagtttgctgaaagctgaatatacacacatcttctaagcattcaagcaagactttattgccagatgggatgccaaggatttttttggagaaaagtaagcaaaaataaacacagtgttaagcaaacagtaatcattccaccttctcttgtaaaaatcccagtggaagtttttgtcctgagtcacccctgtacgtagcctctcaccgattctgctgcagaacttacctctaggtcaatcttgaggccttggtgatacacctcggtctcaaaggtgatcaggtgcagctcctcagtcacaatcagggaagcctacagtaacgagaaggacactcttaggccaggtgtggtggctcatgcctgtaatcccagcactttgggaggccaaggcaggaggattgcctgagcccaggagttcgagaccagtctaagcagcacagcaaaactccatctctgcaaaaaatacaaaaattagctgggtgtggtggtgcacacctatagccccagctactcgagaggctgaggtgggaggatggcttgagcctaggagatggaggctgcagcgagctatgattgtgccactgcactctagctggggtgacagagtgagaccctgtcttaaaaaaaaattaaattaaataaaaaaaaaggctgagcgtgatggctcacacctacaatcccagcattttgggaggccgaggcaggtggatcacatggtcaggagttcgagaccagcctggccaataatttggtgaaaccccgtttctactaagaatacaaaaattagctgggtgtggtagtgggcgcctgtagtcccagctactcaggaggctgaggcaggagaatcgcttgaacccaggaggcagaggatgcagtgagccgagatcacgccactgcactccagcctgggtgacagagtgagactctgtctcaatcaatcagtcaatcaataaaaaagagaaggacacttttcctcagagagaatggcattcagtactaacagccacagccaaggaaagtgacatgccaagcctcaccacaccaagaagggtaagccaccaggtggtcacaaacaaactgccagggacacaacttgctcggcacttactctcttcaacaccaagaacttccaatgctgtgatcctcaacctaatcctttactcagtttgtattataatattacatagatccaattggttatttgtaaaatacgtaaggcacaaagaataacaaaacaatatgaacccaccattcaatttaaggaaaagtccatcactcctaaaattctctgggtgcccttccccaaccccatccccttccctcctccctcagaaataactgctattttgtcttttgggtttatcatttcctagccctttttgtcttgttttgttttgtttttttacagttttaccatatttgtttatctaagcaatgcaggtattgtttagtttgggacatttgtgaaccttacacttatggactccaatgaattcttttgggattcacttttcacttgatgtgaaatgaatccacatggttatgtgtatctgcagtgtattccttttcacagctgcggagtattccattgtgtctataccacaaataatgtattcattctaatgttgatgggtatttatttgggttgcatttagagcttataatcaggctgatgtccactttatatatgtctcctgggacatatatgcaaagatttctctgctattaaatcctgggaatggcaccgttggtttacaggtatgttcatttttatactgccaaattgttttccaaactgactacaacaatgtctcacatcagtacagcaaccttattttaagtaagagttgtcaatgaattctcaaaaattgaattctagtctgggcacagcggctcatgcctgtaatcccagcactttcggaggccgagatgggtggatcacgaggtcaggagttcaagaccagcctgaccaatatggtgaaaccctgtctctactaaaaatgcaaaaattagccaggcgtggtggcatgcacctatcgtcccagctacttgggaggctgagacaggagaatcgcttgaacctaggaggcagaggttgcagtgagctgagatcgcaccactgcaatccgatagaacgagactccgactcaaaaaaaaaaaagaaaaaagaaattaaattataattcatttttaatactatttttctgattataaaagtaatatattcagtttaaaatgcaaatatcacagagacagtctagaatagccatggataccaacagcagcactaatacacatagcactgctggtatattcctccagaatttcttaatatacatatgaatacacataagagtatagtgtatttttaaaacacatatactaataatactattcaaattattttacattttgctttttcttaatatgtcatgtacattttcccatatcattgcatacaggctacttcactctactgtcaagtaaaattccacatttttaaaaaggactgctacattttattttatttatttttttgagacagagtttcactctgttgcccaggctagagtgcagtggcaaaatcttggctcactgcaagctccacctctcaggttcaagcgattctcatgcctcagcctccccagtaactgggactacaggcgtgcaccaccacacccagctaatttttgtatctttagtagagacgggctttcaccatgttggccaggctggtcttgaactcctgacctcaagtgaccagcctgccttggcatcccaaagtacggggtgtgagccagcacgcccagctaggactgctacattttaaagaggaagaattgttcaggggacaaatgtaagaaaaagaacggggcatcacaatttttaaaaatgactgaaaactagccttccgtcacatttacctttttttgtttgtttgtttaaagtttattcttgacaataagaatccaataatctgaatcaatgaaaagcagaaaataagggggataaagaacaagatgggtttttgtttgttcattttattttatgtactcttttcctaagcaagctaatgcaaggtggtcatttattttaaagtttaactcaaatctgttgcttttacaccctctatcccacctcagtgggagagaaaaacagggcactaaaaatggagccaagcagggtcagccgcaggagctggatggggaatttggaaagccccaggcaaggtggaaagctgctttataccacatgggtgtggagaacaactcagcaagggactttccacttctccttaaggaggagccaactcccagatattcacggaaatgttccaagccagagagctccatggcacatggaacttctgttcatgtcactttggcctgaagtgactttttggaataactacagctgaaagaacaggttgatgtttctaattctggggattaagaaggatctttacccctctctccctcaaggaaaacaccccagttgtctttcatccccaacaaaacttacatcacaattggctcggcccccattcccacatctctgctccctcagggtctgtaagaaaagaaaaaggcaggtgtcctgtgaggctctccctagccctctccggcagccagaggccctttgtgaaggggagctcctcccacataccaagtgtttgaattctgcagagaggctgccgttgttggattcttccatgttcatcacttttgtgtttgtgcccagaatgttaaatttccgggatctgaatcacaggggaacaatcaactatgtaggtgaccaagtagccggaggatgaagttaggttaaacggaacaaaaggaagcctctaggctgaacttaccctctgagagctgcaacgtccccagagtctctgtaagaacacagactgttgttaataaaataggctctgtgtttcttcaaaaagcctactttgaccacctgttatttactgtcatgaaaaaacctctgtgctcctgggcatttctttaaactattcagttacagttgatcagcgcaacataacacctctgcgtagcaggcacagttggttgcctccccataggaaggggaacctatgtttcatattgcatatgtacttattaaacctaccaccttcgtcaactcccttatttcattattttccagtgcatcctcatgaaatttccacataattacatcaactaaaaataagaatgcattttatcttttcttttttctttttttttttttgagatagtttcgctcttgttgcccaggctggagtgcaatggtgtgatctcggctcaccacaacctccacctcctgagttcaagtgattctcctgcctcagcctcccgtgtagctgggattacgggcatgcgccaacacacctggctaattttgtatttttagtagagacaaggtttctccatgttggtcgggctggtttcgaactctcgacctcaggtgatctgcccacctcagcctcccaaagtgctgagattacaggcgtgagccaccgcgcccagccacattttctcttttcttttctttttttttttttttgagatggagtctctgtcgcccaggctggagtgcagtggtgtgatcttggctcactgcaaactccacctcccaggttcatgccattctcctgcctcagcctcctgagtagctgggactacaggtgcccgccaccacgcccagctagtttttttgtatttttagtagagacggggtttcaccgtgttacccaggatggtctcgatctcctgacctcgtgatccgcccgcctcggcctcccaaagtgctgggattacaggcatgagccaccgcgcccggcccacattttctcttttctaatgtcgtcaaagggtatatgtattttacatcctgaaaggtattgtgaaattttgcgtattccattatatggtaaagtgtggaacaattaaaaaaaagagatctattctttccacatgctatgtatggaaagaatatataacgacgtttcggtcaacaacaaaatgcatatatgatggtggtcccataagattatcatggagctgaaaaattcctacttcattgagatgtgttacaattgcctacggtattcagcacagtaacatactgtacaggtttacagcctacgaccagtaggctctgccacatagcgtaggtgtgcagtaggttctgccacccaggtttgtgtaaggactatatactctacaacatttgcacaacaaaattgcctaatgatacattttgcagaacgtatcccagtcgttaattaacacatgatctcagtcttatatataatatgcatgaatgacatgtacaagtaaaaaactaaacaaggaaaagagggactggttgtcacaatagcaaccacaaatcaaatctgtacccccagctttgtggctttgttcagacacgtaaatgacaatgcaccccaaggcttttgaaaacttttgtccacaaaatgaagatctctgaataaagacagagtctctagttcaaatgatgtctgtcaaagttctcatttttctattcctcatttgaaaaacagagctaagataggagtacttacttgtcaatgcacactttaattttaagctgataattcaactcagggaatttgaccagcaacctatttaaaaagaaaaaatccaaggaaaaaaagtcagtaactctcccataaccttttcttgaagaaatgtaaaattcataattcttcatttccaacaggtaaataggccaagctgtctataattacaggctcacatctataatctcagcactgtgggaggccaagctgggaggatcccttgagcccaggagttccataacagtctgggcaacaaagtgagagcccacatctataaaaaatttaaaaattagcggggtgtggtagcatgtacctgtagtcgcagttactcgggaggctgaggcaagaggatcacttgtgcccaggagttcaaggctacagtgatctatgatcatgccactgcactctagcctagatgacagagcgagatcctatctctctttctctttttttttttttgagacagtttctctcgttacccaggctggagtgcaatggcgcaatctccgttcaccgcaacctccgcctcctgggttcaagtgattctcctgcctcagcctctcaagtagctgggattacaggcgcgcgccaccacgctcagctaattttgtatttttagtagagacagagtttctccatgttggtcaggatggtctcgaactcccgacctcaggtgatccacccaccttggcctcccaaagtgctgggattacaggcgagagccaccgtgcctggcccctatctctctctttaaaaaaattaaaatagggctgggtgcggtgactcacacctgtaatcccagcactttgggaggccaaggcaggtggatcacaaggtcaggagttcgagaccagcctggccaagatggtgaaaccccgtctctactaaaaatacaaaaatcagccgggcatggtggcaggtacctgtaatcccagctacttgggaggctgaggcaggagaatcacttgaacccaggaggcagaggctgcagtgatccgagatcacacctcagcactctagcctgggtgatagagaaagactccatctcaaaaaaaaaaaaaaaaaaaaaaaggccgagcgtggtggctcacatctgtaatcccagcacttttggaggccggggtgggtggattactgaggtcaggagttttgagaccagcctggccaacatggagaaaccctgtctctactaaaaatacaaaaattagccgggcatggtggagtgtgccggtccagctactcagggaggctaaggcaggagaatcgcttgaacctgggaggtggaggttgcagtgagttgagattgcaacacgcactctggcctggccgaaagagcgagactctgtctcaaaaaaaaaaaaattagccgggtgtggtggcacgcacctctattcccagttactcaggaggctgaggcacaagaatcacttgaacctgggagatggaggttgcagtgagctgagatcatgccactgcacaccagcctgggtgagagtgagaccctgtctcaaacaaaaacaaaagatgagtatcactccttcaagccaaaggtactgagaaaacatctaagaactaacaacttaaagttgtgagagattcacaaaaggataatcaaagccatataatgaaaaatattacaggaacacatgctgtgcagctggcattttgttctattaatcctgaaaccgaacaccatactaagtttctgaggagggaaattttgctgcagaaggtcaaaaccccagcacacctgttctgacttgagtgtgaaagtaacacctcaccctacaggcccaccacccacctgccctggggcctctcagcttccccatcactaagccttactctttcccttaaaatccacagggaagagtagcctcaaagaacagaaaatagatgacattattttgtcccttgggcagaaggagaagctgtggcctgagactccaggtctacaatcataggaatatgcccaggtaccttcaaaaagatgactgctcttttgcttttgacatcagaatcagagagcaagcagatagtatggcaacaaatttcaaccccgcaacagtgtactgcctgtgacaccacacctggaaagaatgaccctggccaccaactctaccctcaccctaacagtgtccctcagtaaaatctctactggaaatggaagtggcatggcctacctgactttagtagtgaactggacgccggtcttgatgacgaggggccggtcaggatgcatgggcatgcagggctgccgctccaccacaaaggcactgaggaaagagaagatgggctcacgcgccacggccatgaccagaagtcagcccgcctctcactctaccacgtgagtctttaggtattttttagatgagggaaagggacaaggatgctaaattaccttttcattaagtttctaaacagctccacgattctctcctccagcatcggccggtgctgtacaatggggtcccctttgtaggaaactttttgctgcaactcctccagtttcttaatttgttgacgggtctgaagttgagattctgctaatgacgttatcctgccaataaattaagaaagatgctaattaccaaagtgaatgtatacaggtgagatggagaaggggaaggaaatactgaagacatggagaccactacaataagaacaaggaatttttttattgtggtgaaatatatatagcatgaaatttacaatttttcatcttaagtttacagttcagtgacattaagaaaagaggaatttttcaccatgttgggtggatgctgaaaaaataaataaaaaaagaaaataatttatttatttatttattttttgagctggagtgcagtggtgcaatctcggctcactgcaacctccatttcccgggttcaagtgattctcctgcctgagcctcctgagagattacaggtgtaagccactgcgcctggcctttttttttttttttttttttttgagatagagtcttactctgttgcccaggctggagtgcagtggcacagtctcagctcactgcaacctccgcctcccaagttcaagtgattctcctgcctcagcctcccaagtagctgggattacaggcacccaccaccactcccggataatttttgcatttttagtagagatgggattttgccttgttggccaggctggtcttgaactcctgacctcaggtgatccatctgcctcgacctcccgaagtactggcattacaggtgtgagccaccatgcctggccagaaaataatttattttaccttttattactagtcccttcctaaaatctcaaatttctaagagggggctgggcacacaagaagtattaaaatttataccactaggaggcattgatggagttatcactggaaaatgacaagcatctgagcccagatatgcagaacacgaaatatggaatttagcacttactttactcatcctaacttgtctatgaacataaagactcagaaaaagagattagacagctcccaaagatgggtttgagccagctctgtcacacactatctgtgcaagctttgccaggcccttcaccatcatgggccttagcatccccttgcatgaagagaagggcttgaactacatgagccctttcttttctttctttctttttttttttttgagacagggtcccactctgtggcctagtgcagtgcaatggcatgatcatagctcactgcctcctccaactcctggacatgagtgatcctcctacctcagcttcctgagtagctagaactataggtgtgtgccaccatgcctgtttagtttagtttagttttttgagatggagtctcactctgtcacccaggctgaagtgtaatggcacatgtctagttttttaaatttttgtagggatgggatctcactttgttgcccaggctggtctcaaactcctgggttcaagtgatcctcccgactctgcctcccaaagcattgggatttacaggcgtgagccacaacacccaatccccataagccttttcaatgtcagccttcaactgatcaaaggacatgacattatgtttcaaaatattgataacatgcacaaggaataagtgaatagagagggagaaaaagctcattaaatctatctccaagaatagagatattaggccaggtgcagtggctgacacctgtaatcccaaaaatttgagaggccgaggcaggtcgatctactaaaatacaaaaaaatagccaggcatggtggcatgggcctgtaatcccagctacttggaaggttgtgactaagaatcgcttgaacctgggaggaggaggttgcagtaagccaagatcatgccactgcactctaacctgggtgacagagtgagactctgtctcaaaaaaattaaaaaaagagagaagttagcatcattccatcattctttgatggtttatcactagtgtaacaaagaccaaaagaccagaaagacagaaagtgaaaggagagggagggggaccgctgcagggatttctgaactcctgagctcttttctggcacttctatcctcccattcccagaacttaagcttcttcgttccctggtcaggaagcatttaaaactgctttcagtaaattaacaacactcagggttagtgaggatatgaatagacaggcattctcatgtagagttgcgctaaatttccagtgcaggctctgtatctcaagtttctcctaaggcaagctggtgcaacatgctcactatagggccttgcacaggaagggttgcagtaagatatgctggatgaaggtaaaagtgcaaattacagaaaagcatataaaggaagatcctgggctgggcacggcagctcacatctataattccagagcttttgagaggccgaagtgggatgatcccttgagcccaggaatttgagaccagcccaggcaacaaagtaagaccctgtctctataaaaaatttaaaaattagccaggtgtggtggtgcatgcctgtagtcccagctactgagaaggctaaggtgggaagactgcctgagcccaggaggtcaaggctccagtgagccatgactgcataactgtactctagactgggtaacacagtgagaccctgactccaaaaaaagaaaaaaaaatgatcctaatataaactgtataaatttctatctttatgtgtatatacataatgtgtatatacataatgacagatgtctagattgagcatcaactaaattttaactactagtactgctgatgatttcatttaaaaattttttcttctcttgattaattttctgtatttgaattttttcccttaaaaagggcatgtgtcattttagattactaaaataactaaaattaaaaggtttgtctatctgttaaatacagttaaaccaaaagccttaattgaattattaagtaaaatatacttaaaatataataatataaatacattttttaaaacaaagtttctccaaataaagtaaaaactttattttatttttatttttttgagatggagtctcactctgtctcccaggctggttggtgtgcggtagtaagatctccgctcactgcaacttccatatcccaggttcaagtgattctcctgcctcagccgcccagagtagctgggactacaggtgcgcaccaccacgcccggctaatttttttatgtttttagtagagatgtgttttcaccatgttggccaggctggtctcaaactcctgacctcaagtgatccgcccatcttggtctcccaaagtgctgggattacaggtgtgagccacagcgcctggccgaaataaagtaaaaactttaattcttgggctaaatttgaatatggaaaagtccccacgttggagatatagtaccaattctgtgggcctgcagttaagatcagaattcaatctagctttcgagaaagaaaggaaaagcttctttcatcctttaccagttttctagccgatctaggcagatgttgggcgggcctccaatgcaggcaatctgttgccgcctcttccagtcagccagctcctcgtccgtgagagttttctgcacgtactccatcgctgacaaaagccccgccagctcactcacgatgctctggttggaaaccaaaacaaagtcagaaaacatttcctcagactgtctctaaccacattctttagtcaactccagagcaggaacttcttagaaaccaagcaagttctgccacaagacgctgaaatcccgcaagtgagcgagacacatgggggaagtggtccgacctatgcccttactctccgcatctggtccagcgcagtgagcatctgttccagctgctgcatcttctgcctggtcactgactggttgtttccattcagatcttgcatgtctgcgaaggaagaaaaaactccttgacctgagggaatactccttgacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactccttgacctgagggaatactcctggacctgagggaatactcctggacctgagggaatactcctgtccttaatgaccaggctcctttgaggacccgtacctcccttgcgccccgcccgccttaagatctaaacagagttaagacaaatgagtctttcaactcaacaacacaaactcactttctagagattttaacatctctaatattcacttgcctccttgactcttgagggttttatagttgaaatcaaagtcatcctggagattctctaccactttcattttctgttctagatcctgtttaaaataagcaaacaaaaaaacagaagtaaagaaagatttccttgggaacagaaaatataaagtttctgaggagaattcaaatgaagccaaaacctcaaaaaagatacatgcaggacctgcaggcagtatccccaagagaaggctccctgttggccaggtgcagtggctcacgcctgtaatgccagcactttgagaggctgagttgggaggatcacttgagcccaggagttcatgatcagcctggacaacacagggagacccccatctctacaaattttttttttttaattagctgggcgtggtggtgcatgcctgtggtcccggctacttgggaggatgaggtaggaggatcgcttgggcctgagaggtcgaggctgcagtgagctgtgatcatgccactgcagcccagcctgagtggcagagcaagaccctgtctcaaaaaaaaaaaaaaaaattaatgaaagctccctgcccgaggcttgtaacttgcatcacctgcactctcttccggacatcctgaaggtgctgctccagcatctgctgcttctccgtcaccacggctgctgtggggtggttggcctggcccccttgctgccaaaaaggaggtcaatgcacatgtgaacacagaactatggggagaggaatacctctacccagcttccatcccaccctaactacccttcttgtttggcttgagacgctgctgccatcacaagaggaagggaaacagaggcagtggtgctgtcactacacaggtgacactacacaggtcataccataaaccccctttatggcactaagagaccacatgttcagctaagacatggtctatgccttcaaaaacctcatgggcaagtatgtcaaaaaattcaaaacaatttatgacagcagatgttggatgtctacttaaacgtggtgtccagtatatttctgagggataataaaaaaaaagtcctgccctagggatgaaattccatattaaaagatattatcttggggagaaggggaggctggtaccttggaaaatgtcaaatagcacatggaaaaagaaaaagaagaaagaaggctggatgtagcagctcacacctataatatcagcacttgggaaggctgaagtgggaggactgcttgaggccaggagttcaaaactagcctagtcaacatagtgaggccccatctcgaatgaataaatgaatgaatgaattaaagaaataacaaaaaataaatagcatatgaaacttaaaaattacaggttcgtgccaggtgcggtggctgatgcctgtaatcccagcactttgggaggccaaggtgggcagattacctgaggtcaggagtttgagaccagcctgaccgacacggagaaacccatctctactaaaaatacaaagttagctgagcttggtggtgcatgcctgtaatcccagctactcgggaggctgaggaaggagaatcgcctgaacccgggaggtggaggttgtggtgagccaagactgcgccatgcactccagcctgagcaacaaaagtgaaactccatctcaaaaaaaaaaaaaaaaaattacaggcttgggctaggcatggtagctcccacctataatcctagcactttgggaaaccaaggcaggaggatcacttgaggctgggagtttgagaccggcccagggaacatagaaagagacctcatctcaaccaaaaaaaaaaaaaaatttttttttaactagctgggcatggtggcatatacctgtagttctagctacttgggaggctgaggtgggaggatcatttaagtccagaagtttgaggccacactacagccagttttatgggcaaccattctcttcctttcccatggtccctatccaagcccacagaatacaaacttcttagaagttttgggaaggtgacccatgcccctacttcttcccacagtgacagtgactcatctgattggtaagatggagagaaagactctgtgtacacacagatcttcaaagaacccagcacctaagctggtgcctccctcctctcactcttgccttcctagggcccaccataagcaagagcagcagcctggtttctagaagcaggtctagaggcctatccctctgccttgttggtctatggcagctgaagctccatatggatggctggggtggggtgggggtgctgctctgcacatccagtctctctaccccaagatctaactcagggcacaggcattggaaagcccctatggttaccagctcaagccacactttccattctagttttaccaacaatacagctgatgttttaaccttcattcctttctcatgtctatttctcaagcaggactacacttaaagggagaaaacatgattaacgatcacccacagaaacccacctctaataccttcgtaaaaaactgtattggctccccactgcttccagctataaacatctcaggccaacacagaaagctgtttcacacaattgataacttcaactttccctccctgtgccttggtcaccccagactcccaactcttccctgcatgcagtgtgtttccacactctcttcccacccgctatccactcagcatggcctgggcttcagcccaaacacacctgaactcactcaccttcaaattcagttcaaatgtttcttttcctgagaaatcttattcaacttccttagacaaaatgacacacatccttttctgtgtttttctcactttgagtgtttgtgtacttataatcccaactagcctgacagcccttggtagcagggattacatccactcttctatctttaaccaattctagacacttaagagcatgccaggtattgtaaacagaaaaaatagcagtgaggcctgggttgaggccacaaataaccaacttatagctttatatcaggggttgcaaactttttctctaagggacagagggtaaatatttttggtttcctgggtcatacagtccctgccacaaatagccctgccactgcagcaccaaagcagccacagataatgcataaataaatgagtgtggctgggttccgaaaaaacctcatttacaaaaacaagcagcaggctggatttgggccacgctcacagtttgcagacccctaatccgtacgattgaaaacatccttgggataactttggctttcctacctcccatggtaagttggagcctctatccaaattgacttaaaccacttatttttatcttgtggagcaggataaaatacaaaggttttccacagcagaaaatcctagtgctgcctgagcaaatgcctgtgtgctaacctcttgggctacagggcactgcacagtaagtgttacctaccacctcgctcacacctgagcatatcagttttctgcttaaaattcctcactagggccggacacagtggcttatgcctgtaatcccagcactttgggaggccgaggtggatggatcacctgaggtcaggagtttgagaccagcctggccaatatggtgaaaccctatctcactaaaaatacaaaaaattagcccagtgtggtggctcatgcctgtaatcccagctacttgggaagctgagacatgagaatcgcttgaacctgagaggcagaggttgcagtgggccgaaatcgcgtcactgcactccggcctgggtgacagagtgagactctgtctcaaaagaaaaaaaaaaaattcttcactgggtccccatttcctacagtaatggtgagggtgatgatagtgatgtcagcagcagcagaaagcagttaaattattttgcatttatgtgtcagatactgttctaagcattttacatgtatgaattaattctatgaagaaggtattgttatcactcccattggaggaacagagagagtaaaaattgtttacttaaggttacagagcaagtggcagggctgcgggttcaaaccgaagcagttggccccttgtggtaaactgctcttccagggccccactgttaggcatgactaattaaaacatcatgtggccttgactagcttgtcttccccgacccaatcagatgctgaactttctacacttctcccaagaatacacatttctgtttctgtctttgaacatgatcttctttctgcctggagagctctttctcatcagttgatgagcccaggagttcaacaccagcctgggaaacatggcaagagcccatctctaccaaaaaaaaaaaaaaaaaaaattagctgggcatggtggcatgtgcctgtagtcccagctactcataaggctgaggcaggaggatcgctagggcccaggtggttgaggctgcagtgagctgtgatcacaccactgcactccagcctgggtgacagagtgagactgtctcaaaaaaaaaaaaaaaaaacaaaggttacaaaggtaaatttgaaatgtaatgttatgtgtatttcaccacaattttttaaaaagcagggggtcacggagaaaaagaaaaaatgtccctgattataggatattaaagacggtaaaacccctcacagaaagtaaaaaagtctcctatgaccgactactttaatgatttagtatatgtgtttccagatattttcccatacataccaatagtatatgcaaattgcatacatttagttttactactatgaatcagatctttctttttttttttttttttttttcagtcggagtctcgctctgtcgcccaggagtgcagtggcgcaatcttggttcactacaacctccgcctcccaggttcaagcgattctcctgccccagcttcccgagtagctgggactacaggcgcgtaccaccacacccagctaatttttgtatttttagtagagatggggtttcatcatgttggccaggatggtctcaatctcttgacctcatgatctgcccaccttggcctcccaaagtgcttggattacaggcgtgagacatcgtgcctggcccagatctttactttcattacatcttctaacaggttactgctgctactgattaggggaactgcagattctaaaaatatttatcttgtatacaatggcctttctaaaccttgctagttccaattgttattgttagttttgtttctcttggatcttcgaggaagacctatctatctgtaaataataagagttctgtcccttgctttccaatatttgtaccctcatttctttttctttttgcataggctggatccctcagaaaagtatcaatggtaaaagacatccttatcttttgctgtttttactgagaatagtgtttcaccactgtgcatcatgctccctttggtttctgataaatattctttcttgtgtttagaaagatccttaattaagccaggtgcggttgctcacgcctgtaatcccagcactttgggaggccgaggcgggcggatcacgaggtcaagagatcgagaccatcctggctaacacagtgaaaccccatctctactaaaaacacaaaaaattagctgggtgtggtggcgcgcgcctgtagtcccagctacttgggaggctgaggcaggggaatagcttgaacctgggaggcagaagttgcagtgagctgagatcacgccactgcactccagcctggcaacagagcaagactctgtctcaaaaaaaaaaaaaaggctgggcgtggtggctcatgcctataatcccagcactttgggaggctgtggccggtggatcatgaagtcaggagatcaagaccatcctgcctaacaaggtgaaaccccatctctactaaaaaaaatacaaaaaattagccaggcttggtggcacacacctgtagtcccagctagtcgggaggctgaggcaagagaatcgcttgaacctgggaggcggaggttgcagtgagctaagatggcaccactgcactccagcctggacgacagagagagactctgtctcaaaaaaaaaaaaaaagagagatgaggtctcgctacattgccccagctggtctcgaactcctgaggctcaggcaatctgcccgtctcagcctcccaaagtgctgggattacaggcgtgagctactacacctggctgttttttaggttttgatatgaggatttttccagcctcataaaataagctgaaaacatcccttgttttcctatactttggaaaagtttgaatgatattggaataatctgtactatgaaagtttgtcagaacaggccgggcacagtggctcacgcctgtaatcccagcactgtgggaggctgaggcgggcggatcacctgaggtcaggagttcgagaccagcctgaccaacatgaagaaaccccgtctctactaaaaatacaaaattagctgggtgtggtggcacacgcctataatcccagctactcttgaggctgaggcaggagaatcacttgaaccctggaggtggaggttgcagtgagccaagatcgcgccattgcactctagcctgggtaacaagagcaaaactctgtctcagaaaaaaaaaaaaagaaaaacaaagaaaatttgtcagaacaaaacaaaacttttaaaccattgggtctgttggattcttttggtggaactttcttttttttagagtttttcaatgtattttggggggtggaactttctttttttttagagtttttcaatgtatttttatgattattgatctatttaatttcttttccttcttttttagtagatctaataatttatctcattataaagttgtttgattttccattcctcccagaccagggatttgttttgtctcaggtctcacctgggccgcagtggctgcagtctgtagaaggcgtgattcttcccacaggcaccgggccacaatccgggcaatctccattggcttctcaagatacctgctctataagtaggagagaaagagaataaaaatcagcagcagaccatggagatgtggactgaactgtggcaccttaaaactaatgtattcatcaaggaaagcatttattctaggaaacaacggaacaaaggcttcagagcctgggtgaaggctctctgtcggcggggggcgaaggggaggtcgttactatttctgtaacagaaggcacattagcctgagtcttttttttttttttttgagactggctctcactctgtccgccaggctggagtgcagtggcgcaatcacggcttattgcagcttcgacctcccaggctcaaacaattttctcacctcagccttctgagtagctgggactacaggtgcatgccaccacaatcagctagtttttaaaaaaaatttctgtagagatggtgtcttgttatgttgcccaagctggtctcaaaactcccaggctcaagcaatcctcccacctcaacctcctaaggtgttgggattacaggcgtgagccaccatgcctggccttgtctgagtctttacacagtatactatcctggtcttgcagggaagctactgacttagtcaagaagtatcccattatggtcaaacatttaacatgtaacagtgagagtcatcttcctatcagtggaccgcgttaacatgctaacatgtatgattaacataacaatcactttattacttcaactgtgacaagagaagtgattctcaggtaatgatgctcacgggtaagtatacagagctttgagaaagggctaattacttctcctgtgattgaaaatacaagatagattctcgttacttagccaaatgagaaaagagatgcttccaggaaagaacactaacacccgactctgcgggtcctgtttctccttgtcctcagtttctcatcatacctgaagaaactgcttgattcttcgtagattgtgctgatagagaacattcgactcttgcaggaagcggctatactgctggtcaatctctcccaggagattatgaaacaccaaagtggcatgtgattctttgctggccgcatatgccctaggaaaaggaagaatgataaagaatggctctgaagccgacgcatacacacaaacacagaaatcaccatcaagaaagaggaaaaaaacaaaaaaacaaagcaaacctgatgctataacccattcatcatgttagattcttcttgctcagcaataaaatgccatcaatgtaataattattaacaattattccaggccaggcatggtggctcatgcctgtaatcccagcactttgggaggctgaggcaggcggatcacctgaggtcaggagttccagaccaacctggccaacatggtgaaacgctgtctctactaaaaataaaaaattagccaggtgtggtggtgggcacctgtaatcccagctactcgggaggctgaggcgggagaatcgcttgaatccaagaggcagaggtgcagtgagccgagactgtaccactgcactccagcctgggctacagccagactccatctcaaaaaaaaaaaaaaaaaaaccacaaaacaaaaaaacaattattccagatattattacccactctcataatctgttgtatttgtaaaatatttgagcaaagtagacagatatgctgttttgctttaaaccctcaattaactctggtcagatttattagtacaaataagtaatcccaggctgggatggcctatctccaacatctgtgaatcacctcctggcccttcaccaaatcagagtatgcattctggaaaaaccaggtcatattaacactggcctgaattaaaccaaaatcagtagtgagcctgagcatattaaagtgaagaaaatagttgctggacatctgtgccattatctgctctatgaatggaatctacttcccttatcctgtgatctagtttggatctacatccctgcccaaatctcatactgaaatgtaacccccactgtttgaggtggggcctggtggaaggtgactggatcatgggggtgggtttctcatgaatggtttaataccatccctgttgatactgtcctcgagacagtgagttcttgtgagatctgatagtttaaaagtgtgtggcacctcccccttgctctcttgctcttgctgtggccatgtgacctgcctgctccctctctgccttccgccatgattggaagcttgctgaggcctccccagcagcagatgctgctatgcttcctatatagcctgcagaactatgagccgattaaacctcttttcttataaattacccagtctcaggtatttctttatagcaaattgagaacagactaatacacccctgtggctccttcctttaactaaaggggaattacaagtatcaacccaaagttctagctatgacagaattcacattcagagaaaaaatatgtctaccacatcactggattatcagaatatatagaggatctgcccaagtaaatgaggtccaaatcaaccttcaagacatccaccaccatacaggcggtttcaatgtgtcaaagacagttgcccacatgcccttctaagataaaaaaggctttacaagaccaaagggtgcccctttatctcctgatctcattttccccatcacctgtacccatacattttttaatggaacagcaaggcatgacattaagagttcatgtctcttgactcaaactgaaacctaacaatttggagagtcacttaagaaggacttaccaatcttgactctcaatccaaggggccagaaactgccgcagctccattgggaagctgtcactgtagagctgatggagctgctccaggtaccgtgtgtcaagctgctgtagctgattccattgggccatcctgctaaaatcaggggtcccaactgtaaaccaaagtgtgcatatgttcaccacaagtcccagtaggggtaaacaatctagaagtagccattgcccaacacaggtgtcaggtctgtgactagggataaagatgctctggggaggaccctgcttctttctcccagtttattttatttttaaaaaatagagatggggtctctattttttgcctgttgcccagggtggccttgaactcctggactcaagtgatcctcccaccttggcctcccaaagtgctgagattacaggcataagccaacacacccagcctgtttctcccagtttagaacaatacaaacacattcacaatccccaccttgggataatcacagctcctttttattattttttgaagacagagtcttgctctgtggcccaggctagagtgcaatggcatgatcatgggctcaagagatcctcccacctcagcctcccgaggagctgggactataggcacacaacaccatgccacactcattttttaaaaaatgtttcgtgagacaaacaaaacatgcccaggctggtcttgaactcctgggctcaagtcatcctcctgcctcggcttcccaaagtgctgggattacatatgtgagccaccccatctggccacacatctcttttacactgggatgacaagtggctattatgccaggttctagaatccattatctaccagaagtgtgtgaaattaaaaaattacttaactcccagatttctattcccttgtctataaaatagagataataattcccactcctcagaggtattgagatattcctacagcatccagctcagtgcatggcacataacagatgcccaacaaatgtcggttcctttctttctcctccacagcccttttagttatacacagtaaacctgtactgtagccaaaatgtagaaattggatgtttggggttgggggacagagcactaattccaagactacaggtttaaaagtataaatgaggatccaggaagatctgcctgagattctcctactcaacaaataataactattttaaaaattgcttagtctgggacaacagagaaggaaagaaaaatgccaggcataaaagttgtcccaggttcaggaacatcccagtgaaatgctctggtatgagaaacccagccagctaattacctgtaatcctctttctgaatagcatgggtcatggaaatatcaatagaggccaagttgttttaacaagttctaaaattaggccaggcgcagtggcttacgcctgtaatcccagcactttgggaggccaaggcgggcagatcacctgaggtcgggagtttgagaccagcctgaccaacttggagaaaccctgtctctactaaaaacacaaaattagccaggcgtggtggcacatgcctgtaattacagctactcaagaggttgaggcaggagaattgcttgaacctggaaggcagaggttgaggtgagctgagatcgtgccactgcattccagtctggcaactagagcaaaactctgtctccaaaaaaaaaaaaagagaagttctaaaaataattacaagtcagagccaaagatgaaggtatgtacagaccaaggtccaatgagatggttctctgggatagtgagaacatttaatgagagactgaacacacgcaaacatactagagttcttgattctcagagaaggcacgaagaagcacctagttagcactggctttttcataaaaatgactgagcaaactggcaacaaaaccagcaggtcttctgttctcaaggcagcaaatgtaacggaatgaaaggtgcgatcgtggaacctctaactcctgcaacctctaactcctgggctcaggcaatcctcctacctcagcctcccaagcagctgggagtacaggcagcattgctgcacctggctaatttttttaaaaaaatttttgtagagatagggtcttcactgtgttgcccaggctggtctcgaactcctgggcttaagcaatcctcctgcctcaacctcccaaagtgctgggattacaggcgtaagctaccacgcctggcctgggatcaggttttctgacagaacctgagagggctgcacttctccctccctctttgggggacagactcagaatacccctcttgctactgtgaagacggctggtggagctctcaagcatatattcagggaagtgcaggtagtacctcccagcagtctttacattgaataattaataatctaaggcagcagcatccaacagaaatagaatacaggccacacatgcattttaaattttctggtagccatacttaaaaagttaaaagaggctgggtgcagtggctcacgcctgtaatcccagaactttgggaggccaaggcaggcggatcatgaggtcaggagatcgagaccatcctggccaatatggtgaaaccccgtctctactaaaaatacaaaaattagctgggtgtggtggcacatgcctttaatcccagctactagggaggctgaggcagaagaatcgcttgaacccaggaggaggaggttgcagtgagccgagatcgtgccactgcactccagcctgatgacatagcgagactccatctcaaaaaaaaaaaaaaaaaagaaaagaaaagaaacaggtgaaattaattttaatgtattttatttcatttaatatatccaaaatgttattgcaacatatgaacatacaaaacatattattatttatttatttattttttggagacaggcactctgtcacccaggctggagtgcagtggttcaatcacagctcactgtagcctcaacttcccagctcaaacgatcctcccacctcagcctctcaagtaactgggactacagatgcgcaccacatctggctgattatttttgtagagacggggtcctactgtgttgcccaggctggtctcaaactcctagactcatgcatctcagcctcccaatgtgccaagagtataggcttgagccaccgtgtccagcccacaaaaactattaatgagatactttacactcttttttttgctacgaagttttctaaatctcctgtgtactttacatgtgcagcacagctccaaggtattttccctcctcatgtatcaagggcttaaattccactggtgaaaaagctcagtaaagcaaatagagagaatgtcagaataaggtatttgccccaattaggccaatacgcttctataaattaactaaatattccaacaatgttattttgttgttattgtttttgagatggaatcgcctaggctggagtgcagtggtgcaatctcacctcactgcaacttcagtctcccgggttcaagcgattttcctgcctcagcctcccaagtagctgggattataggcacgcaccaccatgcccagctaatttttttttttgtattttttagtagacagggttttaccatgttgcctaggctggtcttgaactcttatcagttcaagaccagtctggccaacacagtgagatcctgcttataattaattaatttaaaaatgtaggctgggcacggtggctcacacctgtaatcccagaactttgggaggccgaggcgggtggatcacgaggtcaggagttcgagaccagcctggccaacatagtgaaaccccgtctctactaaaaatacaaaaattagccgagcatggtggtggccgtctgtaatcccagctactcaggaggctgaggcaggagaatcacttgaacccgggaggtggaggttgtagtgagccgagatcgcaccactgcactccagcctgggcaatacagcaagactccctctcaaaaaaaagcaatgttacttgccaccttccaccctaagattcacctgccacaggacaaatgctgcctgggcagtggtacaggtacactaagcactagccagagtaaaagcagtggctgacgtgcatactatatgctgaagcattgtaaccatggcatgtattgattgccctctgtaagaaatcaaaggccattagatctctcttacaatatttgcattagggccaagttaaaatctgcctcacatggaggttgcagtgagccaagattgtgcatctacactccagcctgggtgaccaagtgagactctgtctcaaaaaaaaaaaaaaaaaaatctgcctcatagactaaaagcatcatgacctgacttatgctatgcaagaactgatgtgcatacaaagaaatctgcataatatgccaatttatgtagattctattgcatacaaatttactgaaactctaaacctacacagtccagtatggagtcactagccacatgtggctactgagcacttgaaatgtggctgcttcaaactgaactatgctgtcaatataaaatacacactggattttgaggacttagtgaaaaacaaaagaatgtaaagtatcttgttcatgttgaaatgataatattttagatatattgggttaaataaaatatattattaaaattaacttcacccatttctttttacttcttttaatatggctactagaaaacttaacattggtagggcatggtggctcatgcctgtaatcccagcacttagggaggccaaagcatgtggatcacccgaggtcaggagtttgagaccagactggccaacatggcaaagctccatctctactaaaaatacaaaaattagctgggtatggtggcacatgcctgtagtcccagctactcgggaggctgaggcaggagaattgcttgaacccgggaggcggaggttgcagtgggccgagatcgtgccactgcactccagcctgggcaacagagtgagactgcatatcaaaaaaaaaaaaaagaaagaaagaaagaaagaagagaaaagaaaagaaaagaaaaagaaactaaaagaaaacttaacattacatatgtgacttggatcttatttttattgaacactgctactctagacaatgtagccaaaaagcggtggttctcctaaaaaaaaatgatttaaaaaaagaaccaactgctttttgtaataaactccagtgtttaaaattaattttaaaaacagactttattttttgagacagggtctctctctgtcacccaggctggagtgcagtggcaaatatagatcactgtaacctccaactcctgggctcaagcaatcctcctaactcagggacctgagtagctgggactaggggcacaagccacaatgttcagctaattttttgtagtttttgtagagacaaggtctcattttgttgcccagactgatcttgaactcctggcctcaagcgatcctcccacctcagcctcccaaagtgctgggactgcaggcatgaggcatcatgcccagccaaaaatagactatttaattatttgtcttggatacaaatgcagaggcatcacagtctactccctgaaggtccaaattaaatcatgaaacagcatcccactatacctgctccatcatagattaacactggggtcatgcatgaatatttgcattttcaaactaacatatcctaaaaacgtgtaagttattgaaaattatctaattcatttccagtacataactaaggattttttggttgttgctgttcttatttttagctggggacagaggagggctagtaagtagtacaataattgtgttcttttttttttttttttttttgagatgaaatactgtcacccgggctggtgtgcagtggggcgatcttggctcactgcagcctccacctcccaggttcaagcgattctcctgcctcagcctcccgagtagctgggactacaggcatgccccaccacgcccggctaatttttgtatttttagtagagacggggtttcactatgttggccaggctggtctcaaactcctgacctcgtgatccgcccgcctcggcctcccaaactgctgggagtacaagcgcaagtcatggcacccggcctgtgttatttcttaaaacagaaaccagctagtagttttttccataaaattaaagcaccaggctgggcacagtggctaacacctataatcccagcactttgggaggctgaggtgggcggatcacaaggtcaggagtttgagaccagcctagccaatatagtgaaaccctgtctctactaaaaattcaaaaattagccaggcgtggtggtgggcgcctgtagtctcagctacttgggaggctgaggcaggagaatcgcttgaacctgggaggcagaggttgcagtgagccaagatcgtgccattgcactccagcctgggcaacagagtgagactctgtctcaaaaaaaaaaaaaagaaggcaccagggcaccaacaatgactgatttcatgttttacttcttagtctaatcaccataggtaatactttaatagttattctacaggggaaaataaaagtataacttaaagccaaagaccaggtagtattttcaaggagagaatatgcaaatacttccatagtcttctccttacaggctgcttagctacaaaccatatttaattaacagcagtcacaggagatgactagccaaagtgtctaggaaaatcactgccaagcagctttactgtaactgttttactggaaaagacctcaaagagcccatgttatttcacaatttcaattttggtttttcaaattacaagttaatctaaagaactccactaagttctaactacattacttcatatctacggaataattctaagcctgtgggtttttaaaaaaattttattagacattctagaattgggcaacacttcattcaatgccataggatgaatgttctccccaagcctgtgacttaataactacttcattgagccccagaacacacaaagttatctgaggaacaacttgagtgccaactaccactctgggtgcataagagagaagacaattcattactccatataggctgccttaggacattatatggggctcaattcaaagcatttactcaggttaagtcagcagatagtagatgcactgtacaaaggcaaggtgggtgtaatcctgttttctataactgaagagaaaagaaaaaaatgaaacagcaagtcatcaaagactttttggacttttcaaaacaggaatttctcagtcccttggggataacctaccaacagcaagtcataaaacaaataactattgtctaattgggaacttattaccgtaaagatgactgaaaaagtctgtccaaagttacagttctcatttatatacttgaatctaatgaaaccaaaagatatattgagaaacgcagtcaagaccacttacaaaagggatttactacacagcttcataaaactttttaaagttaagacttgtacttcacatccatgcactagtggatttacaacgagggtgagggaaggcggaaagagagacgaaaatcaggctcatacaataatccagaacagaaagtgatctaaagataacttctgttccactttgcaatgtgtcatgacattttcctttgggtaccacctatacttttattataaatacatgcattttaaatagagcatacctgtgttttatctgctgcctacactaacctcttctttgctgtcaggaaaggcccagtgatcaaggcaaccaaagtataaagaaacacagaagatttcttgcactgaattctataggaaccagtccttttaagagatatgtttgaaagattataaaataatgttcaatgtggaaaatttagaaaaatataaaaaagaaaataaaagataaaaacatccatatcccaccatcccactatgcagaacaaaaactgacatgttgccaggtgtggtggtctgtgaccccagcactttgggaggctgaggggggaggatcacttgaggccaggaagtcaaggctgcagtgagctgtgattgcaccactgtactccagcttgggtgacacagcgagaccctgtctccgaaaaaataaaaattgacatgttgatgtaattcctttaaatctatttcagaatgtgtttgtgtgtgtgtatatatatatatatatttttttttttttacattggagtcatagcattaatacagctgcatattcttttaaagtttattgtgtagtaaacatttttctatgaaaagagtattgtgtttgtttgtttgtttgttcaaatagagaccagctgcccaagctggtctcaaactcctggtctcaagcgaccctcctgttttggcctcccaaagtgctgggattacaggcgtgagccacagtacctggcctgaaaagagatgttttgttattgttgttgttgttgtttgagacagaatctcactctgttgcccaggctagagtgcagtggcaccatctcagctcactgcaacctccatctcctgagttcaagtgattctcatgcctcagcctctggagtagctgggattacaggcatgcgccatcatacccggctaatttttgtatttttagtagagacggcgcttcaccatgttggccaggcttgtcttaaactcctgacctgaggtgatctgcctgcctcagcctcccagggtgctgggattacaggtgtgagccactgcgcctggcctgaaaagaaatttttatttaaagcgcataaaagaactattttgtttctattggtgttttcaatacaaccctgctaatcccactgagggccacataatttattaagatttggaaaccccaatttatttgttctcaccataccacgttctaaaaataatctgaagtatctgcaagtagattaggaaggaaaaaaatgagaaaagtaagagaaagcaattcacgctagagaaaaacattcaatcttcataaaattttcaccacaggataaacagcataatggatgacagagagtccacattaaaatactgtaggccaggtgtggtggctcatgcttgtaatccttgggaggctgaggagggtaggtcacctgaggtcaggagttcgagaccagccaggctaacatggcaaaagcctgtctctactaaaaatacaaaaattagccaggcatggtgaaatacacctgtaatcccagccacttgggaggctgaggcaggagaatcacttgaacccgcgaggcagaggttgcagtgaaccaagatggtgccactacactccagcctgggcgacaagagcgaaactccatctcaaaaaataaattaaataaataaataaataaatactgtagctttaaactattagagtcattcataatttaaccattcataattactctagacattaagaatggaatttcaagtttaaaacataactcaaaataagtacacttatatagtaagcacacaatttcatagttttaagtccaaatagtacctttgtaagatttaagactagatacttgcaataagaagtctatatataaatctagttttgatttcctaaagagacaaaatattaacacttgagtgcccaatctgaaacaaattactataattactgtaatgttcaattacatataacaggatttgctttaaaattaaaaaccaatgacgatcaagcttgtaaaaatgaacatcaatctataagaaaacttgagttatagttccctactaatatgacaaaatttgaatatatgaaagaagtaaaggccaggcatggtggctcatgcctataattctagcactttgagaggccaaggtggaagagggattgcttgagctcaggagttcaagaccagcctgggcaacaccgtgagaccttgcctctacaaaaaaatttttttaaaattagcctagcatggtggcccatgcttgtagtcccatggaggctgaggcaggaggatcacttgagcagattgagactgcagtgagctgtgatcataccactgcgctccagcctgggtgacagagctagaccccatctctaaagaaggagcaagagcttaacaaacctaattccctctaaattaaaagtaacaaacatgatttgtcaattactgagtgcacagttgattgttaaagctgcctaagaacaggtctgagctctacaaaaactaaaactaaaacaagaaaacccacaaaacagaccaaatttgtgcatcagatgacctccccacttgggaacacttccacttccccaaccagacacattcctctgtatcagtgtggtgtgggggaaaggacagtagagacgggagctggatgggcctgggtgcaaaaccctgcctgacatttattagctatttgtctttgggaatggtatttcactaccaaatgggctttctcttcagtaaaacagggaactctctctcctttgaagaactgttgtaaagttaaaatcaataatggttgtacagcatccctctgtgctggtgctgctggtgccagatcctcagagctgcagttattgttcctttcccccagggtctccctttcatggacatttcttactttttttttttttttttttgagatgtagtctcactctgttgcccaggctggaatgcggtgggcacaatctcagctcactgcaagctctgcctcctgggttcacaccattctcttgcctcagcctcccgagtagctgggactccaggcgcccgccaccacacccggctaattttttgtatttttagtaaagagggggtttcatcgtgttagccaggatgatctcaatcacctgacctcgtgatctgcccacctcggcctcccaaagtgctgggattacaggcgtaaagccaccgcacccagccagatatttcttatcttaaacccatttccttagtgtcctggaaagcaggttaatccatcagattcactaggggttaagtgtgataatcactaatcagctttccctgctaagtaaaatacatgcatttcaatgcacactcttatcatatcgggagggaaggagtcagtgatgctgtgatttggcatgttaatttaaggagagaagggaggtcaggagagctgggtggtgacctgatcaaatatctccatacgtatttcacctaggatggctctaggtcctaaaaagagtaaaaggtgaaaacactaagtgatattcaaaacaaaagaaaaagatgaaaaataagaaccttggttaaagagcagtcgaaataagtaatgattatagctatgatttatatagcactttttacaagaagccaggcgctgttttaaacacttgacatacttatttgctcatttcataattgtaacaaccctatcagataggtactatttttatcccactttacagaggagaaactgaggcacagaattttaagtgatttggccgggtgcggtggctcacgcctgtaatcccaacactttgagaggctgaggcgggtggatcacgaggacaggagatcgagaccatcctggctaacacggtgaaaccccgtctctactaaaaatacaaaaaattagccaggtgtagtggcgggcacctgcagtcccagctacttgggaggctgaggcaggagaatggtgtgaacctgggaggcagagcttgcagtgagccgagatcgcgccactgcactccagcctgggcggcagagcaagactccgtctcaaaaaaaaaaaaaaaaaaaaaagatttttaagtgatttatccaaagtcacaacacaggtagtaaaggcatggagctggaatcataacgcacagtctgttttcggaatgtctgttcttcaccactataggagtcttgttttttcttttttttaaattagagatggcgtctggccatcttgcccaggctggtctcgaactcctaggctcaagcgatcctccagcctcagcctccaaaagtgctgggattacagatgtgacccaccgtacccagctactacaggagtattagaaagtgggaattttggccaggctcagtggctcacgcctgtaatcccagcactttgggaggctgaggcaggtggatcacctgaggtcgggagttcgagaccagcctgaccaacatggaaaaacctcatctctactaaaaatacagaattagctggccatggtggcacatgcctgtaatcccagctactcaggaggctaaggcaggggaattgcttgaacctgggaggcagaggtggcagtgagccaagattgtgtcattgcattccagcctaggcaacaagagcaaaactccatctcaaaaaaaaaaaaagaattttagttgatttttaagtaacccacaaaccaaccattgtaactagccaatgtgatcttatggtattttaatagacatactagtacttggattttgaaggatctagtagtctagctgtaacagacccacatctggatgctattctaattctgtgtatcaaaattgaaatggaacactaaaacaaccaaacacatccagggagggacaaccagggtgtgaggagttgaagaccttgaatattttgctcagcaagaagatgcaggcaacaggagtgaggttaggagagaaaaacatgaattacagaagagtggcccctcaaatacctggaaatctgtacgagaaaggataaatcactctaggactagaacctgtctcctcacaacatcttctcccaaattcttccccatgaagtaatacagaggtctccaccctggctgacactaaaaaatatatacagcaagaaagatgcctgggaaccaaaccagtgccaaattggaacctctgacagtgggaccaggtttcaaatttcgaaagctacggctgggcacggtggctcacacctgtaatcccagcactctggggggcctaggtgggtggatcagctgacgtcaggagttcaaaaccagcctgaccaacactgtgaaagcccacctctactaaaaaatacaaaaacattagcaggcatggtggtggatgcctgtaatttcagctacttgggaggctgaggcaggagaatctcttgaacccgggaggcggaggttgcagtgagctgagatcacgccattgcactccagcctgggcaacaagagcaaaactctgtcaaaaaaaaaaaaaaattcctcagatgatgctaaagtgaggccaaagaataataataaattttttcgtgatcattaataaatataacgagaacctcgaaatcagagcagagatcagggctcaactctgaatacgcctcagaatctcctgaggagctctacaaagccaggtgccagttcttagcccagaactagcaaataataatctccagggttctaatgaagcagtacactgtagagactgtacaaggagaccacggcagaagaggaggctggagaaggctctcctgtcaagatatctgcactttcttccaagggcaatggggtaagtctttgaaaagctttaaacagacaagtgatagtttgatttacatttcaaaaagatccctcaggctgcaataatcctggtgggaggtcgtggctgcccaatttaggtagcagcattgtaagtgttttgaggcagacatccatcttctgtgacattacagagctacatgtgatgggacttggtgactgactgaagggcaaaggtgactcagagaaagggaggagtaagtgacaacctcccaggttcctgtggcatttggtattcagatggcggtcacatgctcagcatggtaaatgtcatggcaggagtgccaacattgagagggcaattgggccacacagtctctaaaaactgtttgttctataaattactgtcaagctcgattccctcaagacattacagccacagcaactcaaaataatactgtaggaaaagcaagtagatatttaaccaaaaagggttcagggtttgtactccagctgaatggtaaaacctgccatcccctcaggaaaagaggcagaggcaagagaaaaatcaggcagaaacatcagagccaaaatgcatagggggccatggcaagagctgttaactgtctcccaacatctgtgtgcttgcctccaggccattttccacactgtgggtagagagaccttttcaagacacaaacttgatcttgccacacccctacttaaaaccctcctgatgactgctctgttcttaggctaaaaaacaagatttgttatcttaaggcagaatagcatggatttgaatcctggttccaccacttcgatcacttagcgtgtagctggtgccagttatttatcctctttgtgccttaatttcctcatctatagaaaggggagagaacagtgcttacctcacagggttgctgtacaaattcatcgagctaatgaacacgtagcactcaggagcccaatagcgtgcagcatgtaagtgtttgtactcattactagcatgaccgacatcctggctggctctgcccctctcgtatggctggtaccagctggtggctaagttcctggcactcactctgctccttcttcaggtcctcaaaaacaccaggctcctgcctgccactggccctcacacatgccttccttctatcaccatcaccatgacttgcacccaagtactgtgactccattaacttggactcataaccactatgctggactgaaagccccatgaagacaagaagagtcttggcttttgctcactagcgtgtcctaccctgaaccctggcatccagcatagtgtctggctcataataggtgctgaaaaaataggtattgaatgaatgaacgactggagtgaattacaactaaagtgtgtagccaggttctcccaagtgaggacactgcgcccaattagaaaatattctgaggaataggccaactcttccagttttgctgtttgaaaaattcaagaatgatcaagaatcactgattcaagaataatccttcagtgattcttcaataagagtaaaatcacagcactccccagctcaaaaacacacactaacatctcattgtccaatgcaaaatctttacccttatctcaggctctgtaactactcagccaactttagccccttccagttcctctctccagcctacagatgactttcattttttgagacagggtcttgctctgttacccaggctggagtgcaataatacgatcacagctcactgcagcctcaacctcctgggctcaagcaaccctcccacctcagcctcctgagtaactgggattacaggcacatgccaccatgtctggataattttcttttttttttttttttggtagagactcagtctcaccatgttgcccaggatggtctcgaactcctgggctcaagttgtcctcctacctcggcctcccaaagtgctgcgattataggcatgagccatggcacccagcctccaggtgactttcataagtgttgtcttccttcaagtcaacttatctcctccttgccccccacccacagactttgttcctttttcatatttgttcttgcctaaaatgcttttttctctgggtggcgttatccatccctttcttgtgtctgtcagacaggctctccctaaccccacccctagtccaatgactgctttcactctgaatccccacggtacatatataagcatctgaggctctttcctattggctttgattctacctccttcacttgaggagcagctctctgctggcaaccacgtaccatcctgatttagaacttcccacaggctaacttaagacaccaaataaacacttgcacacacacataaccaccacctcccattacagaagtacacctcccctactgaacagatgatggccacgatactgaaaagcatggcatcaacatgacaactgcatcctgaaagatcagcctatatataggtttggttatcttgaatttcgagtttggagagaagcaaagtatttttctaataaactgtgaatgctgaggaattcaccttcataggagtcagaaacaggctgccaaacttttcaaaagaaaaacagtggtaggttgagcaagcacattgtcatgtcagattttccaggctcgagggccactgaagggagaagagcgagtagctggaaaaaacctgtgggtactgttatctttggccaaagctcaaataaaagaatcacaaaaacatccactgatctaaaatgctatgtaagtcattaatattcatctaagagaggcaactgaaataaagcagataaagagaacttaagccattctcttacctcagcctcccaagtagctgggattacaggtgcccgccaccacacctggctaatttttgtatttttcgtagagatggagtttcaccattttggccaggttggtctcaaactcctgacctcaagtgatctgcctgccttggcctcccaaagtgttggggttacaggcgtgagccactgcgcctggccaagaatttaaatttctgagtctcaaagtcataaacctataatatggctcaatgcttacctcagtgcttactggagagaaggaagattcttttctcaaatttattcaggtcactttccctatacgaaatactaaggtagtcctggtcacttacatggaacaatatacctggggctgacgatgcttggatatatagaagtccttcagtcaaaggaactatgaacttttgaggcagaacctcaaattcagaaggcatttgtggtggttggataacatggccctaaattctctcattatgccccactctctgagaggagggggtctttgttcccttcctttgaatctagctaagtccataactgttccaaccaatagagcatgctgaaagcggcgagatgtcatttccacctgatttcattggaagtctcattctccagaaccagccacattctgtgagaaacccaaggcaaaaggggaggccacaagtaggcacgtggtctacagtctcagctgaaatcagcctttgagtcatcgcagcccagacatcagatacaggagtaaagaaaattccagatgattattacccccagccgcttgagttttctcagtgagacctcagacatcgcagagcaaagacaagccatccctgctgttatctaaattcctgcccacggcatcttcgaacatagtcaaatgattgctgctttaggccactaagtctgagctggtttattgcattcggcaactagaacaacatttttactaacatagtgattgaatgtagacttaataatgaaagagtccaacttccataagaaaaaaattcataattttaaaggaagaggctttgctgttaaagttttttttttttgtttttttttgtttttttttttgagacggagtcttgctctgttgcccaggatggagtgcagtggcgtgatcttggctcactgcaacctccacctcccgggttgaagtgattctcctgcctcaacctcccaagtagctgggactacaggtgcccggtacaacgcctggctaatttttgtattttcagtagagacagggtttcaccatattggccaggctggtctcaaactcctgaccttttgatctgcccaccccagcctcccaaagtgctgggattacaggcatgagccaccgtgcccggcctgttaaagctattttaatagtaaacttattttctctatgcactcctttctaaattattcagccccactttctttcaaaacaacgtttatacactgacaattctcaaatttatgtctctagccccatccgctaatatgaacatcagacacttatagccaactgcctcttcaatatctccacctggatgtctaaaatgcatgtcaaacttaatgtatccaaagccaaccccttcattaaaaacctctcccagccggcttctcctccagtctcccccattctagcaagtgacaactccattcctgcacatgttgaggctaaaaaccttgaaatgagccttaacttcaactccagtctctctctctcttcctccccctcctcctgccacacctaatccattaacaaatcctgttggctctgtcttcaaaatctggaagtgaccgggcacaatggctcaggcctataatcccagcactttaggaggctgaggcgggtggatcacttgagctcaggagtttgagaccagcctaggcaacatggcaaaaccctgtctctacgaaatatacaaaaattagccggatatagtggcgcaagcctgtgatcccagctacttgggaggctgaggtgggggtatcacttgagcccaggaggcggaggttgtagtaagctgagattgcaccactgcactccagcctgggagacagagtaagatcctgtctcaaaaaaaaaaaaaaaaaaaaaaaaggaaggtgagcctttctcacaacctcccactgacgcagccttaatccaggccaccagcatctcttacctagatagctggactaggctaactggcctggatgctttcatccttgtccctctaccttctattctccacattacagatcctttcaaaataagagtcctggctggcacggtggctcaaacctgtcatcccagcactttgggaggccaaggcgagcagataaattaaggtcaggagttcgagaccagcctggccaacaaggtgaaatcccgtttctactaaaaatacaaaaattagccaggtgtagtggcaggcgcctgtaatctcagctactcgggaggctgaggcaggagaagttgcttgaaccggggaggcagaggttgcagtgagctgagatcgcgccactgcactccagcctgggtgacacagcgagactccgtctcaaaaaacataaacataaaaataaataaaaaataaaaataaaaacagaaattcgccggcatggtggcccaagcctgtaatcctagctactcgggaggctgaggcaggagcatagcttgaacccaggaagtagatgttgcaatgagccgagattgcgccactgcacttcagcctcggcaacagagcaagattttgtctccaaaaaaaaaaaaaaccagagtcagatcatttcattcccctgctcaaaacccactcaggaaaaaatccaaagtcctaccacggcccaccagtcaatccattttgccccagatgtctctctttgcctccttccctacaactctccccttgctcacagctgtcccctctctgctcctggaacacaccttgcccgtttctgccctaggactcttctctccacctgataggctctttccctagatatctccatggcttgctccctcacttcgttcaggtctctgcacaatgtctcttgacacccctctatctaaaacagcaacatctcccctgctgaattctcctttacagtactcatcgccctccattgttcatatatttcttttttcatgtatctccttccaatatgatcaactaggaacttaagccccataagaacaaagacattcttcagttcactgctatttccccagcaactacagaatgctcaaatatttgaataaatgaatgaaaattaagtaagtttttcaaaaatctagaacacacttttagcatagagaaaactgaagtaccataggaggttaattcacttcatataacagcataaactgcccttccttaagtaggagacaataggtacaataatgcatgcaaatgttaagtggtaaagcaaacatacaaagtttcccaatagaagagtttaaattaaaatctaaacttccagccaggagcagtagtggacgtctagtcccagctactcaggaggctgaagcaggaagatcacttgagcccaggaattcaaggccagcctgggtaacataggaagaccccatctctaaaaacataaaaataaaaatctaagcctcaaaagaaaaaaaataaataaacaaaaggcatttcctataaagttaaactgttacagaattgtttttcttaaactgcaataatgagactttagcactctcttgtcctctaaaagacattatttcatgacatgtgcccattggcagtatttgagaatctaagaaagtagatcacactaaatattgatatgcagacactaaaatcgtacaaccacttggatgactaggtttgagatattcccaaagtgacaggtttttgttttgttttgttttgttttttgagacaaggtctcgccctgtcgcccaggctggaatgcagtggtgcaatctcagctcactgcaacctctgcctcctgagttcaagcaattctcctgcctcagcctccctggtagctgggactgcaggcatgcaccaccacacctggctaatttttgaatttttagtagagacagggtttctccacgttagccaagctggtctcgaattcctggcctcaagtgctctgcctgcctcagcctcccaatgcaaccagcctttttttttttttttaacttttattttaggtttggggttacacgtgcaagtttgttatataggtaaactcatgtcagaggggtttgttgtacagcttattttgataaaatattaagtattaagcccaatacccaatagttatcttttctgttcctctccctcctcccactctccaccctcaagtaaaccccagtatctgtggtttccttctttgtgttcacaagtccttatcatttagctcccacttataagtgagaacacgtggtcttcggttttctgttcctgcattactttgctaaggataatagcctccagctccatccatgttcctgcaaaaacatgatctcagccgagcacggtggctcacacgtaatcccggcactttgggaggccgaggtgggaggatcatgaggtcaggagttcaagaacagcctgcccaacacggtgaaaccccatctctactagaaatacaaaaattagccaggcatggtggagggcacctgtaatcccagctactcgggaggctgaggcagagaattgcttgaacctgggaggcggaggttgcagtgagctgaaatcgtgccacctgcattccagcctgggcaatagagcaagactccatctcaaaaacaaacaaacaaacaaacaaacaaaaacatgatctcgttgttttttatggctgcatagtattccacagtgtatgtaccacattttctttatccaatttgtcactgatgggcatttaggttgattccatgtctttgctattgtgaatagtgctgcaagtaaatctctttaaacagcaaatctattactgcctgcttttcaatgctttaccctcaagaaacttgggctacaactcaataacaaaaagcagcatttttgttcttgttgtttttaattcagtttcttttttttgttttgttttgtttctaagagacagggtctcactctgtggcccaggctggagtgcagtggcaggatcatagctcactataacctcgaactatcaaactcctgggcctaagtgatcctcccacctcagcctcctgagtagctaggactacaggtacatgctgccaaacccagctaattaaaaaatattttttttttggtgatgaggtctatgttgcccaggctggtctcaaattcctggactcaagcgatcctcctgcctcagcctcccaaaacattgggattatacagatgtaagtcactgcactttggccatgtgttggttttttgttgttgttttttgagacggagtcttgctctgtcgcccagactagagtgcggtggcgagatctcggttcactgtaacctccacctcctggttcaagcgattctcctgcctcgcctcccgagtagctgggattacaggcacccaccaccatgcccagctaactttagtatttttagtagagatggggtttcgccatgttcacctggcctcaagtgatccgcccaccttggcctcccaaagtgctaggattataggcatgagccaccacacccagccttttttttttttgagacagagtcttgctctgtcgtccaggctagagtacagtggcatgatctcggctcactgcaacctccgcctcccaggttcaagcgattctcctgcctcagcctcctgagtagctgggattacaggcgcctgccaccacacctggctaatttttgtatttttagcagagacggggtttcaccatattggccaggctggtctcgaattcctgacctcgggtgatctgcccatctcgggtgatctgcccgcctcggcctcccaaagtgctgggattacaggcgtgagccaccgcgcccagccatcttctcatttctttggtgagattgtttggtttttgcttctgaagattttcctgtttttctttttttgtttttttttttaagagacagaatcctgctctgtcacccaggctgaagtgcagtggcgcgatctcagctcgctgcaacctccgcctcccaagttcaagcatgcaccacctacaggtgtgcaccacaacacccagctaatttttttttttttttttagtagaggtggggtttcactacgtattggccaggctggtctggaactcctgacctcaggtgatccacccaccttggcctcccaaagttctgggattacaggcgtgagccaccacaccgggcctccctgttaagcccagtttatccagtatttctaggtgttttgtacaaaagagttttcagggcatttagcctaacataaagcagaaacaaaagtcaggatgagtcaagtaacagtatttgagaaaacttcagaggtagaaccaacaggatttgctgatgctttgaatgaaagcagagataagacagaacagggaatttaaggatgattcctagatttctggcttgcacaaaggagtagatggtggtctaccatttatttagatggggaagtcagacagggagagaggcacaaacttgcagagagaaaagtttaagagttatattttgggcaagtagacaggagacaactacaagttacttgagggaagatgtcaagtttgcagcaggatgcaggagctgggagcccagagcgactgggtggagggccacacttgctagtcatcacagcggctaacacgtcttcacagtaaaagccaaaacaggcggggcacggtggctcacacctgtaatctcagcactttgggaggctgaggcaggcggatcacctgagaacggggagttcaagaccagcctgaccaacatggagaaacctcgtctctaattaaaaaaaaaaaaaaaattagccaggcgtagtggcgggcgcctataatcccagctactcaggaggctgtggcaggagaatcgcttgaactcaggaggcggaggttgcagtgagccgagattgtgccactgcactccagcctggtcaacaggagcaaaactctgtctcaaaaaaaaaaaaaaaaaaattgaggccaggtgcggtggctcatgcctgtaatcctaacactttgggaagctgaggcaggtggattacctgagctcaggagttcaagaccagcctgggtaacacagtgaaaccccatctctactaaaatacaaaaaaattagcagaacatggtggcgtgcacctgtaatcccagctacttgggaggctgaggcaggagaatcacttgaaactgggaggcggaggctgcagtgagccgagattgcgccattgcactccagccagggcaacaagagtgaaactgtgaaactctgtctccaaaaaaaaccaattttaataggtataccattatacacccattaaaatggctaaaatccaaaacactgacaccactaaatgctggtgaagatgtggagtaacaggaactctcactcactgctgatgggaatgtataatggtacagtcactttgaatatagtttgatagcttcttacaaaactaaacatactcttaccatatgatctagcaattgcactccttgatatttatccagaggaggtgaaaagtcctgcactggaatgtttatagcagctttattcataactgctcaaacttggaagcaaccaagatgtctatccttcaggtgaatgtttgataaacaacatgtggtatatccatacaatagagtattactcaccaatgaaaagaaacaacctatcaagccacaaaaaaacatgaagaaacctgaaatgcatatcatttactgaaagaagccaatctgaaaaggctacacactgtatgtccaactatatgacattctggaaaagacaaaactatggagatattataaaagatcagtggttgccagtggttcagcagaggaatgaataggtggagcacagggggtttctagggcagtaaaactattttatataattgtgtactggcaaatatacatcatcacacatttgtcaaaatccatagaatgctcaacagagtgaaatgtaatgtaaactatggacttcaggctggacagagtggctcacacctgtaattccaacactttgggagactgaggcaggaggattgcttgagcccaggagtttcaggctatagcaagctatgatgatgccactgcaacctggcctggacaacacagtgagaccctacctctaaaaaataataataataaaataaaaatagaaataaaataaactcaggaatttggttaataataatgtatcgagttggttcattagttgtaagggacgtactatactaatgcaagatgttaataatagaagttgtgggagaaagtaaggggtatatggaaactctctgtactttccacataatttttctgtaaaactaacactgctttaaaaaataaagtctagactggccgcagtggctcacgcctgtaatcccagcactttgggaggccaaggcaggcggatcacgaggtcaagagatcgagacatcctggctaacatagtgaaaccctgtctctatcaaacatacaaaaaattagccaggcgtggtggcagacaactataatctcagctacttgggaggctgaggcaggagaatcacttgaacctgggaggcggaggttgcagtgagccgagatcatgccattgcactccagcctgggcaaaaagagtgaaactccatctcaaaaaaaagaaaagaaaagaaagaaaacacgtatctactaaaattacaaaaactagccgggtatggtggcaggcacctgtaatcctagctacttaggaggctgaggcaggagaatcacttgagcccgggaggtggagtttgcagtgagccaagatcacaccactgcactcagcctgggtgacagagcgagactctgcctcaaaaataaaataaaataaaaataataaagtctattaatttttaaaatatattaattgagccgggcgcggtggctcacgcttgtaatcccagcactttgggaggccgaggcgggtggatcacgaggtcaggagatcgagaccatcctaacacggtgaaaccccgtctctactaaaaatacaaaaaattagccgggcatcgtggcgggcgcctgtagtcccatctagtcaggaggctgaggcaggagaatggcatgaacctgggaggcagagcttgcagtgagccgagatcgcgccactacactccagcctgggcaacagagcgagactccgtctcaaaaaaaaaaaaaaaaaattaattgagctttatggttaagtttttaaaaagataaatctgacccataaagtttaaataatagtcaagatggaagatgagtgatctccccaaggagacaagcttttctatgaaaatcttatcaaaatgtataatgtacttagaaaactaagtgacctcattacacatcatagttttgcatgatgtaaccactcttcagagaatatctcattttgtccttcagctcccacacaagagaaggttaaggaaattccactactcatgaaattataatcccacaatgtaagtgaagtggtggctgtgcctaggaaagaaagagaatacacgcttagagagaatctagaaagaaacattatccagtttgtgttggggatagcccatgatctaaattctaaaaagcacacccatatagaacctagcctgggctgggtgcggtggctcatgcctgtaatcccagcactttgggagactgaagcaggtggatcacctgaggtcaggagtttgaaaccagtctgaccaacacagtgaaaccccgtctctactaaaaatacaaaaaaattagccaggcatggtggtgcatgcctgtaatcccagctactcgggagcctgaggcaggagaatcgcttgaacctgggaggcagaggttgcagtgagctgagatcgtgccattgcactccagcctgggcaataagagtgaaactccatctcaaaaaaaaaaaaaaaaaagaacccagtctgaagcatgaattcacattgcgttttccagtcaatcactcagccaaagagaacctgaggtggccaagataatgtaacaaccctatcaagtaggtgttattcccatttacagataaggacagaaatgttaagtgactacacatggatgcaaacttggaatcttcaaactcccaggctagtagccaaattacctgtttttaaatctcatctctgctatctgatctctgccaagcaaatttccctttgaatttgttatgcaaacaattaacgagaataaaggaaaatgagagctttatatacgttacatgtaataactggaagttaactttattaagacatctgaaataagtcaacacttttaaaacttaaaggctattctttaccagaatcgtctgtaggaattaaccccagcagtcagaaagtaccttaaaacaaaaccaacattaatctggtaatgtcatgacttcataaaatatccttaatattcaggtacgtgcataccaagaagagtaaacagaataaaaagaaatctctaaaacattttccctcattcactacatgtctactcttccacttacctttatctctaaaacaaaaacattttctaaaccctgtggacatgacttcactaatccaaagaagactttatattctatgggccttgtaaagccacatttctcaaactaaggaccaaggaccatctgaatcagaatatctgctatgcctgtgaggatgaccccagataaactacatcagaccctctcaggcagatccatagattctttcttctttttaagcaaataacccagggattcttatgttaaaacctttagaccaacctttctcaaactcttcgctctcatggcccctttatttattattttttaaatttaaaagaaataataagcaaaccgggtcaggtggctcaaaactgtaatcccagtactttgggaggctgaggcaggcagatctcctgaggttgggagttcgagaccagcctgaccaacatggagaaacccccatctctaataaaaatacaaaactagacgggtgtggtggcacatgcctgtaatcccagctactcgggaggcttaggcaagagaatcacttgaattcgggaggcggaggttgtggtgagccgagatcgcgccattgcactccagcctgggcaacaagagcgaaactccatctcaaaaaaaaaaaagaaaaagaaagaaagaaaagaaataatagagccgggcgcaatggctcacacctgtaatcccagcactttgggaggccaaggtgggcatatcatgaggtcaggagttcaagatcagcctggccaacatggtaaaaccctgtctctactaaaaatgcaaaaattagccaggtgtggctgctagcccctgtaatcccagctactcgggaggctgaggcaggagaattgctggaacctgggaggtggaggttgcagtgagccgagatcatgccactgcactccagcctgggtgacagagtgagactccgtctcaaaaaaaaaaagagaaagaatgattgataaaccaactgggatactggcagatattttctcaaaaatgaaagaagggaagctgtctgttcagggaaagcaactgacaatatttgttgccaatgataaaatttgagctttagagtaaaaatcagaatttgagaaagtttgtatccaccactgtgagtctgacagttgtctaatattaatgattattaatgaaaccccatctctactaaaattacaaaaattagctgtgcgtggtggcacacgcctgtagtcccagctactcaggaggctgaggcaggagaatcacttgaacccgggaggtggaggttgcagtgagcggagatcatgccattgcactccagcctggcaacagagcaagactccatctcaaaaaaaaaaaaaaaaaccggccaggtgcggtggctcacacctgtaattccagcactttgggaggccaaagcgggcggatcacaaggtcaggagatagagaccatcctggctaacatggtgaaaccccgactctactaaaaatacaaaaaattagccgggcattgtgacgggcgcctgtagtcccagctacttgggaggctgaggcaggagaatggcatgaacccgggaggctgagcttacagtgggcccagatcgcaccactgcactccagcctgggcaacagaatgaggctctgtctcaaaaaaaaaaaattggcggtttatgggtttgtggggggtacaattcctgcctgtccaagtgacagactcatttaattatccccaagttaatgtttaagtgcaatggggtaaaacatgcactctgttaactaaaaagccacatttccaaatagtatacatattacgattaaaacattaaaaatatatgtgtacagatttattcatataagcccaaaaacaaatgtcagacaatgtttctgtctttggaacctgactcaaaataaggttcctcctgttggcttcttcctgagacacagccaacgctaatttgccgcccaggcaaatcatctatgcctatcattaggaaatcaaatttatgatatgcatagcctagaatactactctgtagtttttttgtttttgtttttgttttttgagacagaatcttgctctgtggcccaggctggagtccagtggtgtgatctcagggttcaagtgattctcccaccacagcctcccgagtagctgggattacaggcacacactaccatgcctggctaattttactatgtagattttttaaacatgaggtatatacacatgtatttgcattgagtattctctaagataaagtgacaaaaagcaaaatacagagtttggtgtatttgctgctatatatggaaggaacaacacccagagaataacatgtttgcatgcatacatatgaagtaactcaggagagataaatagtaggtaactagctgtccctgggaaagagtcccaaggataaggtgcggactaactttccacttactacatatcttttgtactgattcatttcaaaatttactctaaaatattggtattacaataaagaaaactggagtctagaactgaatgacaaaactgatacattcttactacaaatctgtggttaagattagcattaatctttcctaggcaaagaggaaaaagtttaacccaaagactgtatggatcttctctaccctacatctccaatctcattcccattactcagaaaatattctcactgggtatagaggtatgaactcccattggaaaacttagggtaaacgtccgtggaatctatggggcactgctgacccaggacacctgggatatttctgcagaaacaggattttttttttttttttttttgagatggagtcttgctccatagcccaggctggagtgcaatggcgcgatctcggctcactgcaacctccacctcccaggttcaagcgattctcctgcctcagcctcctgagtagctgggattacaggcgtgagccaccgcacccagccagattattcttaatcagttgattatttctggctccagaatgcttcaattattccacctgcccctatgtataagcgttaccaccctaattatgcttgtttttgtttttttggttgtttgagacggagtctctgttgcccaggctggagtgcagtggcacgatctcgactcactgcaacctctgcctcccaggttcaagcgattctcttgctttagcctccagagtagctgggattacaggcacgcgtcaccacacccagctagttttttgtattttcagtagaaacaggatttcaccaagtcggcaaggatggtcttgaactcctgacctcaagcaatccacatgccttggtctcccaaagtgctgggattacaggcgtgagccatcgctcccggcctcctaattatgtttcattttggttaatgtttcaataaatgtgctttccctaaacatactgatgaaaagaggcccaaatgcaaaactgatttgtcgagaaagtcagtctgagatgaaatatttattatgtctaaaccacaagtagaaaaaaattcaaaggccgactatttcaatgctaactcaatgcaatattgcactttgtttggtttacgggagaggtaatttacacagctaacatttgggttttcaagattacattgtggggagagaaggggaaaacaagaaaagtctaatgcttttagattctgtcagaaaaagtgtttgctaaaaagcaaaacaaaatgaacatgagaaaaaatgtgaaaaaacatgcattttaggaagctttcaccgaagcaggtgctcaagttcagactcaaatcttccaactcttgtaataaaaatgagaggtcagaataccacaaactaatcaaatcaatcaaacaaagcgggaaacaggtggctgacaccagactgggcagggttttcctaaattgggcttaccttcactaatccaaatcagttttcagaaatggcttctacaaaaactacccaaacatccccctaataatttgcactcctcctccacaatagggaagccaagccgtttatttcccagaaggtttactttctctttcaagctctgctggcttcttcctgccccgcatacggccaggaaaaaagaaaagcactgccttttctttcctgccttctctaaaactggggagatggggtgagagaacctgtttcatggacaagctgggtggttcttaactgcaacactgttctgaatacagattagtttgcaaaggaaagttacaggacaggaaaataaaggtctacccctccaactaactcatacacatgtacatttgcatgtacgcacacacacagatgtgagggcacatttaattcagctgagtaatgtgcagcaatcagctcccagcttcatacctggccaccgggatgcctcctcactcccaccttctttacctgactcaaaataaggttcctcctgttggcttcttcctgagacacaaccaactctaatcattcctcttcccctcaaaccttcaacactacctgcactttctgggtcgggagcaattccttgggtggtaatccatttttaatgtgttaaatattacttaaaataagggagaggtaatcatggactgtgggcaatgcagagatttatcagaagggcatttgtgtaaacaggaatttacagtttgccttacctattccttttatatgacagcctcaatttcctctaacagaatgtaagtcccccatccctattcatttagtttttttcccattaggttagaatctgctaattattctttctctcctttgggtcattagtggctgccatgaatcataatttgcctgactttgtaatatctaacagatattaccattttagtttagtttttgatatgacagttttttgttttttgtttttgtgacggagtcttgctctgtctcccaggctggagtgcagcggcgcgatctcagctcactgcaacccccacctcctgggttcaaaagcaattctcctgcctcagcctcccgggtagctgggactacaggcacccgccaccacaacaggctaaattttatatttttagtagagacggggtctcactatgttgggcaggctggtcttgaactcctgacccgcctcggcctcccaaagtgctggaattacaggcgtgagccaccatgcccgacctcctaattatgttttattccacctgcccctatgtataagcgttaccaccctaattatgctttttgtttttcggtttttttgagacagagtctcactctgtcacccaggctgtagtgcagtggcacgatctcggttcaccgcaacctccgcctcccgggttcaagcgattatcctgcctcagcctcccgagtagctgggattacaggtgcccaccaccacaactggctaatttttatatttttagtagagacggggggggtctcactctgttgggcaggctggtcttgaactcctgacctcaggtgatccacccgccttggcctcccaaagtgctgggattacaggcgtgagccaccgcactcggcctgatattatagtttttaataagagtaattcagcctaggcaacgtgacgagatcctgactcaaaaaaattagaaaattagctgagggtggtagcacacacctgtagccccagctaccccgaaggctgaggcaggaggatcacttgagcctaggaggtcaaggctgtcatgagctgtgatctcaccgctgcactccagcctaggtgacagagtgagaacctgtctcaaaaaataaatagtaataatagtaattattagcacttgaatgttacctgtctgcccggcactatgcaaagtacttgatatgcatcatcttgcttcatcctctcaattactctacaagtggacctcgtttccacaattgtggacagagaaactgaaaaccagagaagtgaaaacaacaggcccaaggtctaagagaaggcagaactgggattaaagcccaataggtctgacctgatagtccactcttttaactgctatagtaactttggaccatgaaaccctcaaacataccaaccaagtgtttcaaaactacaatagcaatcaccttaggaatactcaaaatataagttctttggctgacgcagttaaaaattcaaaggtcaggtaaaatttcagtgatgagcaaggtcatttattcttatggctgggggtagcaggaaggaaagccggatcgtcgaagcattattttcttgtaggggcagatttaccttccttattattcttttgctaggctgttaaaaggaatttggaaggccaggcgtgctggctcacgcctgtaatcccagcactttgggaggccgaggcaggcggatcacaatgtgaggagattgagaccatcctggctaacacggtgaaaccctgtcgctactaaaaatataaaaaaaaaaacattagctgggcgtggtggcgggcgcctgtagtcccagctactcgggaggctgaggcaggagagtggcgtgaacccgggaggcggagcttgcaatgagccaagatagcgccactgcactccagcctgggcgacagagcgagactccatctcaaaaaaaaaaaaaaaaaggaatttggaataaatatgtctccaagataacctggtaaacagaaagggctgcaaaaaatctgaataaaagcaagtcaattaacaggatacatgtaaaacacacattttatattcctacaagtctttttttttataatagcatgttattacttttctaaaaaggacaaaataacttattttaatgacatttaaacccaattattaacagaaaagggataagaactgtggttccttggcctcctttccccttggtttagttctcctaaattaagaacttctacttatagctccctgaacacacaaggctgttttaagcctctgcaccctcatgttccttcagccttgaatgcaactttttgtaacgcaacttcgtggaaagaattcctattcatcctataaaaccctattcaggtgttcccatctgataaagcccctcaataatgatgactttctctcactcctgaaaagaattaatctcttttcttggatatttagtaagaacttagatttaccgagctcttactatgtgccaggcactatgctaagcattttatccacattatcttattgaatcgtcaacagtacctacaagataagcactgttataatcttcttttacagataagaaaatagaggctcagattctgactaggaagtggcagatccaggattcagtcccagatctgtttgacttcagagccagagtcttgaaccactcactgccctgtcgtctcccctgtcctacttccatactggcatagcacacacctcggtccctgcaacatctccagtttcatgaaaacggacaatatttcattatccttggatcctgcctgacgcaatacctggctctcaacatgtttgctgatctgaattaaagagttgcggtaatccttttttttttcttttttttttgagatggagtcccactctgttgcccaggctggagtgcagtggcacgatctcagctcactgcaagctccgcctccaggactcatgccattctcctgcctcagcctcctgagtagctgggactacaggcgtctgccaccacgctgggctaattttttgtatttttagtagaggcggagtttcaccgtgttagccaggatggtctcgatctcctgacctcgtgatccgcccacagcctcccaaagtgctggaattacaggcatgagccaccacacccggctgggtaagagttgcagtaatcctaacatgacaaatgagaactgaccataacagaaattcattcttccatatgttattcccaggcctcataacctctccttcctctgaagacatgtagcattcagtgtagcactgtcagaatgtctcactctgtcccccagtctggagtgcagtggcaggatcttggctcactgcagcctccacctcccaggttcaagcaattctcctggctcagcctccagagtagctggaactacaggcgtgtgccaccacacctggctaatttttgtatttttagtagagacggggttttaccatgttggccaggctggtctcaaactcctgacctcaagtgatccgctcacctctgcctcacaaagcgctgggattacaggcatcagccaccatgcccagcctgtttttgccttttttttttttttaaagaaacaaagtggtctcactatgttgcccaggctggtcttgaactcctgggctcaagcaatcctcttgcctcggccttccaaagtgctgggattataggcatgagccactgctcctggcccgatatgctactccttttaaaaactggaggcatctcaaacaatttaccaccaaaggaccatgtggccatactgactaaagcgcactacactttacgcttacgtcttgtaagccaaggtgtctaacaaagagtatataaccaccatattaattctttacaccataatcaataagggctgggccagcccagcaatgccatcctcctggatctcactgaggctgctccagaacaccagaagttcttcaggattcggggatgtccctcaagtactctttcagtggtttttataaatgactcaaaagttatggtgaaatttttaagtgccaaagacataaaatatgagtggtggtttgtatccaatcaaaaatcctcaaaaaacacttctgcacttaagcacactatacttttttcacccaaagtaccaaatcaaactagtcaggatacctacctttgtacaatgtcagactccagttaataactcccctagggcagagggcatatgcactgatttactttgtacaaattaaccagcatcaggcaatcaggcctgtgcctaacacatagtaagcactctatgattaaacatcagtgcttcggctccaaagttttatttatttatttatttatttattttttttttttttgagacggagtctcgctctgtcgcccaggctggagtgcagtggtgcgatatcggctcactgcaagctccgcctcccgagttcacgctcttctcctgcctcagcctcccgagtagctgggactacagacgcccgccacaacgcccggctacttttttttgtatttttagtagagatggggtttcaccgtgttagccaggatggtctcgatctcctggcctcgtgatccgcgcgtctgggcctcccaaagtgctgggattacaggcgtgagccaccgcgcccggcgccccgaaagttttaaaagcttcccctacaaaagaacagaactgaaattccttggtcctgtattcaatgtcttttgtaagtaatcacttctcccctacttaccctcctagtctaccgggctaccaggaattttttttttttttggagacagggtctcactctgtcacccaggctggagtgcggtggcgggatcacggctcactgcagccttaacccccggggcttgggtgatcctcccaccttagtctcaccagtagctgggactacaggtccacgccaccaggcctggctaattttttttatttttaggggagagggagttttaccacgttgcccaagctggtctcaaactcctgggctcaagcaatcctcctgcctcagcctcccaaagtgctgggattacaggcataaaccaccgcaaattctttacacctatcaaattccacccattatttgggacccagttgaaatccctctttggcaaaaagactttctagacaactccaggcctcataacctctcctttctctgaagatctgtagcattcagcctagcactgtccaatagaacgttctatgataacagaaaagttctacatctgtactgtatgttcttttatgtagaacagctaccttgttagcacaagtgtaaagtctcaccatctctttgatgacaacatgttacattggatggttaaaacatttatcagctcccccagtagactgcaatttctgtgaacaagatacaacttattcttcatagcaactctgacaaagttgcaaaaggtatatatatgttggccaggcaaggtggttcacgcctgtaatcccagcactttgggaggctgaggtgggcagatctcttgaggtcaggagtttgagaccagcctggtcaatatagtgaaaccttatctctactaaaaatacaaaaattagccgggcgtagtggcgggcacctgtaatcccagctactcaggaggctgaggtgcgagaatcacttgaacccgggaggaggaggttgcagtgagccacgatcatgccactgcactccagcctgggtgatagagtgcaactccaactcaaaaaaaaaaaaaaaaaagtatatatttgttgatttgcacatcacctaagaaaaccataagctaagaaggtttggactcaggcgtctggaaagttggtcaccacctctaccccacctcatatctgaatgtcaagagacacgtagaggcagagaagttaaagcaactttctagagacagaaatgaccactgatcaagccacaatgcactctggtttaaatgacatttaggtcatgactgtccttaatctaaaacaaacctagattagtatttcttttcattagtaaatagctaaattctgatggtaaattatgctgaccaaaaacagttcctcacttcccaagttagacatagcaattagaaaaataatctaagcaagctccatttgtatttcttttttcacctgtttattgaatatttacctcccatgaagtctttcagcctattggtggtattttactgttcagatatatgttagaatttcactgatacttactgggcgcggtggctcacacctgtaatcccagcactttgggagatagaggtgggcaaatcacaaggtcaggagttcaagaccagcctggccaatatggtaaaaccccggtctctactaaaaatacaaaaattagctgggcgtggtggcgcacgcctgtagtcccagctacttgggaggctgaggcaggagaatcgcttgaacccaggaggcagaggttgcagtgagccaagattgcgccactgcactctagcctgggcaacagagcaagactctgactcaaaaaaaaaaaaaaaaagaatttcactgatacttttcacaaaatatacagaaggaggcacaaattccaccactatggcactctgctgcgttggccaagtgtcttgatcctttggcctcaattttcttatctacgatattagggtaattgttatgtgaactacccacctcacaagtcctttgtgggttaattcataactgtgctgtgggtatttctttttctttcctttcttcctcctttcctttctttctttcttaaagatgggttctcattatggtgcttagactagactctagacccaattcctggcctctcaccatgttgcccagaccagactcaactcctggactcaaggaatcctcccacctcagccttcaattagctgggatcagaggtgtgcaccaccatgcctggcactgtggatatttctaagtgattattcttctcaaatgaactacataaaaaacaaaagattcatgaatttactaatggttctttgtgatggatgtgctaatatagagactaaaatcaaggctccaacctctaaaacatttttttttaaattccagacttgtttccccatcccactgtgcaaactgaacaaaaactgggctagcactcctgtctggaacatgtaataaggaaataaatgtgctgactcagagaacacagacatatttaatataaaataagatagaaaactggctgaaccaagtcataacacagtctaaatccacatataaaagattgagatgattttctgctttgctttattcaagcccaatgctttatcagcacagccagccaaaaatttacaacccatacacagactatgtaaacctttagttgcacatacagtaagaccagcaggtacacactatacacatttttaattaaaaaaatgactaaccactgattttgtcaccacacttaacaacgacctgatatggcacagagtgatgtgtaccaaacatggaaataccaacttgggcgacggtttgaatcttgttaacttcagtgcaaccacaccccccaaatgcatgtaaagtttgcacacatggttttttcaaggccagcctgtctttgtttccctctcctctgcatttacccaagatcttggctctgagacagaaaactcccactctcaattggttcattccgtcctatgcaattaagcaacaccacaatccagtaaatgcaatggctcaattatttatcttctggccgactttaccaggtatttggaaaaggacaatgtcaagaggtttatttctctctctagagctggcttgacgggttgatggggattttattttgtctttttttctcttttttacaaggcggggacgtggggggagcataatttaacctagaaaaagatgcgagggaatttagaaagagtaccggtctgtcaatttccctacaggaaacttgattcttatgcaataaagcctacccacgaccagccagcccgtaaggctgcaggcgacagacacacctattcctgcctccaaaagggcacagctgtctcctgaaggagcgggaacagggcaagcggaggaagtggctcagcgggagccgccgaccgggcggggaggaggcgctttccgaccccccactcgcgccggtgatccccgtcggcgtgacagtcgctccggtggccggaacgtccccagggccccagggagcaggaaatcgggggactgtccctcactcctgccgccgcaaccgagtgcgccctcgccccacggtgccccctcgagcgcgttctgtttctccgaagaacgaaacttccctccagcgccccgagtcccttccgaggcccgctcctgtcatcccgaagagtcttccctcagggcgaccctccgcgtctcttcatctctcccggccccactgcagcgtccatcacaacatccccaaggtcccagaggccccctgccgctgcggagcccccgggtccccaggcctccccaacggccccaccctgcacccccttcacctgtttctccggcagaggccgagaggccggggctgcgcgtgtgccggggacgggcggcgaggctccctcaggccgaagggcctctccgagccgagggggagagacagcgccaagccggggtgcctgtccaggatccggttggggcttgttccctcggctgcgacgtcggaacccccggctccccctcccagtctgcgccgccgcagctccggaaacc

SEQ ID NO: 1671 - DNA, 75172 bp, Homo sapiens; identical to SEQ ID NO: 1670

SEQ ID NO: 1672 - DNA, 270192 bp, Homo sapiens
ccttgtttgggtgaaatgagttactaaatgtagcatttatttataaggaatgcattgtgaatagtttctcagttttcattatggaaagatgatgatttcagcccacattcagtgtatgtttctaaataacacaatcgacaggactgtctgttcagtacaatggaggacagctttttcagggcaaatgggatttcttgataatgctaaatctgtcttgtcagctgaatttcttgggctttatgtggcagtgtggtaaaaatatatgatcagatttcactgttaagaaaattctttcagcaatacatgtagagtcaagtttcttgcatggataactgaacatgtgggttatgagattttaaaaaatgtctcgtgacaaactttacggaaatgcaacaatctggacatctagttttgtctgagagtggcgtggatatgaagaactgtgctgttggtgctgatgccacactaagttttggcagtcacactcttggttcttcatatttgaggagatgggatggtgaggaggcctgttggctttattttattaatgccaccatctagaatacagattcttggatatttcatcttcacaaggtgagctgcaaactggaaaaaaaaagaggcaaaatttttagaggatatacagaagacatctccaacctcatgttttttctcagaatttgaaagacaaaattaatttaatgttatgattgctgccaccactgtataataagttgtcaacttggttattaatataaattaaatcactcttttatatgctgacgctgacaatttctttatcttatggaataaatgtctcttcagttctcttttatgatttttttgaatatgtgataaatatacatggtaaacaattcaaattcagtagtaaagggtatacaatgagaagtaaactcattccacttctgttcccagtcctccctctccagaggtcattaatgttactatttttaggtattcttccagtaatagtcaaaacaagctcaaatgtacattgaaaaaattttgatattatggtccacttcaatgtcccacagagagcccataaaccagttgtaacatgtttttggagcaatcacaactaacattttgagtccacaaacctggaatgaatttgaaggacagatccaggaagacttctagatgtctagcacaagaggactttgtaaaagttatcaagacatatacacagacgacttagctaaaatctacctatccaggatcatcgattgcctttccttattctttgcactttatgataaagcatccctcaactgcgtatcaatcccaatatagcatactgctttatgctcagaccttttcttgggcagattgtccaatgttgggcacatgctccatttcccaccaattcctgtcccctctttagcgcctcctcaatagtaacccccacacataacctcaaacctgcctaacttctattcattttcctgctcaggcacttccttctctagaagctaagttgccattagggtccctgcttctcagctcccgaagtttcttgtatgaatctcaatctttggccttacctcatttatttaaattatccatttaagagcttccttctattttgttttcttcttggtagctggcagatggtaggggctcaatatatgtttgctggattgaactaaactatgccaaatgaccataaaacctagggcaaaattatgaagtaaagaagtttttctttggccctttgcctattttatctctgttccttctctttgatagtgtcctattcctcctcattgagtatttgtgtcttcaagttcttttcaattactgtctctactaaaacctgatcttagatccttcaataaaaatgactaatctgctcacagtgctattgcttcttggggctatttgaagcttaatacttagtaatatctcaaggcagcaatctaaactttagggttcaaaagaatgggctgagtggtttggccaggacaagttcaaggcctcactcccagagattctgctttattgatctggggctcagggataggtatttttaaataagcacctgtagatgattctaaagcaggtggcccatggacaattttttgaataatactgtcttaagtcaaaaggataaaggtctcggtcagtaggtggaataaataatgctggactgggatcttagcaatctccaaaataactcacataaatgggtcttagtactgctaaccctacttatcttctctgtgattctctgcagtggctccacagagattcaaacggctgttcatatttcacatcctatcctctcttagagctaacagatgggaatccttgatagtaactaatgttgaagagaaacagtgctcctgtatttcaaaaggtgtcaagtgagctggtgtgagctggtcttcatcctgttcttacttctctttgaaccccagtccttaagaaagcaagcaccagattcatctgcctgagtcatgtgcaggcagcacagtccctggtaccatatgattattgaaacatcttggctgcattctcctacatgcacaattcaattaccatttaggccagaattctaagataaacataacattactgaaaaagccttgtggataagcagtcttaactttcagttctttcaaaacattgtggaaatcagaaaatgagtaacgaaggactgtacatgcaactaatctcccttaaactatgctgtagagctggaaagagttctgttattgtaaggaagtccctaacaaccaggctgctactgagctggaaaatggtaaagacaaagcaggcagaacagagcactttgcaacaatcaggttgctgctgtgtgggaggtctaagaagaagagtagaaatggagtgcaaggagatagcaaatgtttagatgccttgaaaagaagcaggctgtgtttaagaaaaagagcaactgttgagttttcacataagattatgagttatgctcctctgatgctctgctgtgttttcaattatccatgttaaatactggcccctggcagtgaaaccacgactgcatcttttctactgctatggaaacatttctttgctcagttattcggtcattcatttatcaaacatttcactgagcacctactaagtaggtaccaggcactgttccagtttttggagtgcttagagttcagtgggggagatagtattagacaattaatatgaagtagtatgggtagcataaaagcagaagtttagggatcttagcagtccagagataataagccgagtttctgaatttaacaggggctggggagctggtttctttcttctttccttttatttctctttcattactgactcttaaagggaatgagaatccagatgagatggccacagttgctatacttatcagacaatattctttgtggctatagcttgacaggttagggaggaaagaaaaggctgtgaatgtgctggggtagatttccacagtgttaaataagtcacatcatacatggagaagatatacagtgggacaggggagaaccaggcatctagggtatagggtttcttccatctttcatttttcatctggcagggcttttgactgtatactccacagagtgcagactccacccagaaattacaaatctacacttactgagcaacatccttggtgggggtggcaggatatcatactgaaccagtggttataaagtcagcagaatcatctggttgcttttattaaacagcaataacaaggtttgttgcagactaataataagtagagtttcttgggacagatctctgacatcagttgtttttaaaaggctccccctttcccaggtgattctaatgtgtaactagcattgagagtcatttaattagataatgggattcatttgcaggtcaggtttgtctgggacctcaaactgcaattcctatacgtatatgtggagagcaagtcactttgcactagaagaggctgctgtgtttgtagggctgaaatttgtgagagctgaactttatcagacatagtagaatttaatgtgaaacagattattgcagataaaaagggagatttcataatgataaaaaattcaatttgctgaaaagatatgacaattctaaatctgtgagcattcaataactaagactcagaatataaaaatgtgatagcactgaatggcaaaacagacaaatccaccatgatggtaggtgaaataacaaccagaaaaaaaacggtaagatgcaatacttgaacaatgcaattaacaaatctacttaagggacagatacagaacactaatacccaatgccttcagaataaaattctttttgagtacatgtgaaacatttccaaaattgaccaattcaaaaaagcaactcaactttcagatttttaaaggattgaaattattcagattatgttctttgatgacagtaaatattatgctggaaatcagtaacaaaagggtgactagaaaaatctctaactctttctaaattaagcaatatgcctctaaacattacaggtcaaagaattcacaatgaaaattagaaaatattctcaactgattaataatgaaaataacataaaaactcgtgggttgccactaaggcccactatagggctacatcccatgtagagagaatgggggtcttcaaattgcacaactagctgagatctatatagcaacatcccacgtgagggggccagatatgatatctcctggcacagtatctggggacttccagacctcatttttgtggacagtactccatgtggggagggcaaagcttttgtattttcacagttcctctggtttttaggatctggtgctggaattcatttctaggatgtggtcaggcacaccttaatacagcagtgtctgaatatggaaggttcttgcgggtgccactctatcttgttttctctctttatcttgcatctgaacttggattaagagactggcatgtttgcccggagaaagttaagttgtgcagtagcaggagaataagtgaagaaaagggatttttaagcagccacagagtactgtgggtgaactaaggccaaaaaattaaaagctgatgataggtaggattcatgaggtatgtagaacagaatcatgtctctcactgggccctctaggacacaggtttgggaataactcacagtagcagcaggaaactaagaaagtttggggttctggaagatttagggaggaacacatggcaggacaattaggttacctgatacgagtttgaagttgatactggagactggacaattggcatggactaactaagaccctgacaaagctcaaacagagaagtcttttatctcttccattttatctggccattcctttccctccaaataatcctacatttggggtatgaaaattttactttcggttgagcatggtattgaataaagaaactggcaattatcctataataagcagctgtagtaatttgtttttcttcatcttatggacgtgaggcagatgctattagtcttatgcctcctcttgaccctctggaatgcttaatatgacacatattcaatatttctggcactgtgtgaccatggctaggctgatgcttcacacaaattaggtgcatatttctaagagcttggctagacaaggcagataagcatatttgagatgaaaaacagaatatggggtgatttctcaatctagagtacagtgtggtcttggaatgaatataaatgaagtgctgtcttgttccaattatttaagaaatttctgagctcattaataaagttcttaatcagtagaactgcccatctcagtgctctcaatgagaaacataagagctgtggcaaggattagtaggaaagaggtgggaatgatttatctaatactgcactgatttcttcccttgattatataattaaatataattttgaatgtcactttttgtttcaatccttattgtgttcccccatactgagataaatattttgtgtcctgctagttttccgtattcagatctttttaactcattgaagtttattttcttaatagcattatataaggtataaaactggttttcatagtaataatatctagtaacaattaggcagtggttgctgtattttctaatttcactcacagaaataaaaccagcagcagagcaaagccaagaaggtgaatgcacaggccagtaatcattttataccctaccataggcacttgtgacaaggaaggagaagaacaggtaattccagcatattagtgtgttatatatgagaaaatgctaattatgtatttttaaaaagtgggagagtctagaagaatagtcattacatggtccagctttctcatccatgtttattttataaataactactccaatgttatctgggatattttgaagccatactaatagtattctttagtattgtccacaaaaagggttctaataaacttttaaccaagttgtttctaatttttttggaaccaatctttgaggttaggaaatttgatagtgtaaggatttttatcttaaaaaatatttttatagtttgtgttacataaggagatattataaatatctagagtgtgctaactcaatgcattttcatgttttaatttcccattacccaaagttactatctttatttcatgtcttcccattctttctctgtacatttttattttaaaaaaagtcaaaaaatatataaatatagacaagaaaggtataacgagctgctaggtccccaacactcagcttcaacaattgtaacttgtagctaaattgtatcatttattccttccatgccctcttcccacctttgtactgttttgatgcaaacccagatattttatcatttcatacataaacatgtatcactgaaataacaggatttaaaaaatatatacccatagtactatcacacctagaaaaaagccccaataatactcttcctgtaaaatataatcaaatattcagcaagtgttcaaattttgaattagctcataactcataaacgtcctctctctctcttcccctccctctctttgtctatccatctgttcatccataattaaatttgttgagtcaggatccaaacaagggccacgcactgtgactgacggacatcttttaaggctcttttaatctaatggtttgtcctatctcttttcatttctttgcaagaagcctattctctctcaaattctccccaaacttttgtctctaccactcccccaaaatactcttattaagactggcagtaatctccacattgtcaaatccaatttttaaaactcattctgaatctgacttggcctatcagcatcatatgacacatttgatcatgccctcctttcttcaaaactttcttccattagccttcagtacaccaatctctcctggttctactacttcactagctgtgccttctcatctcccttggtggatttatcttatctttttgacttcgtgctccattgcttagtcctctgacctcttctctatctacattcctcccctaaatgatttcatttagtcccacaggtttaagtcctatctatacactgatgactgtaaatttgtctttactatcttccctggaatttaaactcatgaatctgcttcctcaacatctattagacactttgatatctactaggcttcacaaacttaacagtttcaaaggggaacacttgattcctaccctcctctacccaatcctctcctgaagtcttccttatctcaggaaatggcaatttcagtcttctagttatctaactaataaacctggatatgtttctttttttctttaccaatgtatcctgtaactttcaaaacatattcagaatctgatcacttctcactgcctgtactaatattgtattagctcaagtgatggttatttcttacctagattattgttaacaacctatcaactggtctcccctgcctccactctttccgctatggtctaaccctcacacaacgtgagtgatccttttaaaatataagacagacatttcacataacctgtcacaaagcattttaacggcctgtagctttattcagaatacattcctaagtcttttccatagtctatgaggtcttacatgatctgcaaatctgcaaacaatttcccaactccccaactccccatcatctacctctctaatctcatctcccagtccaaaccaccatcatctcttacttagattactgcaagaacttcttgaatgactgcttctatccttgcccagtataatctttctctacatgacaatcatcaaaagaatgattctcttaaaatatgagtcggatgatataacaccctttgttccacatcttctattggctttccatctcagaataagagctccactaatcactctacaaagaaaagaagccatcagcactctttttcctcgtgttaaccttatttgatcatttataaccactttatatatatatctaaactatatatatgtatgtatgtttattgatggtctctcccaaatattgtaagttccatgacagtaggaacttaattttacttgttactgtttctccaatgcctagaacagtgactgctagtacacagtatttgctctaatatatgttgaataactgattcattcattcaacaaatactttctgagcatctactgtgtgtcaggcactatgctagggactggttaagctgttttacttccagtggaggaggcagaaaggattttagagcaaatagtaaggaatctgactggctctggtaagagtcaaatgctagttgcttttatcttttactaatagagtcttcacccaactcttgtatgagttgaacaggcaagatgattttttaaaatgatatcttaggtaaaagacatctacacaaaaatatatttatacaataattttgatgaagtttataactatagaaataataaatgcttgtgacatatgttactatatgtaacatatcatctatatccacccatgatagacaatatcctcacttcatttccacagttaaggaagagaagtagatagaagagtttagagaggatgcagtgaaagttttactttctactcttaggctccatgctatcataatcagattctccatatctttctacctttgtctgcagccaaaactgctctgttcaaagaagccccgtgctttcttagttacttttttctcaatgagtttggcaatttttagtggatcactcaatagaagtgtgaaaaaaaaagataaatggatatcttcatgaacaattataaattttcctctcctattttactttcatatgtaattctaacaaaatctcataaggattaaaggaaagaaagataatttaaaatttttaaattataagttttaaatagaaatgtcaagacaaataaatatttttcctatggtgcataacatcttagcatgagtgtgagtcaatgcaacttcatagtttggtttgttgaaagttcaattatacacacacacacacacacacacacatatatataattttttttcttctaacatgtcaaaatggtcttttcctttcctttctcttctagttccctttgatcttattttctttgtaaatttcttctactaatcacttgcacttatgcaatttttttcttatttttaagctaatttataatggagacagtcaatttttatggtttcttgaaacaaatacaagttattaatatatcttttaagggtcttttcaacaatctctgaaacaaatacaagttattaatatatcttttaagggtcttttcaacaatctcttattgagactatcacctggaatttgtctttctttctagaataattcatttataagcttttaaaggtaattatggaaattatggaaaattataccataattatgataattatggaaaatgaagccctacacctttttttcatgttctgtagaatactgtttattacataagtgggaggattcaatacacatctagtagaagtcttctttgaattctagtctgaatctccaaatgctcagctgattatttttccagtgatgtaccattagcacttcaaattcaatatgtccaaaattaatcacattcttttcaaacctacgttattcttctcttctctatctctggtaacagtatcagcaacctccccaaacacccaacctggagactttaaggtctttttttaattaatttttttttttttttttgtagaaacaaggtctcgctttgttgcccagactggtatcgaactcctgggatcaagtgatccttcctccttagcctcccatagtgctaggattacaggtgtgagccaccacacccagccaagttcttatatctgtctctaagtatctctctctctctttatatataaatatagatagatagatgtggatagatatacacatatattttaaacctcctttgtctgcacatttaattagttacaaagctgtgtcaatttaggacttgtcttgtatccattccttttttttttttcattcttcttctacttcattttagagtccaattattgttggattagttcctaagtggtcctaatgcttctaggttttcctcatccagttctctgctgactggtggtaacattatggaaggttctcagaaaatcctgagacttcagtcagtatcatacagagatttcttccttactagggttattgtccttaagcaaagtaagtcaagatccatggatcccttccaagaaatagtttgcttaccatagtaaagacaatgtgtactatttaaaatttctttttggaagttacattttgataatagttaagtctaacatccctttgcatttcaagaaagacaaattcattacacacacacttgcttactcctaatacaaatacatacattaacttatatttacatgaaaggttaacaagaagagaagactgtcctttagtgttacaaagaaagtaaggaaagaaagtgaccaggtgccttgaatcacatagtaacagcaggggattatttccccagtctcattttgaaagtcacagagctttggctatgagtctcaggcaaacccttctattgtctcttcctcacagccttgtgagctttgttcactctgagggctaccaactatttagatagtgagagactgaaagcttaagagagagggtcaatgtaaaggtaagaatctagcattgagatagactgggagtattagggaaaatctctgttccttggtgttttaaaatttgtttaattgggatcaagggcaaaagaaagggaagatgcttaaattttggcaaaccttaatacaaataaaaaagttattttccaaacgactttccaaaatatagctgatagtgtcactttccttttctaaaaacctttaatagctcccgactgctaaaatgaaaactctttaacatagcactcaaggtcctctatcataatcagattctccgtacctttccagctttatcagcagccaaactgctcttcaaagaagccctgtgctttccaatgctactgtgctgtttcctttgcttgaaatactccctcctgactgtggtcctccccaacaatttgtattactgaaatcctacccatagttgaaggtctaggtctattatcaccctctctgtaaagctttcagaattcctcacttagatgaaatttcttccttcgcagtactatttccagaactttaattataaatctcatatagcacatgtcacaatgttgcattctgccttcaattttaatcatttgtatacatgtctaagcttcctaacaagactgaaagttttatgagagcaagggactatatctttttcatttctcttgcctcacaagtttccatttgtaggcattcactgttcattgtcctgaattaaactagtacttgacactagtgttttttcttttgcctttctctttagggcaacttgtgcaaaggtgtagtctactgcaaactattattttcacatgctttgttcattaacttaatcaatttgcctatcaaatatttattgagtgttttctatttgaaaggcaccatgctaggggctggggatataacaatgcaacatagtccctctccttaatgaactagatggggatatgaataagtaaacaggtgattacaataccatttgataaatgctacctagagccatcatttatggttgttcaaattgtgccttgtacgagaaagcctgaaaaagggagtaagtggagcatgaaaagttgcccatcccttcctttctaagctttgtgccctcacatggtgctgtatttccctgaaggaagcatgggatttatctaatgcataaataaagttgctctctatatgtaaactaagtaaaagattttctatgaggatttaagagtgatacttagttccagacttgagttgttaaggaagacttccatgaagaaatgctatataaacagcatttcaaaacaaatgggagttacctagattaacagaagtgggaataatgctccaaatgaggagaaaaacaaaaagagaatataaggaactgcaagtaggtaattatggctgaaacctaagagggtgagggagcagcggccaggaaggaccttggaacacagagcagaatccagatcatggagagccttataaaagatgattaggattcgaacttcattttgaaggcaacggaaagtcatagatattttagcaactagtcatagggtattttggcaactatcaaatttacatttcaaaaagctcagtctagtgtagggcagaagtgagggatgggaagttgcaggcaggaacagtggggagctgcagtaagtctttcaataagtcaggtacaagatatcagcaacctgagtgaaaacagttgtgcagtaaagatggagataattttagacctagttaacagagtaataagtcaaataatactttttcatataatttcttgccattagtcaagaaggataaaatactacttcaaataaacaggctgggtggtttggaggaaagtgtaggaactttgtagacagatagccctgggtctgaatcactactctgccatttgtcagctgtgggatcttggccaagtttcttagcctttttggccttagttttgttacctgttaaatgtgtaataataattcagttaaacagtacacttagagggttgttggaaaaattgtatatacaggaacacctcatttattgtgctttgctatagtgcatgtcacaattattgcatttttaaccaattgaagggttgtggcaatcctgtgtcaagcaagtctattggtaccatttttacaatagcatgtgctcacttcatacctctaagttccattctagtaattattgcaatatttgaaacgttttcattattattatatctgttatgatgatctgtgataagtgatctcagatgctgctattgtaattactttgggggatatgagccatacctatataagatggcaaacttagtgaataaatgtgttttgactgctccactgaatagccatttctgtttctctccttctccttaagcctccctatttcctgagacacaaaaatattaaaaatattaaaattaggccaattaataacctcaaaatggcctttggtgttcaaatgaaaggaagagtcacataattttcactttaaataaaaaatctagaaataagattaagattagtgaggaaggcatgttgatagccaagatagcccaaaagttgggcattttgggccaaacagccaagttgtgaatgcaaaggaaaaattcttaaacgaaattaaaggtgctactccagtgaacacacaaacgataagaaagcaaaacagccttcttactgatacagggaaagtttttgtggtctggataggagatcaaactagccacaccattctcttaatcaccatctgcagagccaggccttagctctccaattctatgaaggctgtgagagatgaggaagctggagaagaaaagttggaagctagcagacattggttcatgagctttaagaaaagaagctgtctccataactaaaagtgtaaggtgaagcaacaggtactaatggagaaactgcagttatcctatccagaatatctagctaagattgctgatgacactaaacagattttcaatgcaaatgaagcagcctttgattggaagaagatgccatctagggctttcataactagagataagagatcaatgcctggcttcaaggcttcaaaggataggctgactctcctgttagaggctaatgtagatggtgactttcagttgaagctaatactcactgaccattccaaaatcctagggcccttaagaattatgccaaatctactctgcctgtgttctataaatggaacaacaaagtccggacgacagcacacctgtttgcagcatggttactgaatattttaagttctttgttgtgacctactactcagaaaaaaagattcctttcaaaatattattgctcattgacaatgcacctggtcacccaagagctctgacggagaacatacaaagagatgaatgttgtcttcatgcattctaacacattttgcaatccatggatgaaggagtcatttcaaccttcaggtcttattctttaagaaatacattttgtaaggctgtagctgctatagatagtgactcctctgatgcatctgggcaaaataaattgaaatcctctggaaataatccaccattctagatgcctttcaaaacatttgtgactcttgggaggtcacaatatcaacatgaaatggagtttggaagaagttgattccaaccctcatggatgactttgaggagttcaagacttcagtggaggtagaaagtgcagatatggtggaaatagtaaaagaactagaattagaagcagagcctgagatgtggctgaactgctgcaatctcatgataaaacttggatggatgaggagttgcttcttatgaatgtgcaaaaaaaaaagtgttttcttgagatgcaatctacttctggtgaagatgctgtgtcatttttgacaacaaagcatttattatataaatttatttgataaagcaacaacaggattggagagtattgacttgatttggaaagaagttcttctgtgagtaaaatgctgttaaatagcactgcatgctacagagaaatctttcatgaagagtcaattgatacggcaaacgtcattgttgtcttatgttaagaaattgccacagccacttcaatctttagccaccattgccctttaggaacctttagcaaccatcagtcagtagctatcagtgtggaggcaagaccttgcaccagtgaaaagattatgatttagagaaggcttgggtgactgttagcatacttttttttttttttttagcaataaagcattttttgattaaggtatgtatgtacttaatttagatataatgctgttgcatacttactagactacagtatagtgtaaaccacttttatatgcactgggagacaaaaaaattgtgtgatgcattttattgccatatttgcctcattgggttggtctggaactgaatttgcagtatctttgaggtgtgcctgtgtttctgtgagtgtgtgtgtgtgtgtgtgtatatgcccgattcacaggcagatccttattacaagatggtttccttctatcctctcttcttccgttatcctttccttaatcactccttttataggagagaaatttacaacactttgcaaacgcatagattcaaatgtaaaatgcaaacttgtccccaaatggaatgtgagatacggctttatggtgttcatggtgaactctttatgatggaggagtgatttttaccagtgactcttaatgtactgggtcacaaacgctttggcaatcagataaagactatgaatattgtgtctcaaaaaatggcatttatgtggaacactttacacataatttcaattagttcaaaaacctcctgaaattcatgatgaactccaggttaaaaagttttcttttatactatgttttaatttttaaaattatgttagtgacttagtgtttgtgaatatggcaattaggatcttcctatagatttatagattagtgattaataatagtttctacttttaaacaagtccttccagaaatggctatgtggaaatttttttgaaaagcaaactatgatagaaaagtttgcttgaaaacaattcttgttcttaaaaacatgcactggcttatgtgagaagacaaggctcttctgataaaattccatcatctaatatcattttgtatcaggagccctaataagtcttgtggtaaattttcttttgatctatgacatttgggaactgaatttcagcaacaagcatttatcagcttctgtttacactagacaactgagactagtaaacccacactgtgttcaagccactggtcatattacacaaagtacgctatgccctgaaaagaatgtatacaataaaaactgagattcaaaaaacagttaggactatgatggatcacagccaagttccaacctctgtgggtcaaatgggagggcaactatggttagtttcttattcagccacagacattcctgtggtaaggagtaattaaatggtgggctgtggagtacagggtgggtatgtagaataacacatattgagacaagataactttcatcctgtgtcaggtcacaaatgtgagtgccaaagatcacaagattaagatgatgactttgcagtttttcctggaaattggaaaaaagcttgctctctctttttaaaaactgcttatattttaccatataatatttctagtaaacatgttaaaaaaccaagaaaaccaatgtctggattaggtgtattaaggccctcttcactactactttgctttttactacacaaaacttatgaaaagctataagaataaggactcaacaggagtttttagttcatgagtctttcgaagtaatcttttatcacttaacaaatcagagttatgtagaagagtttccactgttactcccaacttttatatgatgtccagcatgttcaaggtgcattaatatataaactattttcttataatctaatataaacctacagactaaaacatttgctgacgagcaaggcaagaaaaatgtcaggaagaaagccaagtttaaccatagccagtgcttataggtataacaagatcaagaaagaattccttgcatacttgaagctgataaaggatattcacttctcattctttaactaaatgcttaaggtataaagaggtctaataaattttagaacaggtaaaaagacccatgacacgtttagaagttctagaagtatcatattaatctgaagaactagatagatactatctggagctagagaagtttaatacagggacaacacatatgctgaattggtttacagtgtcttatgaagttattttgactcttttgaacacataattgtagaaggataatctcaggtgcctgagaccaaaggctagaggaagagcttgagcaaaggggggaaggtgacagggctaaagagagaagggtgccacggtctgaatgtttgtgtcttccccaaattcatatgttaaaatcttaaccccaaggtaatgatattaggagggagggcctttgggggtgatgaggtcatgaggggagacccttcatgaatagaattagtacctgataaaaaggacctgagagagcttccttgccccttcttccacatgaagacacagcataaagatggccatatatgaactatgaagtgggctcttaccagagcctttatcttggacttagtctccagaactgtgagaaataaatttctattgttataagccacccaatctttggtattttgttcttgtagcctgaatgaacaaagagactagcaaaaggtaaaggctaccaatgatcaccacaatatcttaaaacttggtttagcttggttaaggaatccaggaagtaatggggagccgggagaggggggaaaagcctcatattaccacaacacaaattaacttccaacctatcatctacagatcaaatatactagggctacaggggagtgtaaattaacacaattgggttgttaccttattttaaaaagtagatgcaatggcatgtcttgcttattatgaatctgatcatttttatttaaaaacaactgaaatcacattttaaacttaattattacatgccacatgtagaaagtatcagttactcacactgtttagtgatagaatatccacataaactgtctcttgtctaggtttctagacaagaataaaatattattcagatatacattactcttttctattttttgttttgctttaaagaataattgcccatctgcctgcaactagatatgtttagatgaatatttcttttgataacaaaagaaaagtattaactttgtgccaagaatataacaatttaagggtaagatgaactgtctctaatattttctgaaaagataagacaaagtgagaggcaaagattcctccagtttcttttgtagatatccttttgaatgtgatacactgttggggataaaatattagtggtctcataatcacaaaatattatctagatatagttaataattaattttagtcttatgagtttcagagactaacataccaataagacatttacactttttcttaaaactaaagttataaaaacactaattggagctttcaatttcttctattctatgttgttggccagttttccagtctgagacccatcactgtctctagagttgcatcccattaccttattttcccacagggaggaaaacagcacaataacacattaagcatgctatggtaccaactcattattcttactaaacatcacgatttactttcaggaaagagatggattcactatggagtttttacaagctgaaactttgaccttatgttagaagtagggtaatgtgggtaatggttgccatgggtatcaaaacaaattatacattttccactaggtaacatttgattaatgtcaaaataaaaattctcctttatatctgaacactctgctcaaggatataaaaatgtacctttttatatccttgtttacttaatacatgatatggtagactagctctccctattgatctgaatagttattgcttcaattcccagatttatatacttgttctctgagattaattcagcatgcttcagttttgtaagaggtatctttctggggctctctgtatatatcctgctggcatgttttgtttctaagcccagagaatctaattacagtttagtagccaaagatgtaatatctcacatgactttttaaaaaacgattatttttgcaacagcacaagagtgagactttgccgtgtttttcattttaaatgtgacacaataaaggcttgaattgacttcatgcttgttttgatacaaaggtcttcctaccaatagatgcagtcgacatttgtttggcttgtcaaattaaactcatccatacagcaacaaggattagcacaaaaacgggtctaccctgtgaacagtaccatacatttcagagatctaggactccacttcactcattagagattatctgatttttcttaagacttagtaatatagctttgcttacagcatatttgactatacttgattatactatacactatagctcattgctttatttaacctttaagataaagtgaattaaggaataactgacaagtgggatttagcaagactaaattctggcctagagaagcctctacatggtaccttaagtaaactaagatctttgcagtccttctttactctgttctggtgaaaagcaatgttttatctagataaaaaatggcagattccaaaggttttctgatgtatttaatgtggaagcagggccaaatacaaatacaaaaggggaagtggtaattgtaaagaaaccatcttatagcaataaaccgctaatcaattgtaattacaggaaatagttaatgaatacatattaaaatggtatcacatggcttctgattatataatacttattcaggcacatgaataagctgtatttctcagatccattctgtcttctatgtgagtttagataatatatccaatacatctggtcactgtatagtaatttctgcatatctgtatgacaaaagacactccagtactaatttgtatgtcaaatggatgattttaatgctgtcagctgccagctgcagcacactgattttcacttagaagaaaagctgttagtttccgaagattcacttaaaaaaaaacccaaaataccttcagaggttaaaaaagacctcatcagaacaactcttatgaaaacttcttcactactactgatcagaaagtgtagggctcagataagcgggtgatattagggtagcctgaacacattaaattctataccttatttgaaaaaattgaggtaaaacatatataacataaaatttttccttttaaccatttttaagtgtagaattcagtggttttaagtacgcttgcaatactgtacaaccatcaccactagttatttccaatttttttcatcatctcagagaaactttggactcattaagcattaatttccattcctccctcccccagcccgtggtaccactaatctacttcctgtctccatgaatttgctgattgttgatattttatataaatgaaattatacaatatttgtcctttttatatgtggattatacttagcataatatttacatggttcattcactctgcatcaaatatcagaacttcgtgtctttttatggctgaacattacactgtatatactaccttttgtttattaatttatctgttgatagacacttgggttgtttccacctttgacttgtcaataatgctacaatgaacattggtgtacaatatctgtttgagtccctgttttcaattctttttggtaagcatctagcagtcaaattactgactcatatggcaattccatatttactttttcaagcaagtgccaaaatattttctatagaagctacatcattttacaatcccactattaatgcaccagggttctaatttctcctcatccttgccaacacttgggtgtgaagagctatctcactgtggttttaatttttatttccctaatgactaatgatactgattatcttttccatgtgcttattggccatttgtatatcttcctcagagaaatgtctactcaagtcttttgcccatttcttaatatcgttgtctgttgttgagctgtaggagttgttagtgaatagaaatacaactgatttttgcatattgattttgtattctggtattaagtccttatcaggcatatgatttacaaatattttctcccattttatgggttgtcttttcactctcttcaaagtgtcctttgaagcacaaattcttacttttagaagtccaacttactgtttgttgtctgtgctcttggtgtcatatgtaagaaaccactgtcaaatccaaggttatgaagatttatctccacattttcctctaagagttttatagttgtagattgtaaatttagtctttggtccattttgagttaaattttatatatggtttaatgtaagggtccaatttcattttttgcgtgtggatattcagttttcccagcaccatttgttgaataatctatcttttctcactaaatggtcttggcacctttgtcaaatatcaattttccatagacgtgagggtttatttctgggctctcaatttaattccattggtctatatgtctatcattatgcctgtatcgttttgattactatagctttgtagtaaattctcaaatcaagaagtatgagtcctctgactttgttctttttcaagattgttttgggtattatgggtccctagaaatttaatatgaattttagtatggatttttttaattaaaaaatgcaattgggatttttataggtactgcatggaagttacacattgttttgggtagtattgtcatcaaaacaattattccaacacatgaacatgggatgtctatctatttagatattcaatttctttttattttattttttattttttattatagtttaagttctagggtacatgtgcacaacgtgcaggtttgttacatatgtatacacatgacaagttggtttgctgtactcattaactggtcatttacattaggtatttctcctaatgctatccctcccccatccccccaccccacaccaggccccagtgtgtggtgctccctgccctgtgtccaagtgttctcattgttcaattcccacctatgagtgagaacatgtggtgtttggtttgcagtccttgtgatagtttgctcagaatgatttccagcttcatctatgtccctagagaagacatgaactcatccttttttatggctgcataatatttcatggtgtatatgtgccacattttcttaatccagtctatcattgatggatatttgggttggttccaagtctttgctattgtgaatagtgccacaataaacatacgtgtgcatgcatctttatagtagcatgatttataatcctttggctatatacccagtaatgggatcactgggtcaaatggtatttctggttctagatccttgaggaatcgccacactgtcttccacaatggttgaactagtttacacccccaacagtgtaaaagtgttcctatttctccacgtcctctccagcacctgttgctttctgactttttaatgatcgccattctaactggtgtgagatggtatctcattgtggttttgatttgcatttctgatgaccagtgatcatgagcattttttcacgtgtctgttggctgcataaatgtcttcttttgagaagtgtctgttcatgtccttcgcccactttttgatggggttgtttgattttttcttgtaaatttgtttaagttctttatagattccggatattagccctttgtcagatgagtagattgcaaaaattttctcccattctataggttgcctgttcactctgatggtagtttcttttgctgtgcagaagctctttagtttaattagatctcatttgtcaattttggcttttgttgccattgcttttggtgttttagacatgaagtccttgcccatgcctatgtcctgaatggtattgcccaggttttcttctagggtttttatggttttaggtctaatatttaagtctttcatccatctggaattaatttttgtataaggtgtaaggaagggatccagtttaagctttctacatatggctagccagttttcccagcatcatttattaaatagggaatcctttccccatttcttgtttttgtcaggtctatcaaagatcagagggttgtagatgtgtggtgttatttctgaggcctctgttctgttctgttagtctatatctctgttttggtaccagtaccatgatgttttggttactgtagccttgtagtatagtttgaagtcaggtagcatgatgcctccagctttgttcttttggcttagaattgtcttgacaatgccaactgttttttggttccatatgaactttaaagtagttttttccattctgtgaagaaagtcattggtagtttgatggggatggcattgaatctataaattaccctgggcagtatggccattttcacgatatggattcttcctatccatgagcatggaatgttctttcatttgtttgtgtcctcttttattttgttgagcagtggtttgtagttctccttgaagaggtccttcacatctcttgtaagttggattcctaggtatttcattctctttgtagcagttgtgaatgggagttcactcatgatttggttgtttgtctgttactggtgtgaaggaatgcttgtgatttttgcacattgattttgtatcctgagactttgctgaagttgcttatcagcttaaggagattttgggctgagacgatggggttttctaaatatacattcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaaggcttccagttttagcccattcagtatgatattggctgtgggtttgtcataaatagctcttattattttgagatacgttccatcaatacctagtttactgagagcttttagcatgaagggctgttgaattttgtcaaaggtgttctctgcatctattgagataatcatgtggtttttgtctttggttctatttatgtgatggattacgtttattgatttgtgtatgttgagccagccttccattgcagggatgaagccgacttgatcttggtggataagctttttgatatgctgctggattcagtttgccagtattttattgaggattttcgcatgggtgttcatcatggatattggtctaaaattctcttttttgtgtgtgtgtctctgccaggctttggtatcaggatgatgctggcctcgtaaaatgagttagggaggattccccctttttctattgattggaatagtttcagaaggaatggtacccgctcgtctttgtaattctggtagaattgggctgtgaatccatctggtcctcgactttttttggttggtaggctattaattattgcctcaatttcagagcctgttattggtctgttcagggattcaagttcttcctggtttagtcttgggaggatgtatgtgtccaggaatttatccatttcttctagattttctagtttatttgtgtagaggtgtttatagtattttctgatggtagtttgtatttctgtgggatcggtggtgatatcccttttattagtcttgctagtggtctatctattttgttgaccttttcaacaaaccagctcttggattcagtgattttttgaaaggttttttgtttctctatctccttcagttctgctctaatcttaattatttcttgccttctgctagcttttgaatttgtttgctcttgcttctctagttcttctaattgtgatgttagggtgtcgattttagatctttcctgctttctcttgtgggcatttagtgctataaatgtccttctacacactgctttaaatgtgtcccagaggttttggtatgttgcgtctttgttctcattggtttcaaagaacacctttatttctgccttcatttcattatttacccagtagtcattcaggagcaggttgttcagtttccatgtagttgtgtggttttgagtgaatttcttaatcctgagttctagtttgattgcactgtggtctgagagacagtttattataatttctgttcttttgcatttgctgaggagtgctttactcccaactatgtggtcaattttggaataaaggcaatgtggtgccaagaagaatgtatattctgttgatttgggctgaagagttctgtagatgtctattaggtgtgcttggtgcagaggtgagttcaagtcctggatatccttgttaaccttctgtcttgttgatctgtctcatactgacagtgggatgttgaagtctcccattattattgtgtgggagtctaagtctctttgtaggtctctaggacttgctttatgaatctgggtgctcctgtatagggtccatatatatttaggatagttagctcttcttgctgaattgatccctttactattatgtaatggccttaattgtctcttttgatctttgttggtttaaagtctgttttatcagagactaggattgcaaccccttcctttttttgctttccatttgcttggtagatcttcctccttccctttattttgagcctatgtgtgtctctgcacgtgacatgggtctcctgaatgcagcagtgatgggtattgactctttatccaatttgccagtctgtgtcttttaattagggcatttagcccatttacatttaagattaatattgttatgtgtgaatttgatcctgtcattatgacgctagctggttattttgcccattatttgatgcagtttcttcctagcatcgatagtctttacaatttggcatgtttttgcagtggctggtactggttgttcctttccatgtttagtgcttcctttaggggctcttgtaaggtaggcctgttggcgacaaaatctctcagcatttgcttgtctgtaaaggattttatttctccttcacttatgaaacttagtttggctggatatgaaattctgggttgaaaattcttttctttgagaatgttgaatattggcccctactctcttctggctggtagagtgtctgccgagagatctgctgttagtttgatgggcttccctttgtgggtaacccaatctttctctctggtgcctgttaacattttttccttcattttaaccttggttaatccgaaaattatgtgtgttggggttgctcttctcaaggagtatgtttgtagtgttctctgtatcttctgaatttgaatgttggcctgccttgctaggttggggaagttctcctggataatagcctgaagagtgttttccagcttggttccattctccctgtcactttcaagtacaccaatcaaacagagatttggtcttttcacagagtcccatatttcttggaggctttgttcgtttctttttattcttttttctctaaacttctcttctctcttcatttcattaatttgatcttcaatcactgatacgcttctttccacttgatcgaatcagctactgaagcttgtgcatgtgtcacatagctctcgtgccatggttttcagctccatcaggtcacttaaggtcttctctacactgtttattctagttagccattcgtctaatcctttttcaaggattttagcttccttgcgatgggttcgaacatcctcctttagcttggagaagtttgttattattgaccttctgaaggctacttctgtcaacttgtcaaagtcattctccgtccacctttgttctgttgctggcaagaagctgtaatcttttgcaggaggagaggtgctctggtttttagaattttcagcttttctgctctggtttctccctatctttgtggttttatctatctttggtctttgatgatggtgacctacagatggggttttggtgtggatgccctttttgttgatgttgatgctattcctttctgtttgttagtcttccttctaacaggtccctcagctgcaggtctgttggagtttgccagagttccactccagaccctgtttgcctgggtatcaccagcggaggctgaagaacagcaaatactgcagaacagcaaatactgctgcctgatccttactctggaagcttcgtatcagaggggcacctgggtgtatgaggtgtcagtcagcccctactgggaggtatctcccagttaggctgcacgggtgtcagggacccacttgaggcagtttttccattctcagagctcaaataccatgctgggagaacgactgctctcttcagagctgtcagactgggacgtttaagtctgcagaagtttctgatgccttttgttcagctgtgccctgccccagagctggagtctacagaggcacgtaggcctcattgagctgcggtgggctccacccagtttgagcttcctggctgctttgtttacccactcaagtcttagcaatggtggacactcttcccccagctaggctgccgcctcacagttcgatctcagactgctgtgccagcagtgagcaaggttccatgggcatgggacccactgagccaggcacaggatataatctcctggagtgccgtttgctaagaccattggaaaagtgcagtattaagctggaatgtcccaattttcctggtacggtctgtcatggcttcccttggctaggaaagggaaatcccccaaccccctgcgtttcccaggtgaggcaatgccctgccctgcttcagcttgcccatgggctgcacccactgtccaagcagtcccaatgagatgaaccaggtacctcagctggaaatgcagaaatcacctgtcttcttcattgatcacactgggagctgcagaccagagctgttcctattcagccatcttggaacagacctccaacatagtacattttctactttttaaaaaaactttctatgaaggaatggaagattggctcaaattctagaacttttttattatcatcatacataagataaaatagtatttattaaatttacatgtatgtaaataagtactagaaaacaaaattaatagttgatgttaactgagtgctcactagtatcaggctctgtgatgaaccatatatgcctaatctaaaatcttcacaagaattctgtgaggtaggtatttttagccccttttatgatgacttagaataaataatttgtgcaaattaacacagctggtaagaaatagaacacagaaaccaatgtaggttgactaaaagattcatgtatttagatactacccttatccaaataacagtccaggtacaaattagccctaagaataaactgaggggggctcacttataaagacattaattatgaaggtacaggtgctatataagagaatcataagagatagtgcagttacctggggctagcaaaagcagagctgttgccatccctacagccagagggaccagttgttggtaaatgtgttgtggagagaaggcttcctggagagaagtgttacccttcaacagagggacaagccaacctgacataattctggagggaagggcacagcaggagaaatattctgtccccattctctcctatagcttgccagagctcccgactggttaacaactggaagccaggagacatggaagttagcttcctggggtgaataaggtaaaaaaggatggagaatagatctatgatgggaggtggggcaaagaaaaggtatccaggacaaccatggatacataatataattccaacaaatatgctttaaactgagacacttcaaaattagtgggaaggaaaaacaataggcctacagatctgtacagcagacaaaaagatgtaaagtacatgcaagtaaatatgtaaagttctcttctgccccatgctgagaaaagtattaaagatacattgctataaaaatgtttaaaacagtttcttgaaacgatttcctaatgttggattgaagcatactagctgagcatataatttgttcagtaattgtctataagtatgcctgagtatggaggacgtgaagaagaaagaattatttatcatagcatctggtttctgataagtatgatattgactgacttatttggaatgtgatggctctttaataaaaatatatgatactagtagcaataaataatctgaatagtcatgcttcgagattgccttcacattttaaacttttatttttactagcactttgattggcaatatagtgttctatacaatgccttgtacatcatagatgacgtatttaattgattatttaatgaaagaaatgagttacctattgacttatatatatgtttttacctttatggtaaaattaaaatgaacagaagcctagggtttagtacaatgagtaagatattagaaaacatttggcaatcttaaaaagataattatacaaggtctgtttattagatatcatctttaaaattgttaatgttttatgaaaatagagccctaagcatgttagcacatacagcataaaagtttatttcaggtcttgctttcacacactgggagaacactgtgatctgtgaaagtcagaataagcctgttttagaaaacaggatatgtggcagcattcacactcaaaagccttcggagctcactgagttaagggtgtgatttatagagtcatacagactggtgtttcaatcctggctctgacacaggcaaatgagattaactttgagtctaagttttctaatgtgtaagatgtataaaacaatagctctgtagaggatggcagggggccataggtaggtgccctggcagtggcagctcaggtgctgtgggtaggaagtgctccagtgggaggcaccataggcaggcagttcttgagtggggatgctgcaggttagaagtgtatggcatccatgactgggattattaccatttttgggatttctttaggccatatattacttggaacctaaacatgtgattttacatagtgtatctgcactataattgaaagttgagatttttcactggaatgacatagcaacataaattaatgtagcagcagcaacagcagcagtattgtggtagcagtaaaaaataataatttaacaacttacatcaaaataatatagacactatggctttagtgagaggttgtcatgtaaattcaagaaatgcagagaacccttgtgagatactatgtaagacaaccatccccaagacacacagtcatcagattctccaaggtagatgtgaaagaaaaaatcgtataggtaactagagagaagcggcgggtcacttacaaagggaactctgtcaggctcagtagacctttccgcagaaactttacaagccagaagagactgggagcctattttcaatatctttaaataaaagaaatcccaagcaataattttatagcccaccaactaagcttcataagcaaaagagaacgcaattctttccagacaagcaaaagctaagggaggctgactgcagtggctcatgcttataatcctagcattttgggaggctgaggtgggcagattgcttgagccccaggagtttgaaacaagcctgggaagcaaagagagaccctatccctacaaaaaaatacaaaattacccaggtgtggtgacatgcacctgtagtcccagctacttaagagactgaggtgggatcatttgagcccaggatgcagaggttgcagtgagctgagattgtactactgcactccagctggggagatagatagagcaagagtgtaccttaaaaaaacaaaaaagctacgggaatctgatagcagtagacctgttttacaagagctcctaaaggaagtgctaaacatggaaatgaaagagcaatatttgtcaccataaaaacacacttaagaacataccccattgacactataatgcaactatacaattaagtctacataacaaccagctaaaagcgtgatgataagaccaaatcctcacatagcaatatcgaccatgaatgtaaacaggctaaatgcctcgattaaatggtatagagtgtcaaggcggataaagaagcaagacccaaatgtttgctgtcttcaagagatccatctcagaagtaacagcaataggcttaaagtaaaggaatggagaaagattgattaggtaaatagaaaacagaaacagcaggggttgctattcttataccagacaaacaaacattaaagcaacaacaatcgaacaaagaaaaatattacataataataaggggctcaatccatcaagaagacttaactattctaaatatatacatacccaaaattagagttcccagatccataaaaaaggttcttagagatctatgaggaaatacagacaaacacacgataacaatgggagatttcaacaccaccttgacagtgttacatcatcaaggcagaaaactaacaaatattttctggacttaaactcaatacttgaccaattagacctaatagacactacagaacactccatccaacaacagaatacatattcttctcatctgcacatggcacatactttaagatcaatgacatgctaaaccataaagaaagtttcaacaaattaaaaaaattgaaatcataccaaacacattctcagaccacagcatagtaaaaacagcaatcaatactaagatctattaaaaccatacaattacatgttaacctactcttgaatgacttttgggtaaataacaaaattaaggcagaaatcaaaacattatttgaaatgaatgaaaacagacacaacataccagtttgggacacagttacagttgcattaagaggaagattcatagcactaaactcctacgtgaagaagttagaaagctctcaaattaacaatcttgcattatacctcgaggaactataaaaataggaacaaaccaaacccaaagctagcagaagaaaagaaataaccaaaatcagagctgaactgaataaaactgagatgcgaaaatccagacaaagtatcaatgcccccaaaagttggttcttcaaaagatgaaacaagattgaaactgctaattaattagattaataaagaaaaaagaagatccaaataaacccaatctgaagtgacaaaggtgacatttcaaccaaccctacaaaaatacaaaagttcaccagagaatattatgaacacctctatgcacacaattaggaaatctagaagacattgataaattcctggaaacacatagccttctaagattgaaccaggaagaaattacaatttggaacagacctataacaagttctgatattgaatcagtaataaaaagcctaccaaccaaaaaaagccctgaaccagatggattcacagccaaattctcccagacataaaaagaagagctgatgtcagtcctattctaactattcaaaaaaaaaaaaatcaaggagaggagattcttctgcagctcattctatgaagccagcatcatcctcataccaaaatctggcagagatacaatgaaaaaaggaaacttcaggtcaatatctctgatgaacatgcaaaaatcttcaacaaaatacatgcaaaccaaatccagcagtgcatcaaaaaactaatgcactaagattaaataggccatattcctgggatgcaaggttggcttaacatatgcaactaaataaatatgattcactacataaacaaaattaaaaacaaaaaccatgatcatctcagtatatgcagaaaaggtctttaatatatgtgaaagtctcaataaatgtagaaaaggtcttcaataaaattaaacatcccttcatgttaaacatcctcaacaaattaggcatcaaaaaaacatacctcaaaataaaaagaggcatttaggacaaacccacagccaatatcataataaacaggcaaaagctggacacattctccttgaaaactggaacaagacaaggatgcctgttctcaacattggtattcaacatagcactggaagtcttagccagggcaatcaggcaagagaaagaaagaaaagagatcgaataggaaaagaggaagtcaaataatctttcttcacagatgatatgattgtatacctagaaaaccctagagatgctgccaataggcttttataaccaataagcaatttcaggacacaaaataaatgtacaaaaataagtagcatttctatatatcattagcattcaagctgagaggcaaatcaaggacataaatccatttacaatagccacaaacaaaaatatctaggaatatatctaactaagaaggtgaaagatctctaccaggagagttatgagacactggtgaaagaaattatagacaatataaacaaatggaaaaatgttccatgctcatgaaaaggaagtgtattagtctgttcttgcattgttataaataattgcctgagactgggtattcataaagaaaaaaagtttcattggctcacagttctgcaggctatacaggaagcatggctgaggaagcttcaggaaatgtacaatcatgatggaaggtgaggaggaagcaggcgcatcgtacatggctgcagcaggaggaagacaacaaagagagaggtgctacacacttttaaaacaaccagatcttctaagaactcactatcacaagaataacaagcagaaaatccacctccatgatcaaatcacctcccaccaggcccctcctctaacaattcgacatgagatttggctgggaacacaaattcaaaccatattgggaagagttaagattgataaaatggccatactgcccaaagcaatctacagattcaacattattcctgtgaaactaccaatgtcatttatgacagaattagaaaaagctattctaaagttggcatgaaccaaaaaaaaaaaagtccaaatcatcaaagtaatcctaagcaaaacaaagagccatcacacttcctgacttcaaattatactacaaggctatagtaacccaaacagcatgatactggtacagaaacagacatagactcatggaaaaggatagagaaaccagaaagaaagccagatactgacaaccagttgatctttgacaaagtcaactataatacataatggggaaaggactctctattcaataaatagtgctgggacattctagccaaatgcagaagattgaaactggatcccctccttttaccatatacaaaaactgactccagatggattaaagacttaaatgtaagaccgaaagcaatcaaaaccctagaagaaaaccttggcaataccattctgggcagtggccaggaaaggatttatgactaattcctcaaaagctattgcaacaaaagcaaaaattgacaaatgggacctaattaaactgaagagcttctgcacaaccaaatatttaaatatcatcagagtgtacagacaacctacaaaatggaagaaaatttttgcaatctatccatctgacaaaggtctaatatccagagactataaggaacttaaaacaaattcacaattaaaaaaaaacccattagaaagtggacaaaaaacatgaacagatacctctcaaaagaagaaattcacacagccaacgaacgtaaggaagaaagctcaacatcactgatcattagagaaatgcaaattaaaacctcaatgagataccatctcatgccagtcagaatggagattattaaaaagtcaaacaacatatgctggcaaggttgcagagaaaaaggaacacttttacacattggtgttagtgtaagttagttgaaccattgtggaactaactggaattgccatcagtatggcgattcctcaaagatctagaagcaaaaataccatttgacccagcaatcctattacttggtatatgcccaaaggaatataaatcattctgttataaagatacatgtgcatatatattcactgcagcactattcacaatagcaaagacatggaatcaaccttaatgcacatcaatgatagactggtagtacatatacaccatggaatactatgcagccataaaaaggaatgagatcatgtcctttgcagggacatggaaggagttggaagctgttatcctcagcaaactaatgcaggcacagaaaaccaaatatgttctcacttacaagtgggagctgaacgatgggaacacacggccacatggtggtgaggggaacaacacacactggggcctgttgggggagctgggggagggagagcatcaggaagaatagctaatggatgctgggcttaatacctaggtgatggattgatctatgcaggaaacaacgatggcacacacttacctgtgtaacaaacctgcacatcctgtatgtaacctggaacttaatctacagaatgggagaatatatttgcaaactatgcctccaacaaaggtctagtatccagaatctataagaaacttaaatcaaaaagcaaaaaacaaatatcccagttttaaaactggcaaaagacatgaacaaatacatctcaaaataagaaatatatgccactaacaaatatatgaaaaaatgctcatcatcactaatcgtcagtgaaatgcaaatcaaaaccacaatgagataccatctcacatcagtcaaaatggctattaccaaaatgtcaaaacacaagaaatgctggtgaggttgcatagaaaagggagcacttatacactgctggtggaaatgtaaatcagttcagtcattgtgaaaagcagtgtggagatttctcagagaacttaaaactaccatttgacctagcaatcctactatatgatatatacccaaaggataataaattcttctgccaaaaatacatatgcatgtggatatatattgtagcactattcacaatagcaaagacatggagtcaacaaagatgcccatcaacagtggactgaatagtacatatataccatggaataccatgcagccacagaaagaatgaagtcatatcttttgcagaaacatggaagcagctggacgccattatcctaagtgaactaatgcaggaacagaaaaccaaacgctacatgttgtcacttataagtgggagctaaacaatgggtactcatggacacacagaagggaataatagatattaaagactgcttgaggaagaatggtggggagagagacatggtttttagggctacctgtcaggtactatgctcactacacaggatgagggggtcatttgtacacgaaggatcagcaacataaaatttattaacaaacctgtacatgtacctctagaacttcaacttaaaaaaatagaaaaaaaaatagaaaaaaataaaaatacttgagactgggtaatttataaagaaaagaagttcagggggcagggccaagatggctgactagaagcagcagcattccgaggctcgcataggaaagaaaccataataagcctgtgaatccttcactggcaaccaaggtatccaggttctctcatcaaaattgactagaaggctggcatgactgactgagagaaggaagagcagtgtggtgtggcggtccacctgtgatccacacagggaaggggaacttccctcaagccaagggaggcagtgagtgagcacactacccagccaggggaaactgtgcttttcaaattgaactgtgcaacccatggattggaagatacacttgcgaacccattccaccagggcctagcgtcccaaccctagaatgtgcagattctcacagcctctcagctggaatctgcttaagcccacctaactcttgcggggagaggcgaccagcactggctgcggctacctgctgtctaagccatttgagctccttggggaaggggcagcagccagccctgggactagcaactacctaacactctaagctccctgggcaggggaagcgtggcacccatttgtatagctccaggctgggctttttccctgctggagcaagggaggctggaccacttggtcccaagacttgtccccacagcccaaaacaccggctgtggcagtctgcggccaaagtgccttttcaggtctaaccctgacccaccttcctcagtgggcggggcttccctgaacaatctccaataactccagccagaggctcagggacagaattcagatctccctgggccagagcccctgggggatcggggaggtggcctcagtctctgcagaccagccaacttagcctctcctcctggtagttctgaggaatccaggcagctcagacgagtgggtttccccccagtgaaacacaccctctagaacaaggaataaagtacttcattaaacaggtcctgctccctgtgccacccaactgggtgagaccatccaacaggggttatcagacaccttatacaggagtgatcctactggcatcaggttggtgcccctcaaggtcagaggtcccagaagatggagcaggcacccatctttgctggtctccagcctccttgagtgacatctccaggcacaggagcaaataagatgaatagggaagtgaacccccaggaaactgcagcagccctacagaagagggacttgactattgaaacaaaaacaagtacaaagtgacaacagcaccaaaaacaacaaaaagacccccataaaaaccccatgcaagggtcagcagcctcaaagaccaaaactagacaaactcatgaagatgggaaagaatcaacaaaaaaatgctgaaaaccccaaaagccagagtgcctcctctcctccaaatgatcgcagtgtctctccaaggtgcagaactggatggaggatcaaatggacaaagtgacagaagaaggctccagaagatgggtaataaaaaactatgacgaggtaaaggaacatgttctaacccaatgcaaagaagctaagaagactgatgaaaggttagaggaattgctaactagaataactagtgtagagaggaacataaacgacctgaaggggctggaaaacacagcatgagaactttgtgaagaatacatgagtatcaacagccaaactgaccacatggaagaaaggatattggagtttgaagaccaccttactgaaataagacacagagacaagtatagagaaaaaagaatgaaaaggaatgaacaaaacctccaagaaatatgggacttaataaaaagactgaacctatgatcgaccggagtaccagaaggagacagggaaaatggaaacaagctggaaaacacacttcaggatattagccaggagaacttccccaacctagcaaaacagaccaacatgcaaatcaggaaatacagagaacaccaccgttaagatactccacgagaagatcaaccccaagacacataatcattagattctccaaggttgaaatgaaggaaaaactgttaagagcagccagggaaaaaggccaggtaacctacaaagggaagcccatcagactaacagcggacttctcaggagaaactctacaagccagaagagactgggggctaatatttaacattcttaaagaattttcaacccagaatctcatatccagccaaactaagcttcataagcggaggagagataaaatcctttacagacaagcaaatgctgaggaatttcattaccaccaggtcagtcctgcaagagctcctgaaagaagcactaaaaatggaaaaaacaaaacaaaacaaaaccagtgccagccactgcaaaaacacaccaaaaaataaagaccaatgacattatgaagaaactgcatcaactagtatgcaaattaaccaaatagcatcatgatgacaggatcaaattcacacataacaatactacccttaaatgtcaatgggctaaatgccccaattaaaagacacagactggcaaattggataaggagtcaagacccattggtgtgctgtattcaggagactcattttatgtgcagacatacacaggctcaaaataaagggatggaggaaaatttaccaagcaaatggaaagaaaaacaaaacaaaacaaaacaaaacaaaacaaaacgggttgcaatcttagtcgctgacaaaacagactttaaaccaacaaagatcataaaagacaaagaagggcattacacaatggtaaagggaacaattcagcaagaagagctatattctgaatatgtattcacccaatataggagcacccagattcataaaataagttcttacagacctacaaagagacatagactctgacacgataacagtgggagacttcaacaccccactgtcagtattagatcaatgagacataaaattaaggatattcaggacttgaactcagctctggatcaagtaaacctagtaaacatctacagaactctctactccaacagaatatacattcttctcagtgccacatggcacttattctaaaattcaaccacataattggaagtaaaacactcctcagcaaatgcaaaagaactgaaatcataacagtttctcagaacacagttcaatcaaattagaactcaggattaagaaactcactcaaaaccacatagtttcatggaaattgaacaacctgttccttaatgactcctgggtaaataacaaaattaaggcagaaatcaagttccttgaaatcaatgagaacaaagagacaatgcaccagaatccctgagacacagttaaagaactgttaagagggaagttttagccctaaatgtccacatcagaaagctaaaaagatctcaaatcgacaccctaacatcacaattaaaagagcaaaagaggcaagagcaaacttatccaaaagctagcagaagacaagaaataactaaaagaagaattgaaggagatagagacatgaaaaaccctccaaaaaaatcaatccaggagcttttttttgaaaaaattaacaaaatagactgttaactagactaatgaagaaaaagagagaagaatcaaatagacaggataaaaatgataaacaggatataaccattgatgccacggaaatacaaactaccatcagagaatactataaacatctctatgcaaagaaactagaaaatctagaagaaatggatacattctgggatgcatacaccctaccaagactaaaccaggaagaagttgaatccctgaatataccaataacaagctctgaaactgaggcagtaattaatagcctaccaaccaaaaaaagcccaggaccagatggattcacagctgaattctaccagaaatacaaagaggagctggtaccattccttctgaaactattccagacaactgaaaaggagggactcctccctaactaattttatgaagccagcatcatcctgatatcaaaaccgggaagagacacaacaaacaaagaaaatctcatgtcaatatccctgatgaacattgatgagaaaatcctcaataaaatactggcaaacccaatccagtggcacatcaaaaaacttatccatcacgatcaagtcagcttcatccctgcgatgtaaagctggctcaacagatgcaaatcgataaatgtaatccatcacataaaccaaaccaaagacaaaaatcacatgattatgtcaacagatgcagaaaaggcctttgataaaattcagcatccattcatgttaaaaactctcaataaactcggtattgatggaacatatctcaaaataataagagttatttatgacaaactcacagccaatttcatattgaatgggcaaaagctggaagcattccctttaaaaactggtacaatacaaggatgccctctctcaccactcctattcaacacagtataggaagttctggccagggaaatcaggcaagagaaagaaataaagggtattcaaataggaagagaggaagtcaagttgtctctgtttgcagataacatgattttatatttataaaaccacatcatctcagccccaaaacttcttgaactgataggcaacttcagtaaagtctcagaataaaaaatcaatgtgcaaaaatcacaagcattcctttacaccaacaataggcaggcagaaagctaaatcatgagtgaactcccattgaaaatcactaaaacagaataaaatacctaggaatacagctaacaagggatgtgaatgcctctttaaggaaaactacaaaccactgctcaagcaaataagacaggacacaaacaaatgaaaaaacattccatcctcatggataggaagaatcaatatcatgaaaatggccatactgcccaaagtaagttacagattcagtgctattcccatcacactaccagtgacattcttcacagaattagaaaaaactattttaaatttcatatgaaatcaaagaagaccccatataggcaagacaatcctaagcaaacaagaacaaaattggaggcatcatgctagatgacttcaaactatactacatggctacagtgaccaaaacagcatggtatttgtacatatagaccaacggagcaggaccaacatacagaccaatggagcagaacagagatctcagaaataataccacatgtctacaaccatctgatcttcaacaaacctgacaaaaacgagcagtggggaaaggatctcctattcagtaaatggtgctgggaagactggctagccatatgcaggaaactggaactggcctggagccctaccttatgtcttatacaaaaattaactcaagatggattaaagacttaaaggtaaaacccaaaaccatacaaaccctagaagaaaacctaggcaatagcattcacacataggcatgggcaaagacttcatgacaaaaatgccaaaagcaattgtaacaaaagccaaaattgacaaatgggatctaattaaactgaagagctcctgcacagcaaaataaactgtcatcagagtgaacaggcaactacagaatgggagaaaattcttgcaatctacctatctgacgaaggtctaacatccagaatttacaaggaacttaaacatatttacaagaaaaaaacaaaccatcccatcaaaaagtaggcaaagcatatatgaacagctcctcctcaaaagaagacgtttacacagtcaacaaacatgaaaaaaagctcaacatcactggtcatcagagcaaatcaaaaccacaatgagatactatttcacgccagtcaaaatggtgattattaaaaagtcaggaaactatagatgctgctgaaggtgtggagaaataggaacacttacactgttggtaggaatgtaaattagttcaaccattgtagaagacagtatggtgattcctcaaggatctagaaccagaaaaaccatctggacccagcaatcccactactgggtatatacccaaggaatagaaatcattctattataaagacacatactcatgtatatttattgcagcactatttatgcccatcaatgatagactggataaagaaaatctggaataaaactggataaagaaaaccatggaatactatgaagccataaaaaggaatgacatcatgtcctttgcagggacatggatgaagctggaagccatcatcctcagcaaactaatagaggagcagaaaaccaaacaccgcatgttctcgctcacaaatgcgagttgaacattgagaacacatggacacagagaggggaacaatacaccccatggctgttgggtgctggtgggcgagggaagggatcttagaggacaggtcagtaggtccagcaaaccaccatggcacacatataactatgtaacaaacctgcatgttctgtacatgtatcctttttttttttaatagaagaaattaaagaggtttaattggctcatggttctgtaggctttacaggaagtgtggtaccaacatcttctggtgaggcctcaggaagcttacaatcctgacagaaggcaacagggagttagcatgtcacatggccagagtgggaacaagagagagaggaggtggagccaggctcctttaaaccatcaactctcataacaactctcacatgaattagcagagcaagaactcacttattaccactgggagggcaccaaaccattcatgagcgatcttcccccataatccaaacacctccttaaaaggctccacattgaacatagggattatgttatctcatttgaaatgagatttggaggggacaaacatccaaaccacatcattctgcctctgatcccctaagtcttatgtcctcctcacatatcagaatacaaccaagcctctgcaatagtccaccaaattcttaacctgcttcagcattaactcaagtctcaagtgccaagtgtcaagtctcacgtatcatctggagatgagtccattgatcctatgagcctgtgagatcaaaaacaagttatttactgccaatatacaatggtgctacagatattgggtatgcattatcatttgaaaagggagaaattggccaaaagagaggcaatacgcccacacaagtctgaaactcagcaggacactcattaaatcttaaagctccaaaacaatctcctttgacatgtcctacatcctgggcagaatggtgtgagatgtaggctatgaaggccttggacaggtttgtccctgtggctttccaaggtgcagccctcatggctgctgtcacaggttggagttgagtacctatggcttttccatactgcggttgcaagcttccaatggctctaccagtctcaggtctggagggtggcatcccacttcccaaagctccactagccggttccctggtggggactctgcaggggctccactctacgtttcccattggcactgccctagtatagtttctctgtgggggctctgctcctgtagtaggcttctgcctgggtatccagacttccccacacgtgctctggaatccaggtgggagttgcgaagcttccttcacatttgcattctgtgcatctgcaggctgaacatcacatgaaagctgccagggattacggcttgctccctctagggtggcagcctgagctttaccttggcccagttaagctgtggccggagcctgagtggtcacgatgcagggagcactgtcctgaggctgtgcagggaagtggggtcctgggcctgaccactgaaaccattcttcttccctaggcctctaggcctgtgatgacaagggctgtccctaagaactctgaaatgccttcaaggccttttacccattgtcttggctattagcacttggctcccttttagtcacgctaatctctctagcaaatggttgctctgtagcctgcttggattttttctaccatagggctgggctacaagttttccaaatttttatgctctgcttcccttttaaatataactttaagtcttttatttgcttccatatatgacttagggtgttagaagaagccataccacttcttgaatgctttgctgcttagattttttttttctgccaggtatcttgtcatcataattaagtttaaactcagatccctatgacatgaacacactgttgtcaagttctttgccagggtgtaacatgggtaatcttaactccaggtcccaataactctctcatttccacctaagacttaatcagcctggactttattgtccatacagctatcagcattttggttataactatttaatcagtctctaagaagtttcaaacttttactcattttcctgtcttcttctgagccttccaaactctttcaacctctgcctattacccagttccaaagctgtttccacattttcaggtatttaacagcaacaccccactcctggtaccaattatctgtgttagtttgttcttgtgttgctataaagaagtacctgagactgggcaatctattaaaaaaagatggttaactggctcacagttttgcaggttttacagaaagcatggtgctgacatctatctctgatgaaacctcacaaagcttacaatcatggtggaaggtaacagggagccagcatgtcacatggcatgagcaggaacaagagaaaggaggaagagccagacttttaaacaacgagctctcatgtgaactaacagagtgagaactcacttattaccatggagaggacatcaagccattcacgaaggatctgcccccatgaccaaacacctcccactgtgtccggaactggtgggttcttggtctcactgacttcaagaatgcagccacggacccttgtggtgagtgttacagttcttaaaggcagcgcgtccagagtttgttccttctgatattcggatgtgtttggagtttcttccttctggtgggttcgtggtctcgctggctcatgagtgaagctgcagacctttgcagtgagtgttacagctcttaaggcggcacatctggagttgttcgttcctcccggtgggttcgtggtcttgatgggttcaggagtgaagctgcagaccttcgtggtgagtgttacagctcataaaggcagtgtggacccaaagaatgagcagtagcaagatttactgcaaagagcaaaagaacaaagcttccacagtgtggaaggggacctgagcaggttgccactgctggctggggcagcctgcttttattctcttatctggccccaaccacatcctgctgattggtccattttacagagagctaattggtctgttttacagagagctgattggtctgttttgacagggtgctgattagtgcatttacaatccctgagctagacacaaaagttctccacctccccactagattagctagatacagagtgctgattggtgtatttacaaaccctgagctagacacagagtgctgactggtgcatttacaaaccttgagctagatacagagtgccgattggtgtattcacaatcccttagctagacataaagattctccaagtccccaccagattagctagatacagagtgctgattggtgcatccacaaaccctgagctagacacagggtgctgactggtatgtttacaaaccttgagctagatacagagtgctgattggtgtatttacaatcccttagctagacataaaggttctccaagtccccactagactcaggagcccagctggcttcacccagtggatcccacactggggccgcaggtggagctgcctgccagtcccacaccgtgcacccacactcctcagcccttgggcagtcgatgggaccaggtgctgtgaagcagggggcagcactcgttggggagtcttgggccgggcaggagcccacggtgggttggggggaggctcaggcatggtgggctgcaggtcccgagccctgccctgcgggcaggcagctaaggcccggtgagaaatcaagtgcagcgctggtgggccagcactgctgggggacctggcgcaccctccgcagctgctggcctgagtgctaagcccctcactgcccagagccggccggctgctcccagtgcggggccgtcaagcccacgcccacctggaactctaactggcctgcaagcaatgtgcgcagtcccggttcccgcctgtgcctcttcctccacacctccccgcaggctgagggagctggctccagcctcggccatcccaggaaggggctcccacagtgcagtggcgagctgaagggctcctcaagtgcagccagagtgggtgctgaggccgaggaggtgccaagagtgagcgagggctgcaagggctgccagcatgctgtcacctctcaccaccaggccagcctccaacattggagattacatttcaacatgagatttggaggggacaaatagccaaaccatgtgtgttactattttctgactttctctgaaataggtgtattgagattgttctctgttggatggtagatacagttatataaaagataggtgagtgatttataacttagaagtaatatccacttgcatacttctttagtatggttagttaagtttcatcattaagaatgactttcatttagtgtcaaaagttaatcctggccaggtgcggaggctcacgcctgtaatcccagcactttgggaggccgaggcgggcagatcactaggtcaggagattgagaccaccctgtctaacatggtgaaaccccgtctctactaaaaatacgaaaaaattagctgggcgtggtggtgggtgcctgtagtgccagctactcgggaggctgaggcaggagaatggtgtgaatctgggagatggagcttgtagtgagctgagattgcaccactgcactccagcctgggcgaaagggcgagactcgtctcaaacaaacaaacaaacaaaaagttaatgctgctatcagtcctgtacttctgagacatggattgttggatgcttaaaatggtttatgatcaatagtcttaaagttctaatctgacttttacagttttaaatttctaacaaagatggaaaaaacagacactgggccctacttgaggctggagggtgggaggaggaagagaagcagaaaaaataactattgggtactaggcttagtacctcggtgataaaataacctgtacaacaaatgcctatgacatgtttacctatataacatacctgcacatgtatccctgaacctaaaataaaagttaataaaaatttattacaaattaaaaataatatacaacaccaagagtgagccctgatgtaaactgtggacttgggatgataatgatgtgtcaatgaaggttcattagttgtaacaaatgtaccactctgatgggggaggctgataatgggaaaggttgtgcatgtgtggggtagtggtatatgggaaatttctattcctctcgattttgctctgtgaaaagcaaaaacttaaaagacttaaaaattatagtgaaggcatcaaatttggaaaaatcaatagcctagttccttactatgaaatcatatggcatagttctctaaatgtaacccttacatgttgttttcatggacttcatacacactcgctctaggaataaaagagcaaagtattttcatgtttccttttttctgagtttgtatcagtatggggtatgtgcaggtggggatgggagggttacctttagccaatatcagaattgaattgaatggaggaattataattttccaataaaaaaattcaagaagtgttttttgcctcccaggtggtaaaatcatgcatactttttatttccttttttggtctctctatattttccaagtgttcaacaaagtgtggttattagtttttataataaaagacattttaggttatttctctgattactaagagtaaaaaaaaaataaagttttaaagttctaatctgaaattttcagtgaccacatttcaggagtgctcaaaggaatatgtacaatcaaggcaaatattttgtctccactcctgatttccctgatgacagaattttcctaagcatattcctggcctttctctttgtccctctattctctgtgccctgggaggttgaaggatttatttgattggtaaatttgggaaggctcagtcctgcttatcttccttttagaaaaaagctgtctgcagggagcaagttacctctgctacttttctaggagcagattcttcccttttagagaaagatcctgtactcgttcaacgttgcctatatctagataccttctctggctgcttgtttttaagtaagtccatttggctctcatactaagctacagtcttcaacttgtcttttattaaaaaataaagatatttttggccttcatatgctactctttgttttatttttcaatttgcttagaacatagccatggaagaaggaagccattttattgtttcatgtacttctcatgtctgacagttgacattctccctgaattctctatcattaaaaagctttgagtctctagtaaacacaatttctaaatctaacaaatctcatcatgaccagctctcagagcctacacttgaacactactgtttttctccagtggagggaattcaagctacttctttacaatttcagaaagcagttagaaaaaaacagccttaggctattttgattttttaaggttactgttgattctgatgctgaacactgaaggaaaaatgcttcaattaaaggcagacaaactcttccatataagaacacagacaaatcttcaaagctcatagtatttgtgaccaactcctgaagaaatatacttttagataaccttcatatagaaggcaggtaaatcactcatcatatgtacatatgacatttctgaatatacttacctcagctgtgtgttttgccacatgccccacgatgacaatgaccttccctttgaagttctggagcatagcagtgtaagggccctgggtaagctccccttctgcagtgaaggcagcactgaatggaatgttgatgcttcctgaaatgtgaccacgaataaagctgagaaggaaagtttaaggaaaacatttatttgtgtgcaatcctgagtgtctgagggaaactcacagagctaagtgactcccagaagatagtactaaacatcttccagcttatgtgagtattttatctaaatgaagtaaggcacctccaggagaaaaaaaaaagttaaatttgaaaatgaagtagaaaagagaaaggaagatgactagccaaagatataaaaggatcttacatcaaaagcatctctcattacataaacacagatatgggtaaacaataactacacttaaagaggttctataaagagtggagatggtggagatggactacatatcttacaatttaaattttctagtcagctgctgcttcatctttttttttaaagaaaagggtatgacattaataatgagagaaagaactgtaaataagttctgaaaaatgaaaggagagagaatcaacattaacattccagtaggcattgtttagttgaagttttctagaatgggcagagaatttatgatcatgggtagattacctttgaacttcatcagcattagtttctcaaacatttctaattattcaatattcccaattgcagttttcctgaagagtaatgacttttctctcagaatataattactctgatggtacttttttaaaaaactgaaagtacttttattttcagtaaagatctacttaaaatgaaaattttttataacacatactaagaacctaacaaacaactcatatattctcagcacctatatctacatctgtgaggcctgaatcagttgccagagagtgtttccatatttatcaaacaaccttttcaactatgaacatctttcctttttttagtgtgtttagagtagcaaaagcaatacaaatctatcctggtgaaatgctgtagcagacatgtttgggctgcctgcccacctgctgttttcttgtttggaagagcaccaaccactgaccctgaggaaagggtgagcctaggttgtcgtgttggtatcagatgaccctgctacaaccatgactgacaggatggtggaggggagggtgatggtggatatatgatgcaggctgagccaatgagattctctcccttgaaaatcagaaataaaagacataaaagataatgctcagactgtgttaagctttacatgtaaaatcacctttaagtgcctcttccataaaatttgttcagccatccataaaatttgttcagccacgtattagaaaattagaagaccctgactctaaaagaagaactgtttaatagatacattcagtgaatactgtatttggttaaaaaagtacccatctatatctaaataaccatacctagtaactatatctataatcatagataagtattaaggtgattttgtaggctcgatatcacctatttattatgtgcctttaaagaagattttaatctaaactcctttcagttactaaaagtatgtcataaagttattatcctattatccttgtgatttattatttgtttaaaaaatctagattaaatattaaaatgcttcacaaaatatgacggcaacagagtcttttttgaaagagaaagtttttcaaaatacaaaatgattccaaaccttttttaggctacactttggaaaataaggcacaaaagaaacagagttttaaaccacactttccttattcttaatctacttcaaccaaaatgtcctggataatatctaagaacactcatccaagaacactcttgtcatgaaacttatagcacaaaaatgattgggtaagcatgaatgtctgtagacatggtggtcaaacctctaaatcgtctatcattactggaaaacagcagaggagaatgtattactggcaaaaaacagaggagaatgagattggcctagttataaataagtatatttataatgaatagcctgttgtttatataagttggataatgaagacaactttggttatttagaaatctcttcttgtttccttggaaagtatttacatggcctacaatacaatttcccatgtgacacagacagcattaggtgaaatagaactgctttaggcaacttctagacatttgagaggtggtcagattatattgtaaatctaggtaggtgaatacttttttcacttgttgagtacttcataatcagaataaaatatgaggtatttggaaaatgagcaaacaacagatttctgtatattttttattagaaagaataaataaataaagaggaaaatagaagaaaatttttgacatatggtgactctgaatgaccatagttgactatcatcagtcatgagtaaaatctggcaaggaaagagacatgatagagaatatgttgagataagcacatttttccatgctctaagaactttggttttatttcactgtattacagtggaaaacaagtatacataggaccttcacacaaaggtagggttagagatgaacacgcaacactacatatttttgaagtatgactgtcactttactgctttctgtataatatagataaaaatctgaatcctctacactaatgttttacattttaaaaaggcctttctcattacataaacacagatatggggtaaacaataaccacacttaaagaggttctataatgagtgtaatactcaacagtcagtcactatgctattttataaactaagagtttaaaaagctacagcttcaaagaacccagttcagaggaaatattactattaaggaaatagtagccaaagtacttatggggtgattagccccaatcacatatatatcatgatactgtaatcccaacaatgacattacaatttttggttaggttttggcaaaagtggcaatggtatccataaacactaatttttaacttccagtgttcataggaaattagaattttttatgacatacttgaaagcgttaaaagataaaaaacatcattacagaagtcagcagtaattacaatgaaatctctagactggaataataatagttatgaaagcataaaagcatccagttattgtagcagtcactttaccacgtgtttggatatggttgtttactatgctgaatgcactacaggatatattccagtaaacatatgaattttctttggcatatggtgaccttacactatatatcttaccctgtcttggagtaagttgtacccctccctgcaaataagccattcagctcaatattccatttggcagatactaccaaaagtatttgaatgtgtgctaagaacaaaatcaaaaatttgcattaaacagaatttgatagcccaatgcacagacagatttaaaaaattactgtaaacttctgataaataagttggattatcagaatagcattaacaggtagggatgatgtatattatcttctaggtttctaagatattaaaactttcctgtattcataattcagtctacaaaacaatgctgtaagtagatatgctgtacttcaatcaaacagaaaaaaatcaggtataagaatataggtacagtgtataggtaaattacatggtagttaaccaagtatgttcagaaagactcttcaatttacaaaaagatttgaaaattcctttaaaatattgtttaaaattcagcacagaaaccagctcatgtttttttacatcctaaaagagcacagcatttttgctggatgccacacttagtgacatcgtatctttaaagacaacacacaccaatatttcaccaaaccattcaagaagatctacctacctttgttttttggctgtttgtctgctgggttaactaattataattagtattatagacctttcagcccaaactgaaagttttacctttagtatatcaacagcgaaaaagaaatatgaaattaaacccacagttctctcatatataccataactaaatagcattaactgatataaaaatgatgtttagatatcatgattttctttgctaaatctattgatagtctgaatggcatcaccatcccccaaatcaaccagtcaaaaatctcatttccaacatcttatcagtagcaacatccaatattctacagctctaataaatcttgtactcacatttttattcccattaccccttgcctatttcagatattgatttgtcttgagcttaaactactgtagtaactgttttctccaacttttgtcttttctcttggaaatacacttgatttacaatattgacagagaaaaaatttaaaagcaaagtgttctgattattgtatcctttctgagaaactttctatgactgcctataggacaaagcccatatttctcagttcagtcctcatgaatagaacctaactactttaattccaaccaaactaaatcatgcactgttaccaatatgttttctatctcctgtagttttctctgcccaaatatctttttctcatttttgcgcattcaaacatccatccttcaaatgtttcatccatgaaagtttcccttcccacagtatctgtacatatcttataacagcaatttgattttatataaaattttctaatgaaaatgacttctatctaaacaactgataggaacaatgtgtattatatttatttcgtctttgaatctcttgcaaggattaatagaatgcttagaacatcacttacatatttggtgagtaaatgaatttcagaattttgccaaacctggagtaactagtatcggcagcaaatatgctaaggtgccttctggccaccccaaccagtggcaccagtatctaacaatgcttgcaagtgtcaacgatatagaatttccctttgtcagcacacactttgagaaaagggaaagaaacagcaacaaaagtaatttctctcaatcttcttcagcataggctcactaaaaccggtttatttagggaaaagctagggacctcactctttatgacaggatatgaatgaatgattatacacatcaaatttctggataattcaatcctaattttgcctgcaagattatctctaccctcatccatcctctacaatgcattaaagtaatttttctgaaataaaaatctgagcatggcacctacctgtttagaattttttaagtttcttactgcctttggaataaaacccaaatttcttagcatgttatgagacattttcaatgaggctacttttacctactctagtttcattactaattctcatatattccagacatgctcatccacaattcttgtaacttcctaaatgtgtctgtctcaccttctctgggcctcaaacaatgtgatttttcaatgctttctctcttttctttgttaggttactaacttctacttgttttttaagaatcatgtcagacatcacctggtttaggtgcccatcctatatttccatgacatttgggtatgcttcagacataggccatttcatattatactgcaattatctatttcatgtatctattttagttataagactgtgagcttctggtgggcaggggtgctataactaaactctatatccccattgcctggcaaagcaggtcctcaaacaggactggctggctgattgaatgagactgtatggcactctaggaactggggtcatggatggttctcacagcaaatcggagctctttaacagctaatacacctttcataactagcaatccagacatgaagacattgctcagcagttgctatcatatactcccacattatacaaagcccactcaaatatgggaatacaattggatggaaattttaatttagatagattgaacctaagcccaaatgagatgaaaaaaaccttactaaaccttctcatcagtatctgtcctgctctgctcatgagtatctttaaattgctttgaagaagtttttataaatcaattattaaggacaaagagacaagagtaatactagtgttcactaaggatgaatgtgccataatgaaataatgaatacaactgggtttatgtgtttttcaaaaaacaaatttaagcctgaggttgtctttggtatagttttagatactaacttttttttaaaaatcaaaaggtaagagttttacaagtaaagctcagccttgagcaaaaactcagccttgatttcaagcaaatgagtaacattcctttaaagtattgctgtttacagataaaataaattggatccacaattacatgactaagacctctcttaatatgaacttccaagaaaactgaaaccctaaatatttacaactattaaagaaaacaagagtttgcttgtgtattaccatggaaactattaacatcacttctgaaattcatgtcactacatgaaaacattttctattgcctccttataaaatgcaatttttgtttgctttgaaattctcaaaatatactgaagaacaaatatatctgacttgatttttacctagattaacatttcatgtttctatcttctaaaagcaaacaaaaaaacgtgatttcaacaaaaactgttgttttgcctctctgagcctttggctttaatattaagagtttagactatattagggtttcttcttattctaaagttttgggattatgtttttattgttaagtgggtaaagtttgtcttcatgtccttcagctttcttcttctgtattctccattcccttggcccacattggggtttgggtagttccctaagattgctggcaccttaatgtgctgcttgtctcctacaatcacaaaaactgaacatagattaaaatattaccacctgcaggctttttgtattttaactgagactattcataacacaagctaaatgactgaagcctcaacagtagcgtttcaggcatcaagtgaaggttctgaagggggcttggtggtagtagtgaggctgtcccttaaatttattggtagacagcttattttgcctgtggataagattgcctccctccctgtcataagcaaccacttaaatcattttacataggttaaaaaaaaagacgagatgaaatatatttttagacattaaatctcctggaagcacaatttaggaaaaaaaaacttcacctataatgaagatgtaagaactgtgttaggcaaagacttcccatttaaatgatgtataaaagcaaaacagaagataaacatgatacagggacattataaataatttgaacaacatttcaaaaataatttgcttcctctagggaaggaaaaggtgttagagaaagtttcttttttttccatattgtacagggtcacattttgcggcaagagagaaataaaactatttcaaaaatatcctagtattaaatatgtaatcacttcttaaacagattgttaaagtcacataaatcctagactttaattgcgaagatttaccttggtaagcattaagagttactgtacaaagataattactttaaaaatattattaaaatttcaatgggctttaaaaaacatcagcatattagtagctttagggaaatttttattaaaaagattttgaatgaattaaatattataaattaagtcaatataatagggaaggatctttctatcatgtttcctccctcaaagtgttgcaatactgctttctaaaatttgaaatacttcagttttcctcgattctgtggctacatctgtataaagataaccacaggtagatttgttcagttggtatctgggattagtcctcttatacacacaggtgctgaaggtaatagcttattttgtgtgtaagatttgaagaaatgtgtataacatctgaatgaatatatctagtgtagaggaatcaatgcatgtctcactgactcattaatttctattaactcatttgtttcaatcttgtttatgcttaactgtccctatgcagagaccagataggcacctgtaaaatagtgtaaaatttagaagcacaagactggctctgcaattactagttatatggccttgggaaagttgcttaacctctttaaacttcagtttatcagtaaaacagagataacaacagtatatacagcataggactagcaccatgcttggtacagtgtaagaacttaaagactgctattattagaagtcaatttacttcaatctattcaagaagcagctagtgtgcgtggctagaagcagctagtgtgtgtggctctcatggagaaaaacagaagggggcaagtaaataccacaccttcagctgaaacatccaggtatttgcagtgggactaatcaaggaaacaacttgacctttagagaatgaagaaaagtaagacaggacaacgacccacctgggaataacatggaaccaggggatactcccccacccaagggaagtggtgagtgaatgaacggccccagaaaaacacacttctctcacaggtctttgcaaccctcaggtcaggagatctccttgtgaacccactccaccagggccttcagtcttcagtctgacggacagagctacatgaagtcttggcagagcaactgctcaggcataggtggagaccctgaagccttagattattattgggctttctggcaaaagtagctgcagctttggcaaagtagaaggttagactcctgtacatacccgtaggaaagaggccgaatccagaaggctgagtagcaacaacccataggccccacttccatggcacctcacaagataagacctactggcttgggatccagccagctaccagcagtggcactgcacctccctaagaaggagttcccagggagatgggtgggttgccatctttgctgttcagacaccttagccattccagccttcaggctttggacagtctgagctgactcagagcagaaggaatcccacagcacagcatagatgctctaccaaaatgtggccagaatgcaaactgcttttttaagcaggttctgatcctgttcctcctcactgggcaggacctcccaaccagggtctccagccactttgtacaagtgcctttaaaccacagtctgagctgactcaaggcagaaggaatcccacagcacagcatagatgctctaccaaaatgtggccagaatacaaactgcttttttaagcgggttctgatcctgttcctcctcactgggcaggacctcccaaccagggtctccagacacttggtataggtgcctttaaaccaccaacaggtccatacctccctgggacaaagctcccagagggaggaacaggccgccatctttgctgtttcacagctttcactggtgacacctccaggttctggaaaatccgagatgactagggcctagagtgggccccaagcatactgcagcagccctacagaaaagtgggcagactattacatgggttcctgttcccacatctccttactgggcagatcctccaggcctggggttccagccaccccaaccagagctatcgagccagtgcgaactcagcaactccctgcccagagcctacaggggcaaataaaagcctctctgccactgtctctgcagtggaactgccctagccacccttgaactaatgaagaagcaaagaccttaactgtcttatccatacctccaacaagctgcagttgaaccaaggagaggaggccagtccatctcccacaggtcccacacactccccaaaactcatcaccagacaggaaactcctggcttgggcccacagaacaaacctccattttgggctgacttcgctgagtgattgatgacctgcatctctctggggcggagcccccaggagtcaaaaaaaaatgacccttggccacaaccactactaagatctcttcctctactgcctctaagctggggaaggaatataaactctgagatcatcccagagctgcagtgggcagcccaggagtgccaagtcatgaactatagcaggcactcaagggggagaggagcccacactttcagagcactgagagggaacatggctgcaactatgaggaaacataagggagccacactactgaacaaaagtctaccaactgacaaataaggctaagtgtcacctgctggataaaccccaaagcttcaacacaaaaaatacctcactaacgtaacccactctaaagccagagacagtcagtcagcttccaataaagactctatacaaatactcatcccagtgaaaatatccagaaaataagtctattgactgtactcaatctacaccacagttaaaggaacacccacatgcagagatgagaaagaaccaatgcaagaactccagtaactaaagtggccagagtatcatgtgtcctccaaatgactgcatcagtcctccaacaagagttcttaatcatgccgaactggctggaatgacagaaacagaattcagaatatggacaggaacaaagataatcgaaatgaaaaacacaggaatttcacaatacaatctccagtattaacagcagaataaaccaagccgatgaaagaatctcacaattcgaagactggttctttgaagtaaggcagtcagactaaaataaaaaaaaaaagaataaaaaggaatgaacaaagcctctgaaaattatgggattatgtaaagagactgaatatatgaatcattggcatccctgaaagagaggggaagaaagcaaacaacttggaaaatgtatttcaggatatcttccatgaaaacttccctaaccttgctaaagaggccaagagtcaaattcaggaaatacagagaactcctgcaagattctacgcaagatcatacatgagacacataattgtcaaattttccaaggtcgaaatgagagaaagaaggttaaaggcatctagagagaactcgggcaggtcacctacaaagggattcccatcaggctaacagcagacctctcagctgaaaccctaaaagccagaagagattaggggcctatattgaatgttctgaaagaaaaaaaatctttaaccaagaatttcatatctagctaaactaaactctctaagtgaagaagaaataagatccttttcagataagcaaatgttaagggacttcattactaccagacctgccttacaagagatcttgaaagcagcactgaatatagaaagatcactaccagtgaatacaaaagcacacttaaacacacagaccgacgtcactgtaaagcaaccacacaaacaagccaacataaccaccagctaacagcacaatgacaaaacccaatccacacatatcaatatgaaccttgaatgtaaagggtgaaaataccccacttaaaaggtagagtggcaaacaggataaaaaagtaagacccaataatatgctctcttcaagagactatctcacacataatgacacacttataagctcaaaataaagggatggagaaaaatctaccaaaaaaataaaaaacagaaaaaagcagggattgcaatcctaatttcagataaaacagatttcaaaccaacaacgatttaaaaaaaaagacaagggcattatataatggtaaagggttcaatttaataagacctaactattctaaatatatatgaacccaatacaggagcacccagattcataaagcaagttcttagagacctacaaagagacatcgactcccacacaataatagtgggaaacttcaacactccaatgacagtattatacagatcactgaagcagaaaattaacaaagatattcaggacctaaactcagcattggaccaaatgaatctgacacacctttacagacgtctccaccccaaaccaacagaatatacattcttctcattaccacatggcacatactctaaaatcgaccacataactggacataaaacaatcctcaataaatgtataagaactgaagtcattccaaacactctctcagaccacagcaaaataaaaatagaagtcaacacaataaaaatcactcaaaatcatacaattacatagaaattaaacaacatgctcccgattgacttttgggtaaaaaataaaaggcagaaatcaagaagttcttttaaagtaaagagaacaaagatacaacataccagaatctctgggacacagctaaggcagtgttaagagggaaatacaatatcaccaaatgtccacatcaaaaagttagaaagatgttaaattaacaacctaacttcacaatggaaagaattagagaagtgagaacaaaacaacctcaaagctaatagaactgagaaataattacaaaaatcagggtgaagtgaaggaaatcaaggcatgaaaaactattcaaaagagcaataaattcaggagttggttttttgaaaaaattaacaagataggccactagctagactaagaagaaagaagatccaaataaacacaattagaaatgactaatgaaatgtaaccactgaccccacagaaatgaaaataaccatatgctctatgtacacaaatagaaaacctagaagagatggaaaaattcctggacatatacaccctccgaagactgagccagaaagaaactgattccctgaacagaccaataatgatctctgaagttcaatcagtaataaatagcctaccaaccaaaaaaaacccaggacctgatggattcataaccaaattctaccagatgtacaaggaagagctggtaccattcctactgtgactattccaaaaaaattgagaagaagggacttatacctaactcattctatgaggccagcatcatcttcataccaaagcctggcagagacacagtaaaaaaggaaaacttcaggccaatatccttgatgaatgtcgatgcaaaaatcctcaatgaaatacttgtaaactgaatccagcagcacatcaaaaagctgcttcaccatgatcaagtaggcttcatccccgggatgcaagattggctcaacatgcaaaaaatcaataaatgtgattcattacataagcagaactaaagacagaaactacataattaactcaacagatccagaaaagacttttgataaaattcaacatctgttcacgttgacaactctcaataaaccagctattgaaggaatatacttcaaaataataagagctatctatgacaaaaccacagtcaacattatactgaaggggcaaaagctggaagcattccccttgaaaactggcacaagacaaggatgccctctctcaccacttctatgcaacatactattgaaagtcctagtcagagcaatgaggcaagagaaagaaataaagctcattcgaataggaagggaagaagtcaaactatctctgtagatgacatgattctatatctagaaaaacatgcagtcttgacccaaaagctccttcagctgataaacaacttcagtgaggttgcaggatacaaaagcaatgtacaaaaatcactagcattcctatacaccaacgacaaccaacctgaaagcaaaatcagaaaggcaatcccattcacaactgacacacacatacacacacacacacacacacacacacacactccctaggaatacagcacaccagggaggtgaaggacccctacaatgagaattacaaaacactactcaaagaaatcagagaagacacaaacaaatggaaagacatcccatgctatggatcggaaggatcaatatcatgaaaatggctgtactgcccaaagcaatatacagtttcaatgctactcctatcaaactaccagtgacattaacagaacaagaaaaaactattttaaaattcatatggaaccaaaaaagggcccgaatatccaagacgatgctaagcaaaaagaagaaagctggagacatcatgctacccaacttcaaactacactataaggccacagtaaccaaaacagcatggcagtagtacagaaacaggcacatagactaatggaacagaatagagagcctagaaataaggccacacatctatgaccatctgatctctgacaaagctgacagaaaacaagaaatgggaaaaagactccctattcaataaatggtgatggaataactggctagtcatatgcggaagattgaagatggaccccttccttacaccatatacaaaaatctactcaaggtgggttaaagactttaatgtaaaacccaaaactataaaaaccctggaagacaacctaggcaataccatcctaaacctaggaatgggtttagatttcatgaaagaaaccaaaagcaatcacaacaaaagcaaaaattgacaaatggggcctaattaaacttaagagcttctgcacagcaaaagaaactatcaacagagtaaacagactgtaggagattggtcagggtggtggaaaaaattgtagaaagacacaaaccttcttggacgtccaggaggttttataaaagctttggaaaagcatttggctgaaggcagccaaaccctcttatccggagcccgagagcgaaggttacataacaaggggatataaaggaattgatctagataagttagtttatttaggccttggaacctggcctttaatcatccacgtgcaggactgctctctccagggagggtgaccatgttaattacccacaagtgtgttgactcaaagcctttgtcattaaatctgtactaaataaatgccagcagcaccagcttgtcagggctgcggctgctacaactctttctgtcagcggtctggtcccttagcctactctttcactcaatacttgtgtctaagtacattctttcatccatcattcagccagggtctatgggtcagacccagcaggtggtgctccacatgaggaatgctgcaatggactgcgatagaaccctcaaaaatgaaggtgaaaagactgcgcagtcagtaagtcagtaagtcattggtgcccactcaggatttccaagttggagagaactgttcaggctagggtttcatcataggacaacagttatcagctcaacagcaacagtatataaaagcattgaaacagctgcttaaaggtagcagagccttggtttcgcaggctcaattaagagacctaatgcaaactactgtttcccataacccatggtttctgaaagaaggtgcactaaacttggagatctgggaacaagtgggtagaaatcttaaacaacatgatgtacaagggcaatgggtcccaataacatctttaacgttatgggctttagttagggtggctctggtcctactctacacagaagagcctaaaaagggaagggaggaagaactgtcacctaccttactgcctccatctccctcagccccgctgtctccaggaaaaaataacaaagaggaaatggaggttttgcctgaggcccctcatccaaaaaattggaaaaaagacaagggatatgctgtcttacgcaagcagcattagatggggagctcttagcctgcctggtaatgcaagatcaacaaggcaatcatttcttttaatgcttataaagagctaaaaaaaaaaaagcattaaagaaaacggagccactagcccatttacaagagggttaactgaggccactctgcagacctctttctaacaatggccactgttatttctcccctacccctaacgtggctctctcaaaatcctatttgggtagaacagtagcctttaaagggagagaaattataaagagcccatgaattagccgaggagcaattaaaagctgaccatatagaaccgtcatacagtccttgtaatttgcccattttcatcattccccaaaagtctggtaaatggagacttttgcatgacttacgtgctattgatgctaatttgcaacctatggggccccttcagcaggggctcccctcccacgtggcaattcctcgagactggcctataatcattattgacttaaaaggctgctcttatactattccccttgcagaacgggacagagaaaaatttgcatttacaataccagctatcaataatgaaaggccagctcactgatttcattggaaagtgcttcctcaaggaatgctgaacagtcctaccatgtgtcagtatcatgtaaatcaagcttggctccccagtagaaaagaatttcctaattgcaggattactcattttacagatgatattttactagcagccccaacagagctagtacttttcaagtcacatgcctctgtcgtaaagaatacacagttaagaggtttaatcatagaacctggaaaagtacagatgtctttctccttggaaatatcttgggtacatactaatttcccagtcagtaagacctcaaaaggttaaattaaatactagcaacttacataccttaaatgatgatcagaaattactaggtaatattaactggatttgccccaccttggacataactactgataagttacagaacttgttttccatcttaaaaggcaatgctgccctagactctcctaggtatttaactcctgcagcacaaagggaaattgaagagatagagcaagctatttctcagagacaactagattgcattgatacatggtattcagttcaattatttgtttttcccactaaacactcccctacagatgaccccagggctacgcttcctagaatgggttttttgctcacataccgggactaaaacactctttccctatatccagttagtcagtaaagtcatttattcaggatgcagatgatgcaatcagttgctaggttatgaccctgatatcatcaggattcctttaagtaaaaagcaattcaaggcagtattgccttatctatggacctgcaaatagcactctctgattacaaaggccatatagagcatgcccttcctgctgacaaactccttcagttcttatcttgtacttctgtggttttgcctactaaaacagttcaatcccccatatctaatgctttaacagtgtttactgatggctctggtaaacatggaaaagtcactttctggtggaaatcacgtaattccctcacttgttctggatttactagcgctcagagggctgagattggagccttactattggccttggaaactttttccattcagctcatcaatattgttagtgagtctgcttactctgtttatttattgcagaaccttgagagggccctcattaagtccactctggagcccaccctgtatgcactttttctccgacttcagcatttgctagatcaacatacacatcctatttttatcatacatatttgagcccacagctcactgcctggcccactggcttatgaccatgatcaagcagacgtacaagttagaacatcactgtttgaccaagccacccagtcacatcaatttttccaccaaaactggagaaacttatctgaacaatttcaacttacccagagactagctaaacaaattaaccggcaatgcccagattgccagctcacaggcacgttccctccttatacaggtgttaaccctagaggactagaacctaatcagttatggcaaacaccatgttacacatgtgcctgaatttgaaaaactaagatatgtacatgtatccattaataacaattctcaattagcgctcatgcctttcctggagagtccacccgatatgtcattaaacatcgtcttttaacttttgcatttatggggtggcctacaaaaattaaaactaataatggtctggcttatgccagctcacaatttcaacaattttgtcacagtggaatatccaacattccacaggcatcccttataacctccaaggagaggccatagtagaacatactcactctatccttaaaaatatgctcagaaaacaaaaaagggggaatatgagtaaggaccctgcaacactactagcacaagccttatttacccttaattttgaaaatttagatgataaatttcaattagctgtagaaaagcactttgctaaaacctctcaagacataaaacctgcagttttatggaaagatgtaaacagtaatgtacggtgtggtccaaatgaattgttaacatgtgggagaggatatgcttgtgttcacaccccctcaggtcctctttggattccagcacgatccatcaaaccttaccatagcatggctaggacccaacctggtaccagaaataaagaaaatgaccctataggacctacagccccagaaaatgtggcttcctcggacgacataggccctggacaggacgctgaagaagagaagtcagaagactgagcgaatctgctctggacacagacaccattcactccagataatttgttccttcctatgctttattaacctttttaattctttcactttacctgcaaccctcacctgctactctctattgggcccatctcttagatacgcctttcttcagccctattatttaaacaaacacccccttctcagcttctaacaacacgactgcttggctaagagggaatgacatgccccaagtggggttcctcaataacggcacacattggactaagatgccaagtaacactacatgtcactccttaattggaaaagaatgtggctaattatactcatatttgtcttctattatttactaattctaggatgcaaagccggaatgcgagcagtgcccgccacacctgacaaacctgctgctgcacacatctgtactcttcaatcaacaaaacctgatgctaaaaacagaaaagggggagatgtaggagatcagtcagggtggtgggaaaaattgtagaaagatgcaaaccttcttggaaggcggggaggttttacaacagcttcggaaatggatttggctgaaggtagccaaaccctcttatctggaccttgagagcaaaggttagatagcaaagagatataaaggaattgatctaggtaagttagtttaacttggaacctggcctttaatcatccccatgcatgactgctatctccgggcagggtgactatgttaattacgcaaaagtgtgttgactcaaagcctttgtcattaaatctgtaactaaataaatgcctgcagcaccagcttgtcagggctacagctgctgactctttacagcaccctgctcggggtctataagcagccaggtcctctagcccgctttttcactggatacctgcgtctgactgcattcttacatccgttgttcggccagggtctgcagattggacctggcaacagacaacctacagaatggaagaaatatctttaagattaaaatagggtgttataatgttattttttatggttttatgggagaattgctatgaataaagactcaagcaaaagaaatacaaattaaaaagttaaaaacattaaacagattctaaactcctgaagtataagatcagaagaacttccagactaggggttcttgaccagttaaatagaatttaatgcctcattcgggagtccactcatccactctgcaaagagtttctagtattgctgaaaccctaacaaccagggatatcaacatttatactctctccaaactcagaaaaatagaaagtagcaacttttcacaaaatgataagaatatatcatttgaaattgtgagctctccaattgtactgtcagaaacctaagattctatgaattacttaataaagtctgtaaatgtgtaatttgaatttcatttcaaaaattggaattgaaaatattaacatgaaaacttattgctgattgagtatccttaatccaaaaatctaaaatctgaaatgctccaaaatcaaactttttgagcaacaacatcaggatcaaaggaaatactcattagagccttttggattagatattctgaactggtaagtatatacatataatggaaatattccaaaatcctacaaaatatgaaacctgaaatactgtcacaaacattttggacacaggatactcaacctgtatatgccaattttagcatataagaaaccattaacctgctaaccctcatttatagcatttatagttagtaaatgttataaatctgaacttatgaagcaaattagttataacattcatttatattttatatattgagtttctaagaaagattttaaaagttgctctgtttttaaacaaagtgaaaaccatttatctagattctagaaaatacacaatcaaagaatctgaagataatgaaaatagaaggagaagagactgaactgttactattttgtaactcttcatactctaatgccaatcaaacccactggatgttacagtatgttcaatagtaaaatcttcgtaaataacattttgtagttagtgaaaatacatgttctatgtaagccagtgttttgaaaattataatgaacacaaggtcagtgttgagatgtagcaaactttttctctaggctatgaggtaaaacaggtgtatacttactctttatctttgccacaattcctatctacagcatgaaggattcaaatgccttcaagaatagcaatatacaccagagaaacacaaaaaacaacaaaatatcccaatattctggcattgtttggaaaatatcatcaggtctctggtatgtaatgttatcttataaaaccttatgcaagaccattctggcatccagtttgagagtaatttaactacttgaattcagaagaatcccagaattttttttttttaaccacacaacacttaaatgaaaggatgcaatacaaataagcagtaccaccctttaaaacagcatatgcaaaggatactcttcactattccggatgtcaaccaccaggagctttggtttactggactttgttttcttgctgggtgttttgaagtggcctgtcactgtgagctcacacaagtcaatcaggtcctctgctgaaatccgtggtgatacttctgacttcaggtcatttaatgggatggattctcttgactgaaaaaaaaaatgtacaaaaaaaaatattgagaatattatagaaaaacaaattatccccagtaatagaatatcttgataccaaacaatacagcatataagagaagaggaaactatctaattttcacagtctattgtgtaattcagtggtctccaacccccaggccatggactggtactggtccatggcttgttaggaactgggccacacagcaggaagtgaatggtaagcaagtcagcaaagcttcagctgtatttacagttgttccccattgctccgttatagtccgagctccgcctcctgtcagatcagtggtggaattagattctcataggagtacaaaccctgttgtgaactatgtatgtgagggatctaggttgcaagctctttatgagaatctaatgcctgatgatctgtcattgtctcccatcacctctagataggatcatctagttgcaggaaaacaacctcagggctctcactgattctagcttatggtaagttgtataattatttcattttatattacaatgtaataataatataaataaagtgcacaataaatgtaacgtgcttgattcatcctgaaatcatcccccccccatctcaaacccagtccatggaaacactgtcttctaggaaaccagtccctggtgccaaaacggctggggaccgctggtgtaactgataccttactattgaggtttacttctttgttatttacacttataggaaagcattattgttttgattgactgcaagctcctgggtcaaacatgtagaaagagatgaggcaaagatttccttatgagagtgctttaaaaaaaacagctcctttaagtacatttcacttttctttaaatataaactactgttgttttgaattgcattaattttaactcaggtaatatgagaaattgcactgtaattaggcatacatagtaattaaagaaactggttctaatatatgtgttggacttttataatataatttatgttatatataaatggttgagtggaaacttgattctcagagatgaataaagagcaccctaatgctttcttaaatagtaaaccaaactaacaatgtgtcttaactgtgaaggaggtaacttaagactccaggctatcaaacccatccattggtttgtgtctatgatattgcataaaaatgattcagactaagggctatttacaattattctctatgtttcttagtagaagaaggatgagcctttccccataataggcaatgcaatacaacacaactaaattcaacataaatttattgagcactagtgatctcttgaaatcttatgtgacatgacttgagaatttaaacactttaggctgggcgcggtggctcacacctgtaatcccagcactttgggaggctgaagtgggtggattacgaggtcaggaaatggagaccatcctggctaaaccggtgaaaccctgtctctactaaaaatacaaaaaattagccgggcgtggcagtgggcgcctgtagtcccagctacttgggaggctgagacaggagaatggcgtgaacccgggaggcggagcttgcagtgagccaacatagtgccactgcactccagcctgggtgatagagtgagactccgtctcaaaaaaaaaaaaaacaaaaaaacacacaaacactttaaaaaatcaagtgattaacatatgaggattcaaaaaatttttaatttatgtttcataagttatcaaaatagagtctaataattatctcgtttactcattttctcttttttctcagttacattgtggaattctacacttagaatatccaatttagaatttgtaggtaacaaaaaataaaccatataaatcatttaccagatagatttatttaaaaaaatggttttcaattggagtttcatgtcagctctcaccccttgggtttccccagttgtactctgaatttttcagtggtaaagcacttgttctcttacttcattaacttttaaatagaaatggaaattgctaagctttatgggtttatagcttttaataaaaaataggcattaagaatcttaattttttaatattaagaattaaagctacttaaacatcctgaaattaaaagtgcttcagaaagattaaagggttttgaaatcagcaagccatacaatcaatgcttccatctcctttttcattagattgcaatctctacaggtattttttccagccttcacatgaagtcatacatttatgaagataaaataaagaactttttgattagcccagttccacttttagtcattttgtgatgaatgcggcatttcaaactgaagtttcacctgagtgaaaagagtgccctgactaagaagaggatttgtccaaagtattctttatgaagaactgagtggtttaaataaagatttgacctaagcattagttccaatcaaatgtatcatatgggaggagtttttcaaaggaaagagtattgctatatgaaatggtaagaagagaaggagaggaattgctgacaaatttaaatgttctaaacttctgtgaatgtgtatgtgtaaagaactttaatgtatacaagttcttctgcaaatgaattttaggagattagtaaattaaatttagaaaaaattatactactttgctttatgaagaaaataattacaatattaaaaacagagaatttagtttttcatacttttataagcaaatttactagtcatttaaaatttccacttagaggcataaaagtaaaactgtacaacttttgtcttatttagtattatagatattgtgtgtctatatcacattttccttatgtgaatgggggtttcaaattcatgagactttgtttacaggtaatggacaagatttaggataattataaaacaacactggaaatgtccatcaatttatcatttctgcccaaaagcctttacatacactgcatgttaaacttagatgtccacccagaaataaatcaatgtatttacagccaactgattcttgacaaagccaccaagaactttcagtaggggaaaggacagtcttttcaataaatggtgctagaaaaactgaatatctatatgcagaaaaatgaaactagacccctatctcttactatatgcaaaaatcagataaagatgaattaaagacttgaatataagacctgaaactataaagctactaggagaaaacattgtggaaatgcttcaggacactggtctgggaaatgattgtttggataagacctcaaaagcacaggcaacagaagcaaaactagacatagaattacaacattctaaaaagcttcttcacagcaaagaaaacaataaactcagtaaagagacaacttgcagaatgggagaaaatatgtgcaaactctccatcagacaagggattaataaccagaatatataaggaactcaatagcaataataaaataatctaatttactaacgggcaaatgatctgaataaacatttctcaagagaaaacatacaaatggccaaaaggtacatggaaaaaaaaatggtcaacaccactaataaagagagaaatgcaaatcaaaaccacaatgtgagaggagccaagatggccgaataggaacagctcgggtctacagctcccagcctgagcgacgcagaagatgggtgatttctgcatttccatctgaggtaccgggttcatctcactagagagtgccagacagtgggcgcaggtaaatgggtgcgcgcaccgtgcgcgagccgaagcagggcaaggcattgcctcactggggaagcgcaaggggtcagggagttccctttccgagtcaaagaaaggggtgactgatgcacctggaaaatcgggtcactcccacccgaatattgcgcttttcggacccccttaaaaaacggcgcaccacgagattatatcccgcacctggctcggagggtcttacgcccacagagtctcgctgattgctagcacagcagtctgagatcaaactgcaaggcggcagcgaggctgggggaggggcgcccaccattgcccaggcttgcttaggtaaacaaagcagctgggaagcttgaactgggtggagcccaccacagctcaaggaggcctgcctgcctctgtaggctccacctctgggggcagggtacagacaaacaaaaagacagtagtaacctctgcagacttaaatgtccctgtctgacagctttgaagagagcagtggttctctcagcacgcagctggagatctgagaaccagcagactgtctcctcaggtgggtccctgacccctgacccccgagcagcctaactgggaggcaccccccagcaggggcacactgacacctcacacggcagggtattctaacagacctgtagctgagggtcctgtctgttagaaggaaaactaacaaacagaaaggacatccacaccaaaaacccatctgtacatcaccatcatcaaagaccaaaagcagataaaaccacaaagatgggaaaaaaacagaacagaaaaactggaaactctaaaacgcagagctcctctcctcctccaaaggaacgcagttcctcaccagcaacggaacaaagctggatggagaatgactttgacaagctgagagaagaaggcttcagacgatcaaattactctgagctacgggaggacattcaaaccaaaggcaaagaagttgaaaactttgaaaaaaagttagaagaatgtataactagaataacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaacaaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccctaaatcaacagaatatacatttttttcagcaccacaccacacctattccaaaattgaccacatacttggaagtaaagctctcctcagcaaatgtaaaagaatagagattataacaaactatctctcagaccacagtgcaatcaaactagaactcaggattaagaatcttactcaaaaccactcaactacatggaaactgaacaacctgctcctgaatgactactggatacatgacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattcacaccctaacatcacaattaaaagaactagaaaagcaagagcaaacacattcaaaagctagcagaaggcaagaaataactaaaatcagagcagaactgaaggaaatagagacagaaaaaacccttcaaaaaattactgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctaaaagaaatggataaattcctcgacacatacactctcccaagactaaaccaggaagaagttgaatctctgaatagaccaataacaggagctgaaattgtggcaataatcaatagtttaccaaccaagaagagtccaggaccagatggattcacagttgaattctaccagaggtacaaggaggaactggtaccattccttctgaaactattccaatcaatagaaaaagagggaatcctccctaactcattttatgaggccagcatcatcctgataccaaagcctggcagagacacagcaaaaaaagcgaattttagaccaacatccctgatgaacattgatgcaaaaatcctcaataaaatactggcaaaacgaatccagcagcacatcaaaaagcttatccactatcatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaatgaggtattgatgggacgtatttcaaaataataagagctatctatgacaaacccacagccaatatcatactgaatgggcaaaaactggaagcatttcctttgaaaactggcacaagacagggatgccttctctcaccactcctattcaacatagtgttggaagttctggccagggcaattaggcaggagaaagaaataaagggtattcaattaggaaaagaggaagtcacattgtccctgtttgcagatgacatgagtgtatatctagaaaaccccattgtctcagcccaaaatctccttcagctgataagcaacttcagcaaagtctcaggatacaaaatcaatgtagaaaaatcacaagcattcttatacaccaacaacaaacagagagccaaatcatgagtgaactcccattcacaattgcttcaaagagaataaaacatctaggaatccaacttacaaggcatgtgaaggacctcttcaaggagaactacaaatcactgctcaaggaaataaaagaggatacaaacaaatggaagaacatttcatgctcatgggtaggaagaatcaatatcatgaaaatggccatactgcccaaggtaatttacagattcaatgccatccccataaagctaccaatgactttcttcacagaattggaaaaaactactttcaagttcatatggaaccaaaaaagagcccacatcgccaaggcaatcctaagccaaaagaacaaagctggaggcatcacactacctgacttcaaactatactacaaggctacagtaaccaaaagagagatatagatcaatggaacagaacagagccctcagaaataacgtcgcatatctacaactacctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagacaaaattgacaaacgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaacaaacaaccccatcaacaagtgggcgaaggacatgaacagacacttctcaaaagaagacatttatgcagccaaaaaacacatgaaaaattgctcattatcactggccatcagagaaatgcaaatcaaaaccacaatgagataccatctcacaccagttagaatggcaatcattaaaaagtcaggaaacaacaggtgctggagaggatgtggagaaatagggacatttttacactgttggtggaactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcattattcacaatagcaaagacttggagccaacccaaatgtccaacaatgatagactggattaagaaaatgtggcacatatacaccatggaatactatgcagccataaaaaatgatgagttcatgtcctttgtagggacatggatgaaattggaaatcatcattttcagtaaactatcgcaagaacaaaaaaccaaacaccgcatattctcactcataggtgggaactgaacaatgaaatcacatggacataggaaggggaatatcacactctggggactgttgtgggctggggggagggggaagggatagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaaaaacacaatgtgatatcatctcacctgggttaaaattgccgttatcaaaaaggcaaaaagcatggacgttagtaaggatgtggagaaaggagaatgctagtacactgttggtgggaatgtaaattagtatagccactatggaaaacagcatggaggttcctcaaaaaactaaaagcagttgcaccatatgatccagcaatcccactgctgggtatatacccaaaagaaaggaaatgaggatatcgaagaaatatgcactcccatgttcattacagcgctattcacaatagccaagatacagaactaacctaaatgtctatcaatggatgaataaagaaaatatatatttattaatatacacaatgaattactattcagccattaaaaaagaatgaaatcctgccgagtgaggtggcccatgcttgtaatcccattattttattgtgccactgcactccagcctggataacagatcgaaactccatctcaaaaataaataaataaatgaataaaataaaagaatgaaatcctatcattttcagcaaaatggatggaattggaggtcatcatgttaagtgaaataagccaggcacagaaaggcaaatattgcatgttctgactcgtatgtggaaactaaataagttgatctcatggaagtagagagtagaacagtagttgctgggaaaggtggacagggtgggtttgggacatagggggagagtggtggggtggaggtggtggtgttgtgggagatggggatgaagagaggctggttaatgaatatggaaatacagttagatagaaggaataagttctagtactcaatagcacagaagagtgactatagttaacaataatttattgtgtatttcaaaagagctagatttgaaatatttccaacacaaagcaacgataaagacttatggagtaaatctatataaagtatttagaatggcgtctggcaagatatgtgctctataaatttttatcttatacctcttttctcacccctcaccatcttgtcccttatgctttagcattagcacactacttgccttttcacgccactgtgcctttgcacatgttgttccttcgcttagaaagccacaacctgtgcatttaataaatccctgcttgcctttcaaatctcagttcaaacactactttctctgtgaagaaggcctttctttttaactcctgactgacaaagtttctcttctatgtcttcacaggtatctggtatacatctttattataatgagatgagtcatttcccactagactaaaagcttctcaagcatgaaaaaattatttttataccttattttcctcaggacccagtgtattatctgacacacagaaagtattaagatatatatatattgattataaaggaataaaatagtatttccaaatcatctactgttcatgagtaacattgtgctatgaggtatgtatatgtaacgaaaactgtgcaagtacctctattatagtaattactatttgtgagatattgtctatttctccacttgacttacagtctccttgaatggaggttccacgtgttttcatatttgtatctcgaaaagctagcacaaggtctgcaacaaaaaaactcaatggatatttgatgaatgaatgaatgagtgaataaaaatatgattaaatgattctgcagagcagaatcaattcttatgtctggattatcagacaaactcttcagggatggcaaagtcatcacatgctctctggcatctgagcaccatgatggttaataaagaacactaaaatgtatgtctgcctcaataatttgtcaacaaagtcatcttttgtttcctcaactgaaaaactggagatgacagttgctaccatttaaagctttcaaaactgtgctctaattaactgaaagaagttggctgggtgtggtggctcatgcctgtattccccagctctttgggaggccgaggcgggcagatcacaaggtgaggagatcgagactattctggccaacgtggtgaaaccccatctctaccaaaaatacaaaaattagctgggtgtggtggcatgtgcctgtaatcccagctactcgggaggctgaggcaggagaatcgcttgaacccaggaggcggatattgcagtgagctgagatcgtgccactgcactccagcctggtgacagagcaagactccgtctcaaaaaaaaaaaaaaaaaaaaaagaagttaggtgaatataaaggagaccaaaaataaacaaaaaatcctaaaccatctttaggaaaataggcaaaataatttaataaatatatcaacgaagagaaaaacagacaaatattagtgttgacattttggggtaaacaaagttcaaaaatctgtaaatggactgagtgcgtgcatgtgtctgagagggagagaaattacaaatcagaaaaactgtgtttttatattctttttctttctcatttttaatcatattatgagaacatatataagcatacagaaatatttaaaaaatacaatactctgtacaattctataatacattaaaaaatattgatccaaatattccccaaatagtagaaaacctcagaaaacctacatgttcataggcctaagtacacctgaatcaactggggtgtgttcatgtgtgtgtgtgcatgtttgtgtgtgtgtgtgtatgtgttcaaaagtcagaaagtcatagaaaacctcaataggcctttttaaatatagctaaaattttaaagttttcaaatgattacgctgaagaaagatgccaagcacaatttttttccaaacaattctatcttattttcaaagtatagggaattctcatgatataataactgctcaaaggcaaaaaaaattgaaaaagtgccccaggccattttatttatgaagctgccttaagctaatatttaaatctgacaaggatagcactacacacacacacacgcgtacacacacatgcgtgcacacaccacccccacccagtattccttagaaaaacagattttaaaactctaaaaactctagaggctgaatgcaatagcagtttttaatacttccataaaaatgacttaggacatatttcaggaatgaaagatgattcaatattaggaaaattttaaatatagctcatcaacttaattggtcaaaggatacaaatatgtaatcaacactataagttacataaggccagatgtgatacaaattcacatcgactcccaattttagaaaaagaaaaccccattgtagagcataccagaagaacacttaattagaatgaaacatgttttttgagacagctattctttatcttaaacatttgacattctacttatcaatgaatcactagaagcagagttactgaaatcaagatgcatatagtcctagaaaacccagaataatccgaggaaaatccaataaaactgcaaagaatttcattagggtttagttacaacatacacacaacaaaatgattagcttttctatacagcagcagtaggcagaaaatataatagacaaaagcttacattcatgatatcacaatattcatccaaaataaactacctagaattaaccttatatttaaagaaaatgaaatagtttcaggcaagacatttgaaaaaataaggagaggggatattagatgctttctagaaagattcaatattataaaaactttatttttccttagggtaatgtatataagtataatcaaaatcctaaaataaatcatattttctattttgaaacttaaattttgaagtttatttgacaaactagacaaaaatgccaagaaaatattggaaaataataaataaaacacactgtcatatattaaaaatgtacaaagttaacatcgtatgatattgcatcaggaaagaccaaaagattaattggatataatggaatgcacagaagcagactcaaatacatataaatatttggaaaagaaaaggatgtcatgtcaaatcactgggtgatgatttgaaatggcatcattctattcttttattttgttctttattatttagaatatagtactgggataacttgttaactggaagaaagtaaaactgtgtttctatcttacataatacagaaaaatgatttatatagactaagcacttattttatttcaatttccaggatacatgtgcaggacgtgcaggtttgttacataggaaagagggccatggtggtttgctgcacctattgacccatcacctaggtattaagccccatatgcattagctatttatcctgatgctctccctctctccgccccctggacaggccccagtgtgtgttgttcccctccctgtgcccatgtgttctcattgttcagctcccacttataagtgaacatgcggtgtttggttttctgttcctgcgttagtttgctgaggataatggcttacagctagatgaagcacttcttaagtataaagaaatgaaattacaaaagaacaagaaaaagtattgatgacttgaaacatttacgtgtatagcaaagatgaattcttaaagaagagtaatgtatgtgaagaatacaaatttaagatgtccttcttgtaacaaataaaaatcctgctttgtcaaaaaaaaggggagatataaacatatacttgacaaaagaagaaacacaaataggtaataaaaatgttttacgtcattaataatcacagaaatataaagaagtatttacagtcatagaaatacaaaaagtaggtaagtattctggttatcttctgtttgtccctccagattcactctccactggtctccaccttgctttctgccctatgtggcaacctgtttagactgcgtcaagagggactttcaatcctctgctttaaaatgggtacagacaataggaagagtgaggtcacagtattcattcccctagtatattggcttggctgtgtcccttgaccaaaggtcactgtgcttctgaagacagtgctctctacttgcctctcttatctatcttctggtaaccacttattcccttaactaggggtggtaacaggtctgtagctaatatccataatttactccattactgctttcatttccccccaaagtaccatcttgtaattaccatctctaaataaattcattttaagtgtcctaatttgagggtactaattattggtgatggaaagagatacctagtgaatgtataaatcaacattaacttctggagaaaaatgtgtaatatgtattaaaatatgcacatcttttaatctagaaatttcttagaaatttgttctatggacagtcacagattataaaaagttgcacagaaaaaacatttatcaaacatactgtttttcttaaattgtgaaaaacaaaaataatgttaatacacaataaaagaggatagaacaaataaatagcactgaactcatgtaaagaaatcccattcaccaattaaaactatgtttacaaaaaatatttcctaatgaagaaaatgttcaggatatattattaaggggatattatatattatcaagggaaaaaagaccctgtaatactataaattaattatggaccacttttgcgctaaatacacacacacacacacacacacacacacacacacacacaccacacagaaactgcaaaagtggttatttctgagtagtggaattaattttatttttgttcttcctgattttctgtgtttaggttttattcattaatgatgagctacttttgaataattaaaaacataaaaatatgcaacttgttttcaatcagcattattaaactctcttaaatacttcataactatgaatctaattgttttaagataattctgatgaaatgtttacagcaatgtaaaaagactttccaaatgagaagtcatgactatacttataataggtaatagatctggcactgaaaaacatgcagagatgttaaaaagataataaatattatctttaaattcagattgatatggactagctgggtcccccccaaatctcaccttgaactgtagtaatccccacatgtcaaagatagggccaggtggagataattgaatcatgggggtggtttctcccatactgttctcatggtagtgagtaagtctcacgagatctgatgggtttgtaaatgggagttcccctgcacaagctcttgcctgccgccatgtaagatatgactttgctcctcatttgccttccaccatgacaggcctcccgagccatgtggaactgtcagtcaattaaacatgtttcctttataaattacccagttttgggtatgtcattattagcagcatgaaaagagattaatacagtaggccaggcgccgtggctcatgcctgtaatcccagaactctgggaggccaaggcgggcggatcacctgaggttgggagtttgagaccagcctgaccaagatggagaaaccccgtctctactaaaaagacaaaaattagctgggcatggtggcgcatgcctgtaatcccagctacttgggaggctgaggcaggagaattgcttgaatccaggaggcggaggttgcagcgagccaagatcgcatcactgcactccagcctgggcaacaaaagcaaaactccatctcaaaaaataaataaataaaaatacagcaaattggtaccagtagagtgtggtgctgctgtaaagatgcccaaaaatgtggaagcaagtttggaactgagtaacagacagaagttggaacagtttggagggctcagaagaagatggaaaaaggtgggaaagtttggaacttcctagagacttatgaatggctttgaccaaaatgctgatagtgatatgaacaataaggtccaggctgaggtagtctcagatgttgacgaggaacttcttgggactggagtaaagatcactcttgctatgaaaagagactggcagcatttgcccctgcactagagatctgtggaactttgaacttgatagagatgattgagggtatctggtggaagaaatttccaagttgtaaagcattcaagaggaagcagagcaaaaaagtttgaaaaatttgaaggttggcaatgtgataaaagaaaaaccaattttctgggaagaaattcaagccagctgcagaaatttgcataactaatgaggaaccaaatgttaatcaccaagacaatggggaaaatgtctccagggcatgtaggagaccttcatggcagcccatcctatcacaggcctggaggcctaggagcaaaaaatggttttgtgggtggggcccagggccccactgctctatgaagcctcatgacatggtgccctgcaacacaactgcttcagctccagccctggctaaagggggccaatgtacagctcaaggctttgcttcagggggtgcaagccccaagccttggtggcttacatgtagtgttgggcctgtgctgcacagaagtgcacagaagtcaagaattgaggtttagaaatatctgcctagatttcagaggatgtttgagacacctggacgtccatgcaaaagtttgctgctggggcagagctctcatggaggacctctgtagggcactgcctaatggagctgtgagaagagggccacagtcctccaaatctgagaatggtagatccactgagagcttgcactgtgagcctggaaaagccacagacactcaatgctagctcatgtaagcagctgggagtggggctgtaccctacaatgccagaggggcagagctgcccaaggctatgggagcacacctcttgtatcatgtgacctggatgtaagacatggagtcaaaggagatcattatggaacttaaagtttaatgactgccttattggagtctgaacttgcatgagacctgtggccctcttgttttggccaatttctcccctttggaatgggtgtatttacccaatgcctgtacccccactgtatttgggaaatgactaacttgcttttgattttacaggctcataagcagaaaggacttgccttgtctcagatgagactttggactgtggacttttgagttaatgctgaaatgagttaagactttgggggactgttgagaaggcatgattggttttgaaatgtgaggacatgagatttgggaggggccagggacagaatgatatggtttggctgtgtccccacccaaatctcaccttgaactgtaataatccccaagtgtgaagggtggggtcaggtggaaataattgaatcatgggggtcctttcccccatactgttctcatggtagtgaataagtctcatgagatctgatggttttataaatgggagttccccttgcctgctgatatgtaagatgtgactttgctcctcattcaccttccaccatgactgtgaggccttcccagcaaatggaactgtgagtcaattaaacctctttcctttataaattactcagtcttgggtatatctttattagtagattgagaacagactaatacacagaaaaagtccaaaaatgataaaaagagatcattaaataggacaggctttcatgcattcaaggctggaaaacacacaaaagataacatacacaagtcaataaaaaatgttttaggttcactgaaatgtttcattggtaaggcctactctaccatttacatgaagaaatttttaaataaactgatgtttatctacattttcacaaaacatatttagaatttagagaaaagggcccattggctacatgtaagaatatttaggctggtcgtgatggctcacgcctgtaatcccagcactttgggaggccgatgtgggccttggccacttgaagtcaggagttcgagacaaggctggccaacatgaaaccccatctctaccaaaactacaaaaattagccgggcatggtggtgggtgcctgtaataccagctactcaggaggctgaggcaggagaattgcttgaacctgggaggtggaggctgcagtgaatgcagatcatgccactgcactccagcctgggcaacaagagtgagattccgtctcaaacaaaaacaaaaacaaaaaaaaaaacaaaacaaaaagccaaagtaggcatattggtaaggcaggtaacatctttcaaatagctgactaggtactaaatagtttgtttcaacataatgacagtacactttttgttttgaggacaatgtataaaagtaaaactctgagatttttttttaaagtgacgtataatgtttctaggagggaaactggattaatagaaacatgctaatgaccacagagagccaggtacaccaacagcttaaattccttatatttcatttgcatattctgtggtaattataatagcatcctgcacagagaaggtgctaaaaggtttgataaatgaatgtatgtataaaagcatgctgagtgatgttgtccctaaaaggctatactatgctagtctgctataagtgaagctaccaacaaaatctgtccaaggactaactgagaagggacagagtgactctactacttctgactgtcaccccaacatcccttctcctcctatcctttataaggagataggtttggggaagtggggaattgactttgtggaaaacacagtatttaagatacgatgtacttccattcctaaactataggttagagtagtgggcatttttagccactcaaattctccccttgcaaggcaaatgtgtagttcccaggacaatcattgtagagatttgggcatacctaaaataaggcatgggtgacattctacattgcagtggaatgtctacttcagcagaagacattaatttaccttgtacctctctgagcaggtgagaagtagggagagagatggtagtactgacagagtgggtggtaggcacctaccttcttgacttttctttcctaagctgtaaaatgagaatgatgctgctcttctatttacctcacaaaaatactgtgagaatcaaccagtacagtcaatctaaagtgcttggtagactgtagatctttacataaaatgttattaaaattggatcccaaatgaagcaggtttaatttcctgataaaatcgtcttaatatcatctaaatgttgggtaatcattaattgacaaatagttgatgaactagcctgtgctggccattttgagaaagatgaaatatcatttctacctcaaagactccacaatccagttgggaaggcaagactaacaggaatgaattagtaataaaactatacaataataatagaaaatatatagatattttatatataataaatgtatacttgtatacatttacttactcatttaagtcttacaataatcctgagggaggttctattattttattcatattatagataaggaaattcaggtgcagagaaggtaaaaacctgccaaaggcaatataacagtaacagaatcaggattcaaatttggtcagtctggctctggagaatgtacacttaaccacatcactaccctgcctctcttgtaagattccatgtatggaaccaaaggtgcatactatgagaactcagggaaagagtgaaacacaatatgggcagaagtagttagtaatatattggtggagtaagtggcacttgagtaaggaaaaccaagtagggtttggaaaagaagaaaagagaaggaagactgttgtagaagtgggttactataaaagctctggaggagcgcagaaaaatttgataaatagttactgaatacctattaggtaccactcacggtacttgggatatttcaattaacaaaacaaagatacttgttcttataaaagttaaagtcaatgggtgtaaaaatgacaatggagagactagtctcactgaattgaccatccatcctgagaatcagagaaaatagtattgaataggtagacaagtgccagattatgagatctctgaaagacagagaagtctgaggatatagatcaaacttacagatatgtactgcaggatttttcgaggaatgtgtcacatagtaataacagtatcttaggaatattaatttggctgtttttccaagaatgaaatagaaatgggaaaaattaaagggagaaagacttgctagaaagtgtattttattaatatctagattaagtgatggcattggtaatcgagagctttgctcaattctttatctcctttttttattcagtttttcctttactgttatttttccttttctgttatttttccttggtctataaatacatgcaattccatccatctacagtaaacagaaggtaaattaaaacaataaataataaaactactcttcaaggagtgaatcactcccaagctactacctctctacctccttctcatctctattttctccttaccattgtctcctgaactcactgcaacttggtttctgtcatgatacaggaggagtagttcatttggccagaaaagaagtggaaaactggggaacgcttctttgaaaaggtaatatttcagtggagattgaaaggatgaataggagtttgccgtataaataactgggggttttcaagtatagtattctgtgtgaaattgggaaggtacttcgattctatttctaaggcactggttctacctttaggaggtatgctgaagaaatcctctcatttaaagtctttttattctccccctcccccaccaacttaacctggtatgaatgatgcagaaagttcagtcagcatcctattttaatttgaatcctaatttcctgaagcttagttcacaaatagccaatcaaagtttctcaggtttatagcccctactctataaatcactgccactggtctctttcaatataccatgagctcctgttttcatacctccattgcccagcagagagcctggaactcagtagctattcagtaaaattggttagattaatgaaatgataaagaaagaaagatagatgtatgagagcctgtataggaaaatacagaaagagaaaatatacaggagttaaaggtcaaggatgagtgaataatggctcttaagttttgaacatggttgattagaaaaaaagatattaacagtgacagatggcagataaagggaagatatgtttaaatctagatatgtgaaactgagatggtacagtgacacttgtcactgtcaaagatgtggttagagataaaaagtggcatctggaagaagtcatggttagaatatcatattcttggaatgatcagcatagaaattgcagtttaggttatgagaaaggataaacaatttaaagaaaaaagaaaaaaaattgacaaatatctcaattttggcaggcaatctatataatgctgagaaaaatcttaaattgtataatattaataagacttgtaaaaacataaatttgagatttttagggtaatattaatcaattctcatttttccaaatgtttacaataaacagactctaatttcatagtggtaggtatttcaagctcatgcaagagggggtacaggctttgtaaatggcacagactatcactctcaaaggaattttaacaagaaaagttaccttcaaaaactatcaatctacaaatatcattttgatccatatatttaaaacaataaattgtttcagtgacattttcaagttttcatttctccctcttagttttaaataggaagaggtttctattcataaaatttagaaatacagcatctgatgtggagtttgaaataactatcatactctgaaagctgcatagtatagctctcacactagagagaatctcctcccctcaaacagaagagagacaacatacatgaatatgaaatataaagaaaagtagagacagattttttttttcagtgattagagactttatgctaaaacgttcacagatgtactctggaaaaattgtgtacaagctaagcttctgtaaagagagtaattttttctttgctatacggtatcattctggagacattttatctctctgggcctcagttttctcaaatgatgggcaggagtagacagtatttgtacagtcatgtgttgcttaacaaagggaatatgttctaagaaatgtgtcattaggcaagtgtgttgtgcaaacatcatagggtgtatttacacaaacaaagatggcatatatacttatttcatgtattttttaatatggaaaaccaaatgtcgcagaaccattactgaatatcaattatttcctctagttgatctgtaatgccagtatcaattgctatatatcaggtttctgtatatgctctatcataatctcatgggaccacggtcatgtatgtaatccgttgttgactgaaatgttgttatgtgctgcatgactgtattttctattaagtatataattctattaccttattttttaaatttatattcaactggcaaaaggtcccaaaactcttgcttactttctgagacaaaagttaaaaaccaatacataatacttaatgactccactggagtttctatttaaggagattcagaagtgattctaattatgagactcagttaagtgttgttcatgaacatggcatgcttatataatcttagatcaataagaacttgtttatttgaaaagacaaataattgggaaatatttcatacagtttaagtggaagaggttacagtaagtgaagaactctagtgtcactgacttataaggcaaaaacagggtcaaagtggcaatgtagggtggtgttggtgttggtgttgctttgctactaggatatacgtttctattaatatccagaaataattatttaaaataaaaccagaaccaggtaagtttcctacactcaggtgaacaatatgaaaaagttaatgagagcagccctacttagctggataacttctgaaggtagaacttttgataattttcttctgaaatgtgatagagatgctattcacacagcaccgttatggtcaagtttcaatggcaatactgatctggagtttcagtgagtagagtcagctggtgacaagaggtcacagtaatttagttagtagaactgatgttttcatctcaaactctaattttccaaggtacaatcttgaattgggctgctgactatattacccttcactctcacccttatcctcttccttgtatactaaagtgattagtgctagcatttttgctctggtcctccttgtcacttggaatattctccttgcccccacatcactctcctcactagataaccaaaggatgtcaactaaatgatcaaaatactctctggccagacacttattccctgaggaagaaagtctggagatctgcctctcttcattctcactgctgtgccaaatacaaggtaaacaaggtctctaaagtacttgtgatattaactgttattgccatgattgatttctgggaaatattcagctaatatcatgcatcagccaaccatttacatttgaatgcaattaagatgtcccaaataaaggaaaattcaaaagtttcagcaataaacacaaaagactgtttaacattttaaatgagaaggaagagtattcagctgtctctaatctttaatcatttattttaacacaccacaaatcatcccagatgattcttacaagaatatagctacagaagcatcaatgtctacaatgtgtttagctgtgaatactgcaaacttcttttaaataggagaaaaaattctgatttttatgagatcagaaaggttatgtacatgccacagccaaccttaaaaccagagatcatagagatgtactttgagtttgtaatagtatgacatatattatggaatatgaactcataaatttgaatggttcctttctataacattaaattggttggtacacattttttcatattttcttattgaaaataaaagcatctcaggggtaagctaattattcatttaagctctgaataaagttctacattctgaaacacaaattgggcatgaacaagtacaggatttctacaagaaaatataacaaattattttatgtacaaaaagcctgttaaatataatagcagttataatgaattaaaattatcagctatataataagtgaattgtaatagatgtatataatagatgaattgtaatagatgaattacaataatatttattgtagatatattcaattttacagttgttaaattaaaaaaggtcttcatatcttcctgttggtttactttaatatgcaataaaaggtaatctaagacaagaaaaagtatttgataaatggagttatgggcaatatttattgtggtgaagtaaatctttaaaatactatagtgtctataaaatgtacagatacatttcaacacatatattttatttaaaaaaagtttaagttcttttgcatttctggccacattgccagagatatttgaatgtgtttacaggcatttttcatataaataaaataaaatagctattctattgcaaaaccagatgataaatttattggttaaaacacatgaggctactttaattgaaatggtaataatgctacaaataaaaaaaactacatataatcaagaattaaccaacaaatgacaaatgggaatataaagccacaagttggtactagcctctcaagaaagaaaatttaagagtacttattattgtgtatcactagaaacaacaatcacctttccaaacaatccaggtacaaataatgtcttagttttaaatttaactgaaatttattatttaactttggctgaaaaattttcagtaaggtttcattgtttttcaagtctagttaaattttttttttttctaattccctctcaaatcacaggattgctcattctatgaatttctgtaatatctccacccagtggtgatcagagactttaaatatacccttgacttaaaccgaaagtttggtagtttctgataggatcaaggccctccacataaatagaaattaggacagagcctagatttaaagctggctctaaaatcaaaatagtctaaaatggcaaagctcagtaatccatagtcatggcttatatttagttcctattgaataccagacagtgtgttgataagatatatgataaaactctcaagaaatcagaatgcatgatacttttatgacataataaaatttatctctcaagcaaaaagacagcaaaacaatagaaacactgccatttaatgtaagtgtaagataaagatgtccaccattaccattgttatttaatattgttctagagaaaaaggtgaagcaattaaataatagaaagatataagatgtataaaattgaaaaaggtaaaattataatttgtagatgataaatagaaaatttgaatcaaatgaaaaataattacaaataatgagagaacagtaatatggctgataaaaagtaataatggtaatggtgaaaacttgcagagtatttatatataccagcagtatatataaatattctccatatattaactcaatcctcccaataatcctctgaagtatataatattattatcaccattttatgaacaaggaaacaggcacagaaaagtcaagagaattgttcaaggttacacagctggtgtggcagtgctgtgattcaaaagtttaagagtctatgtccttaatcactatatcaaactgttggtgaaatcaacaatctttctatgtatcaaaaacaatcaaataaaatgtaatgaaataagatatcccaataataacaacaaaaggctaaaatatctagtaataaccctgaaaagaattatctagaaaaccttaaaattccacagaggatcctaaaaaggaggaccttaaatggaaagacataccctgtttttggaaaaaataatcatgccataggttaattttcttcatttagctataagtttaattcaatcacaatactaaaataatttttcccaagggataaagaaaaaagaaagctaattctacaatttatgtagaaacacagcaccaaacacatggtataattataatcttaactcttggtactagaaaagtaataaactaagaaatatcattttaaccgaaaaaaggacaaagaaatagcaaaatacatgtgggaatctagtttatcataaaaccatatttagaatcaatgggttatccaagaaaataaagattatttttattaactaattcaaatatccatttgataagtataaaagtttaaaatttgttaattaagtcaaatctgtcaggactatttagcttcgctttgctaagtgttctagttaatttctgtaggatatctaaacaataatctataattcagatagatgtattttggaaaaacttcagtttagcagggtttttaagttgctcatttttggtttggagaacaaaggatgaaacaacatttagcagtaattctctaacagatgtgacaatgctgcagataaaagcttctttttcctttttcattatgtaccttgctttattaaattctgtgttagcacctgtacaaagcaggttgacaaactgaatttttagcagtaagtttatatgtaatttttgaatctcatataacatggcctatttattttgcacattttataggaaatcctgagagaagggctggaataaacagggcatttacatactaggattttaaaatcagtagactcactgaatcctttatataacaactgtgtctgttgttgctagcctttccgtagaattgtgccaaaatccatttctctttaaatgccaaggatgtcagagatacatgaaatgacatccttgaactttaaggctgcataaggaagatctcagtgcaagaccccagatcttcattagcaagttagaattaccctatctgtgcccatcactcttcatgaagaaaatatattctatagactttctggtggaaaaacatcactacaggagctgtctcaaatcaatactgagttaagtcaggctgcaaagaaataaaaactgtcaccagcataaccttcctagcaactgcaatgtgaatatgttaatactgtgtcaaggcatagccctgatgtctgtaggaagcgtgcctttgtttcaaatcagttcagctactagcttgggacaatcctaagtgaaatactatatcctatatcatgacaatgttatttttaccaacgataacaataattcatatttattttcttcttttgtgtttctcatcaagaaatccatcccaacattcttctaccccaaatttctaaatatctctttcttttcttccccacaacccaccaaaaaaccccaaatcttcctcaatacaatatattctagaaatactctagtgcaactcttatctggctctgggtgtttttcctgcccctttttcacttgttgtgcttacagggcactgctcaattcagaagacacttgtgcatacttcaatttctacattgagaaaagtggcatttactcatttgatgatttaggatgagaaaacccagagatttctataacttagaggaagaaaacatttttactatacgagtacaaattatgatttcccgaagataatgtcacaaaaaaggaaaatagtaaatgtctttaaatatagtggcaaattaccatgtaaattttctattttctaagcttcagactgctgcagtgaaaaaaaatttgatttttaaaatcagaaatatttaggttggtgcaagagggactgcagtctttgtcattaaaagtaaaggcaggccgggtgccgtggctcacccctgtaatcccagcactttgggaggccaaggcgggcggaccacctgaggtcaggagttcatgaccagcttgaccaacatggtgaaagctcgtctctactaaaaatacaaaattagccgggcatggtggtgcacacctgcaatcccagctattcgggaggctgaggcaggagaatcgcttgaacccaggaggcagaggttgcagtgagccgagactgtgccattgcacttcatcccgggcaacaagagcgaaactctgtctaaaaaaaaaaaaaaaaagtaaaggcaaaacccgcaattactcttgcaccaacctaacatatgaagaatcactgagtaaaagaaatggtaaccatgcatcgctaattaacagtttctggaccaggaaatagagacttatccttaagttactgtgttacacttacttatttatactctgcctctttccataaaggatttcagacaactattgacttagtatacccttccaaacaatctaatacattttttaaaaatcctgcctttactttctggtgtttgaattaaattatgtcccaaatttggaactgatatactgtgggaaaggaaattgatataaaatgataaaaatcttgttaactgtaaattgaagagctctgtttcgaataaaagttgagtaagttgagtctggaaaataaacagcacagttgtagggggcatggcaggggcattgctcaacttattctcctttgtctgaattgaggatatgttcccagacacctctcctcatgtaccctcaattaccaaggtaattggaaaagatgcagtccatgctactatgaaatggggtctctgaagacctctctgtaattgcaaagcccttcacaagctgaagtgttgaaaagtgcctggcacatggtaggtgtacaataaatgctgaatgaataaaacttaagtcaaaattcttttaaaattatgagagggacaaaaggaaaagtaagtctgttctttttaaaaaaatgattatctttcttttggcttttccttaatctcaagcaatattttctcttgcttctttacatttctcctctaacttgttcatatttttttgggctgggcatggtggctcacgcctgtaatcccagcactttgggagaccgagacaggtggatcacctgaggttgggagttcgagaccagcctgaccatcatggagaaaccccgtctctactaaaaatacaaaattagccaggcatggtggtatacgcccataatcccagctactcaggtggctgaggcaggaaaatcgcttgaactgggaggcggaggttgcagggagctgagatcgctactgcactccagcctgggcaacaagagtgaaactccgtgtcaaaaaaaaaaaaaaaaaggccaggtgcggtggcttatgcctgtaatcccagcactttgggaggcctaggggggcagatcaggaaatcaagagattgagaccatcctggccaacatggtgaaacctcgtctctactaaaaagacaaaaattagctgggagtggtcgcgtgagcctgtagtcccagctacttgtgaggctgaggcaggagaattgcttgaacccaggaggtggaggttgcagtgagccaagatcacaccactgcactccagcctggtgagacagtgagactccatctcagaaacagcaacaccacaaaacaaaacaaaaaaacttgttcatatttttaagttttcaggagaaagaacatttcaatttgtggtgctttccatggcatataacaactgtgtttatactcatgctcacacatattcacatattaacaccatgtaattacaacaagcctaccttggagatatggagggttcagtcctaaaccatgacaaaaaagtgaatattgcagtaaaattagggacttaatttttttgatttcccagtacatatagaagttgtttatactataatctattagatgtgcgaaaacatgatctagaagaagataatgtatgtcttctcttgagaagtgtctgttcatgtcctttgcccacttttttaatggggttgtttttctcttgtaaatttgtttaagttccttatagacatgaacagatatttttcaaaacaagacacatatgtagccaataagcatatgaagcaaatcttaatatcactgatcattagagaaatgcaaatcaaaaccacaatgagataccatctcacaccagtcagaatggcgattactaaaaagtcaaaaaaacagatgctggcaaggttgtagagaaaagggaacacttacacactgtttgtgggagtaaaaatgagtccaaccattgtggaaagcagtagggtgattcctcaaagagctaaaagcagagctcccattcaacccagccatcccattactgagtatatacccagaagaatataaatcgttctaccataaagacacatgcatgcaaatgttcactgcagcactgttcataatagcaaagacctagaatcagcctaagtgcccatcaatgacagactggataaagaaaatgtggtacatatacatatacatgtaatacatatacatatacatatacatgtaatacatatacatatacatggaatactatgcagccacaaaaaagaatgagatcatgtcttttatgggaacatggatggagctgaaggctattatcctcagcaaactaatgcagaaacagaaaaccaaatactgcatgttctcttataagtgggagctaaatgataagaacatatgaacacaaagaaggaaacagacactggggtctacttgaggagggagagtggaaagagagagaagaacaaaaaaggtaactattgggtactgagctcaatacctgggtgatgtaataatatgtataaacccctgtgacacgtgtttatctatgtaacaaatcttcacatgtatccccaaacctaaaataatagttaaaaaatactttattgctaaaatatgctaacggtcatctaagcccccagcaagtcataatctttttgctggtggacggtcttgcctcaatgttgaggacttttaactaatcaaagtaatggttgctgaaggctgaggtggctgtggctacggcagcttcttaaaataagacaacagtgaagtttgctgcatcaatggactcttcctttcacaaaagatttctctgtagcatgcaatgccatttgatagcatttcacccacaaaagaacttctctccatattcactcctctcaaaccttgctgttgctttatcaaataagtttacataatattctaaatgcattgttatcattccaacaatgctcacagcatctgtaccaggagtagattccattctaagaaactttttttgctcattcttaagaagcaactcctcatccattcaagttttaccatgagattacagctactcagtcacatctcacattccagttctaattctagttctctatttctaccacatctgcaatcactacctcagtgaagtcttgaactcctcaaagttatcaatgagggttggaatcaacttcttacaaacaccttttcatattgatattgtgatctccttccatgaatcacaactgttctgaaaggcatctagaatggtggatcctttccaggggatttcaatttactttgcccagattgatcagagaagtcactatctatggcagctatggccttacaaaatgtatttcttaaaaagtaagacttgaaagttgaaatgattgcttcatccatgcactggagaatggatattattgttgcgggaagtcagggaccccaaacagagggaccggctgaagccatggcagaagaacgtggattgtgaagatttcatggacatttattagttccccaaattaatactttcaaaatttcttatgcctgtctttactgcaatctctaaacataaattgtgaagatttcatggacacttatcacttccccaatcagtacccttgtgatttcctatgcctgtctttactttaatctcttaatcctgtcatctcataagccgaggaggatgtatgtcccctcaggaccctgtgataattgcattaactgcataaattgtagagcatgtgtgtttaaacaatatgaaatctgggcaccttgaaaaaagaacaggataacagcaatgtttaggaaacaagagagataaccttaaactctgaccaccagtgagccaggcagaacagagtcatatttctcttctttcaaaagcaaatgggagaaatattgctgaattctttttctcagcaaggaacatccctgggaaagagaacatgcgcctgggggtgggcctctgaactggcccccctgggcgtggccatcttctatggtcgaggctgtaggggtgaaatataccccagtctcccatagcgctcccaggcatattagcaagaggaaattcccacctaataaattttggtcagaccagttgctctcaaaacctgtctcctgataagatgttatcaatgacaatggtgcccgaaacttcattagcaattttaatttcaccccagtcctgtggtcctgtgatctcaccctgcctccatttgccttgtgatattctattaccttgtggagtacgtgatctctgtgacccacacctattcgcacactccctccccttttgaaagtccctaataaaaacttgctggttttgcggcttgtggggcatcacggaacctatcgacatgtgatgtctcccccggatgcccagctttaaaatttctctcttttgtactctgtccctttatttctcaaaccagctgacgcttagggaaaatagaaaagaacctacatgactatcagggcaggttccccaatatattatgttatcattcatgaagacaatatttattttcctgtacatatccatcagagctcttgggtgatgaggtgcactgttataatgagcagtaatattttgaaagaaatctttttccctgagcagtaggtctaaatagtgagcttaaaatatttagtaaaccacactgtaaacaggtgtgctgtcatccagacttggttgttccatttatagaacacaggcagagtagatttagtataattcttaagagccctaggattttggaatggtcaatgagtattagcttcaactgaaagtcaccatctatatcagcccctaacaggagagtcagcctatcttttgaagctttgaagccttgaagccaggcattgatctcttctctctagctatgaaagccctagatggtatcttcttccaactgaaggctgcttcgtctacattgaaaatctgctgtatagttgctagattttgggattacttccttcagcttctccaccagtacttgctgcttcaccctgtacttttacgttttgaagacagttcttttcttaaatcttatgaaccaacctctgctagcttccaacttttcttctgtaccttcctgatctctcatggccttacagaaccaaagagagttagggctttgctctggattaggctttggcttaagggaatgttgtggctgactcaatcttctatccagaccactaaaactttctccatatcagcaggaagtctgctttgctttcttatcatctgttgttcactcgagtagcatttttaatttcctttaagaatttttcctttgcatcacaatttgcctaactggtagaagaagtctagcttttgggctatcttggcttttgacatgccttcctcactaagcttaatcatttctagcttttgatttaaagtaagagatgtgtgattcttcctttcacttgaacactttgagtccattatagggctactaattgatctaatttcaatatctttgtttctcaaggaatagggagacacatgaagagggagaaaaatggaggaatggctggttgggggagcaatgagaacgcacatatttatcacttaagtttgccattttaaatgggctccgtttgtggtgcaccaaaacaagtacaatagcaacatcaaagagcactgatcacagatcaccgtaacagatataataataatgaaaaagtttgaaatattgcaagaattaccaaagtatgacacaaagacacaaagtgggcacatattgttagaaaaatggctccattagacttgcatgatacaagggtactaccaacttttaatttgtataaaacagcaataacagtgaaagtgcagtgatgagaagcaaaacaaactcaagtgtgcctttactgcatatcttctaagttgaagtaatgggtttaccttttactgatttcaagaaagaaaacataaagcagggaatgtaacttttttgagtcctggatagatttctcactctaatttatttccacatgaatgactttagaaattctgttgttcctgtttagaaactgctttcacaaaatggcgtaagaagagtgggggagtcagggagacagaattaaaagagagttgccctttggcagtaaaaataaaaagagaggcttagagagtgagtaggctgagattgttgaatagtgaaaagggctgttgcttttgttcatgaagaaaaagttaacttgcggcaaaaggttagaataataacaataaaacaagtagactagtataaaaatacacacaaaagcacaaaaataacactatgatcacaaatatgaatgccttattgagatattttcccccatatgaataatcatttgtttagttacaaagatatgagttgtgagaaccctgtatgcacatgttgttaagcaacacatagggactttagtaaaaacataagttacaggagatacccctcaatcactgatttagtagatatgatgtgtgcatcgagtcctaaaaatgcactttcaacaactattatagaagatttttgaggaccatttttcagatacattgctttacagaaaatagagtaaaacattagctggaatgaactttctgttaattcactaaaaaaattattcaataccaactatatgctaggggctaagataagcactgggggtacaggggtgaacaagatccaatctctcccctgtgcctggatgtggaataaatgataaaagaaacacaaagataagtatgtaattataatccatgccatgaagacaaagtagaaagagctagcatagttgatgaataaggaactgtgactaaattaactgaatgctttgttgaaatgagagttaacactagtataaccttttttgtagtaactacatcaaataaatacaaatatattgagaacatactatttctcagagctttgaattaagctctgagggtccaatgataagaacagtcctttccttaatgcacccataagttaccagtgaagaaagaaaggtaggtttttatgtatgtatgtttgcttttcaaaacttttattttttatttttcattttttaatttttgtgagtccatagtacgtaaatatatttatgcattacatgagatattttgatataagcatgcaatgcataataataattccatccaggttaatgggagtccatcatctcaagcatttatcctttgtgttacaaaaaatctaattatacacttctagttattttaaaatgtacaattacattacttttgattataatcaccctgtgcaccagcaaatactaggtcttattcattcttttgaactatttttttgtaccaattaaccattcccaattctcaacacacaccccacccccactacccttcccagcctctggtaacaatccttgtactctctatatccatgagttcaatttattttaatttttatcacccacaaataagtgagaacacacaaagtctgtctttttgtgcttgacttattttattgaaaataatgtcctccagttccatctgtgttgtcgcaaatgacagaatgtcattcttctttatggtcttttgtggttgcatataacaaccaattctaaacaattttagaattgtttcttctatttctgtgaagaatgccatcagcattttaatagggattgcattaaatctgtagattgttttgcgttgcatggacatcttaacaatattaattttttcaacccatgaacatggaatctctttcctttttttgtatcctcttcaatttcttgtattaatgtttcatagttttcactgtagaggtctttcacttctttggttaattcctaagtattttgttttatttgtagctattgtaagtgggattactttcctggtttcttcttcagattgtttgtggttagcatataaaaatgcttctgatttttatatatgttgctttttaccctgcaactttgctgaatttatcacttctaatactgttttttatggagtctttaggtttttccaaataaaagatcatgtcatcttcaaacaaggataatttgacttctttctttctaatctagatgccctttatttttctctttgtctaattgctctggctagtacttccagtagtgtgatgaataacagtagttaaagtgggccatgcttgttacattcttgatcttagaggaaaggctttcagtttttccccattcaacatcatgctcattatggtccgtcatgtatggtttttattgtcctgaggtatgttccttctaaacccagttttgtgagggttttttaatcataaaaagatgttaaattttatcaaatgtgtttccagtatcaattgaaatgttcatatggtttttgtaccttattctattgatatgacataacacattaattgatttgcatatattgaaccatcgttacattccagggataaatcccacttggtcatgatgaatgatcttttcaatgtgttgttaaatttggtttgctaaattttttttgagaatttttgcatcaacattcatctgtaatattggcctacagttttctttttttgatttgtgtttatctggttttggtatcagggtaatactggcctcatagaataagtttggaaatcttccctccactatttttcagaatagtctgaatagaattggtacacgttctctttaaatgtttgatagaattaagacgtgaggccactgggtcctgtcatttctttgctggtagaatttttattatggcttcactctcattacttgttgttgatctattcagattttggacttcatcatggttcaatcttggtaggttgtatgtatctaggcatttgtccacctcttctagattttccaatttattggcatatagttgctcgcagcagctgctaatcctttgaatttctgcaataacagtagtaatgtctccttttaaatctctgtttatttggatcttctcgttttttggttagtctggctaaacatttgttaattttgtttaacttttcaaaaaaaccaactctttgtttcattgatcttctgtactgttttcttcatttcaaattaatttatttttgctcttttccttattcttttcttctagtaattttgggtttggtttgctcattttactaattctttaagatgcatcattaggttatttatttgatgtttttcttcttttttgatgtaggcacttatagctattaacttccctcagtactgtttttgctgtacttcataggttttatgttgtgtcgccattataattcatttccaaataattttcaatttccttcttgatttcttcattgacctactagtcattgaagagcatgctgtttaatttccatgtgtttgcataaatttctcttgtaattgatttctagttttattccatgtggtcagagaacatgcttgatattatttcgattttctgaatgttttaagatttgctttgtcttaaacatatggtctatctctggatagagaacatatggtctatctcagaataatccatgtgatgaggaaattaatatgtattctgtggctgttgaatgaaatgttctgtaaatttggtccatttggtctataatgcaggttaagttcaatgcttctttgatgattttctgtctggaagatgtatccagtgctgaaacaagagtgttgaagtctccaggttttattgtatgggttccatctctctctttagtgctaataagttgggtactccagtactgaattcatatatgtttacactgcttatatatcctcttgctgaactgacccatttaccattatataatgactttcttcgtctcttcttagagttttttttttccttgaattctattttgtctgatgtaaatatagctactccagctcttttttggtttccattggcatgcaatatctttttccatccccttatttttagtcaacatgtgtctttataggtgaagtgtgtttcttgtaggtaacaaacagatcattaggtcttgcttttttaatccattcaaccattctatatcttttcattaaggagtttattccatttactttcagtattattgataagaacttacccctgccattttgttatttgatttctggttgttttgagatattctcttccttctttccttccttcctgtcttccttttagtgaaggggattttctattgtgatatgatttaatttctttttattttttatgtatctgtggtgtgttttttgatttgacgttaccatgaggctttcaaataatatattataatccattattttaagctgataatattaacactgtttgcatagaacaaatgaacaagcaaaaagaaaattaaaactctacacttagttcccctactttttagctttttgtttttcctgtttatatcttaaagtactgtcaatgtcttgaaatgttgttgtagttattatttgacatgatttggacatgtctctccacccaaatctcatgtcaaattgtaattctcaatattggatgtggggcctggtgagaggtgattggatcatgggagtcatttctcatggcttaacaccaccgtccttggtgttgtcgtcgcaatagtgagttcttgtgtaaagtatgtagcatctcccccctctcttattcctgtttctgccacgtaagatgcctgctatcactttgccttctgccatgagaaaaatttccttgaggcctccgcaaaggcagacaggtgctgccttgcttcctgtacagtggaactgtgagtcaattaaatttcttttctttataaattacccagtctcaggtattttattacagttatagcagtttgagaatgggcaaatacattatttgtgattgggtcatcattttgtcttcctagttagtataagagtagtttacacaccagagtcacagtgtgataatattctgtgtttttctgtgtactattactagtgagtttttttttttaaccctcagataatctattactcattaaaagtcttttctttttgtttgaagtactgcctttagcacttgtaggataggtctggtattgatgaaatccttcactttttgtttgtctgggaagttttatttctcattcatgttttaatgacatttttggaggatacactattctagggtaaaatttttttttttttcagcactttaaatatgtcatgccactctctcatgacctgtgaggtttccactgaaaagtctgctgccggacatataagagttccattgtatgttatttgtttcttttatccttttaggatcctttctttatctttgacctttcagagtttaattattaaatgccttgaggtagtcttctttgaatcaaatgtgctagatgttctataatcttcttgtacttgaatattgatatctttctctacatttgggaagttctctgtaataattatcactcattaacatcctttttattcaaaggggtaataactttctatccctatctgtgtttctctctcctctttaagtccagtaactcttagatttgaccttttgaagctatttcctagaccctataggtatgcttcattgttttttattcttttctcttttgtctcctctgactgtgtattttcaaacggcctgtcttcaagctcactaactccttctgcttgatacattctattagaggactgtgatgcattcttcagtatgccaattgcactttttcaagtatagaattcctgcttgtttctctttaattatttcaatctcttatgaaatttatctggtagaattctgaattccttctctgtgtcatcttgaatttctttgagtttcctaaaacagctagtttgaatttcgagtctaaaaggtcacatatctccgtttctccaggattggtccctggtggcttatttagttcatttagtgaggtcatgctttcctggatgatcttaatgtgtgtggatgttcatctgtgtctggacattgaagagttaggtatttattgtagtcttcacagtctgggctaatttgaacctgtatttcctgcaaggcttttcaggtactcagaagacttgagtgttgtgatctaagctatatctgtattaacggacaccccaaacccagtaacactattgttcttgcagacttgtagaggtactgcgttcatggtcttagataagatccagaattctctgcagagactgttgttctttccccttactttctcctaaaaaaaaatagagcctctttctctctattctgagccacctagagcttggggtggtgtgacacaagcatctttgtggccaccaccactggtaccacactgaatcagactgaaagccagcatagcactgggtctcgcccaaggcttgctgtcataactactatcatggctactgcctgtgttcactcaaggtcctgggactgtacaatcattaggtggtaaagccagccagggtttttccttcccttcagggcagaagttcctccaggcaggtccagaggtgccatctgcgagccagggacttatgtcaaaaaccttagaagtgtgcctagtgttctattgtactgtggctaagctggcactcaaatcatgagacacagtatttcccattcttccctctgctttccataggcagaagggcctcaccctatgaccaccatcacaaacccatggagagtattgctaggctactgctgatgttctcttaaggcccaggagctcttcatcgagcttgtggtgaatgctgcctggcctgggactcactcttcagtgtagtttccctttggcccacggcaggtccagaaatgctgtccaagagccaagtcctggaattgggggccacaagagcctgcttggtactctacttccctgtggctgagttggtacctaaggtgtaagacaaagctcccttacttttccctctaatgttctcaatcatagtctctccccatagccatcatagctagtaatgtgctgagtttcacctgaagccagcaagtctcagagtggcatactacctgggtatttctactggttattcagggcccaagggcactttattcagtagttgatgggtcctgccaggactgagtccttcccttcaaggcagcaggttcccttctggcccagggtgtgtctagaaatgtctgggagctaggtcctggaaagggggattcatgactctgactggtattctatcctactgtggatgagctggtttccaagatgtaagacagagacctctttattcttctccctcctctccttaagtggaaagaaggtgtcttttttggagccccatgctgtgcagcctgggtttggggtaggggtggtgcaagtactctcttagccactctggctgtgtctcaacaggttacgtgcctccttagtccactcactttaatctaagttaagcactaggactccccaagagttgcagtccttgtggcctacactgcctttgaagtttatttagagccccagaacactttagcccagggtgataaggcttgccagaactgaagtttggaccactgggatgggcaattcccctctggctagagttggtttaaatatcttctctgagggtgggcattagctaagtgcagcctggttttgcattctgctgtaacaggatatcactgagttcaatgcaatgtcacaattcctgctggggggtgggcaaggggtggtattggtgattcaagactgtttctaccctcctcagtgcctttttcagtgacatgaagttaaaaccaggtactgtgagtgctcatctagtttttggttcttatgaaggtgctttgcttgtgtagacagttgttaaattggtgtctgtgcagaagacatgctcggtgaagacttcaatttggccatcttactttgccccctccctatcatttcatttaagaatctatgatacagttcttgatctttaggaatttatgttaaaagagaagatgaaggcagacatagaggccttaaagcagaagtatgtatagggtatacctaaaactgaacgaaatctaatttctgtgctacagcatagaaaaattagagggaacaatactgacagaaaatcttggtaaagttgtcaagggaaatattacattgggacttttagaccatgttagaagtttgaattttattgtcagtataataataagagtcttggtaaacattttgattaaaaaagattatggtagctgaagtctgaaaaatggattaaagataaatgagaatggatgcagagagaccagtcagaaaattgtacaacaggccgggcgtggtggctcatgcccataatcccagcactttgggaggttgtggatcacctgaggtcaggagttcgagaccagcctggccaacatggtaaaaccctgcttctactaaaaatacaaaattagccgggtgtggtagcacatgcctgtaatcatggtgaacatgagtaaaatattgtcagcagaattggagagaagtatacagattaataaacaaaagtttttgattgactaaatttggaaggtaaggcaggagtcaaaaatgaagctactaacctaaatgaagtagttaagttcttagaaacacaaagcttaccaagactaaaatcagaaagagttaaaaaatctaactagatctagtactagcagggaaattgaatcagtaataaaaaatctcctaagaaagaaaagtcctagatctgatggcttaactggtgaattctaccaaatatctaaagaacacaaatccttctcaaacttttctaaaaagctgaagagggtggaatacttcctaactcattgtgtaagcccagcattaccctgattccaaagccatacaaagacactgcaaaaacggaatactaaagacaaatgtcccttaagaatattgaaacaacaatcttcaacaaaatagtagcaaactgaattcaaaagcatattaaaattatacagcatgatcaattgggatttattcctagaatgcaaggatgtttcgccacaggaaaatcaatccatatgatacattacattaacagaatggagagaaaaaaaaaaaacaaccacatgatcatctaaattgataccaaaaaaagaacaaaatcaaactgtttcatgataaaaacatttaataactaggaatagaaggaaacttcctcaacacaataaaagtcatatatgaaaaacccacagaaaacatgctcaatggtgaaaggctgagagcttttcctctgacataatgaataaacaaggatgcctgcttttgggatgtattttcaacatagtactggaagtcctagctggagaaattaggcaagaaaaagaaaagccatccactgaaaagtaagaagtaaataatctgtttgcagatgatgtgatcttatatctaaaaaataccctaaacattacacaaaacactgttagaactaataatggaattcaacaaagtagcaggatacagaaaaaaatagacaaaaatcagttgtatttctatatactaacaatgaacaatcagaaaaggaattaatgaagacaatttgatttacaatagcatcaaaaggaataaaatacttaggaattaaccagggaggtgaaagacttgtgcaatgaaaacaacaaaagaatgctgaaagaaatttagaaagacataaataaatgaaaacacaagccacgtttatggattgaaagatataatattgttaagatatcaatattactcaaagccacctacagattcaacacattcttatcaaagtatcaatgatgtttttagcagaaatagaaagacctatcccaaaattcatatggaatctcaagagacctaaaatagacaaaacaatcttgaaaagaaagaacaaagccagaagactcagacttcctgattgcaaaatttatttcaaaactattgtaataaaacagtatgatactggcataaaggcagacagacatatagaccaacagactagagctagaaataaaccctcctatatatggtcaaataagttctgagaagggtagctaagaccattcagtggggtaaagaacagtcttttcagcagatgtttctggaaaaactgtatatctccatgcaaaagaatgaagctgaactctcacctaataacatatacaaaaattaaatcaaaataaatcaaagacttaaatgtatggccaaaaactttaagactcttagaagaaaacatagggcaaaagcttcatgatactggagttggcacttgatttctaggagatgacaccaaagccctaggtgacagagaaaaaacagtcaaattgaactttgtgaaataaaatattttgtgcatcaaaagacactcaacagagtaaaatggcaacctacagaatgaaatatttgcaaatcatatatttaatatgagaataatattgagaatatatagagaactcctaaaactcaacaaaaaaagaaacaactcaaaagaccttgaatagggcatttctccagagaagatatacaaatggctaagaagtacatgaaaagatgctcactatcactaatcatcagggaaatataaatcaaaactacaatgagattccactgcacatttattattcaaaaaaaagaagaaaaaaagaaaaaaaatcaaaatagaaaagtgttcgcaagtttgagaagaaactgaaaccaacccttgcacactgttggtaaaaatgtaaactgatacagctgctgtagaaaacagtatggcagttcctcaaaaaactaaagatagataacatatgatcctgaaattccacttttggatatatgccaaaaggaactgaaaccagaatcttgaagagatatttatacacccatgttcatagcagcattgtttacaatcgctaaaatgtgggagtaacccaagtgtctactgatgaatgaatggataaacaaaatgtggtatatatacaaaataggtattatttagccttaagaagaaaaaaaaaatctgaccaaaactatatgattccaactctatgaggtacttagagtagtcaaaatcatagagacagaagtagaattgtggttgtggagaggaggggagaataaggaattacaatggaatgggtacagaggtgcagttttacaagatgaaaagagttatggagatagatggtggtgatggttgcacaacattatgaatgtatttaataccactaactgtacacttaaaatggttaaggtggtaaattttacgttgtgtgtatttttatcacaataaaaaaattagaaaagatccctacaaatacaaataaatgcatatatatttaacttaaaagggtttgtacatattcagaaacctatataaactatattagagcaaccagtattagaattcacggagaacaagctaaaaacacaaaggctcagggcctatcttttaaacaagaggggcctcattttttcttagctttcctggagaggataatatacatcaacatttgcaaaccactgttttataaatgattgtgcagagagaccaaggagtgagggtcagggcagaaagaaagaagtaaaaggaaataggagaaagtgtctgacccagtccaataattgtaatgtgttgtaaactaaggagacattattagctcagctatttgcatttgagatatacaaataatattaagtattactaccatgataacatttctgtaccaaggaatggtttgcagcttgttaaccagaattaggtgtgtctgtgtgtgtgtgtgtgtgtgtgtgtgtgtatgtgtgtatgtaagaagactttcaagacatattgctaagcaaaaaaagagagaagtttgggctggagctaataaccggaagccatggtaactgtaggatgcaagtatgaaacatgaaacaacacaaatgctatgattccatttatttaaaagttagattacatgtttccatcccagccactcccaaatctcatgtcctcacatttcaaaccacagttatgccttttctacagtctcccaaagccttatttcagggttaactcaaaagtccacagtccaaagtctcatctgagacaaagcagtctcttctacctacgagactgtaaaatcaaaagcaagttagttacttcctagatacaatgggggtacaggcaatagaaaaatatacccattccaattgggagaaattggccaaaacaacagggctacaggcctcatgcaagtccaaaattcagcagggcagccagatcttaaagctccaaaatgatctcccttgacttcatgtcacacatccaggtcatgctgatgcaagagatgggcacccatggccttgggcagccccgcctctgtggctttgcaagatatagccccactttccactgctttcataggatggtgttgactgtctgcagcttttccagatgcatagtgcaagctgttggtggatctaccattctggggtctggaggatggtggccctcttctcactgctccactaggcagtgccccagtggggactctgtgtgggagttctgacccaacatttcccttctgcactgccttagcagaggttctctgttagggctctgcctctccagcaaaattctgcctggatatccaggcatttccatacatcctccgaaatctaggtggaggttctcaaacctcgatttttgacttctatgcaccaacaggccaaacaccatgtgggaaactgcaaggcttagggtttacacccttagaagcaagggtctgagctgtgccttggcctctttcagccacagctgaagctgaagtcactgggacacaggcgaacatgttctgacactgcacagaatagcagcagcctaggaaaccatttttctgtcctaggtctccaggcctatgatgggagaggctgctgtgaaggtctctgacatgccctggagacattttccccattgctttggtgattagcatttggctcctcattacttatgcaaatgtctgcagctggcttgaatttctccccaggaaatgggtttttcttttcttcacattatcaggctgcaaattttccaaacttttatggtctgcttcctcttggacactttgccacttggaaatttcttctgccagataccctaaatcatctctctcaagttcaaagttccacatatttccagggcaggggcaaaatgctgccagtttctttgctaaagcatagcaagcgtgacctttactccagttcccaaaaagttcctcatctccatctgagaccatctcagcctggacttcatcatccatatcactatcagcattttggtcaaagccattcaataagtctctagggagttccaaattttcccacatctgcctgtcttctgagtattccaagtctctaggaagctccaaattttcccacattttcatgtcttcttctgagccctccaaactgttccaacctcagcctgttatccagttccaaaatcacttccacattttcggtatccttatagcagcacccaactgtaccagtacctatttaatatattagtttgttctcatactgctcataaagacataccccaaactgggtaatttataaaggaaagaggtttcacagttcagcaatgcttggcaggcttcaggaaacttacaatcatggtagaatgggaagcaaacatgtccttctttacttggtggcaagaaagagaatgagagccaagcaaaggagaaagtccattagaaaatcaacagatcttatgagaactcactcactattatgagaacagtataggggaaattgcccctattattcaattactccacctggtcctgtccttgacacatgggaattactacaattcaagatcagactttgggtgggaacacagtcaaaccatatcaatctctgtctgggaatttgtttgcctttcttcttctctacacttggaatatagaaagaaaaattcatattttaatccaggaaatcaaggtcttttgatatcctatccccaaatccaactatcccttattttcttatgttggattattattattatttgcttattttttgggccaatggtagaataagattatacattactatggaaaaacaaatttcaaaagatatgattttctataaaatgtcttctacttaacttctagagggctgatacattttacccctacatgtagctgccagggtttctagtcttcatctttcactaaaattgtgcctatcataatagctctaaaattgcctacagaacattagataatggcagaagaattgaaccagtaaaaagaacagatgcaaagctaacctttttgttttcaatgcatctattgctctaaataatttcagcagacagtgtttagttctcctttaggttaacattttaccctcaatatgttagcaaaaaaaaggatacataattgtacttttccttatacttactgtaaaaagatttcttcttatttaagagtaggtatgcagatgattgcatgagtatatgttaatgtattttctagagaaatagagaaaaattaaaaaatgcttgaaaagccaagtgtacagtaggatatgatatatattaatatatatgtttcaataaataagagtgaaaaacacatttacagtactgataaaatggcaatttataagttaacttgtattaagtaaggtttctgagtctctttacctctaaaatggggatcaaacatctcagagatttgtttagggggagataaaaataatgtatctgggtacctgaaaatcataaagcactgtggtgttatttttaaactgttcataatctaaaaagtagtgttgttattattgagatgaaactttgtagactggcatttatatttgaattttggaaactatttgaaccaaaagtataaaaatgtgctttaaataagattttatctacagtaaactcatgtttaatctatactgaaagcataccttataaactgaaggtaatgcaataaatgctatcatttttatggtaatagtatatacaagcagttagcattatgtaaataaaaaaattaatttaataaaatcttgggttagtatatgtattcataatgaggtattcaaagaacttaacaataattattgctcatttacatactgcatgtaagtaataccagtcataaatatgtgattaaaatttaacaaagaaatagattttaaaaaatcaaagattaagtagagattttcccaaaatacattccgttcaaaaacattcaatctattaaccaagattacatatctttacttattattttcttcaattaataaacttcagtcagaattctcaagcagttttagctatttaagagaaaactgatgggaaagactttggcactagatgaaataattattttggcaattctttagtttagggatgaaaatagtattaagactaagaagtaaaggtcaaagtgaaattttaaactgaatttactgaggtaaaactgccagaaagattccttctttgaaaagccagcctccctaatccttactctccacactgtttttatagtggtttctaaatgtaaagtgatagtaatgagctaacatagctgaggaaaaacagaatactagaacatcatgtcctttgtacagattatttagatatagaagactgtcataaagttcttgggcagactgcaaagtaaaaaaaattaactgttaattactaaacttgtaataatgattttttactcttttggagtgcttattatgtactagacactgaattaggagctttacgtatatcattattaaagtaaccctgccagggtggtattattttaagtatgctaatgattacaaatagggaactagagaggttatgtgaattattcaagattatatgaagaaaaaggaacaggcttgaaatttgaaaccaagtccatctaacagcaaagctcatgctttttctattataaaactctgcttcagggaataaatacaatagatgcatgcagaaatgaaagtaaaattgatttttcttctaatatccacttttaaccttccattctactagtaatagagtacaatttatctcagtttataaaagccgcttttaaaatctgtttttgactcagacataagaatatataatatgaacctgaattctgattatgctaattttaataaatattctttttacagcatgcatacattatttttgtatctgctttctattatactaatatatttgaaccttcaaataaacaatattaaaaatgtagacatttcagataaaaaagaacaaaaatcaaaaatattttatgtacagaattctataaacataaaaaattaaacaaaataggtacttttagaaaaaattttgagaaaataaacatgttaactaaatagaaatacttttcaaacaacatgaacttacagaagtggtttttcagacaagtttcctcaatttatgtaaaagaggtaattccttttatagaaaatgattaaatagcagacaggagaaataaataaaatttaaaaaataatttcaacttttattttagatttaggagtacatgtgcaggtttgtcacaagggtatattgtatgatgctgaggtttagggtgattcctgtcagccaggtagtgaccacagtacccaataggtaatataatcttaagaccaaagcctgacaaggacaaaaagcaaaagaaaattatagacttatctaatctataaacataggtgcataaatttttttaaaaactagcaaatcaaatatagccagtatgtctttttgttagtgaccaagtagactttatctcaggaatgtaatgaccattaaatataagaaactgtaataatataatacattatcacaataaaagatgaaataatcccaaattaatacaaaataagcatttgataaaatttaacattcatgataaacactcaaatacagaaaagatggtacaataattgtctcaataaagagtataaaaaacgtcaaacttaaatgatgaaattagaagcattttcattaaactcgggaacaagtaagtctacctactcttaaactagaggttctgtccaaagcaatagacaataaacaattggaaacataataacttgaaagaaagagataaacttattcatatatataggggtgtgtgtgtgtgtattatatacacactgtatatatatatatagagagagagagagagaactatatatatagaactgtatatatagaactgtatatatatatatagaactgtatatatatatatttatatatatatacaattggttgaattcgctacaagctattagtcttagagaatcaataccaacatacttagacacgaaacagaacacctttaattaacacataggtcaaaatattaactaaatggaaatgaaaacacaacatcaaaattggtggaatgcatcaaaaacaatgctcagaggaaaatgtacagctttgaatgtatatattagaaataagggaagttctaaaatcaatgatctaagcttccaccttagaaaactagaaaaagaacagcaaattaagttcaaagtgagtagaagaaaaataaaaatcagagcagaaatcaatgaaattgaaaacagtaaatcaaagagatcaatgacaccaaaagctggctccttgcaaagatgaataaaatcaataagcctttaaccagctaagaaaaaaaagattattcaaattacaaatagcagaaatgaaagagatctcagtacagatcccatagacaataaaatgataacaaaggaatactatgaaccattctatgcccataaatttgatagcctggataaaatggcttgaaagacacaatatgacaaaacttatatgagaagaattagataatctgaataggcctgcatctattaaagaaattcaatcaataattaagaacatttccaaacagaaagtatcagacccagatgaattcactggtaaattctattaaagactgaaggaagaaattatgccaactgtctacaatttctttgagaggacagaagcaaaacgaatatgtcctaactcattctatgaggccagtattaccctaaatactaaaactagacaaagacattacaagaaaacagtatctctcatgaacatagataccaaaatcctcaacaaaatattatcaaagtcaaatccaacaatgtataaaacaaattatataccatgaacaagtagaatttatcccaggcatgcaaggctgttttaacatatgaaaattaattaatgtaattcttgcaccaacaagctaaagaagaaaattcacatgatcatacaaatagatacaggaaacacattctacaaaatccaacatgcattcatgataaaaaatctctcagcaaattgggaataaaagagaccttactcaacttgtaaaaaacatctacaaaaacctacagctcacacaatactttctggtgacaccctagaagccttcctgctaagatcaggaacaaggtaaggatgtcctctcaccatttctttttaacattatattagatgttgtatctaatgcaataacacaaacaaagaaaataagaggtgtactaattggcaaggaagaaataaaactgtccatttttcaaataatgtgatcatatatgtagaaaatctgaaggaactgagcaaaaaactggagctaataagtaactacagcaaggtagcaggactcgaagttaatataaaaggtcaaacgctttcctgtatacctgcaatgtacaaatggaatttgaaataaaaaataataccacttacatcagcattcctcaaaatcaaatacttagatataagtctaactatatatatataagatctaaatgagaaaaactataaaaatctgatgaaagaaatccaacaactagataaatgaaaaaatattccatttcctggataggagactcaataaaggttgaatatctctagttccaaaatccataatccaaaatgttccaaaatcggaaacattctgagtaccaagatgatagtcaaaggaaatgctcattggagcaatctggattttgtatttttggattaggaatgctcaatcagtaagtataatgcaaatattccaaaatcagaacaaataaaatatctgaagcacttttggtcccaagcatctttgaaaagagacaatcaacctgtattgtcaacagttcttcccaaattgatatgtagattcaatgtaatcccaatcaaaatagcagcaagttattttgtaggtatcaacaaactaattttaaagtttatttggaaacaaagactcagaataaccaacacagtattaaaaagaacagttggaggactgacacttctgagcttcaagacaaattataaatcaaaacagcatagtattggcaaaagaacagacaaacatcaatgaaaaagaatagagagttcagaaatcaacccacataaatacaaccaactaatctgtgaaaggaacaaaggcaataaaatggaaaagtcagtctttttaacaaatgtttttctgctataaagaggatataattcaaaatttgaaacaaagaaactattaaataagtttgtatttagaactgctgaatttcaaagtttcaagctatcttacaggtcatctagaacagtgttcctcaacttttttggcaccaaggactgtcttcatggaagacaatttttccatggacccagggtgtggcagatggttttgggataattcaagcatattacatttattgtgtactttatttctattattattacatcataatatataatgaaataattacatgactcttcataatgtacaatcagtgggagccctgagcttgttttcctgctacttaatggtcccatctggggataatgggagatagtgacagatcatcaggcattagattctcataaggaatatgcaacctagatccctcacatgcgcagttcacaagaggatttgtgctcctatgagactgtaatgctgctgctaatctgacaggaagcagcgctcaggtggtaatgcaagtaagggagcagtggccgtaaatacagataaagctttgctggtgtgcctgccattcacctcctgctgtatggcctggttcctgtgactggtaccagtctgtggcctgggggttggggatccctgatctagaacaacatttaccatttactgacaaattagttctctcaccaaaattcattacatggaaatatcttcagctgaatatttctagtatttgagaacttactttcttccaggcaggcagaagacaactactacttttggaaaactataatgcaaatatttatttataagtgtgggttcttattcttttctctctcaggatattttagaaatatcttataatctttcatatatatattcatttagctgtttccctctctatcatctgtatatctagaggcagagattgtaattattgaaattgctctgtattcaatcataagcagggtcatgtttataagtgaccttaatataatttgattgtgatggaaatatatgaacaaatgaatgtacccatatatttggggacataaataaaatcatagaaagtgccatatctgaaaagcaatacatacatattaacagaaattcaatttcgtggaaataattatgatactatgataatattagaatattcgaaatgtatgaattattataactgaaagctttgttgaccatatttataaactgtgtttagtaagaatgataatgttgaaacacctacatggcatagttttacaaatgctgtttcttctgtcaaccaacaataagttcctgctctattaacaactctttttctatttttttaattctttctttgcttctgtaatctctcactatataaccaattgatatataaacagatactacaaatgcatacaaaaaaagcaaaacttgctacctggaggagtacgtcaaaataatcttcctaactctataaccaaatagatataatggttttctggaatatttctatgaatcaaatcatgtgttagaaaatatctacattaaaaggacataaatgacaccattaagaacaataaagatactagggtatattaattttaacatccatctccttttagagtttgtaaactaaatccgcaaatacataccagatctgtctttggaggatctggacactcagcagagaaataaggtgccgaacttctgcctccactgctgtcagaagatggctttggaggttgagcatgctgtctgtaagtagcacttttaggagtccaacaaaacaggttgatagattctctcacacagcgttcaatgtcaatttctagatagaaatgttttaaaaaagcaaatgtatagaatttagattgctcttttaatgtaataaacaccatctctcctaagtgaatatatctaaatatggctaagatgataagttattagaaaaaatgtcagtaaaaaaaacaatgtatatattaatcagcatatttatgactggattgatggaaatatttggtataatttgcttatatatatttgtaaatgtatctacttatgttttcatgtgtgtcttttacttggaattatctacatatacatatgtatatatttcagagtatcattatttaaatgccacagaatagaacacatctccttatttaaaaatctgccaaatttatgctgatgtttccacttttccaatgtgaaacaaaagttatagggggagaatacaatttgggaataggtagacaaaagatttagaagatgttgattgctgattcagaatgaattctagtaaagtgaactgacagttttactgccattaaataagatataaaattatcagaaaaaatttttcagaatctcaattcagcatttctcaattttttttttcctgtttttgagatagagtcttgttctgtctcctaggctggagtgcagtggtgcaatcacggctcactgcaaccttggcctcccaggttcaagcaattctcgtgcctcagccttcctagaagctgggattacaggcctatgccacaacacccggctaattttttgtatttttagtagacatggggtttcgccatgttgcccaggctgttcttgaattcctgacctcaggcaatccacctgcctcggcctcccaaaattctagggttacagggatcatccaccatgcccaactagcatttctccattctttaataatctcttgagttaaatgaagaaaggttttaaagtttaatcaagtaaggtttaaatgcacttgactaaaagataaaatagaaacactttcatattagatttccttttgtttctcatgtttgaaatgtaagcatctttaatgcagaggtaatatacatagaaaggttactacaactctatattgtttgtgttttggatgagactgtatctctttaggaggccaacagtcctgatgagaagttagccagtcctctatggcgaaagtagaaagatcacagaaaggcggagaaattcaagaagttgactgtgatggagtttagcactgactagtttttatctttccatatttctaaaagtacaaatggcatatattctcatttcctctgtaaaagtccaagtgtcgggctcaggcaggcaatggagaaaaatatattacatgtcagaaagtggtaagttctttttttctccccctctttttgaaatgaagggcttgtaaggggaaaaggaaataggcattaagtaaattctgtggatagtgcatgagtaatcatttagagttatctgctgtggtaaggtgaagaaatctggaagagggaaaaagaaggtaacactgaccatctattatgtgacaggtattgtatactttcacttaatccatttaattcttacaatgattttattaaagacaggtatcgtaattcttcttcccaccttctatttctgctaaagacaaagaaactaagacacaaggaagttaagtgatttgttaagtatgttactatgagtagaagtctgaagttactataaggttataaggcatcttttgttacttcctaacttagatttggaatatgaaaagatagtctgataagaccagttactcaattaggcattccttagtgatgtttaccaacttcacagctcattacttccatggctacaaaaagaggtcagatttcatcacctcatatgctattcctaatataaaaactataaaacagagtgaaacaagctttgaggcatgggcctatttatttgggcaatggataatatagtgaagctctctaacaatatcaacttgttatttcacaaagaaaatacaaacacaaactagaagaaaaatcaaggtttaagacaggtttctctagcctgtttaagaaaaaagagatagcacaattcattttagaaaactttcaattcaaatagttaagataaaaatttggcagctaatgagagaaaatactcaaccatctaaagtctgtctacttaacacagtttagtttccaaaggaaagggtttcagtccatagattttgtatttgcagggctcaaatcaatttgacacatctgtcaccagcaaagtttgaaggtgagtcagtgatctagagtaaaggttgtagtgcagtccttcaatcactggcattggaaaagttatttttatctgcttccaagacatcccatcaacaccataaaaggtttacagtgaatcttgatgatgtactggcatccatcccgattctaccctgatggttagttctaacagatatctcattttccatttcacttgactcatgtcacctctcatctcaaaacccttccaaagcacattatcataatcaaaatataatgcaaaagtactttgtgaagtgtacattaaaatgcacaattactcctacaaagtaatctctcattacatggcactactgttttttaaccttgcattataattattgagacaatgcattgtgaataaaacatggattatggtttcccaggtttgaattaaagctccatgaggtattttgcaactctgggtaaaataacttctctaaatctattaatttcttcattggcacccattagtattagatctttcagaaatactgaactattttcaatatgataaacacaaccatttgggcaaggatagatggaaaagacagctttcctgagcctgctcttctctcactttaatggctataaattccttctgaaatttattgcatagctattgtcctggaacttctctttaccattatccaattctcttaggctatcccctatatttgattcctaactttttgggtaagacattatttaccactctttcatatttacttctcattttgatgaaacacattatccagcagctacaaagaaagagtacacaggaggtaaactattcaaaaaccttcaatgaatatcattaatctgcccttgactgatagtttgaccagatacagcattctagggttgaatttttttcttctgagttattaaaggtagagctccaatgtctgctgctgagaagtctgataaaattctgatttaggattatttgtacatgattttctgtttctctgttaagttttaggatccctgtattatgaaatttcatggtgatatacttacgcatatacttcattgtgctgggcatttggtggatccctgagtagtccttcagttacacaaaaagtatgtttttgatgtttgtgataatttgtttctttttaaatcttctattctataagaatcttgaacttcctgaatttaatttctaataattttgtcattttgttcttactttccacgtgtatttttgtttcatactctgtgagatttcctaaattttatcatcttacattttcatcacaaacatcattgcatttctatatcaatttcaatttccaggccaggcacggtggctcatgcctataatcctagcactttgggaggccaaggtaggaggatcacttgaggccaggagtttgagaccagcctggccaacatggtgaaaccctgtctctactaaacaaaaatacaaaaattagccaaatgtggtggagtgcacctgtaaccccagctacttaggaggctgagacacgagaattgcttgaacctgggaggtgaaggctgcagtgagcagtgatcacgcctgtatcacgcttgtactccagcctggctacagagcaagactctctcaaaaaaaaaaaaaagaaaaaaaaatcaatttccagattttcaacaattttcattgttatgtttaaaagttctgttttttcatagttaattttctcatagttatctttctgaataaattattttttcagtttatactattctgtatcttaattggaagctttcctcagagattttgtgatctttgattctacatatttacaagaacagcaccaaaaatcagattgaatttttttttttttttttttatgtgggctggggttagtgactggtggattaactataaggtaatttggggacatggttattttgttagaagactcctaagtaagatatttctccttctgggaacattgagtttttccagataattctctgatcttctaagctcatccttgccagccttcccagatatgaccataggaggggcctgtataactatatacattcactcactcctgctctctgctatgcctattggctctgagtctcaagactcagtgactctactactccagagaatgcctctccatatttaccattaaaatggtcacttttgtaaaatttgacaaagtaaaaatatttcaaccacaacaatgaagaatgctgcctctttctacaccaaattctctccattatacttccttgatattgggcaacattacaatggctgtgcatgctctacatataactaagagtaagctgaacatatttactttggtttaataggtcatatttttgttatctgaagtaacttctgggtattgacaaagatgctctccttaaccaaagtctagccaggctccttagagcccttttttgactagggtccaaactttgcctataaagacttgaacaaaacatgaagatggcttggtttttctactttactgttatttttaaattaatacataaaattgtacatagtttatgtattaattaaatatggaatacatgtgatattttgctatatgcatacaatgtgtaatgatcaaaacagggtaatcagaacatctaccaattcgaatatttattttcttatgttgggaacattttaaatctagctattttgaaatatataacaaattattgttaactatagtcatcctactgtgctgtctattgaacaacagagcttattccttcggtctaactgtattttgtatccattaaccaacctctctcttcatccccatcccccagcccattcttcttagcctctagcaactatcaatctactctcaacctcaacttatttagtttcccaagtatgagttagaatatgtgatactgtgaatatgacatagtctttctgtgcctggcttatttcacttaatgtgatgacctccaattacatccatgttgttgcaaatgacaggatttcattgccttttatcgctgaatggtaattcattgtgtttttatgtacgttttctttattcattcattcattgatagacacttaagttgattctgtatgttggctattgtgaatagtgctgcaataaacatgagagtgcagacatctctgcgatatcctgatttcctttcttttggacatatatccagcagtgggaatgctggatcttatggtgcttctatttctacttttttgaggaacctccatactgtttttcatagtagctatactaatttacattcccactaacagtgtactaacatcccactttctgcaccatctattatttttctcttcttcgtaatagccttttaaacttggataaaatttcattggggttttgatttgcatttctctgataattagtgatattgagtactttttcatatacttgttggccatttttaagtgttttttttttttttaaatacagggtctcactaagttacccaggttagagtgtaatgactacagacatgatcatagactatgacctacgacaagcctgaaacttctgggctcaagtgatcttatatcacagcatcctgaatacttgggactacaagtatacaccatcacatctgtctctatgtctccttttcagaaatgtctattcagatcatctacccgttttttaaataggattgttttttggctattcatttgagttctttatgtactctggctactaatcctttgttggttgaagagtttgcacatttcctcccattctgtaggttgtttcttcactctgttgattgtttcctttgctgtgaagaattttagcttgatgtaattctatttgtctactttggctttggttgcctgtgtttttgtggtctgacctcaaaaatccttgcctagtagatcaatgttgtgagacatttccacaacgtggtctagtagtttcatgtcttacatttaagtctttaataaagtttgatttaatttttgcatatggtgagagacaggggtctagtttcattagtctgcatatggagatacagttttcccagcaccatttattaaaaaaaacctgtcttttccccaatgtatattgttggcacctgtgtcaaaagtaagttggctgtaaatgtgtgaatttatttctgagttatctattccatttcattggtctatgtgcaggtttttatgtcagtacaatgctgttttggttactacagctctgtagtatatttgggaattagtgtgaggcctctagttttcttccctttactcaagattgcttttgctacttggggtcttctgtggttccataaaaattttaggattattttttcgaattctgttaagagtgtcattggtattttgatagaaattacattgaacctgtagatcactttgggtagcatgaacatgttaacattattaattcttctaatctataagcacatgatatcttttcattttttattgccctctataatttatttcattagtgtttgttctcattgtggagatctctcacttcttttgttaaatttgttcctacatattttattttatttgtagctatttcaagcagaactgcttccttgatttctttttcagattgttcactgttggtttaaagaaatgctactgatttttatatgttgattttgtatcccaatttactgaattcgcaaatctgttctaacagttttttggtgaagtcttgagggttttccaaatataaggtcatgtcatctgtgaaaaagaataatttgagttctttctttccaattgaatgtgttaatttttttttctgttgcctaattgctctgtctagaatttccagtactctgttgaataaaagtagtgaaaggaggcatctttttcttctagattttacaaaaaagcctgttggtttttccctattcagtgtagtagctgtggggttgtcacatatggcctttattgttctgaggtgtggtcctcttatacccagttctttgagaatttttatcatgaaggaatgttgaattttatcaaatacttttctagtatctattgaaagaatcatatgggttttgttcttgatcctgttaagtgatgtagcatgtttattgatttgcatatgttgaatcatcactgaattcctgggatgaatcccccttgaccatggtgaatgatttttttaacgtgttgttgaattcagttgcttgtatttttgttgagaatttttcatctatgtccatcagggatattggtatttagaatgagtttgaaagtatcctctcctcttcattttttttttaagaatttgagagaatttgcattagttctttcagcaacataggcatccactgctggacttttctttgatgggagacttttttattacagctgcttatcttgttattaattgttgatctgttcaggttttctatttcttcatggttcaatcctgctaagctgtatgtgtccagaaatttattcatctcttcatggttttccaacttgttagtgtatagttgttcataatagtctctaatgatcctttgtaattctgtagtataatttgtctgcattctgtagtaaaatgtctcagtttacataagattttatttatttgggcctagtcccttttttgctagtctagctaaaggattattgattttgctaatcttttcaaaaaccaacttttccttttgttgatcttttgtattgttttcttagcctgaatttcattcgtttttattctgctctttattatttttccttctaccaatgttttgtttgttcctgcttttctacttccttgaggtgcattgttaagttctttatttgaattatttctacttttctgatgcaggtgtttactgcaataaactaccctcttagaactgtttttgctgtatcccatatattttggtatatttccattttcatttgcacattttctgttaaatacaggaatactataatttcctttataatttcttcattgacccatttgctattcagaagcacatcatttgatttccataaatctgtagtttctaatgttccttttcttaatgatttctaattttattccattgtgatctaaaaataaatttgatataattttgatttttgaaaatttaagacttgtttcgtgaacacagggtccatcttggagaatgttccatgtgcttttgagaaaaatgtgtattctgcagctgttggatggaacgttctgtaaatgtctgttaggtccatttggtctacagtacagtttaactccagtgtttctgtgttgactttctgtctggatgacctgtgtattgctagaagtggggtgctgagtccccttctattataacactgcactcaatctctctctttaggttaattaatatttgttttatattctgatgctccagagttggttgggtgtatatataattgttatatcctcttgctatattgacttttatcatcatataatggacttcttttgtcttttttaaaactattattgaattaaaatctattttatctgatatatgtacagttgcttcagctctctctatagtttctgaatcttctctcatcccttcacttttagtctctgcatgtcttcaaaggtagagtttcttgtagacagcatatagttgtgtctttttttttaaatcaattcagccattctagctctttttattggataattaatttaattggataaattaaacctatttatattcaagattattaataataggtaagaatttgctactgttattttattacttgctatttgcttgttttgtagacactttcttccttttatcctctcttaaagtcttcctttgtggttaggtgattttctctagtagtatgttttttttcctccttctttttattatactttaagttctgggttacatgtgcagaatgtgcagttttgttacacaggtatacatgtgccatggtggtctgcagcacccatcaacccgtcacctacattaggtatttctcctaatgttatccttcccctagcccccaccccgcacaggccccaatgtgtgatgttcccctctctgtgtccatgtgtcctcattgttcaactcccacttacgagggggaacatgcagtatttggttttctatcttgtgataattcgctgagaatgatggtttccagcttcatccatgtccctgcaaaggacatgaactcatcttttttatggctgcatagtattccatggtatatatgtgccacaatttcttaatccagtctatcattgatggacatttgggttggttccaagtctttgctattgtgaatagtgccacaataaacgtatgtgtgcatgtctcttttttgtagaatgatttataattctttgggtatatacccagtaatgggattactgggtcaaatggtatttctagttctagatccttgaggaatcgccacaatggctgaactaatttacactcccaccaacagtgtaaaagcattcctatttttccacaacctctccagcatctgttgtttcttgactttttaatgatcaccattctaactggtgtgagatggtctcattgtggttttgatttgcatttctctaatgaccagtgatgatgagcattttttcatatgtctgttggctgcataaatgtcttcttttgagaagtgtctgttcatatcctttgcccattttttgatggggttcttggcttttttcttgtaaatttgtttaagttctttatagatgctggatattagccctttgtcagatggatagattgcaaaaattttctcccattctgtaggttgcctgttcactctgatgatagattcttttgctgtgcagaagctctttagtttaattagatcccatttgtcaattttggcttttgttgccattgcttttggtgttttagacatgaagtctttgcccatgcctatgtcctgaatggtattgcccaggttttcttgtaggatttttatggttctaggtcttacgtttaagtctttgatccatcttgagttgatttttgtataaggtgtaaggacggggtccagtttcagttttctgcatatggctagccagttatcccaacaccatttattaaatagggaatcttttccccattgcttgtgtgtgtcaggtttgttaaagatcagatgattgtagatgtgtggtgttatttctgaggcctctgttctgttctattggtctatatatctgtttttgtacagtaccatgctgttttggttactatagccttgtagcagagtttgaagtcaggaagcatgatgcctccagctttgttcttcttgccaaggattgtgttggctatgtgggctcttttttggttccatatgaagtttaaagtagttttttccaattctgaaaagaaagtcattggtagcttgatggggatagcattgaatctataaattactttgggcagtaaggctattttcacaatattgattcttcctatccatgagcatggaatgtttttccattggtttgtgtcctttcttatttccttgagcagtggtttgtagttctctttgaagaggtccttcacatcccttgtaagttggattcctaggtattttattctcttagtagcaattgtgaatgggagttcactcatgatttggctctctgtttatgtgttattagtgcacagaaatacttgtgatttttgcacattgattttgtatcctgagactttgctgcagttgcttatcagcttaaggagattcggggctgagatgatggggttttctaaatatacaatcatgtcatctgcaaacagagacaatttgacttcctctcttcctatatgaataccctttatttctttctcttgcctgactgccctggccagaaagtccaaaactatgttgaataggagtggtgagagagggcatccttgtcctgtgccagttttcaaagggaatccttccagtttttgcccgttcagtatgatattggctgtgggtccgtcacaaatagctcttattatgttgagatacattccatcagtacctagtttattgagagtttttagcatgaaaggctgttgaattttgttgaaggccttttctgcatctattgagataatcatgtggtttttgtcattggttctgtcttataatgtcttatgacatcgaactatcccaacaataacacaatgaaattatcactgtagaagaagactgaaaattataaagttccttatcttattagtggagaagaaagtagagggaataaaatatgcatattatgaagcactctctgtaaggtaaggtctaaggacaatactctgacaccttcaagttgacagcacatctatcactacttaatgtactgacataaaataaaattatagtggatagaaatggcatagaattagtcttccaacaaagaattaataaccttgagtaactcactgatccacgtttaaggactgttagtagtaagtatcaactacacttcaaggaatacagcatagaatgttattacttaagagagaattctaaaatattagaaatctctcaggactttgtcatataatttattttggtaaagagctaaattcaataatactcttttaccacattcttgaagttatccctggacagctgctctctttctactgcttagaatcatagcatttcaggtggccaatccatcttccatactacagccagaatcatttttctaaaatatagataggatcatgtcatttctgtgcttaaaactttccaattgcatataaaataatatccaatttcctcagcatatcatgcaaggcccccataaccattcctctacctattttaccaacttttatcactaccaccagtaccaccaccccagcccatccacttcaggtttctctctctcaacctatcctctactaacatcctatttacaataagacagccatgagcctcacatatctgtgttatccttatactattttctaagctgccaatgctttctctccatcctactacagagctacactatgtcttatttatttttatggccccagtgcataatactgtgcctgtcatatagtatttattaaacatgtaatcagtgagtaaacttacataggtctcatagaaagtggacacaatttcctgaccagcagttcacacaatttgtatgcttcacatctcaaaaacactaaagaaagttggtgagttttcttattgctaaacattattggatgttttccaaaagtaattacaatcttgctttgcttttttgttccaaacatagtatttttcacaagtcccacttactgcagtttagtctcactgacaccattagtaatctatacaacatttttgcattatttgtccttgttatgatccttctcatgtatttagctgattcatgcttcaaacatcatcaagatcacaaaaaatccctttatgctcctagcaggtattgaggaaaaaaagagccattctaaatatgccaagagcattataattctccctaataagtgaaatatttttatgacagcctaacttactagggcttcaccaaagcctaactgactacaggaaactttagactctgacaagtaagatcttgaaattatacttgtcattttgtcactaaaaatctctaacagtgcctcagcttctaaatctagctgccccgtaatatcttaagcatgtatctaaaacttaactcactatctttgtcagtaccatgctcactcatttcctaatatgttcccattacccaccttgattaaaatataaggaatacttccatacactaaacattccactggagattctatagagaaattctaaaagggaagttgaattatctaactgaaaatattagagaactaatacacaaggcagtcaagtgacttaccaggacaagggagtaataccctatgtattaataattaagataacccaagttagaagtatcagtcacacttacagattaccactggatcatctttaaataattatgcatgaatattctgttctggtacaaagaaataataaaccaccaataagactagtcgtatacatatatagagatacatgtgttttatatatatagatacacccactcctagaagtcaacagatatttaaataaatgaatataattttaaaacacaatcttcttagttaatgtctaaggagaaaaggatggtacaatatgttaccgggctccagatataattcacccagcctttcaactctggtatatgtgcatgcaattactggcacattttcctaagcatctatcatttctgttgtttaatacctacaatgaaatgagaaataaataggaaatgcaatacattactgatatatgggtaaactgttttctattcttaacatagttgtcttaatgagttaacagttgagtaggtagatactttgatgcaaagtatctgtatctactctacctatagagcaggtatttgcagcagcttggaaaatttagcactaggtcagttgcagccatcgttttctctctttcttttacacttcacggtgaatcagaacaaaacaggagtctttgatttttgtggcaagtagaaccttgttccaagttcaataagcagttttcgtatgattgataatttgcacagaaggattaaaatggcttgaaattttaagtaattaaatgtgctttcttgtaataaaaatattctagtcattccctctatgctataaacactctggtatattatttctataaatactctggtatattatttctcttttctcctatctagtctatgtgtatgtgtccatatgtctagtgtatgtgtgtggtaagaacacaacatgagattcaccctcttaccacgaaattttaagtgcacaccatatcattaactgtatattaattgttgtacagcagatccctagaaattatatcttgtataactttatactcactgaacaacaacttcccatttcccactacccatgtttaatcattctatttctgcttctataattctgctttagatggctcatataagtggaatcatgctgtatttgttcctgtgacaagaacttacattttttaaaagattccatgatgattctagaacaacaccctcacatgttaatgggaagactgagacctagagaaaggaaaaggatcacaacattgtgagcagcagcctgggttcaggaagcaccctttctttcattcttgtttttccaactttaattttaggttcaaggagtacatgtatgggtgtgttatatgggtaggttgcgtgctgcagaggtttggtgtatagattatttcattacccaggtaattagcatagaacccaataggtattttttcgatcttcttcctcctcccatctttcatcctcaagtaggccctggtgtctattgttctcttcgttgtgtccatgtgcactcaatgtttagtttctacttataagtgagaacatgtggtatttgattttctgttcctgcataagtatgttaaagataatggcttccagctccatccatattgctgcaaagggcatgatctcattcattttatgactgtgtagtattccatggtgtatatgtatcacaattttctttatgcagtccaccattgatgggcatttaggttgattttatgtttttgctatttttgaatagtgttgtgatgaacatacacatgcatgtgtctttatggcagaatgatttataatcctttgggtatatgcctagtaatgggattgttgggttgaatggaagctctgttttaagttctttcagaaatctccagagtgcttttgacagtggctgaactagtttacattcccgcaggcagtgtataagggttcccttttccttgcaacatcaccagcatctgttatttgttggctttttaatcatagccattctgactggtattagatagtatctcattgtggttttgatttgcatttctctaatgattagtgatgttgaacattttttcatatgcttgttggccatacagatgtcttcttttgagaagtgtctgttcatgtactttttacatttttaaaggggtcatttgtgttttccttgttggtttaagttgtttttaagactctggatagtagacctttgtcaaataaatagtctgcaaatattttctcccattttgtaggttgtctgtttactctgttgatagtttcttttgctgtgcagaagcttaaagagcttaattaggtcccacttgtcaatttttgtttctgttgcaattgcaattgctcttgaggacttagtcataaatactttcccaaggcccaggtccagattggtgtttcctaagttttcttctaggattcttattgtttgtggtcttatatttaaacctttattccctctcgagttaatcttcatatatgatgaaaggaagcgctccagtttcaatcttctgcatacagctagctagctatcccagcaccatttactgaatagggaatcctttcctcactgcttatttttgtcaactttgttgaagattagatggctgtaggtgtgtggctttaattctgcgttctctaacccattccattgatctatgtgtatgtttttgtaccagtaccgtgctgttttgtttactgtatccttgtagtagagtttgaaattgggtagtgtgatgtctccagctttgttctttttgcttaggattgctttggtgattcgggctcttttttggttccatataaattttagaatatttttttctaattctgtgataaatgttgttggtagtttgataggaatagcactgaatctataaattcctttgggcaatatggccattttaacaacattgattcttctgatccatgagcatggaatgtttttccatttgtttgtgtcatctatgatttttttttttcctttttttcttttttgagatggagtcttgctctgttgcccaggctggagtgcagtggcactatcttggctcactgaaacctctgcttcccaggttcaagctattctcttgcctcagcctcctgagtagccagaattacaggcgcatgccaccacgcccaactaattttgtatttttagtagagatggggtttcaacatattgatcaggctggtctcgaactcctgaccttgtgatctgcccacttcagcctcccaaagtgctgggattacaggcatgagccactgtgctcagccatctatgatttctttaagcagtgttttgtagttatcgttgtagagatctttcacctcctttgggtagatgtactcttaagtaatgtatttttttattggctattgtaagtgagattgtgttcttgattgggctctcagcttggacacagtgtacagaagtgctactgatttatatatattgattttttatcctaaaacttggctaaagttttcatcaaatctaggagctcttgagcagaggctatggggatttctaggcataaaatcataccacttgtgaaaagagacagtttgatttcttttcttcctattcggatgcctttaatttctttatcttgcctgactgttgtaactaggacttccagtactatgtggaataggagtggtgagagtgggcatacttgtcttgtttaaattctcaaggggaatatgcatccagtttttgcccattcagcctcatgctggctgttggtttctcacagatggctcttattatttcaaggtatattcttttgatgccttaaatctctctcttaaatttaatacattttggtccttacattcttattgcaatatctatcagcagtatatgtagggatattttaaacagtttctgacttttaaaggtttttgaggttaattacttttaatctacttcaaaagtgaaaaatgctctatatattttgttttgcaaatctaaggcacatataaacattcaatagtaaagcaaatataaacctaatgccatcattggtatcttgaaacaaaatatgcttaataacactgatctaaactataagataatttttggactgctcaaaaaattcagaaagcaggaatcctttcacaaaccagaaacccttatcaaccataaaacaagcagctctgctatagagaaaggccttcctatcagattcttgacaatttgggaccaggtttaagatgtataagaactcagatctactctaaattttcaagataagtaaaaattctgatcacctctaacattatttttcattacagttcccaatacgtacgaaatatttcttttaaactttataaagtatttacatgttgcaaaattagttgtatgcttcaagagcaacaattaggttagtgttatgtgaattctttcagcttcctagaatcacgttacaatttcagagtcttcatcagtcatgctcctggctgctattttcatgaccatttattagcttggaggtgatgtattgtaatatctgtttttaaattttccccttttccataaaataatgcagtatttccaccacaaacaagactgacataacctgaggttttaaaagtaatttttcataaagttttatttcagtgactatacaccatgccaatataaacaaattaactactttctcacttatccttaactaattttaaactcacaagactttaatatgccatccagattttaatgtttatatgtaatttttacagatgggtgggggagagaaggaccactgctaaaacctccaaatttaatttccattttgattgtccttttgcaattccaaggtgtacttagaaacagacatgcagtgagccaaaattgtgccactgcacttcagcctgggtgacagagtgagactccatctcaaaaaaaaaaaaaaaaagaaaaatagacatgcatgacatgcatgaatatcatgtagctacaagcagaaaatgggaataattaattctcagcttcaggtaaagtggcatcaatcttacaggcttgacaatacaaaactttcactgaacaactgtgtactacagttgctctactctttcacaaatcatttctccatcccatatctggctataagccagggagaaaaaatgatggataactattgggagcacttatgttaagaatcctttgcttcactcatgatagatcaccttgaaaaaaatgtagagagatcagaaagctctacaaatattaatatcaattatagcattcgtattttggtacctgatgttattttaaatacttatttcattacttcaaaaatactgaaaaaatatctcaacaaatatatttttaaaaatctttaatgtggcctacaagatgctgcatgatccttctttgtctacctctccattcacttttctagccactcctctccactttcccatttgctccaacttccttcagctgtttcaggcctttgagcattttattccctctgtctacaagattttcctctctttccactccccactccccaatatcacttaaataatttcaaatattatcttaggtatcatttacttaagaaaaactgcctaactccctgttttaaactcctattgttttctgcagtattcatcaccatgataactatttaacaaagaggtcacaaattagtagcctactggctataataagctatttgattaagtcttatagtttcaaaaatctaagccactgtttataatggaaagattacacataaatcttacagtaaccctatttaatttatatttatccctagattacaataaaaaactattgactgaaaacccaaattgtttcccatttatatacttaaacatctctaaaatactttaaaaactttggatataaatgtagtataactaaatttacttggcagcacttttgctttattaagataagtactgaataatggaaaagttatagtagtcaactgtccactcatctgatggtgatattgaaccacaacattgatacctgctttctttgctttggttaagcatttcatgaaaatataactgctgcttagatgaatatgaacatttgttttagctaaaacttcacaattacactatatctctgactaaaataagttttacttcaagtaaactcaaagccttattgttttaagagaccaaataaattctctcaaattctatgctacataaaatataagtgtgaaaataaaatcagaggtcaccagattcttgtcctacttatccaaatacacgcagaacacattcaatctaaacatatgaagaagaagaacttttttttttttcttttttatggagacagagtctcactctgttgcccaggctggagtgcagaggcgccatgtcggctcactgcaagctccgcctcctgggttcatgccattctcctgcctcagcctcccaactagctgagactacaggcgcctgccaccacgcccgtctaatttgttgtatttttagtagagatagagtttcaccatgttagccaggttggtaagaagaacttttaagtacatacaaaattttcttaaatagtcagctctctatatctatgggttctgcatccatggatttaaccaattgctcagtgaacatatttggggaataaaaatgaatgtctgtgtctgtactgagcatgacgttttttcttgtcattattccctaaacaatacagtataacaactatttacatagcatttccattgtattaggcattagaagttatcgcgagatgatctgaagtataaaggtggatgtgcataggttacatgcaaagggacttgagcatttgtggattacagaatctgggggagtcctgaaaccaatcccccatcgataccgggggatgactgaacttgtatttcactgaatatcttgctataaaatgaaaatagtattattcatacatacttttaacagatagaatgctcatcagttaaaaatatcaaatttgtgcctactgtgaacatttgaacttatttatttgaagtttatactattactaataaataatattttgttcaggaatgaggtggtaatgtaaatggaaaggaagaagacatagataagctaggcagctttgaaaatatgtggaaaatgtcattcctgttcatccagttaagtgctttaataggacctatcatcaatgcattgagatgttaggagcagggatgctgggactgaatttaagagttattaatataagatgaaatatcttgggtctttgcatgtaggataacctatttataagcaaaacagattaattatttcatggaaagatgaatttgcagtaagagcaattaagcaaagaaacccaattgtaccagctgacactacatcaactaaatagatttcattcctatttgaatagcatgctctgaacaacatgagtgtttaataaggtttgacagatgttatgatatagtgactagaaaggataaaattaccagaatttcatttttaaggcctaaaacaagcaagataacatctcttgaatgatcattagtaagaatactgtacaattcctttcagttttgaattaatcgagaaactttattctaatcttataccatctgtaaagtaaacccaaagcaggcaattttaaagacatagaataatttttcctatggaattaagacagaaatatgtcagtcgaccataaaatacacagttgcatgaattttttaacagacaagcagagttgccactaatctccctataaagtataaaaacagatgcttcaccagtgtttaacaggagcatttatgtattgaattggaaaggcaatacatttgcttgatttgaaaatgtacaatcagcattcctaatatatatatttttagaactggccagaaaatgtattttaatcctaatcaatcatcttatgtttactttggcaagctggaaatgacaagaaatcatctgcataatataaacagtattcccagtttgcgaaactagcttatttattactgttcaaaacaaaaaaatagataacttgattttcataatctcccagaaaaaaatatgacctaaactattcattcatagtaagaaataactcactttaattaaaatttgataagtcagaaagctgatgataatagtttcaattttgagggaagggggaataaaaagttttaaataaatccaaggtatttttcttattattttcccacaaatgataaaaaatttcaacagagaggcggtaaagtaccaagtacagatcatccattaaacataaaaatgagggctggcagtaggtttcttatttttcttgagagtaattaataaagacataatcttaagggaccttccttttgttttttatttggttttcaggcaaatttgattctgggataattttaagtgtgtttattatcagcagtaacttgggcctgcctgaaaatatggagaacagcacaagggatgctgtcaataaagtactgtgaagttttttcacctaaaaaaactgaagtttctgcaaaaatatagatttagttacatcctaggtaacgacattaatttcatctttttacccatagcttcaaagctcagactatagttatccatatttctacatttaagcattcaactcctaggtttacaaactccttacttgtgaatactctatatagcttaacatattctcctgcattgcatgacatagatgatttgtcctcccaagagggcagtatttccttttgtcaaatcgtaaaattgttagcaagcagctttggctgggaggcaacaaagttttgtgaattgtatctttttataaacacagattcttaaacaccttcccaagtggcctttctatactttccatcactgaagagaaacagcccctgtcctaagcaaaagagcaaatatgatattgcccccaacttcctggcattttacccatttagtagcattaccaagatggaagtaaatcacagtgagcgggtatgacccagatttgtatttacaatgctgggtcagcagaagaagcagtatatgagagaaagaatccagagaggatgatgaggcccaaacagaagagatgctgaaggcctggatggttatttttgccaatggcttaagaatgtgtcattatttcatagtcaaatttcatttaatggctccatttatttagatctatacctggtaaatcggagaagagaagaatacactcattaaagccattagccaaaagccggtcccgcagctgctgaagaattgctactccaatacagaatgggaaagaggaattcccaagtagtaaggtatcccagaggtggaaaattttgtgtagtggaaatacatctgtaaaacgataaaaatacaaataaattaaaaaaccaaaataacaattaaaacaataacaacttactttactagttctataattattaccttatggtcaaaactattacttcagagctaatactaccaaactctttttatgaaatgtttatttggctttgaaaatttatagcttcctaaggcatcttaaaaaattgataatcaaacagataatatttttaaccctattaaccattcataatatttcttcccagaactttccagttatattattctcacagatttatctagatgaactttagtgttgttttaggtacagtaaaataacgtatctattatattctctaaacaactgttttaataaattcccaccaaaaatcctatgagcaacttcctattttttgtaacttcctttttcttattaacaatactatgtatatcttccaggccactgcataaatatctacttcaaatattattacagttaccatgtaaaccatattttattagtaaggatgtccactttattaatatttgtagcaaattaaagtattacgcattcacataatctgcttaatttctagaggaatcctagtttaaaaaataaaagttactgaagaatctctgaaaattaagcctgatttgattgtaatagttgcccttataagctttatgtaaatattatagttaattttttttcaaaggggggcagagtttgtacaaatatcatgaaatgtccaataggtttttattttatagaattctcactttgatattcagggatcagaacaactgaaattcttttctacctaactctattatgttagaaacacataaaaatacttactaaatctgctcaatgttattgtaaatataaaatatggggaggcatcgggctgtccttttgctaatacaatatcaaaaaaaccgggggaagtcatacttacgagtaaacatggtaagaaaccaagggatggcatagagctatgagtggaaaaaggggtacagggaatggataaaaaggaaataaaaaagataattagaatgattaccaataaactaaatggtaaatgtaagttctatgttttggtctactttattggttaaaataaaagagaatgtagtgttaagtttagcctaaagctgcctccttaaatgttttaagttcggcctaaagatttctccatacatagtgaatcatatctaactggatgtgtaaacagactgtagcaaatgctgagctgtaaccaatctagctgtttctgtacctcacttttgttttctgtatgtcacttttctttttctgtccataaatcttccaccatgtggctatgctggagtgtctgaacctcttctggcttgggggctgccaatttatgaattggtctttcctcaattaaactctgttaaatttaatttgtcaaaggtttttcttttaacataggtaattacagttattacaaatactcttatataatgatactatccacattacaaatgtagatgactcttttggcaaagattattcacagaatgtctttatttcaccaaaggatagactcaagaccatggctaatccaaatgcaatgctggtatactaatttcaagggtatattttactttacaggtttgtacagaatatttctgagattttaaagatccttgtgttagttaattgactgcatcaggtgatacctaggtatctggttaaatgtgtgtgtttgtgtgtgtgtgtgtgtttgtgtgtgatggtgtttccagataagatcagcatttgaatcagtggactcagtaaactgtcctctccagtgtgggtaggtatcatgtaatcaactgagagcctgaacaaaacaaaggtagaggaaggaggaatgtgcctcttcttttctacctcactgcttgagccggaacatttcatctaatcttcccctgcctttagactgggatttgtatcaccagcttcctggttctcagacctttggaatcagaattacaaacacctctagactctcaattataccactggctttcctgggtatccagctttcaaacagcatattgtgggatatctcagcctccataaatgtgtgagccaattactcataataaatctcctctatctatgtttatatatctcctattggttctgtttctctagagaaccctaatacagtcctcataagttttgaggtactcttaattgtatttttaagaattaattagatactttttaaatgttcaaaatgtctcaataaaaggtattatgaagcatgtgctttttgttaccacttaattaacaggatgcttcataacagactaaaagtaataagatctaatattaccattattaataatttgacaaatttattctcctaagtttactacctagaaatatatacatacacacatatatagctatatatatagtatatatcgttctatatacacacatatagacatatacattttcaaattttagaaggttttagaagtgacaaatcatccttaatttataaaagtagagtaaaaatctcctttgtcaatagcaagtatcaaaaatcaacaataatttactgaaaaagcactaattttatttcactttatgagttaatacaggctgctattaaagacttctttactacctacagggttagtttaaataaatattatttcagcacctagcaattatgaatttatgagtaaaaggtgcatattgtctttgcatttcactcaattgagtatttatactatcaagatgacagtcaagaactttataagtatattaaaatctaagtactacatgtgaaataaaacccactcatctccaccatatcatcattttttataggctgacatttagatacatttttctagggacaatataaatggaaaaaggaaaaagtacaaaggtatatgacttcactgtaatgagtaagggttgtagaaaacaataaaacataaattgttcatttaaatttaaattaaaaaataaagtcagcaaaattagtttcattgctattattcaacatctcttttaaagacacgacatcaatattaccttctccctttttgatgaaagctaactgtcattaagaatcttcttcaaattatttcagcaactagctaacagtgcctttctcctatactagtctttgtaattagcttcatcaagatctatggaagaattctgcttctgaccaaggtggcataacaggaaccagatttacctcctgaactgaaacacctaaaaatcagaccaaatatataaaacaacaatttgtacatcttagagagtggtacctgagagaggagaaacaaatgaaatgaaccctaaaattgcccaatttactgcatgcaaagaagttccaggccactgacagggaggaagaacccagaaagagcttggtggttgtcctaagctgaatatgcagagtaggaaatctggggagatcaaggtggctatactcttcaggagagtgtcctggaagattctgccagagagagagatgcatagagaaagctccagaagtctgctgaagattcccctcaaatctttgctaattactgaagagtgtgtgtgtgtgtgtgtgtgtgtgtacacagaaaacatatctgagtgtgtgtgtgtgtgtgtgtgtgtgtatatatatatatatatatataatacaaagtagggcagaaaccacttcaaatgatcagagtgaaaaaatgccaagatcataaaatgccaagaagagttcattttttcactaaccagaatgaaaacaacaaaacaaaacaaaacaaaacaaaaaaacacccacaactgttataaacaaggcattagggagagtagtcagaagagcattgctttagtaatggaggaaaattatgctccaaaaccaagctgctctggccccattaaataaaccttaaaagcaagccttgaaaggatcaaattgtttcagtgtaacttaactgcacccaatcacactcatggtcacccccaaactgcctcttttttctaccaacaccattattatagtcacttaggtagaaaaatcttaggtataaaagtaagtctgatagatattatttttacaaggtctcttcagtcttctgtttctatccattcatactgaactaatcttgttttggttctcattcttctttcatggactactgcaaatgtttcatagttgttcaggttctacctggtccaatatttcctttagccaaattgatttttctaaatatgcaactgtgatgacatcattcctctgttccaccacatcaatatgttcccactgcataccaaattaagtacaattttgtactcatgcatttaaggccactgtgaattagtgaaaaagccaaggacttggagtcagaaaacatacaactgagttttgactctgatgattactggatagcgtgccttggtcaagttagttaacctctgtgaatcccagatcttcgtttttgaaataggaaaactaatgtctgtcttaactatgtcatagagatggtgtgatgtggaaataatatatgtgaaaatgctttgtaaacagtaacaacctgcaaatttaaagtagtattattattaatatcagtataagaaactctaaatttctttgcaccttactacttccctacacatgttctacttcctgagaaggcagatttactatgatctgaacacactactttcctaacgatgcactttgcattttcttctttgaatgctccttcctgatcatttccatcaatccaaagctctacaagatttttccaagcctgcctcaaatgccacttgttctgtgaaaactttttgtatattttttatgatacctatcccactatgctttgtatcatatataatatagttgtattatatataatcatggtaatcatttttatattataattacctatcacaacatacttgtactatacttaattctgggtatattcattcactctttcattcattcatgcttgcttttgttcatttattcaatatgaaatgctttgtgctaaatgccacgtgtcccactctagcagaagagtcagacatacgaacagatacctaaaatgctttactattaagtacgacaatacaagttctggtataaggtaatggcagcaaagttacaggagcttatggcctttcctatcatattctctgcaggagaatgataggattcttgtgaataaatgttattttactcatttattcattaattcaatatttactaagtgcctaatacatgccagatctgtgttaggtgataggctatagcagtgaacaaagcatagttccaggctacagggaacttacaataagagcagtagatattcattaaatagtctctcaacccactctaatcaagttcttgcctccacctcaccactgaaactgttcttaccttggtcatcaataatttctatgtcattaaatctaatggccaattctcaattgcaatctttctttaccaatcagcaggatttgacaaagttgactattcccacttcttcagaacatttttttccctccacttggcttccaaaacaccatactcacctagttttgttcttatctttctgattgctccttatccatctcctttgttggttcctcttcctctctctcactctcaacctggagtgtcccaggttcagttcttagataccttttcttttcttttctatttttctccaaataactgtgtagtttgaggaccctatttcagctccatccctaaacctctcctacaaattctgaaactgtatatccaaatgcctgttttctccacttgcatgtctaacagatacacatatcctaaaacgagcttctgagacttccttcaaaatctatacctccaagtagtttccaaatctcagttagaagcaactctatcccctttcaattgctcaggtacttgactcctctcttcctcacacactgtatatttgtcaccagtagtcctgctggctctaccttcaaaagatatgcagcatataaaaacttcccactacttccactgctaatatcttgattcgagccaacattatctcttgcctagactattgcaatagtccatgactagtttcctagattccattcttgcccatccttcgatttttctcagcatagcagccagaatgaccttgttaaaatctttacatgagacatcactcctctgctcaaaagcatcagtggctttccacctctaacaataaaagccaaagtcctaatgatgatcaacaaaactatgtaatatggccctctattacctatttgaccttatcttcttgttcactgtgctctagttacaatggtctactggctgctcctccacatctctgatatgcttccacatcagggctgtagcaactgctgctgctttcgcttggtttgctctttcctttgctttcttaaagcatttattcataagtcaacttttctgtgaggttttcttggttaccttacttatttcaaaattcatggccaggtgcagtggctcattcccacaatctcagcactttgggaggccaaagcgggaggactgcttgagccaagaatccaagaccagcctgggtaacatagggagacctcatgtctacaaaaaatttaaaaagtagatgggtctggtggcgcatgcctgtggtcccagctacttgggaggctgaggagggaggattacttgagcccaagaggttgagactgcaatgagccataatcacaccactgcactccagcctaggtgacagagcaagaccctgtctcagaaataaataatgaaaattcaatctcttctttacctgagcacataacatccatacctctgctttagcttttttttttaaattagaacttaccactacctaccatataatatatttatcttcattattgtctatttactctagaatatgaggtcagatatttttgtctatctcttattttattgctgatatattatccatggcatagaaaaatgtctggcacataataggcacacaaatatttgttgaaaggatcaatcaaatatttgttgaaagaatgaatgaaaaacacaatgaaaatcaatgaaagtgataaattaaaagatccaaatagtcatgagattatatattttcttaagaagttttcaacaaatatgaaataatgagaaaatgagttagtccttccttgcttaatattggggaaaaatccttcatattaaataatggcatgtatttaaaaaaattaaacttgagattttgttatatacctatactttgataataattataaaaaattatttaaaataagcaaaacaaagcttattctaatgatatttgaaaagtaataattagttcaagttgaataaatatctttaatataacatataacagctcctaggtgcttaccagaaccagttatctcttaccaattaaggataattaagattaataaataagtaatgtactctgtgagatagtaatgtctattattttttctttctatatttctcccgtttaaaatattgatattttcatcttaaataattactcaggatattggcacagcttcataatatagcctgatataaaaaagacatcaagatacaataattttgaataccaggtgggttttgattaaaaagaaaagcaatttaatattagagatattattagctatttcctgatttaatagaaaatgaaatccaatgaaaagaaatcatacatactctaagtattttctccagatcatgaaattatgtacaattgatttggtgtagtgctattctacacagtcagctaagtaaatactgccccctagcaatatcaagcaagagtagtgatatttagcatttcatgagatccttccatgtggtctggtaatgtcaaatttagaaccatcaataggaaaaacaaaggaagggagaaccatcaataggaaaaacaaaggaagggggataattttcttgattttgaaaagcagaaaattatgttttactactacaaagaggagtccctttctattgattttcttaatccacatcctttataagcatactatattgtctatcttaagtcagaagtattttcatatttaaattattatatgccttctctgtaatacatattgaccattagtttaatgcttttgcaatgattctttatatgtacattaggaaacatatatacagacattccagaaaagaatgtgtaaaaatctgcactttgcgacctgataaagttatctccttgaacctttaggattattgtgaagattagttaatggatctagaacatctggcatttagtaaacttaaatataggagttacaatgatcacccagaatcttcagtaatggaaaagtattttaacaagccaaagttctgaggtaacctcattaagtcatataacaaaagatacacacttttttttttttaaattaggagaggcatgagcagaaaataaaaagaatagactcctaggcactgtataaaatattttatttatcagtaacaattatttcatcaataccaattaattattctcaactatgcttaaaaatactaataagaaaacagaagaatgatggaatcatctacaaggatagcacagtactaaaataaatcatcactattatgccatccttcatttttctttttgtgctagccatagtattgcaccatctttcaagaagatatgaaagatgtacagagacaccatcattatagattttttgttgtttttttacgttttcattgaacacagctaaagattgagaattttccattttccacctttattattaaaaagaaaagagaaaactgtttcataacaggggaaaatgttttacaattactggactaatcagaagatgaatgcaaaaagatagcaacagtttaactcaagtcaaatggtaaaattagtcacacaagtgatattgcaaattgtgagtgctcagatgacagtctcttaggtgaatttcctcaaacacagctatcagagtaaacaataaataagtctggaattctcattcagtcagtcattcaatgtgaagggcctcaccacacaatattttgcaataagaaacctggaccattttactttgctaaaaggatatatgagagtaatatttgattttttatgatatttgtgcaccaaaatttttgatacagtttaagcaaataaatgctataagtgtatgtgtttgcaatgtaattataaatagatgatatagaaataaaaattaaatttattctaatttgtgttcataaatctaaaaatgaaaatgttttcaaattatggaataaaagacagctgttcttcaaccaagttatgagctctgtcagtgtttcattttgatgactgtgttataaccatgcaagtgcaagaagaaccagaaatcagctagaacctatgagagacatatttgaaatacggaatcagtatttatatgatggatatccttcaggctcatgtatgacagctgagcagtaagttcaaaggacatatacacatatatattttcacatatatatatatatatatatactttcaaaataaggaatatatgacataaaattttgggtttgttgtgtttaaattcttaatattttaatacagttttttactatgctttattctacttctgcaaattattcacaaaatgacttaaacatataaaaataatgtaaaagatcccttggacccaaaaagtaaatggttaatttttttcctctatataccaaagattatattagttatatcttttacaggtcatgatttctctaaataaaaaaagaaacaaataaaaaataactaactgtataaacataccttttattatttattctcagttggcttacaatattgaacaaaagaactatacactgaaaacttacaagaaaatcactcagataatttaatggttctgagatctacattatcatttttgggaaagatgagctattattccagaatatatttcaattatttcattgattactacaaaaaacttttcaaaattttcaaacataattcattctaatttactttaagtaaaagaaagactataaaacatgttatgtagcactttgttgagatagagaagtaccttaaaatcaagcaattaaaaagattaaaattcaaagtggcagaaaatctcatcaattcagacaaccttgaaagtctttattgttattagtaccatacctcctctgacagagtattcattaactgatgtagcaaaataatatatccattatagcttgtaatataatgttcttctaaatatgaatcatgctaataaaagaaataatgcaacatgatcaaactctagtaatattaaataaagaacaataccccttaacaattatagtgtgcctggagctgtgttgaacagtttatatgcattctctaaacttcattatgaggtagaatttattataatctacatcaatggtaagagggttgcagggaaaaaactaaaactaaagctaaaaatagattatgtaattagtatatggaatagccagaatttagaaccctggaccatttggcacaagtgtctgagtacttaacctctacaccagctttcttaaatcttggtcacaggccctggcggtccttaagtcccttcggggtccaccaattcaaagctatttttgtaataatactaagatgatttgctctttttactggattgatatttatgctaatggtgcaaagccactggtggataaaactgctggcatgttagcacaatttaaggcacaggcaccgaagtataataatggtcatgtgaaggagtaaaaattattaaatttattaaatatctcttttaaaatttgtgaaataaaatggaagtaagtgtaaagcacttgtgctatctactgaagtacaaagaggtaaagcacttgggtaatcatctgtgagctaatattgatggtttctgcaagaaatactatgtttatttgaaagaatgacagacaaacaatgatttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacacgcgtgagccaccgcgcccggcccaaacaatgatttttttaaatgtacaaagtgaaacagttactttaagaaaaaatgagagcttttaggcgaagattaaaattttggaaagctaatatctgccactgtgaaattggtcggttcccaatacttaatcactttttggagaagacctgttgtgatattaataaatgtgattttaaaaatattctataatgaaatgcttcatagttggaagatctgtgtaactcagcaaccaatatttttcaatgacaaattcatgacactacaaaattatgtatgagtaaaagagccatctaaattgcaagatagagtgatggattttagtataacagagtatgagaagttcactgacatggttttagactgtacatagcaactagctttaagaaacaatgaggccaggcacagtggatcacgcttgtaatcccagcactttgggaggccaaggcaggtggatcacttgaagtcaggagttcaagaccagcctggccaacatggtgaagccctctccactaaaaatacaaaaaaaaaaaaaaaaaaaaaaaaaaaaattagccaggcatggtggcaaacacctgtaatcccagttacttgggaggctgaggcaggagaatcgcttgaacccgggaggcagaggttgcagtgagccgagatcactgcacttccagcctgagtgatggagtgagactctgtctcaaaaaaaaaacaacaaaaaaaacaaaaaaaaccactgctctgagaagtttaagaaactaccgctatctgagaaactattaacgtgtctgtgtgaggtcacattttcttcatatagttaaacaagtaaaaagattataaaaatgtaaaagattataaaaaggtaaaacaataccactattgcatttttggggaaaaatgtaactatttctcagaaaaatatgttactttggttaacatgcaatggttttgttattgttatttttaaatgaattataaatacataaatatattttaaatctctataaatatcgatagctataactcatgtaaacaaaaactctttgaggtcctcaataatttttcagaatataaaggggttctgagagcaaaatgttttagaactgctccattatgccatacttcctttcacctgtttctggacagcataaggaatcattagattagaaacagatgtgggggtaatgcaaatgaggatttactgaattggaaaacttgctagatatttaacttgtgtgtatagttttttggctagaaagtaccaaaaatgtcattttatcatccctgatactattaatagccactttgatttctaaaatctgggcactttctgaaaggtaatcaagcttcactacgagagagagactttaataagccatttgtattcaaaggccttaatggatccaatgccagtagaatggggtttgtactaatgttggggacatagcagctaccagacaagaggacacatcacaggactcttcagagagactataacaggctagtaggactcttattatgagatattctaaataaggtggatattcctagtttttcctgtaattacatcttgataaaatctgaaaagctcattgtcagtattctctttagactaaaatctaaaatttatttacgtaacaacataatgaagataaagaacaaatgaaggaacaaatacataaatatttctgagcagtttaaactcggctgaatatacattttgaaaatgattgtgataagcttttaagtagtataagcatcctttcagattgtagttaaatgtcaatggctttaccagcatatcatggaatttgttagctttatctttagctgtgacagtaggttgaaaaggcacatatagtactgatacactccttatcatttctcttaatggttacctgacaactcttcataatttgcaagctgaatactattcacagaatttcaggaaaacagttcccttaagaatgaatcatactttcctgatctcattttaaatgaggcctactatatttttaaaagcagaaacacatatcaagacaaaaatgataaatatcaccctgtctccaattttatcaaatacacattattcaccctatttatatgtaaatcacataactaccatgaaatgtataatctaggcatcacatcagtgtacaatatttctaactattcaagctttagcagtgctcagtattcagagttccgtgacccagagcaaaaggaaaaaagccagaaatcacaatctctactgcaatggaagcctgaatttcaatgatgaaagattaatgagggcttactttgataggtttagttcttgagtaggaaactcggtttggtaaatcattatcaaagtacccactcttttacttgatgaatctagcttgtattgttgttagaggcatagaaagttacctcaataattaaaggtagaacattaaagacaaccattcagaatttttaaaaaatgctatatacacaaactaataaaatacaactaaaatatgttattaatagagttaaaaaatgtttttaaaagtcctccatttcatcatgcccctcccataagtactcactgtcaataatgtctacattgaaacattaaatctgttcacaaaattgaatttaaaaaaggcctcatcatttttatattatccacaggcttgaaaaacagctgaattaaaaaacaaacacaaagaaaaagatttcaaaaaacagtcttcctattaacattttagctttctttgttgaataactttgcccactctctgtgacaagaaaacagttgtagatgggactcttcttcaggttaagatatattatttcccctcatttctttctgtttactctaaaattcttaacaagtgacagaaccgtttgctagaggacattcagaaatacatgtgaattaattactcagaaatgagtgtagaggcatttttttgtaatgatgattagaggattgctagtggcaatgagtggttgggggtcagggatgctcagcatttgccatgtgctggatattcctatcccacaaagaattacttcccatcccatatgacttaaaactgtctctgaagactaatcacactaccattgatagcagcaggaggcagaaaaatccctaggcagatggggcaagtccccagtgtaatccaatcttaaaccaaagacagtttaaggtctgaaaaccaagatacaggtctcatacatatctacagaatgtattgagaacctctcccgtatggcacactttcctctgattgatccctaccattcacctattttacatatacctacccttccctaattagttttttacactgttgtggccatctttgagtggtgccttttttttttttttttagctttttttgcatactcacaaaccaattagcacatacactcccattctgagcatataaaagccccaggctcagccacactttgggctacccacttttaggtggtgggaagactacccaacttcaggtaagggtgctgtccaactcaggcttccttctctgctgagagctgttttgttactgagtaaaactctttgcctcactcaaccgctagctgtcagcacaaccttattcttggacatgggaaaagaactcaggacccaccaaacggcaagtgcaaacaaagctgtaaccctgtagcacacccctcctgcttgccaaacaatgggagaagggacctctgggcaccacacacctccatttgttgggctgtggatgtgagactgaaagaactgttagcatgctgtaacaccccctttggggctttggggtcacatgcccacctctgttcaagtgtcacagcattcccctcatccagacgccggctcccaaggtggaagtaggtcatggcatgcctggctcagccgcagagcaagtgcaggatctgggccagagctcaagccaagcacagcctgcctggccaggtgggcagggtacctagtggggcaagcccagggccaagtgagacatgggcaggggcaatgcccaccatgaagatctctgctggcaaagtgacactgaaaaaatcctctgtcactatacaaatcaatattactttcttaataacactacaattgcagaacttttttacaagaagttaagcaataatgctccagtaattttatgtgtagatcataacagggaagcataaataaatatattatgtcacaattatttagttattgagtaattcactcaccctgcatagcagcacacttaacaccaatgtactctccactcagatttaacaagcattaacattttgccacatttactctaaaattttttaaaccaaaataaaatatgaccaatacaatagaagccccttttgtactactcctgaatttcaatcctctctttttaaatttatgttttatactttctgtaaccttaataagaattatttcttagataaaaaaatacaaatataatattccatatttaagtcttctaatggatctagaatttatttttatgtgtggtatgaagttaggctttcatttacactgccctccacatccacatagttactcaatcaggaccatcaacaatgctttcttttctaattgattgtatggtcatctctgtcatatatcaccaaattctatacagggatgggtctgttttgtgttctctcttgtattttactagcttctattaatatcactaatgttgttctggttaattgcctgacttttttttaatctcctttggccaatatctttaagtttttatatttatctcttataagtactatcaagatagattttcaaaaatatctgaaaatctcctttaataagccatttaattagcttacattctttctatgttctttctgcttttataagattaaatgtcttttctttgttctatcctgcacccctccattggtttagaagttacatattctctctttattcttttcaggattaccattaaattaaaattttaatgtgcattattgaacttctgaatttcttgtgaggagagacatttactgtcctttgttctagactatcttttcaaatatgtttgtataaaaaacagccttggaaagcagaaatggaatctccttctagacaaaagacagatttactaatagccttagaagaaaaagacaggctctctctcttgaacaaagggaaggcaaaaaaaaaatccaattccttaagctcatggtttctctcttgtaatgtaatccactacatatgcaggtatcatctgggtccttgatgttgtttccataggatttgagagcaagagaaaccaacacaaatatgctaatgttcatgctgcttgctgtactgttagtgataatgtccttggtctctggcccaggaatcttgcattttctgcctgtatccagaaaacagtaataggctaacttataagctttcaaggagggtacaatcaaatctcagatctgaaaggttccctgacttaatgtctaaataaaatgagcattccctctaaataatgctaaaacattagaacacattttaactgattcccacctacttttacctttcacgttattatttagaattttattttcaccttattattagcccttcccaaagtggatttatatatatttaagtaactttttacacagatttataaacttgtagtatttgatgagtgataatatttaaagagggtggaaaagtgcttggtacacagtaaacatttaatatgtattcacattaattatgttttaacaatatttttaactcaacattgtttcttacatcatactcattcagaattcaattttctgattaactaaagttatttgtccttgtgtgtttcctttcttaatattatctctgttcatgaatatgtctaaggatttttattggattatctttataattctacacattattttttaaagagatgaagtgttgctatgttgttttggtctcaaactcctagcctcaagtgatcctcctgcctcagcctttcaagcataagccaccgcacctggtttccaaacatacttgtctacataaatgttttctgtttctgttcagtgctgagcacaatttaattaggtgcctttacaaaaattttttgaaaataattatcttttttagtctaaattttaaatacttaatattcttttttactcaaaaatctaacaccattaccaacttggcagtcagctccttgacagcttcttcaactctagccataagattggatctatattgtattatacctcacatttataatgatattatactccaacagccttttatttttattctttaattttaaaaatcagtttttattgattttttaaattccttatataagtatttttcaaatttaggtttataaaatcatcttattaaatgtagacttttcaaaaataacacaatgcatcacatgtaggaggcagaaaacattgttttgtaaaacttattttagttgtatacacacatacacaacaccactcgaattctgtgtgccccaggtctcaatataaaatgtatttcttcccatgcattgtgagaataaacagtttttaagaaactgctttatagtattctattaaacatgatcacataatatagttttaggaagtttttaacattacaaaaaaaacaccttaaatgaaaacaattaaaaattgcacttaagccccctcggtacccataactcctgtaaccctacataatcataattaatattctagagtatagcctttcaacttttcctatgtatatacacatatacactaaattctattttatgaaaatgagataataccataatattattttataaattacatttcctactttaatgatatgtaatgtgaacattttggttttttatcaataatttttaataaagtatcttcctaaaaaattataattgcttgaggtcaggtgccttcagcttaacttttgaatgaataatacattcacagtgttaaaaaaaattttttaatgtcaaatgtaacaagaaaacaatttcctttgcacccacgctaccacttgcatccccatcaccaagcagctaacttttgttattaatttattttcctctccactttcatttgttatttttaattgataagtaataattgtatacatttattggatacaatgtgatgttttgatatatgtttattcaacagcctttaaaaagggcttgattctatgtgacaaacaacaaataaaaaacaggctaagtcacgctacagctaacgtttgattttcaactctgacttttagcttgatgtggactacagagaaaagaaaacccaaaatctatctaagctcccaaagtagtatcaagtaaaacacagaagttactttcacttaagtatagacttcctatatcttcaaaatcaggcctgaatatcataaaatccaagtgaaaagcctacacagcacagtttaatacaacactatcactaatgattttctcaaaactatcaactatgctaagaaaaatgacttattttcattacttaaggtggaaatatggaaagtagccacaaacttactaatacaaggctacaattagtagcagtaacttgttcagatatgcactatgacaacaaaaattaagaaaatacactcttctgtgctaataatttctgctttttttttttaaccacatgttctattaatgcaccaagtacttacatctggaatgaaaccaatctcattgagatgattactcagctctggatcatgaaatgcaatcatctgagagaagacagtcagatactctgaaattacaaagtttgagacaatcatcatttttacacagtactccaagaacattatattcaaatatagttttatttatacattgaatgagatttaatttctccatgagaatactttacgtgataattttgttttgttactattttaattacttactgctaattattaaacaagcacaccaacaaactgtcataacctattttctgccttcagagttatcagttcatttcttgagtcacaaattgtacacatgataaataatgttttcctgttaaactctacaagcacattttctctggtaatattaaatctgctttgtatttcttgaatgttcagaaagtgtagcagatccttaaatgaaggagaacatttataagcagtcacaaatggaataataatgtctcaaatttgtttatatatacagataaaacatatgcctctatataggcatctgttccagttctaatttatttccatctaagacttagcaatttggcatatttagaaataagaataccgggggaggaaccaagatggccgaataggaacagctcaggtctacagctcccagcctgagcgacgcagaagacaggtgatttctgcatttccatttgaggtaccgggttcatctcactagggagtgacagacagtgggcgcaggcaagtgggtgcgcgcaccgtgcgcgagccaaagcagggcgaggcattgcctcactcgggaagcgcaaggggtcagggagttccctttcctaatcaaagaaaggggtgacggacggcacctggacaatcgggtcactcccacccgaatactgcgcttttccgacgggcttaaaaaacggcacaccacgagattatatcctgcacctggctcagagggtcctaccccacggagtctccctgattgctagcacagcagtctgagatcaaactgcaaggcggcagcgaggctgggggaggggcgcccaccattgcccaggcttgcttaggtaaacaaagcagcccggaagctcgaactgggtggagcctaccacagctcaaggaggcctgcgtgcctctgtaggctccacctctgggggcagggcacagacaaacaaaaagacagcagtaacctctgcagacttaaatgtctctgtctgacagctttgaagagagcagtggttctcccagcatgcagctggaggtctgagaaccagcagactgccccctcaagtgggtccctgacccctgacccccgagcagcctaactgggaggcaccctccagcaggggcacactgacacctcacacggcagggtactccaacagacctgcagctgagggtcctgtctgttagaaggaaaactaacaaacagaaaggacatccacaccaaaaacccatctgtacatcacaatcatcaaagaccaaaagtagataaaaccacaaagatggggaaaaaacagaacagaaaaactggaaactctaaaaatcagagcgcctctcctcctccaaaggaacgcggctcctcaccagcaacggaacacagctggacggagaatgactttgacgagctgagagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcgtcaggagccgatgcgatcaactggaagaaagggtatcagcaatggaagatgaaatgaatgaaatgaagtgagaaggaaagtttagagaaaaaagaataaaaagaaacgagcaaagcctccaagcaatatgggactatgtgaaaagaccaaatctacgtctgattggtgtacctgaaagtgatggggagaatggaaccaagttggaaaacactctgcaggatattatccaggagaatttccccaatctagcaaggcaggccaacgttcagattcaggaaatacagagaatgccacaaagatactccttgagaagagcaactccaagacacataatagtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacctagaatttcatatccagccaaactaagcttcataagtgaaggagaaataaaatactttacagacaagcaaatgctgagagattttgtcaccaccaggcctgccctaaaagagctcctgaaggaagcagtaaacatggaaaggaacaaccggtaccagccgctgcaaaatcatgccaaaatgtaatgaccatcgagactacgaagaaactgcatcaactaaggagcaaaataaccagctaacatcataatgacaggatcaaattcacacataacacgattaactttaaatgtaaatggactaaaggctccagttaaaagacacagactggcaaattggataaagagtcaagacccatcagtgtgctgtattcaggataccaatctcacgtgcagagacacacataggctaaaaataaaaggatggaggaagatctaccaagcaaagggaaaacaaaaaaaggcaggggttgcgatcctagtctctgataaaacagactttaaaccagcaaagatcaaaagagacaaagaaggccataacataatggtaaagggatcaattcaacaagaagagctaactatcctaaatatatatgcactcaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacccaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctcctcctgaatgactactgggtacgtaacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaacaagaaaagcaagagcaaacacattcaaaagctagcagaaggcaagaaataactaaaatcagagcagaactgaaggaaatagagacacaaaaaacccttcaaaaaattactgaatccaggagctggttttctgaaaggatcaacaaaattgatagaccgctagcaagaataataaagaaaaaaagagagaagaatcaaatagacgcaataaaaaatgataaaggggatatcaccaccgatcccacagaaatacaaactaccatcagagaatactacaaacacctctatgcaaataaactagaaaacctagaagaaatgggtaaattccttgacacatacactctcccaagactaaaccaggaagaagttcaatctctgaatagaccaataacaggatctgagattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactgccaaaccaaatccagcagcacatcaaaatgcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatacttcaaaataataagagctatctatgagaaacccacagccaatatcatactgaatgggcaaaaactggaagcattccctttgaaaactggcacaagacagggatgacctctctcaccactcctattcaacatagtgttggaagttctggccagggcaattaggcaggagaaggaaataaagggcattcagttaggaaaagaggaagtcaaattgtccctgtttgcagatgacatgattgtatatctagaaaaccccattgtctcagccccaaatctcctttagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaatcaaagaggatacaaacaaatggaagagcattccatgctcatgggtaggaagaatcaatattgtgaaaatggccatactgcccaaggtaatttatagattcaatgctatccccataaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaatagagccctcagaaataacgccgcatatctacaactatctgatctttcacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacatacgcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaacatgggagaaaatattcgcaacctactcatctgacaaagggctaatatccagaatctacaatgaactcaaacaaatttacaagaaaaaaacaaacaaccccatcaaaaagtgggcaaaggacatgaacagacacctctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgtggcattattcacgatagcaaagacttggaaccaacccaaatgtctaacaatgatagactggattaagaaaatgtggcacatatacaccatggaatactatgcagccataaataatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaacatcacactctggggcctgttgtggggtggggggaggggggagggatagcactgggagatatacctaatgctagatgacgagttagtgggtgcagcacaccagcatggcacatgtatacgtatgtaactaacccgcacaatgtgcacatgtaccctaaaacttaaagtataataataaaaaaataaaaaaataaaaaataaataaaaataaaaattaaaagtataaaaaaagacataagaataccatgtttaatcagaaagtagagatacggtaggcaattaaaaatatattttgttgattctaattctattagaattcatagagttcagttgaaatatgaggaatatgttcatttttttcattcttccaaagttactattcttgccagtttactcactatgcactaatctaaacaagatagtgctaacaatctactcaagggcaagtaactattatatttttactaattaaaaaaccaagattaatacatatttcaatgagctcaacttttttttttttaaatatagactgggttttgctatgttgtctaggctggtctcaaactcctgggctcaagcaatcctcctgtattggccacccaaagtgctgagattacaggtgacaacctcatttttttgaaattgaaatgacaataacatcataaaacttttcccttcataatcacaactttctcctacagtaaagtaacatctatttttaaaaccgattatttggtgaaaataatcttcaaaaaataatgtctgccttgttatttgttaaatttttaaagtttttagcttttaatatttgaacaaatagtactaaattattgacagtccatcagtacaagtagtcttcccttacttttctcaaataatcctttgcttccaatgatcacatgaattttatagataacatggtttggctgtgtccccacccaaatctcaacttgaattgtatcttccagaattcccacatgttgtgggagggaccggggtgtggtaattgaatcatgggagctgctcttgcccgtgctattctcataatagtgaataagtctcacgagatctgacgggttcttcaggggtttctgcttttgcttcttcctcatcttctcctgccgctgccatgtaagaagtgccttttgcctcctgccatcattctggggcttccccagccatgtggaaatgtaagtccaattaaacctctctttttttttccagtatcgggcatgtctttatcagcagcatgaaaatggataaatacaatagatatttccctataagcaaacatcttacatgtcacatatcctacacagaagagcttcagggcaaaaagaaaaaaagatgaggtgctgtattccatgacaagctgaattcctcatttaatgtgaacttttacccatgctggatttaaaaaaaaaaagatactcaagtaatactttttcttgacttgatgttaattctactgccacaaaatgcattctatccgtccattgtctcaccttttcctctctgcacaaaaaaggtacaatttacatcagtttcaagagttatagatcaaagtgaagacccaaaatatatctgaagggcccagggaacttctgggtttaacttttctttaactttttaatttctccttccaattagtggtggtgtgtttgtaattccaatttactcagaagccagagatatgtgacatcaacaattacaagcattcaactatatatcaatgaaagcatacagttattaacttctaaaaagcatgcttcattttaaaacagaaattcacacctcaggcaattttccacagctatgctccagtttattaaatatcattcttatttgagtctgataaaaataattactatgtaaaattacatggctaattaaggatctgctgaagaaatctaatccatcatgaaaacactgtcctgccaccacacccagctaatttttgtatttttagtagagacggggtttcaccctgtttgccaggctggtctcgaactcctgacctcaggtgatctgcccggcttggcctcccaaagtgctgggattgcaggcatgagccactgtgcctggccaacactgatgattggatttatatgttataactgcatatacatatatatacacacacacacagacataaaatatataaatttattttatgtattattaaaagttatatgttatatatcacttcatatatgcaaatataatttgtaaaactagcataagttttggttgctcaggacaggctttcaaatgagataacaatatggcctgttatatttacaaagttctgtctctaaagggagcacatgtgacagctgatgaaatctgcactatgtaatattctcagttatttcaaaaaagcttttaaaagccccttggtgtaaatttttaaaatatcaaaataaatatatgccttttgatttgcaaatcaaagaattcaagagtagttacaaaaaaaaaagaaaaacagaataaaacaaaggattcaatggaatcatagaatcttgactctttttaaggagacattaaaatattgttaaagctctgtaattgacatggacacaaagaagggaataacagactccaggaccgcttgagggaggaaggtgagaggagagagatgattgaaaacctacctgtctggtactatgcttattacctgggtgatgaaataatctgtacaccaaatccccatgacatgcaatttacatatataacaaatctgtacatgtaccctgaatctaaaagttaaaaaaaatctgtaattgtgatttatactatataataaggatatgaatctagagtcttaacttcaaaaatagtgttttctaacctacacatgacctatatagaggtaaatggtattatttaaacaaataaattaaggttcttattaaatttcccatttaagcttcaagtgaagtttattatattacagtataaaatctatctaatataaattttcttcattttatatttgtaaaaccttataacttttaatttttccaatgaaatataaaatgaaaataaattgtcatcttcccttctaattgctctgtattaaaaatttttgtttctctcctttaaaatggcttgttatatatattaacatgacaatccccaataaatttattgtaagaattttatatgacactatcatatttttgtgcaactgtttataaataagccatctgttttccaaaaaatatatgcagagacaaaatttcagaaagccctacatataggtatccttatttttcccttccgaaaagtttttcagctttgactcttttagctaggataagaagatgaaagatgatgggtgggatttaaaacaaatgttttcctcagctcacacatcagaaatggtattctcaattccataactatttgttgttttccatcagactactagtctatcatgaagatgataaatatagataggttgggagttatgtatctgttgtcaactaagaatgtgcccaaaccaaaccatttggtgataatgttgactcactgcactcaaaagcagggttattttaatgcaaatgaacctgaattacttcccattacaaagttttctgctgtaaaatttggcctatctagtaaaggcacaaaaaacaagcaccaacttttataactaagtggaaagaaggggttcaaaagaagagaaaggaaagagaaaagtaatctttagagctacatttgtgaaccactttctttccttctcacatatcttgctctagctaaaaaaagaatctacagatgagcccacttaatagttatcataataatatttctagtaaaggtaggtaggacatttactgtttcaggaaaaatctcctcagtcacatgatacaagatattcttaaaaatcccaagactgtatatactacaatctccaaatatcattaaagtcattaagcaaagatgtgcactaagctgcacatatattaaaagtaatggaaaaaaacacaactgcttttgcaccaacctaatacaatgcactacctttctaaatacataacttttggagtgaaattgcatattctctcgctctcattgttacagtttggtgggaaagaagagttttataccccacctttgacaactggactttagactttgtatgtctgtcttcctctttctccttccaagagttactgaatatatatgtgtagtatgaacttatctcctagtttgcctgagagagtcccagttggcatctgtagacccagcatctggtacagtgcccctttaaactctcagaaacatcccaatttagttgtacagtcaatctagctatatgtggtactatattaaatgttggggacatcacagtgaagaacatacgattctttccctcaaaagatttagaaagatatacaggtaaacagaaaattggggaaactttctcctaatttcccagatttatatgatatctcctcttatctttacctttccgacttgtagcaaccacatcttccaaaacactacaagagtatgtttaatgtgccaaagtttcattggccaaatatagtctacctggttcctcactggcctgaagctgcctttctcctcaatagcctaagatatacctgtcctgcaagttataaacttgttttccaatatggctgaaatgctaatcaacagatttctttctaattcctccatctttttccatacaattaatactctaagattctgaaccttagaataattttaataatcttagataatctcaacagccaatcctgagttgcataatcagtatgttatttttaaatgttcccatgtattgatagtttgtcaactcaataacaatgtttctggtgataatttgatagtacaaacgataataagaaatattcatttaagtcagaaagtaattaaatttattatatcttaaatatatctgcaggtaacaagtcaatagaactaagtttaaaaaaacagggtatcttgattaaattgagcattcttttactgatctataagaggtaaagcattttagagtctcatgagtgtatatatattttagaaaaaactttaaaatacaaaatattttaagttctattagcgtatagtaataataacttttttttttcaaagaacaattcaagttgctattgaacatagaaacttttaacttccggaaaggcaattcaaagattcagtaaatatgcatttctacaattggcttttaaatggattagtttcttacgacttaggatttttcccaaaatttgtggagaagaaagtgtacatgtgatatttatgccaaccaaaaatcaattactactttgaagtgtaaagcttaaaactctacaaaataaagagaaacacagtaacaaagaagtaaactaataagagctatttctaattctaagcctaaaataaacactttgaagaaaaataaaccactgttctatcaaactttagtaaccaatatacagtgtactgtttcagctccttctttagctttccatctctctttcctacccgacagatcagatttgattagtggatattttatcatcccattttacactcttttacttcagtcctcttctttgttccctgtcctaagaatgtctttacctattctcaccaatgaaattcctactcaaacttcaaattgatcaagtatcttccttttatgaaacctttccagaatgctatctcttctttttgctaccacacacaagaaaattgaaaccccctaaacttcttgctctgtgctaacataatagtatgtatacttgtctcctagacttataagtagtcattttcacatttatttaccgtatcatagtatgaagtcctttgggaaaggaataaatgttatttattgaaagaatctcaattctgtaagcagcacttggcatggcacagtgtcagcacagttatatactgaaagactaaattaattgaaactgttttttttcttatgtaacatatggtcaatataaaatttggacaaatgatttaaaacaccttgtctattgatttttttttagcataatattaaagaacatttatggtggctttaaagaagttcaaaattaaataccaattcaagatttcaaatgcaattttatagaaatcataactgaggaaattattaatacttagagaaacaagcaatcaataattgttgagaggtcttttaattataatattggatgttaaaatgtattactgataaaattgatcaaactaaagaacagtctttttggtcttttttttgtttgtttttgagacggagtctcgctctgtcacccaggctggagtgcagtggcgcaatctcggttcactgcaagctctacctcccaggttcaagtgattctcctgcctcagcctcccaagtagctgggattacaggcgcctgccaccatgcccagctatttttgtatttttagtagagacagggtttcaccgtgttggccaggctggtctcgaactcctgacgtcgtgatctgccctcctcggcctcccaaagtgctgggattacaggcgtgagccactgcgcccagcttttttggcctttctgacaagtctctccaaattcatgttgtgtacactacagtctctaatttaataaattaaacaagacattgtcttgcatatctgtatagtatgccttttaaaagtgtgttaaggctggccgcagtggctcaagcctgtaattccagcactttgggagggagaggtgagcgaatggcttgagctcctgagtttgagatcagcctggggaacatggccaaactcttatctctacaaaaaaatacaaaaattagccagatgtggtgatgcatgcctgtagtctcagctactcaggaggctgaggtggaagggtggcttgagcacaggaggtggaggttgcagtgagctgagattgtgccatggcactctaacctgggtgaaagagccagaccttgtatcaaaaaagtgtgttaaaaaagcctgcaattagaaagtgtggaaatttgtctttttcatattggaaattcattattaatatacaatgtatgtatctgagatatgaaacagtagaaaaataaaattttgggaggaagataatttctatgttttgtaacaggcatctagaaatagaaatagaaatcaatgtaacagaagatgtctcatatggtcttttaagaggtggccatctagccaggtatcatccagccatctaagaaacagtctaatcagctcatgttataagtcctgtttttattgcttatttgaggattccccaatattttcatctttctaaagtatagaaatttagcccaacactgtatattaattgggcttttatatttggaaagttcagtaaacactacaatttcatgttagctttgaaactaacagcattatattgctgacatatttagctgatgattattaaatttctttttatacggcacaaatactaacctgcttattttttacttttaatcttctcagtgtctttggtcaccatttgacagattatttaaattgcatagtttctgaaatcttgtgatattacccaaggttttattaaatccactcatttttctattaactgaaatctgaaagagtacactatcaattctataataaacatcactgataagggtaagaaggaagctattagtaagaatggggcacatccctcttaataaggtacaggacacaaccttatggaacattacttcataaattttgaagaaggtataacatggtccttgaagtcaatgaccttattaaggtaatctataagcaaaaaacaacttccactacaaaatgcactcctccttaattagaaaaagtcaaagcaaaaagctgtaccttctaaaaatctttcttgaattaatctcaactttatacaagtccacactgtagaaaatgtgcaaagaattggacacatctatgtcaaaccaaaccatttcaaaatacaaaagccaatggattttgcgtttcaaaattaacatagagataatggatcattatttccatttctaactcctatctacactgtagacacagatatataggaatgaacacatgattcaatttgcttgtaaacacaaaatttttaaaaagttttaattatttttctctatacctcaaggtacatgatgctgaaaaaacaaatgtttttatgtgctaagctatttatccatattctgttcctcctacttttagctttacttttttgagtttacattttcctttctgcttcctttctaattattttcccattatatcaacctctgatactctaattttatattcatttctaaccaagtaaaattattactaattgagatcccacttactcagaatttttgatgaatcagatacaacatctagtattcctacttcacttatgaaaactggagaattacataaaaccataatgatatatataatacagaatcaggttcaagttgtttaaaataacgtaggaagaattatatatagttaaaaacaagatcaaaaggatatctgataagcatcacaaaaacagtaaatgggagagtgagcagctttgtagtctgctctaaaagaacagaaaaactataagaaaattccctggccttaaaatacacagaatcttgttgaaaggatataaaacagtataaaatgtcacaataataacactagcaaaaactagtacttacagtaacagtaacattaagaaataaataatagcacttattgaatatttctatgtaccagaaatttacatattatgtttaacctctacaatatttttattgtagatatgagaaaaatgttacctacacaacttaaataataagtagtgaaacttaaattttaaacacttttctgttttaaaagtgtgggttttcttgttttgttttcaatttctgtgggtacatagaacatgcatatatttatggggtaaatgagatacattgatatagacatgcaatgcataatctcattcagggaaaatgaggtatccatcacctcaagtatttttcttttgtgttaaaaacaatccaattatatacttacttattttaaaatgtacaattaaattattattaactgtagtcaccctgttgtgctagcaaatacaaggtcttatttattctttcggttatttttttttttttacccattcacaatgtgtatcctccaactcctaccctccactacccttcccagcctgtggtaaccatcattctactctctatctccatgagttcaaatgttttgattttcagatcccaccaataagtgagaacatgtgaagcctgtctttttgtgcctggcttatttcatttaacataataacctccagttccaaccatgttgttgaaaatgacgggatcccattttttcttatggctgaatagtactccattgtgtattaagtgccacattttctttacccacttgtctgttgatggacacttaggttgcttccaaatcttggctatcatgaatggtgctgcaataaacatgggagtgcagatatctctctgacactcatttcctttcttttgggtatatacctagcagtaggattgctggatcatatggtaggtttactttcagtttattgaagaacctctaaactgttctccatagtggttatactaacttacattaccaccaacagtgcatgagggttcctttttctctacatcctcaccagcatttgttattgcctatcttttgggtaaaagccattttaagcagagtgacacgatatctcattgtagttttgacttgaatttctctgatcatcaatgatgttgagcaccttttcagaagcctgtttgccatgtgtatgtcttcttttgagaaatgtgtaatcaaatcttttgccctttttaaaatcagattattagattttttttctatagagttatctgagcttcctatatattctggctgttaatctcttatcaggtgggtagttttcaaacattttctcccattctgtgagttgtctcctaactttgttgattgtctcctttgctgttcagaaggtttttaacttgatgtgatctcatttgtccatttttgctttgtttgcctctgcttatggggtattactcgacatctttgcctggaccaacgtcctggagagcttccccagtgttttcttatagtagtttcataatttgaggtcttagatttaagactttaaaccattttgatttgatttttgtgtatgttgacagatagaggtctagtttcattcttctgcatatgaagatctaatttcctcagaactatttgttgaagagactttaagaacagtgaatgttcttgacacctttgttgaaaatgtgttcattgtaagtgtatagatttgcttctgggttctctattctgttctattggtctatgtgtctgtttttatgccagtaccattttgtttcagttactatagctctgtagtataatttgaagtcagataatgtgattcctccagttttgttctttttgctcaggacagctttggctattctgggtcttttgtgggtccatataaattttaggatttttttttctatctaaatctgcgtatttttaacttctattctattacttccaaaaaagagttcaggaaattatagtacaagtttgaatgtggctaaagttgtcctgaatgaattcacaaacaggttacgctatgacatgaactcttaaggaggaggtatattttagggaagttgaagaaagagggagtatattttgggtatgcatgcatgggaaatgagataaatgtaaagtatttttaatactctgcttacacaattaaacatttaaactttttactaatttacaatggacttgcccatggtgaagctttttgtgagcaattttgattgtgaaaaacacaaacggcagtctcttattttctcaaactcgcatgcctgcaattgaactgaaatgagatcagatatcaaatatccattagaaaaataccataattctttgtggatttggaggaaagactgaactttctaatttctctttatggattttattggatggaccatcatcgtatttttggggtcaaaatcttaaatttaatcaaatattacatcagcacaccagtacatcagtagtttctctgtagaaagacatggaagacatttgcttaccttgtattacatgtgagttgtcttttaagaagaagttatacaggtatttgggaataaaagcagacatacatgcataagccaaggctaaaagagaataaggcaaaggcatgtaaaaaattagttaacagggtagatgaccatcagtaatgcattcacttagcacatattccttgaaactactattaaataacagttatgatagccaagtgctagaaaaacaaaattaagagataaaagcctctatgctttaaaatagaaaatatttttattttagacaacaaaaaataataattctataacttcaatttcaaactagcatggcaatcattatcacacaataatcacaacttttattacctaaacgttgtttcttaaaatttctaagcatgatcattattagtaagttatacggacctcacgatccttaactgctgctgatgcaaacaagagtctacgaactatggatttaggaatagtgttataattcacattttcaaacacagacccctgactatgtttgggtcagtatgagtgatcattggctatgcctaactaaacatagtaaaaaactctagtctagattaatgagtgagaatatcacagaacagagtattttaaaaacaattcaaagagtaaaatttcatttctctgggattatgctatttttacttaattccagaaaccgatgcaaattcggtcatgaaatagaatctgaaaatagggagatcttcagataaggcatctagacattcaagctatatacagtaacacactctatatgtgatttcagggattggagttaatcgaatttagtatttattgaaaagcctacaataataaagttattgcagaagggcaggaaaaaaaaaacctgccattgaaaaagggctgtcaaaaaatattacaacattagtatataagtattagaatacaagatagacacaagataaatttttataaatacaaagtgctttatgggctgaagaaggagaatgagaaaagtcttcattaaggaagaggtatccaaaatgataggctttggagatgcaaggttatggaaaagtgccaccataattgatttctttacaaattctttagaaagtatacttagacaaaaattaatctctaaagaatttagaataatcaaattccactaaatttctagtaatagctttagcataactgaaactctccagtaataaattaatccttcacatctctaaaatgagtctataatagattatttcacagaaatctaccagggagagaataagagccttaaaacaaaaacaaaaacctttcatgtgtgaatcaaatattttagaatattatgcgcaatgattatttaaatgttaaagaggcttaccttcattattgaagtttagatataggaatggagcacaaagtgagtcaagacctaacacagaggggttgggagaaagaagtcaaataaatataatctagtagaattgaagatatataccttattcaattctttgcattacctccaagtagattaaacattagaagtattatccatccagaaatatgttacttcatgagttactgtggggagtgagtgatagtgtagcacacagtatgtgtccaatatgaatcagttattattatctatattattatgagttgaaaagagaaatacaataatagaaaaatgtaagaatgttacaatgctttggatattgtcccatctctgactctaaatgtacaatcttggcaattacttaacatcttctggcatactttctcatctaggacatggagttttgcctatgttgtttttctttgggattatgaaaaaaaattctttaaaaattgtgaagtggattccaaatatatgacatttcttttattgataataatgatatgcatgtattgtcatgttgaaagaatgtacataaatctacctacaactgttaggaggatatagaatagctctgaaatacacagagctaagaaaaataacagctttatttaaactatggtaagaaatagagaactgaaatataaaagtagccacttataacaacacattcaaaaatagggttggaatgggtttctcattctttatcaaacacaaaaaataataatggcaaagctaaaaataaaagatatgaaccattaaagatacaagaaaaaaaagacaataaataaaatgaggactttaggatgatagactatttttaagtgctaatagccatggtaagtataaattagaaatcattaactataagaatctcaactagccccaattgatttaacaatttgcataggcgtttaaaaaatgtatccacaaagatcacaacagctccaaatattctttctgctttgctaatcaacttgtatattaaatattatgttttttaatgatatctactaggatttagacaaagatttttaaaaatgtttggatgtaaacctctcaaaaaatgaatcagagcgtcaatattgactttccccaaagacaaggatgtttagatattttaatttttttaaatgtcagttatgcaacaattttctaatactccagaggagttttaatgactacaaaagttaccttgccaatacacaagatcaggatgagacactacccaggcttttaatacacgcctaaattttgcatgaccttctggtgatgataacagttcatcgtactgatgacagcgaggaatatccacttcaatctgttaaaatagcaaaataataaggtgaaacagtaattgtgtaatcagcaataaacccttaatccttgttcattaaataaggaaaaggagaagctataatatgaatttcaaaacagaccaacttcttaagtgcctaattttttgaattttttaattgatcttatggaaagactaaagaagttgtatgtatacctaaacaggagaattagaccatttcttttgaaaggtatgtatgtgttaatatacttttcaaaaatattttcctttataatctggtccaaatgaagggcaaatttttcagatgaagaactacagtatttttaaaaaggtaacttgacctaaagtcctttaaggtattgttcttactaatttataagcataagagttatggtttctctaacaatatatgtatgcagcagtgtctctgtattcatgagagaaagaggctttcttcatgctccttcctaaaatttaaatatttggcagaattatcttaggttgcttaagaaaacctaaatcatacttgtctatctgtaggaattggagtgtctttatcaattgcatcgtacttggcatgaatagctccctgcaaaaaataaaagaagatatattaatttatcatatccttaatacaaatagtaatatagagaaatctattttttacaaatatctatctttggaaacctacccaactacagataagcacattcaaactcagggtagaactcatcttaagagaaattctctgtgtctttgacaatctgtgatgaaggtctctgataagtgacaatttgccattttgctgaggcaaactcttgaattatacataccagaacataaatgtcatggattaattacttagctagtaagtatgtttggccaacctcccagaccctacaacataacacaaccttgttatgttatatctataattacatgatagaatcattagggcctaaagaggtcatttacgcttttcagttagactgttaaaatttagaaataactgaatgaacgactacaaattttggtcgtgttctataggaccaagcatgaaaaaaatattattattctggcttattatcatggtagagaaagagccaggaagtagggttcaaactccaatatcggctattatcaacttctttgagacattaatttaatgagagttggacaacctgatacctgaagtcctcttgaactttagcattatattgttctacaagtctaatgattaatgtatgatattgaacaattggcattcttgtaaagtaaccaactaaactcaaaggtatttgtagactcttatcaagggaatcaggaatgaagaaaggaaattcttcaaacagaggattgaaaaggattaaaaatagttgaggatttctaaaaattttttagagtcagggtctagttctatcacccaggctagagtgcagtggcacaaccaaggttcactgcagcctcgaactcctgggctcaagtaatccttctgcctcagctttccaagaagctgggaccacaggcatgtgccaccattccagactggaattctttaaaaaggaaggataattatctataagagaatataagaagacaagatgacaaagaaattgacaagaaatgaaaaaaatctggcaagaatttggcccattattatgattgatgtcatcggagttctctgttagtattgcaggccaccataatttgtgacacatctttcctcacaaccacagagaaagtgctatttctcttggtagcatagtccaggtggaataggtgtgccaaaagtcactaaattatgttagtgattttgacaagtcagattagatggaaagatttctccaaatttagacagaaccatttataaacaatcatattctataacaagcatactttataagcaggactacccatttataactgatatatattcttaaaatattctatggtaataatcaaaacattttctgtgaccactattaaatgaaacattaaatagcataatctaataaaccctccattatatttttctattctattgttttcctatattctttccacttaaaattgccaaatattctaatgcttatattttactatataattttctaataactagaaaaatatatatttggaaagcactctccttctccatcctttctttgcataattaatcagcttctaaccttttcttttttccttacctcaactcccagaagagcagcccaggttaaacctctcataagaggaggaatgtcaactcttgcttctttccagatttggttttttttatatggataagcctatgatatcaaaaaagaaatgaaaacgtctcaaattacctagtgccatcttttagtctagacagttctgaatatacccatgataaaacttaagtgacttgcaataaatttcaaagtatgtgcaattattgtgtctggtgttattaatacacataaataagcagtagaatgaatgaatccctaacaccttgaaaaactcgtattatataattaagaagagcagctgattctacctgatttttaatccttcctctctatttgatgctctggggggattttaaatgagtcagatggaggataatagtaccagtctcatacgggttaaataagataatgcaggtaaagcactctgttaaaaacgtggtgatagagaagtgatcaataactataagctactattatgagtacttccgcattttgcatataaatttatacttttataaatttgtgtcttaggagaaatttctagaagagtattaataggacaaaggcaacagatgttgttaaggttcttgatatatgcattcaaattgttttacaaaatgtttcagtacattcacatttattccaacagaatgagagttccaatatcattgcatctgtgctcactttgctaatgcagtatggaaaatcactcctattttaatttgtatttttttcattcccagtgaagatgaacaatttgcatagatttactagctgtatttatattatgtactctatccatttctctgtttcaatattgatgtttttcctgttgacttttaagtcttcttttaaaaaataaagacattattccttttttaacatgattttgcatatgttaccacaccttgtttttactttttaattttacttactaagaacatgtatcatttttaaaatgaaagaaagctaactgaacaagataggtcataaaaattaatcttcttattactcaagattccctaagaattattgaaaaaattaaaaaaaaattccatatgggctattgttaacactttatactttagaatccatacctttagcagcctgtcgaagagaataattctatttagttggtactctgtatccttctctctgatgattaaagggagcgtggcagctgcagacaactcattattgctgtttgaatgaggtaaattagactggctgtaaaagagaacaaaagcaataaaaaaaaaaaatggacaaaaggtacaaaattttctttttttttcctaactctaccaacagtgatttcagaaaaagcacaaaattttaataaaccaaaacctcaggttattattttctatttaggaaacatttttcaaagaaaatgtataaaattcttataaatctaatataaatagaaagaaaaataaatctaaaatgagactacatatactcactcatcttcaagtaatgggtaaaatgcttctccaccaacatctttcaatctctgtgtatttaaagacaaaatatttatgtataaacatattgggcagaaaccctgatctgtgtttaaaaagacaagtaatataacaactataaatttataaagggacctagaaaagtataaaatagagtctaaaaatcagttcttaccataaacatgcaagcatacaatgcctctactgattacggtttggctgtgaaaaacaactatttttttcttatctataggtatcactcataaatgttagacacttatcatgatatattttccaaacagaactcagaattactagcactagtataaaacttaatgaatgggaaaaaaattttaagttatatgaagaaagatgattaaaaagaggtactatatagccatgtatatactaaaagaacaacttagatttatttttgctttggcataatacaagctaagtcaaaaagaaaggtgctagaaaaaggattccaaaatatttctcacatcatactttgaacatgtatgattcaaatagctaataaatcaatggagagagttcacttaatgacaaaatcattttaataaatgttgttccaaataacaaccctgacaggattacaggtattcttcaaaatcataagcaggaaggcagtagtaaagtaaaatgttaaccacatcctaagcaaggtgattaaagttaatgccatcttgcctgctgctctgctgttcaacttccaacttgaaggcagaatgtctgctcctatggggattgacatagaaattcaagctgtgtgtgcagcaagcactgatcttctgctgattagagtctttgtgcacccatgtgagttattcccagaatttttaaagcttaagaaaaatcttttactcaaactaagaattcagcaaacactgaatttatgcctggttctactctaaaaatcaatgtgctatgtacttatcctattttaaaaaacctttaggtatatctttcatatattaaaattttaagttaggaaataaaattttcccaagttttactgcattattaatacacataaatctttttaaagattagttttcagtatactgtatgtcatagattttatctaattaagtatcttgtctgtcttttctaaataaaaacttagcacattaggatttttaaaaggtgaatgaaaacactaaagataaaaattattatatggtttccatatcattttaagattcagcaaattaatatttcttaataactacagaagaagagtattttaaatttcacaagtagaactgtaaaggaattgagacatttagatttgaagcctacattcatttaacttggattatatttaaattgaagaaacaaattaagagcaaaacaaaatcagctgaaatcatatattttggatgtaatttattgttcgctgcagggtattattacttattttgttactttccacatcctttctttcaaagagattataaattcagagtactgagtaggaatagttatatattttaattttctgttgctggcattatggcagacaagagattctaatactctcctactatataacatgtaaaatattaaatggttagataagctttaaaacataaggaaaatgcagtgataacagatataaaaccaggcctagagagaaagtagttaataactgtggtctagagatttagaccataatgggataagggtttgggaacctacataacagaccttcagaatggagaagacccttctaaagccacgtaaagaaaaaactaggggaattgctggcttagacagaaaacaaggataggtacctatttcagctttggctatgaatggttaaaaataaaaaggctaggacttccactttcttatacaaaatataaacagcttagaaggcatcattcttcctctaacaagaaaaatgctgaacaaactgaaaatcaagaactcgtctcacatctgtcagaatcagagcattgtgatgtcctcaaagctggagggaccctcgaatacagggaatcacagctcaacaggaacagagccactgctggagtctgttaagatcaattaaaaggtaattatctaatacttgcaggctgagcacagactaatacgagagagaaaaacttctggaggccctgccttagggaggccttccttgcttccatgagattaacctctgcaggtcccaccaggttctcagggtgaagatctgagaaaaatacccttgacttcctgcagggggaggtggaaagtaaccaatctgaaatacagccagagtactctgttttccttgagaggcctgtcttaaagggaaactcttcggtcaggtcttaactaacttgggttttacagaaatctaaccaacttgggaaggaaatattcaactccagtccactctagtctttgatgtaggggaacagaaatacccaactccagcccctctagctttcctgtctcatgttggggaggaggagtgggagaagctgagaagccttgtgaaggtcacagcccaggaacacaggctcactaaaaaactgggacttaatgataagattataaaatacttctcccctatactttactatgatattaatagggcttctacataataacaggattcattccttcatttagttattatataggaagaaaacatataacacatcaaatgaagagaagtacaatggaggaaaaaaacaaaacaggataaagaatacaagggataggtgtggcgttgctattttataaaggatggccaacaaaagcccaccaataggtgacattttagcagagaatgtaaagaaaagaaatggaagcaccggaagagtgttacaggcagtgggaagagcaagtttaaaggccttaaaacatataactttagaaaatgatttaaaaacaaaataaacaacctgagtaaacttataaccattaagcagactgaagtaatgattacacccaaatagggataaggagcccttacaatatggttttaaagctaactcccatgaaacattcaagaaatagatacatgtaatcatataaagtctttcagaaaatagaaaaaaaaaggcaacactctcctatttattttatgagactagtatacccctgataccaaactagcatcgtgcagtaaaagaaaagaaactcacaggcctatctcaaatagaaacagaaatgcaaaaattctaaacaaaatattagaaaatcaaaacacaaatgtataaaaaaggaaaaatgaaatcatgatctgtttgggtttatcccagaaatacaaacatggctcaacattgaaaaaccccatcaacataattaaatccattaacataatacataaaaaagcatatgaccatcccaatagatacagtaaaaacactcagtgaaattcaacacccattcataacaaaacttataactaagaatagaagacctctataactcaatgcaacaaatatcatacttaattatgaaatataaaaagcaaacttttaaaaccagaaattagacaggagtgcccactatttgtttctattcaatagcgttatagacgctcagcaaaaataatgagaaaagatgaagtgagtagataagaatttggaaatgaaggaaaaaaccctaccttaattcacaaagaaaaccacagggaatctatagacatattatttaaaaaagaataggttcagcaatgttgcctgacacaaaatccacataaaaaaatcaattgtgttactaatcatgcacaaaacagtagttgaaatagtattttaaaaaatattattgatttattttttaaaatcctctactggtatacttaagatttggtacattttactacatgaaaaaatattattgatgtatattttaaactcatctactggtatacttaagatctatacattttactatatgaaaattttgcctagaaaagaactataaacaaatcttaaactctaatgtgtaagctgaattgtagtaatgtcttcattttactttgaaatgcaagaacaaaaaatatgatggattgatgaatagctagaaagatagacatgtgataaagcatgtaaaatgttaattatagaatctaggtcagggattagcaaactgtttctatgcagggccatatgacaaatatttttagctttgtgggccatgcagtctctatcgcaactactcaattctgccaatgcagaacaaaacagctatacataataggtcaatgaataggtgtgacttgattttgctaatagatcatatcaatgcttgatgtaggtggtaagttgttcactgtaaatgcttttcaacttttctgtttaaaaatttttataataaaatgttggaaaaaatcatactcatacttacatatatatatatattctatatacaagagcaataataaattaccttagaaataaatctgataactgatatacagacattaaaaataaaattgttatataaaataagacaaataaatgacatatttatttaagcatgttcaagaaataaaaccctacattttaaatacatcaattctctacaaattaacttatcaattcaatgcaatgtcaatcaaaaccctataattttttatgaagttctttatgatgattataaaaatcagctagtagaggaagatgttaaagagttcctactccattttgaggacaaaaaaactgaaggtcttcccttgctagatatcaacagttcacataaaactacagattaaggcaatgtggtatttgctaaaattagaaaaacaggccaacaaatcagaatatcaaggcccagaaacatatccatatacatagaaaaagttggtattatagatcaaaaaagtgaagagaaaactattcaatatatggtactgagacaaggggtatttttttaatcaatgaaatatgatattggataccttccttacaacttaatctaaaataaattctaggtggattaaagaactaaatgtgaaacaattatttaaatcttttataaggaaatatataaaaacattataaaacatacttataaccttgctattactttaaataagttacaagaaaaaatatatcaaaatatatttgactataaaagaaaatactgataaaaatttagaattctattcaataaaagaatcaaaaagttgaaggaaaagccacagattagaatatatttccatgacatacagctcacaaagatacgatatcagggacatagtttcaaaagtcctcaaatcaataagaaatcactcaacagaaaaactgacaagagatatgaactagtaatacatagaagaggtaggtgaactgctagaatatgtgaaaagacttacaactgcactataatcaggaaattaaaaattagtattacagcaaaatacctttccataccattagattaacaattttttaaaatgtgataaaagaaagtgttaccaggtaaataaagaaatgagaacagttacccaatgatggcgaaaagataaactgataaaatcatttttgtgaacaatcaggtaataaagctgaagttgtacagatgcaattctactctggggcacatattttacagaagctctcccatattttgtgaaatcaaagaggcatacaagatttcttgtgtatctgtaaggttttaattaaagaaaaaaacctaaagcagaactgtcaaaatatctttcttacatttcttagctggcataacgacaatgtcacagtggtatcatctaaaagcgagcttctatctcgaccttgtccaaagctttcaccatcctcaaagagaaaactgaaaagaaatttttaaaaataatatgtacacaaaatccagtttattgtttcttctagaaagtaaagtttattctaagtcatcaatcccttcatcaaaaaagaattaaactttagactggatgtttaataaaacaatgtttttttaattattattattatactttaagttttagggtacatgtgcacaatgtgcaggttagttacatatgtatacatgtgccgtgctggtgtgctgcacccattaactcgtcatttagcattaggtatatctcctaaagctatccctccccctccccccaccccacaacagtccccagagtgtgatgttacccttcctgtgtccatgtgttctcactgttcaattctcacctatgagtgagaatatgcggtgtttggttttttgttcttgcgatagtttactgagaatgatgatttccaatttcatccatgtccctacaaaggacatgaactcatcattttttatggctgcatagtattccatggtatatatgtgccacatatacataaacatatacatatgtgccacatatacattgcatataaaacaatgtattgagatttcttcaaacaagtctcattttcaaatatctcttgagttggtatgaatgtaagtatagagaatttcagaaaaacaaaagtgtcatttacaaccctttgttcatgcagtttcaatgctaacagtactctcctgacattaactcaatgtgttcccaagaaactttatacgtgtagaaaaagataaagggaagatgaaagaaaaagcatattggatagtaacctcatagaagaaaggatattaaataataaatgaataaaatttgtttacaatttcaataaattacttttaagaatctacatatcctttaaaccatttcttcttggaatttccgtaatcttacctctaactttctacttaattcaatgtatgaatggtataatcaaagttaacatttaaaaatcagattaagagagaaaaaaatagaaactagtcaatccaaacaatacaaaagtttaaaaagtaaagaaaaaaatgatgagcagatgacttctacagttgcctacaataatcaaaactaagtctagaaatctaaaaattaaaattttattttattttgagacagggtctctcattcactcaggctgaagtgcagtagcatgatcttggctcactgcagcctcaacttccctgggctcaggtgattctcccacctgcagctgcctgagtagctaggactacaggcacacaacaccacgcccagctaattttttttctttgtagagacagggttttgccatgttgcccaggctgatctcaaactcctaggttcaagcaatccacctgccttgcctcccaaagtgctgggatcacaggcatgatccaccatgcccagcctaaaattaaaaatttaaagtattagtagaagctcaagaaatttaggttcatatttttatgaataaacatgaatagcaatgttaataacaatcttagccccaaggctgtagaggtatttaacttccagtctaatttctagcatgatatcttcttatacagttaggcagatttttttgcaacacactagcacagtaatgatctctaggacacacagtgagaccacagagttcatttacatttacaagtatatttggaaaaagaacatagttcttcatagtaggaacattaagctagtttttagttaactgtcttaaatattctattgtgacttgtgtatttttcattaacatcaattattgcaagatattccataatattaacttcacttcaagtaggtcacaaagcaaattactgatcaaagacaactgatgggaactctgcaattagaaactttggccaatcaaacaaggtgttgattccaattgcttccaataatcacttagctgggatgcctaccaaaaaaattttaaaaacaaccaatttaaaaaaaaaaaacaccgattttcttttttattattaccatagaattattaccatgtatttatttatttaaattcccaagagaagtttctttccttacttggggagtgtgcagataggtggtttggatcgaatgatttccttgttgacaagctctttctccaagtcacctccagccaaacaccaaaggtaatacacttcttcaatagatctttctgccaggtaatcattatttatatctattaaaagcaaatttaaggaatcattgtattatattttctacttttattaaacgtcaacaggcagtaatagctgccattctaaaaaaaataaactctgaagaacagacttccagttcctagttctgattgtagggagcctgaaatttgctactccatcctaacaacaaataaaaagttgaacagactgaaaaatcaacaattcttggatctgtaagagaggtgaggacataggacaaacttctgtccccaggactggagacagagaggagaataaagggagctatggcattctggaacagacattcatgagcagtgcctcaggaaccagtgccaagtttggaaaacctaaactgtaattgataaattactggaggctcagtgtggacaagtctgagagttaaaaactccagagggaaccagtcaaaagggatagccccacacttttgtgagtctggagactgacaaggttctcacagtaaatattggaggaaaatgcccttatgtttccagcagtggcagaggaaatgtaaccattctgaaatacaatgagcactgttcttaacaaggtctgtcttcaggataaaccggttagtcagaggctaactcacttagataatatcagagcctaactgacctggagaggggaaataccaaaatgcagccagctctagccttctatgtggtggttaaggtatggggaacagaagcattctgtagtcagtcctacaatttaggtctcaatctttaagtgagccagtcactctagacaaagtgtttccttgcccttaaggggtggctagaacgagttggagcttgatatttcccctctcctactggaggtatgccatgactggcagattctgattcaatttttgtaataatttgaatgctcccgactgaaaataatatactactaaaagtggcttatataataaagacatttattcatctctgttaataaaatcataggtacaggaggggcctatgcttatcaaaattctagaccattttctgcattcagaagagaagaaagtggtgaacctatgctgcagtacctttcttgacaagaaaatttgttttttccctataagtagcccttatgtccagcactttcatttagatcccattagccaactctagttcacaagcttactgcccatagcaagggaaactagaaaaaaacatctggaattttcaccctttataatgaatacatagtattggaaattttacactctatattggaaaaggaataaggggagaaaatagcacatggggaggcaaccaacacaaattgttccttccctcatatctcaaggcaacggctggctgccttttctgaagtcttccttgatgtcccagacagaaatacagaattaggtgctcctgctatgctgccattgtgctatattcatattgaccttcatttataacagtgattgtataattaaatgtctgtctgccttcccatttggcatgaatgttacttaaagatacagtatgtgacacataccaggaactcaataaatgtttaattgaatgaatgtttagtaaccattttctgctatgacttaagtcataacaacttttcagaataaaggtaactggtgtcactaaaccttacattccaagagtcgtaatcttcacacaagaattaaaagtctaaaagctgatattctcttcaatatgcagaatataatgatatataattcttatcaataatattatttttagagatcatttataaataaattatatagaatatcagtaacttaaatagaaaggataaactgttagctcaaatgtgtgtgtttatgtgtattctagccactccttaagggcaagaaagcacttgtttaaaggctagaggcacaggctcacttaaagattcagaactaatcacaggattgactacagaatgcttctgttaactttaaccaccacacagaaggctagagctggctgcaatttgctatttcccctcaccagttcagttaggctctgatattatccaaggaagttaggctctgactaactatatatatatatttgtgcgtgtgtgcatgtactttgttttttgttgttgttgttgttttttgtagagacaggatatctctacgttgaccaggctggtctcaaatggctggcctcaagtgatcctccctctttgacctcccaaagtgctgggattacaggcatgagccactgcacccagccagtcagttatattttaatcacttccagaattgtctcttaattcccatgatcccaccaatatatattgttgataagttcaaaactgaaagtaggacaaggaaacttctttaaaaacaaggctcatattattctctatgctttaatttatcattacctttacacaactgactgatatcctcaggcagagttaaatcagcacatctcagagaagatgaaaacagactggcaggtttggtaaagggggtatataaaggtgatacctcactgaatactttgtccttcattaattgatctggggttggccttgagaacatttaaaatacagagcatgaatgaaagtcataaaaaatttcctagaataatggcatacattcaagagaatggataaaagtcttaaatacctcattagcacagaaaataatacagctctcttttgcagagtctagatgcatacttttatattataatcaaataactgtgagtaaatactgaattttttttacttatgttgtactttacctcatgatgtatcaaaaatatcattccataaaagcttctgcattgtttacttttaccctgactagcattcacctgctttactgaatatcttaaataattaaataatatttatgcaaactattataataataccatttggcttttcttcctgtcctttaatgtggtacattgacacaaaactatttctctctaacatgtcttgataaagttgtttttctaaaggcaaatttgtatacattattttcaaacattacatagtaaaggaatttagggatagctgtatgactagtagtgacatcatcaagtcaaagtcaattaatgaaacttctaagaaatccttttttattgtcaacaattgttagtttatcacaccactgatccaagttcattgctataatacatattgacaacaaacttttattctcatttcactgatgttattattgggtctaggaatacctacattccatagtttagttaatattctatttaaaagcttgaaaatgaactagtaacttctttagtgtatgtcagttttctgaccgtagtttaactttaattactttttcattaattcacaaaaaatgaaagcttacatcattcacagttatgatactgatgtcaattatatactactccatatgtacattatctttaatccattatattaaaacaagaaaaaaaccaattgcttatgcgtaaaggatctcaatgtaatcccaatctctaaataatatcaacctcttagaaggatggaaggtaaggcacttattcaaaagatctatcacagtttcaggaagctcctggtaaataaagagagaaaataattaattaaaatgatcaattttagaaatatactttattcaaatgtttgctaatctagaagtttttgatgtttttaaagtttttatttgtactttatacaaatttagtcactgtgaaaaagcaaatacttaaagagaaataagcattgctttaaaatagcttccaactggatcccaagtgtgtaaaataaattttcattcacagattgctatggtttgaatgtgttccctccaaagtttaggcttcatgaactttgaaacttaatggccaatgtgatggtattaagaggtgaggcctttaagaagtaattaggtcataagggctcttcccctggtgaatggcattaagaggcttataaaggtgagacctcacatagcaattgcctagcttgcccttctgccttgtaaggacagtgtttctctctcagaagactgcagccctcaccagacgaccaaacgtactggtgcctttaacttggacttcctagtttcaataactgtggaaaaataaatttttgtctttataagttacccaatatcaggtattttgttatagcagcacaaatggactaagacccagattaatgacaaacctttataatgtccaaacaaccatgctcttcagccagaactattaaagtgtcatctacacaatctataaaacagaaaaactatatgaataaatgctatttttctaatctgtccaacaaaccagaaaataaactgatcaaaaatgttttaatggagtaatgcaattttgaaacttaaaatactgaaaactttatcattttgttaaatttctttacatgttttgataaaaatgaaaagcttcagataaatactaattgaataactgacactgaaagataccagcttaaatagtttgataaaggagcaattcctttacaaggaaggtaaagatactctagctctctctgtctctctctaaatatacacatgcagacacacatagctgacccttgaacaacatgggtttaaactacacaggtccacttatatgtggattgtttccaaccaaacatgggttgaaaatacagtatttgtggatgcgaaatctgcatgtatgtaggaccgacttttcatacacatgggttctgtggggctgactgtggaacttgagtacacatggattttggtacatgtgagggtgctagaaccaatcctcttcaagaactgactgtatgtaaacagcgctttttaagaaggctttgtagttttgttttgttttttcatgattacaagactaacttatttttattgtacataatttggaaaatgtacttacatttatttgggaatttaaagtaaaaagtttaggttacagaccacatttaagaatctccaaggcttcttaatagctgtagtatcaatctttgtaattaaatgtggtaaatctggtaaaacttttgcaaatttatttataattcattattatttaatgtttactaatactttcctgtacatattcttatttgtaaatgtttttaacttggatactaatctgtcactcttttgcataaagtgttctatcactgtttttctctccttaattaccaaacatgcttaattaattccactccaaagtagattacataaatttttattaatttgaattatacatgtttggatccacatacatgaaaattcatatgagccttttataaggaaaaatcaatattcttcttgagttgttatttgtacatgattcatcaaatagaaagatagcccaaaagttaagatacattgtctgaaggtaaactgctacagaaatacaattttatattctcattttgatttcacaagttaatttacttggctagataataaagctgagattatttccatctaggttaaaattcctcagagaataaagaaatttctgctgtaatattttagaagggacctcatatgctgttctgctgatcattaccactgatcattagcaacttgagtaaagggaggatatttcagtgtactcactatttcaaaagaacacatcctcaatgtgcatgattactaatagtaagttatatttatatttgaaagataagcaattgtacgacacttacccaaagtaagcaaaaattttagtctttcagaaatatccaagctctgaaataattttcttccctaaataaaatgagaaaagaaatttctattaatatttacatgttttttctaggaaggcatttttctccccttatagctgaaactgattttatcaggcatctttatttatctccaaaagttttaatggatttttaaagtcagctccactaaagaaaaattactggtgaaataacattttagaaagtgttgcataatagttatcatttaaacattttatacatctaagggtcattacattctagtttgatgtaagcattgttcacttttgagatccacacatacctggatatctagatgtattccaggccatatggagtcttactttattgagaccaagatgcctcctgggtaagactgattatactctttcgcctaccgagctaattcttacttaaatatcatgattcggttagtctgtttctccattaaaaaaacttcataacactccttcctcttaccacaataacttcagacagccatccttcatgctcctacagcacctggtatattttaagatgcacacattatattttaattatttccttactagtctgcctcaggaggctccttagtataaggtctggagtcaaacacttataccttcagcatttatgagttgagcaatgattgtgtgccaaattggactcttccaccatcaaatagttatataaatttggcaaactacttaataccacctgaagtttcacttttctcatctgtaaaattaaaatattaactgtacatataccacaggttatggtgagggttatgtaatgcagaatatgcttcattaatgttggctatcattatatttctcttatcataaacaaattaagcttatatgatcatttaaataaacttagaaggaaaaggcttaagattacctggtgtttatagaaaaaagagatgctttgatttttttttaatagagaagaaaaaatgttcttaaacacttaccaaatcagaactacaggtagagttcattgaaaaaaagctgctattcttctcaatcttacattactgtcatatcaatcttctaaaaacgtagttttcatttcaatatcttgttaaacttttaatggtactccatatatcttatataacttaatataaacatcttaactttgtaaaaatatacacattatagagatatcaaaataatatatatctggtaacatttacattcacacttagtaaaagtatgtttccagagatgccaaaaaatatgtgaaattatcaaacatgattaagtcaaattaagccttttctcctcatatgtaattaatttgtacagcaaaaacatactattattaactttcctctccaaaagattattccaataaatgcacaatttccttttattatattaatatttctttatacataccacacaaagctcaaataaaatgattccaagagaccatacatctgatttggggccagaaggcaatggttttttacttggcatgtgatcagtggttttgaaaattccctgtgcaattacctcaggggccaagtacgagggatacctgtaatgatacattaaaataatgaaaaattacaacagggaaagaagcgatagtacatttttacaatcaatgtggtaagatctatgtaaaagtctcatgcaattaaattaacaactgttgctagaaagcattctaaactaaccatcataatacagaactttaatgtcaaggaatcaagagaaaatatacacaagtctgaaatagttttaaaaccttcatgtctccctccagcattagctcctttatttgcttctctctgtgtttttaacacagtcctctaggcttccaagtgtttttccttccttcttattgcctatcttcccttaacgctgaattaatatttaaagtgcattttatcttttaaaaaagtatttatttttagtagtaagaatgttaatgctataaaaaagatacaaattgaaaagtaaaactcctatctctacacccctgtcatccatacatatttatgtatatataactttgtccacccatcacctctgccccacatggtggaatactatacatattgctatataccttttttccacttaaagtgtattttagagattgttctttaaaaacacaagtatagagtttcctcattctttttgaaaactcccaataatttcattgatgtacttaatttgatgaaacaaaaacattttggaacttccattcttttgctattaccaataatgagatgaatatattatgactattacatatcccacaagtatatgcatataaatgacagatatattcttagaagtggcattccaagatcgtaaggtatgtgcattttaaattttgatttaccacaccaagttgccctttggggaggttgtatcaatttatattgtcataagtaatacatgagggtgcctatttcctcacaacttcactgacataaaacgttttttgaaaaccggtttagcaaatattgaataaatgcaaaacactgcctattaaatatgaataaggcataaagaagaaagcttcaatgaacacccatgtaccaagaagcagtttaagtgaagaacataaaattatcaccaaaagtccctttgtgcttctccctgattgtatctccacccctgttcctccagagaagacacctggaatttttgtgtttgtcattctcttccatttcctgatggttttaccatgtttgtatccctaaaaaatgtactgtttagtcaagcatatttctgaactttataacactggaattaggatgactgtattcttttgctctttcaatcaagattatctatattgttggatgaagctatatccattaaattcttatttctattatatgaacataacattatttatacattcaaatggcaatggcatttaggctgtttcctgctttttattattaacattatgaacaacgttgcacagaatgccatgtatggtatacatctgcaaaaggttcccaaggttaacaacctagacccaaatttctaagccataggatatgtgcactttctacttcattacacaatgccaaatgtttttcaaaacgagttataccaatctatacacttgccagcagtgaatgactgttcctattgttttacttcttcaccaacacttgatatttgacagactttttaatgtttaacaatctggtatataaaatctattgtggttttactttgcatttccttgaaaattaatgacattgaggcatatgttcatatgtttattagtcatttgggtttattattgtgtgatatgcccattcaagactttcgcttatttctctagttgttttggggtccccaagaccactctcatgtttagaaattcactagaaggacttacaagacttagcaaataagtgtactcacagctaagatttattacagtgacatagtaagggcatagctggatcacaagggacaaagatagagagggagtctccaggaacctatatacaggcttccttatgctctctccctcctatcagggatcacacagaatacattcttcttccagcaacaaaaatatagcaccacgtatgtgatgtatctttcattttcttttctttcttttttttttaacttctttccaatcttgaagaacaaatgttatgtgatgtttctggccagagaagctcattgaaaatccaaggattttatttgggacttgtcacacaggcactctctgcctggcatgtacaaaaattcaagaactcaagaaggaaagcaagtgttcagcataaaccactttggttgtttacaagcacagtaaactagcctcagcagttaggcatccatggggacatttctgcaacccaagtttcaaggcaacagccaagggcaaacattgctagcaggacttagtttctaaggatagcagtcttaggcttcctatgataatcttttactgcacagttgttctttaactccagatactaatgtcttcttcagtaattatgacttgaaatattttctaccactctgtggttttgtcttttctttctctttacggtatctgtttatgaatgagaagttcttatctttcagttgaattaaacttttttccttatacttaatgattttgtcaaaataatctgttaattttctcaaaatttcagtttagccttttatatttaagtttcttgattcatctagaattcatttttcatatgatgtcagacaaggtacaacttattttcctacataaataagcaattgagccctgttccctttattgaaacctctttctccccaagtagtgccagccgtatactaaatcaaatctccacacatacataggtttgtttcttggctccctcaactgttcatttggtcaatttgcctaagagtatactattacactattttaaataaaatatttttatataaaatatattttattaaataattactgaaaattgttaagagctctcaaaacatacataccttttagtttctctttgggaaaatgcaggctctttgtaggtgtttgttcttctctacatacattttaaaactatcttgccaagtatcttctctttcacatactgaatttttattgaaaatagataagatataaagacaggttgtagagaactaacatctttacaatactaaccctaacaatctataaacatgatatctccatatttatttaggtcttctataatgtctctcaaaaagatttatattttttccataaaggaacatatcacgggattttgtggtgtcactttgtcaggtggaaacctctgtggccagtggtgcctttgcctgagttttgctgggacccactgggcccgttccatccacttggactggcaggctgtgctcagctcgtgctactggcctggatgccacgcggccaagggagagccaggcatggcgtggcaaggggtgtatgagtgagtgtggggtctggccactgtgcacagccaggcacactggctgtggcatggcaagcaggtccaggtgctggcataggcactggcttcctgcaaggctgtggttggaccaggtgcgttgcaagcagcttccatggctggcaccagggaacatggttgtgcccggaaacttggagatgccaggaactgcagagccccaaagagagtgtcacagccctggctcagaaagttcctaggtctgggctccccaaagggctgcagctcctctctccttctgtcttctttccttgccacccgcaatgtggcaagcaaggggttgtttcagccctgtttgttatagctgttttagctctgacatttggcaggtcccaaattcttgtcctgcatccaagaagaataaggtacatggacaagtgaagggtgagcaaggtgaagagatttattgagctatagaacacctaaagagacccacagtgggtagttcctctccactggcagggtgtcccaaggagtgtccaacactcagctgagaggagaccctagggtggatagcttttcccctcaggtggggtgtccctatgagcattcagccctcagcagagagaagaccctggggtgggtagctcctctctacagctggccatccatcatctgctcaagtctggctgagtccagggtttttatggtcctcagagggaagaagtgcacgtccattggtccatgggcggccatgggtgggcccagaaaaagcaccacaagttcccactcaggtccacgggacctgcagcccatctcccatgcttcaggccctcctgggcttgaaggcagggcttcaccagggacctgcccccttctacccaggaacctgtctgactcctgtcactcttcatggtgcccaggctattcgtgccacggagcgcctgcccgccagcactgagctgccctcagccccccttcagactccctcccttgcttgttggtgtccgaagtccacagggagtcaaggcagcagggggctggagtgtcagtgctgcctcgagtgtgcacacacccagccggggtccaacagcacctgggcttgaccccaacatcgctccaagatcagagtgtgtacagggagccgggagaggccaggcagtgggagtagacatttccgagcctacagctgcacctgggagagcagggctcctgcctgcttccggcccccaagagcacagggaggcctgggtctgcagcaccaacttaggcagctgcaactgtgcccgggaacgtggggctcctgcctgctcctggcccccataggctccgtgaagtgacagccccagcagcacctcctccacactgcagccggcatcatggtagtggccatcccagacaggccgccactgccatcaatacctgatttgattctataaagtacctattttgcctgttctatatcttataaaagctatacatggtatgatgctatacatgtttgttttatatactatatatttcacatacaaaaatttaacctcccatctcaattagaaaaaaaagaactacatacctgagggcacttgcgtatctttttataaaccctctacaactaccaatgagacttaaatagaggatatactcagtatagttttgctttaaaaaaaaaattcctataaaaaatacccattaggatggccttacaaacaacaatttaagaagcaggtagtaaataagaattagacataggagcaattgctaaatttgaatcccagtgcctagaaataaaaggaataagaaccgttttagaagagacatggagtgaaattttgccatacttattacatatgtgcatgccctttcgtcatttattgtcagatttagtcatgagcaccacaatctagattttaaaaccagttagattaaattatgtcctcttacaatgataagtataatcaaaatgtatttaaatatatgtatcatctatgtaatatatattaagtaggcattcaaatattatttctatttttcttcctaccttttctacagctacctcctcacactatcattgctagtacttcttatttacattcaaaatacaagtcaattaagtcagggaatgtgacttaaattcaaatgggtaaatttgttttttaactcctttttcattttaatagaatgatgatggtgataccagtatcttcttatgatttgctcatgtatttctctcatatacaaattcgtattgtgttattttaccctaagatgatactgctcttccaaatgaatgtgtgatatctctagaaacagctgaagtctagtggaagcagcactagactagatgttataatacctgtgttctaatttcagttctaccacatattctatatgtgatttgggtttcttcatctgtaaaactggaatattactgcctacgtcacaaagctgttataaatattagtgaatatatagacattaaataaaaataaaaaatttaatacaaatgcaatggtatacttttatcatcaccacaatacatccagaagtcagttttcatcttttttcctgatttccagcacatctaacccaaaaataataataatgaaaaatcaagcaaaactacaggtaaattgttatatcaaaaacttctgacaggacagagataaactttgtttcaaatattttagtttcccttttaatcacaggaaaattattaaaaaataataagctctagaattgttatttaatgtagttcatcttttttcaacaactttctcttctgtagcatagcattttaacactcaaagacaattaccagaactttgctgtgagtatgactgatgaggtaaataaagtggctttcatcatctgtttgatgttttaataaggtattaagctactggccaactgaaatgaatgcccaatttccaactctttacagtattttgaaacagatggtaacattttactttgttgttccttaatatttgtcttttgaatcaactgcaagcttcttctggtgtaaatattttctttcatgccttagctgtttgatcactttatttttcctggctaatgtttcacattttgctctttgatattttctggtaagaccctttgggtctaagacttcaaagcaagccagaccaaagggtaacacaagaccaattctatccaagcattttaaattcaagtgtagctcttacttgatatgctttaagaaaaatcacctcctttcttcgattcatcactgaaacctaaagtacctttaaataaaaatcaaaaacttaaagtaatttttaggtttttggatttctttcttacacaaattgatttagacaaaagaagcagcagcaatcacttgtactacagctacttaaaagtcacctcgaaaggcatttatcatacatgacaaaggagctagagcctcactaaaaacttatattcaactataagttgaataaaaaacccctttcatattcgaaagggcttttttgaacaaataagaaattgtagactgtctttgcaaaataccattttcatgcttatgaaacaagaattggtttttgcctgtaagttttcaatacacaaaactgtaagactacgaatttatgtaccttaataagcagtccatcaaaacagaaaattctcccactaaacaatgagcttcttgaggacagaaagctatcttatttatttttgtaaaaccaacaggcataagagaaattgctcaataaatgtttcctcactgaataaagtttaagattattatctatgtcttaataataagacacagtcataaacttaaaaaatttagttaagaaacctgtaatttgagttataaagaaaaaagggcaagttatatatgaggctggctttaaaaaaaaaatcaaattaagtttttgagtaacattctgtttgaaaaacacactccatgactccatatcacaattctcagtaacggtgtgatagaactgattttaggaagcccaaagaggaaaacacaaatggatactatcaaaaacagtcacattacaattgaaaaaatatgattaatgtctctaggttagataataatactgcatcaagtttagtttccttgttttgacaactgttctgaggtcatgtaaaaaaacaaagtccttcttttagaaaatacaaactgaagtacttacaggttaaagtgctattatgtaattaattactcttaagtgattataaaaaacaatcattatacacatacacacatatatgctcggagaaaaaacagagaaaaagcaaatgtagtgaaatgttaacatttggagaaactgatgaagggtagagaggaattctttatactatttttgtaactattttatctaaaacaatctcaacttaatcttcagaaaagaaaataataatgaaaatgtctaaaagcaaccacacaaatataacacagaaatccgtatcaaaaacatctacttgaatatgcatgaaacaaccttccatttcttttgtggagggcaacatacatctgcaattccataacagaagtgattaaataaacctttctgaacttaaacatagactttcaggtatggaatttatctctatctctaatatccacaatgactcaacttgaatcttaatatatatcttagagaaaagggaattaaacataaaacattaaattgaaaataatgtgagagtgatgtttttcagtctcttgatgcacacacattatcattagttgagaatctagtcatccttcttgccttaagttgatttgattctgaatgaaatacagataattaggaaatattataatgtaaagaatgtcaatactgttagcttctctgccaattcaatgaatgatgaacatcaacgaggatgctgggaaaaactcattgtctactcattttaaaagtatatggaaaattgagatgcattaattttaaaaaagctgtttgcatatcaaaaaggaatatcaaatataattaacaaaatatacatgttatcaaagattacaaagttaaaaagaaactcaaaatagaggaaaacatatccttaccctattgggaaatcaacatcatcaccatgagctgtcatgtgataaagtccaaatttagccaatttaatatgtccctatgataataaagaaaaaaaacactatcaaataatttattataattggcaacatataatttatattataaaattatcattatacattttataactaaagaaaccattatataacaatattttatcaaaatgccactgtagattttaaaaaatcataattttataaaaaactatctgccaatagtctgctttatactcattaaatatgtatatatgcatatgtacacatatatatctcaaaatgacaaatgacatttttctttaatatttttgctgttacattgtctagttatttcacaaaacaaaaaggcaaaaacattctcatctgtcttgaaaccttggttagaatgttttgtggtaattttcacagagcaaatttttttccatggagttgaaagtccatttatagttataatttaactgtgaaataggaaaacttaacttgaaaagatcagttcaaaaatcatcaagattttggtgaatctgctagattttcaataactttttatattgtttgagaacaaaaataactatcataagtataaggctcttaataaatgataaatataattttacatattttaagtttttcccttttaatctataaggctttaaaatattaagttgatcttaaaattggtttgtcttctcaagaacattatttccaagcattataaaatatttatatttaaaaacagcttaaattgataaggtaatgattctttactgccataaatctgaaactaatgagtacaattttctatttttgtgtttgtgtgtttgttttttagagacagggtctcacactgtcatccaggctggagtgcattggtgtgattatagctcactgcagcctcaaactcctgggctcaagcaatgttctcatctcagcctcccaagtattgatttgggaaaagaaccagagaacaaggataatcctaacacagcaaataatgcccatgaaaaaatttcctccaagttgtttttatgtattttatgaaaaggaatcaaattacaattattcctgaaaatatataaccttactatccataattctctttgaagggtttacaagcttcttcttaatgccccataagatttccagtagagaaacagcacttcaatagtaaaaggaggtaggcatgaacagttggtaaataaggagataaatagaagaggaaagaaggcagaagaaaaatagagaaaacacaatgcagttggtttatatgaataacattctagcaaaaagagccattttcttaaaaatgaaaataaattaagaggaggagtatactgggacgccacaaggctttagaaataagagtaaaataaaaaaaccataaagttagaaaatgggtcttgtgggaaaaataatccatgtgaaagatatacagattaaataatttaaggattatttaatccttaaattcaaaaaccacagttacatcactttcatatagacttttcattatgaatattcttaaaacatattctgattctattgttcctctgactgagtagccctgatcccagttgcttccaatttcaaatgatatataaatatttattacatgatttaacaattacctttcggtccaacaggatattatgaggagacaatgccctgtgtactataccatgtttgttcatatactgcaagccctgaagaacctcaaatgctatacacaaaaccgttgaacagctacaaagaaaacaaaaagtcaaagatcaattacaaagcaaataaataacttgttttaacaagtgaaatgtgacctagtgaaaatattcaaaaagttatatttttattgctcctcttttattctgagaaaatagaatctatatattttctaaaatatctacctctacatattttaggttttctgattataacagaattaatctgacaaagatcctacagtttcctaaaggctactgtaatagcagtatttggttcttccacgaaagggctttaattttggtggtgagtgcaactaacctatagcaggtttggcttcgccaaattatcaggttaagtttcaagtatatggcagaactaagtcactaaaaactattttgctcaatacaaaatacctaagcccccgaaaaaagtagtaacaatatattttatggtatacaaacactagcttattttccatattcaacctataaagcaatctctggtcatttatgatttagcaaacttttctctttaattcttatcctatcctctacaagccatccttcacacagatatcctccagtttccttctccttttccctccttgtctctctcaccaaccatctccctaattttttttccaatttgcaagtctactcatgcaaattatcaggaaacaggtactgtatttgggtaaatactgctacttagcagtagtaagtaggatttggaacatgttttaatttttattattacactttataaagtatggattgttcatttgcagacattggtgcctgcattaaaatattttcttgtcaacattccttttctttttgaaaagttcaaatctcagagcataagacaaatgtaatactcacatacaattaacctagctttattaattatcctctaatgttttaatcaaaaattgttcacataggaaatttccccatacctacaatattaacattttcctttctatccattttttttaaatttttctaaaattaaattagtgtttgcagatagccactaaacataatttttaaaaccaatagtagagataatatggaataataaaaaatattcaatccacaaacaggcagaataaaaggaaaaaagaacagaacaaatagaaaatgactaatagattaagtacaaatggtctcaattcaccaattaaaacataaggattgtcagatttgataagaatttaaactcagctatactcagtctatgagaaacgcactaaataaaagacataggttaaaagttaaaaaatggactaacagattgccatgggcttgggtggggggtaggtggactacaaaagagtatgagaaagttttgtggcatgagggaactgttctatccttgattttgatgatggttacataattttgtttatcaaactcattaaactttacataaaacagggtaaatgttaaggtatgtaaattataccttaataatcctgactttaaaaaatactagattgaataaaatttttacaaaaataattgttgcaacctgattctctctccgaaattaaaaccaaaagaaataaccagagataaaagctaaaatttgcctctatgatcctagtttgactttccagagggaatcagcaggttttgttttcaattcttctggtggttagatttttacttacttactaactcttcactatgcaagaggatataattgacgtattttcacaactttcctatttttcttcctcaagtcctttttattacattgttttacattaacaaattttattttacattatcaaataatcatcagcaggtagttttcaattctggtggtagacttttacttaatataactaactcttcattctgcaagaggatacagttgtcatattttcacaacttccccaattttcttcccaaacttcttatctgtattcattatattgtttttacattatcaaacagtaagtgggataaaggaaacctacactcctttctggaaggtgaaacaaataagtaaatagataatgtgacatgtagtgattaaatgaagaaaaaaaaatgaagtagggaagacagataatgtggtcagggaagtcctcactgaggtgacacttatgtagaaatctaaaagaagtaaaaaagacaggtaggtctctggaaaatgtatgattcgggcagaggccacagcaagcaagtcctgaactggtataaagtcagcagctcacaaaagtgtattcagtgcgtgcagtagaatgagcaaagattaaagtgacaggagataagctcagagagatagctatgagtcagaagacgtaaggccctttaggccactttaagacctttgggcttttactctgagaaagatgggaagtgattggcacattgccatatgataataatgattaacacatatttactgtagaactaagcacagaaagaaatagaaacctaggccacttaaaccctagctgtcaagagaaaatgtctcagtcatcaagatttaacggataccataattttataactctatttatgaagattatcatcagctactataatttttatatctcatactatttttaaatttcttttttgtttagctataagacatcttgagaaattgtttcatacagagagcatgagtagaatattttcatgcacggcgcatctgaaaatatcttattcttgcctttaaacttggaaagaattactccattgtcttatagcattctttattaatggcgagaaggctagtatcagtctgtttccaactttgttgcagacatcctgtcactcttccctgggaagttttgaggattatttttactttatccctagagttataatatttcagcccaatatgtctaatgtgggcatatttgtgccagtcatcattaagcatgtactttcaatctgaagactcacatgttccattaacacagaaatattcacaaggaaaatttgatttgctacatctttcactgttttctctctctttttctctaagttggaactcttagtagacagatgataactggaactatttttttaatttaatttttttgaggatatagcaggtatatatatctatgaggtacatgagttttgatacaggcacaaaatgagtaataatcacaccatgtaaaatggggtgtccccccgaagtatttatcctttgtgttataaagaattcaattgtactttcagttattttaagatgtacaattattattgactacagtcatcccgttgtattaactttctgttttaagagcataatctttagtcctatctattatataacttaattccaggagagagagagatccagagatccaaagagagagagagagagcaagagggaaagagacagagagagagtgagagaaatccaaaccattaatttccagcatttctattatgtcctctagttgttccttgtcgatagatactgttctttggttatggatacatcattcctttgagtatctctgagaatagttagaagtcttttaattctgggaaaagagtattatcttcatttcctctatggtgagtactccctctccaccccatctccaggctctgtttttctcgaactatttttttacctcaaatattacctctggtaatccgatccctggttgtcatattttgaagtaaaggaataagctgatattccccataatgtgtgtaaaaaagaagcaatgagggttactatttataaagaatgctatttaaattgactgtaaaatattcctttttatcaaataatttctcccatattaaagtgccatatcactgagtcttaaacaaatagggaatgtgtgaaacaagcataatttgggataaacagagttttcataaacatcttcaaaaaataaactaactgtataaatggcaatattccaaacttaaaaaaaattatttgtaacttatcaatagttatagaggcaaagattttatgtaaaagcacaattacattgataaatatgtgcacatgaaagaaaacaaagtcttccccttaaaaaaaaagagaaacattccctgagattagcaaaatgtaaacctagttttatgaactcatttggctctacaagtcaattttagagtagcttctcttgttcttgtctgtttctcacacaactcacaaaaaactgatgccatattcagctatgacactagaggacctcagctgcatactacttcaatatagatgtctttctcatgaaattaaagccaaacctttaaagtgattttcccattgaacaagttctgaaactactgaacacatagactgcattttctactctctatactgtgcttttgctaattgtgagctattagacattagacttgcatgtcaaaaagcacattcatgttaaaaatgagctgatgaacatgcataccaaaataatttttaaaaattcaaacataaatgacataccgtttcttagctattacttgagagtacatgtcaattacaatctgatttgcttttctgtcctttcatattctcagaatttgattttttaatttgttttaaaatgtaaggtataaagaggaacaaaaaatgctattttataccatgagaagaacaaatcagtatttgcagaattttatgtacttactagctttttaagttatattctttaatactaccaataacttgggtcatgaaattttttaagtagctaatgcaacagcaaagtaaaactatcatatgtctagtagtagttaacatgttacagtttaattgaacatggacactaaaagaagatttaggattaagagaattagattcacacagttatataaaaaagatactgacaggggacaatgggactttatcctacacaattcccaagtgagaatcttgttaaatagacaaacccgtcagtaaccaagaaaatgtaaaattatactttaaatcaaaaaatattctactccttttgacatttttcagtaattattgttacttcagggcctgggtggctagcgtttactttgtcatcattgtcctgaacaactgaacataagaatccctagtgattataaatacagataagaccaaaaggtagctttcaaaataatataattgataactcccaataaagcaagattacatttgaggacatttttacttatattaaaacatatcaattgagtggctatttgtttgttactgaatttttgggcccacaattaccaagaagaagaattgatctgcactacaaacaagcctatagtatacttagaaggacagatttacaaactgataattataatataagcaattaactaagcagataagaattattcatcattttcctttgtcttcaaagaaaaataaaacataaaaatttacttataacattggtgagaccaaaagagacctacaaaagtcataaatcttgggaaagtaagcttaaaatctaaaagagaaaaacactatcaccaccaccaccatcaccaaaaaagatgttgatagtttctaggtatgagtcaacttggttgtatttggattttcaacatggctcaataaattttcaaatctattaggttggtataatcccaagtatatttttttatccctttccagatatatttcaaaggcaatttactgtcttcatgattaaatcgtccataaatcatctctagttgttggttaaaacatactgaggccaagatcatggatttaattcttaagcagaatggaagacttcgtatgttcacagccacaggttttcatctaaccccagccaatactcccaaatacagatagtctgtcacaatgagacactgcacaacctatatttacttaaaacatccaaatttttaactactacctcctatacttctctgttcctcattcctgaggacccactctttaagctcatcaagaccttggggtccctgttctctaagcctcctctgttaccccagccaagtggcccctttttgacatcattctttattctgacagatatggtttgccatttcaataattttttgcaaagatccttaatgggttctcattcaatggctctcccttgtggtagaattgaactccctttcttgatttccgacagtacacagttgagggtttctagattttatggtaattatttctatataagcttgtctttcccactgtatcttgagtatggactagcttattcaactatgactccgtatatctatcagtgtctgtaatgtgcatgttcaataagcatgtattaaaaataggtgttaaaatacatatataaaataatatcacacaatggtacaagggggaaagataattaaattctctaccactaatagaataacacctcaagatagaatgtataatcttttagttagtcaagaaaacacaagatgctcaagttcacccaatggctatccacaaaaaaaattcatttgctgaaaatacaactcttctagtcttttatttactgaaagaaacaggaataaatcaggatatactgggtaacaggataatcttgttaatatctgtctaaaactgtaaattagactaaattgttgagagagattactactggcctcaaaccatcagctcttttaggtatctgcaacatttccaagaagagatgttactcaaattgcaagaaataggggccaggaaagagaatgagaggtcaaggttgctgagatagatttggaaatcattcatgtataagtgataactaaaaccacacatgctatttcctcagatccatgatccatgatatttctaagggccactccacaagccaaaacacccatagtgtcagctaaccaagggaggaaacacatttctgcattctatgagttcaagatgttctttcaccttataaaacctgatcactcccacagaaattttccttttggtctaaaacattccttacttggtatcagcctgaattaaaatgttaagagagaggaaatacagatgaaatatattaatggttagctactgtgtaatttaagaaatggagaggaaaaataaaatgcttactaatgattaatgttcagataatattacaagtgaataattctgtgctatcttcaaagaaactttcctttataacttgaacacaaaagagctcagctagtatataacttttaaagactcattagtttataattccagaatttggggagggtgtttccaatgatgagctagtgtctttgaggcttttaatttgacacttatcacttactaaattttgatgttttgtaaaaaaataccacaatatttaacagagcaaaaaggatgaaaaatacaacagtttctggaattgaaaaaggaaataacacatttcagtactgggcacacatgttttagcctgaaaggacacaactatccatgctaaatttaagaatgtatttgcctcagattcagatgttttgaaatggaaattgcattgataaactgctacctaaagattgttttatagtaagtctaaaaaaagtaatcagtccatctgactttcagttgtgagactaggcatattttacaatttagctttaactccaaaataatcaaaatagaaccctgtaagtctggaatgtgtctaattctcaacaggagacaataaattgggaaattaactttccaacttgaatactagataacttttcttctcagcagaaaattaacttggtaaaatcaaatacatatggaaaacatagtctagcggtttgaggttcagacataaagccaggaggctctgtcactgatttgttatgcttagacagtgttccaacttcaccctgcctccatttgcaaatttataaagtaaaaaatgtaacaccaaacagaagctaaatggagatcaatgagctatcggccctgcacagaatcttaatcatcttaaaagcaaaacaaaataaacaaaaagtccaagtctccctcaaaaatcccagggtttttctgaaactatacaatatattttgttatatcatatgtatatatcctataaattaacaaaaattgcaagttgagttctccaactattctcctgacataactgaatcagaagaaccgttttctaacttctctgtgagaataaaatcaccatttgatacacaggtctggaggatctcaagattggctgcatatttctgccccatcaatgttttcttctcctaagcattttttcctatccttgcacagaaacttcaaaacctcttttgtcatcatagtcactaattctggctgtgcaaacacactaggtaataagtccaactccccataccctggcagcatttgggatgttggaagactgcaacttttctctaagacagaacttatcatggcatatagtgggttaaatctgtaccctgcatcattccaaagttgttttttaaattaaaattaatgtatatattgccatgtgaaaaaaagagaaacaaatttctattactgttcagaattttgatttgagaccaattcacatttttaagtggactaatattttagatgactaatttatcaccctacccatctcaaataatgaatgggagagggcctgaataatatggattgcttattacagcatctgcaagacagcatattgtaaacaaaagtttgtcaaactgaaatgttcagttaaataagtattggtctgtcttaagtaacttatgaccagtatgattgctgaaaaaaccctatttaccacgtcccttgtatttgtcagcagttggggtgatacagtgattatatttagatcagaaaatccaaaaatagccaaattttattcttaactacttctactagactccataagcttcctatgattcataaataggaaggcagacaaagcaaaataatactttaatagccaaagctttgtctccaaattttaatgtagaactctgagttctgcttacctatataaataaatacttttccctaaaccagatcaccttgaattagttagttctgtctatttcacctaaccttgaactagactttcagttctcaatactatgatataaggaagatcataccaattacagcaagcttcacaaaaaagagtaagaaaaagctcttatccatataatcccataatgacccaggaatactgtgtaaaaattggagaatagttatcttttaccaattcacaaaaaatataatattaataaatatggattcttaattttaggttctcctgtgtgtgttgttttcttgtgcaatatctgcaatcacttatttcaaccagaatctataagatggtagctaatttagctcaaatactttaaaactgttcttaacagtggtggctcacacctgtaatcccagcactttgggaggccaaggcaggaggatcacctgaggtcaggagttccagaccagactaaccaacatggcaaaaccccatctctactaaaaatacaaaaattagccatgtgtggtggtgggagcctgtaatcccagctacttgggaggctgaggcaggagaattgcttgaacccaggaggcagaggttgcagtgagctgagatcgcgccactgcactccaatctgggcgatagagcaagactttgtcccaaaaaaaaaaaaaaacaaaacaaaaaaacaactgttcttaagttgtataagtcagtatctcatattgttctacaaagagcacattgatttctaggtttcccaccaatggaagaattttaagaacctttcatcaaaagcaatggtacagaatcaccttaagggctcattaatatagatactgctgggttctactccctgcaattctgatatagtatctaagatgagtcccaagaatttatatttctaataagttcccaggtgataatgatgatgaaccacactttgagaaccgctgtcgtagaaggcgaatataaatgaacctgtttcactttcaggtatacaggaaggtatagtatagaacaaagataataggttttagatttaaacagaacaaagtttaaacccctgggctatctttttctaattgtcatctaacctctaagtatctttcttaatctttaaaatgaagtaataataaccgccagtacagctatgtggtaaagtttaaatataacatgcttatagagcctggtataaagtaggtactcaaatattggtttctttccgtgctacatacgtttcttaatgtgtgtatagcccccatcatcctttctcttccaagaataagttcatagaaagaactcatcaacttaatttcttttgacgctgatgacaatttttttttcaactaagaaaatatctaggcttactcagctccaaagtcattgtttatttaatttttttttttttttttttttgagacagagtcttgctctgtcgcccaggctggagtgcagaggtgcgatcttggctcactgcaagctccgtctcccaggttcatgccattctcctgcctcagcctctcgagtggctgggactacaggcgcatgccaccacacccagctaattttttttttgtatttttagtagagatggggtttcaccgtgttagccaggatggtctcaatctcctgacctcgtgatctgcccacgtcggcctcccacagtgctgggattacaagcaagagtcacctcgcctggcctctttaacttttaactacagttaagggtattttgcatatagcaaagatgtaatagaatataagcaaagcaaaccaatcgcgtgggtaagtacagggtaaaagtttaaaatttaaatcccaattatgggttcacttaactgaatagtctagtaggtcccattgaataacctggtatttctacctacctacagtaacagttaaaataatagcaatgataaagataaccataccacaaccactactataagtatagccctttaataggtctatccaccttttgtaatatacagatttttaagtcacaaactttgtgactaaattaaagactgggtctggataaatggatgaaaattcaacccttggctttacaattgtaactataacaacaaaatgtaaaaggaatacaacttaagatgaagttcctcttgaaaagatctgatattaactgggatatctaaatcttagacataataaatttttatacaaatcatatgagatatatgcctcacagcaatgactttgaaacaacaaaataaaactttttttcctgacctcttttctaaagaaaatgaactttgtttataggggcagcaagtagaattgaaatctaacagaaaatcttttctgcatttgaaataatatttttagagtatgtatcttttgtttatttgctggttagcttgtctgaaaggaggcccccaaaaagatttgtgcacatcctcacccctggcacctctgaatgttaccttatttggaaaaagggtgttttcatttgagaaaatcatcctggattatccaggtaggctcaaaattcaatgtcgagcgttcttataaaagggagacacatagacgagaagacacacaaagaaggtgatgtgaagacaggggcaaagattgaagtgatgtggccacaagccaaagaagccaaggaatgccaacaggcaccagaaactggaaaaggaacagaaggatttttattgaaagcctccaaagggggtgtgaccctgccaacacagtaagttttctgaattctggcctccagagctgagagagaataaacgtctgttattttaagctacctaatttgttgcagtagccatagaaaactaataaaatgttccaactttccatcacatgtttggtctttcgaaatagcccccatcctgaagctagaggctttcaagtgtcacctcatcagaatactcagctatggcttaaagaagccatcatgaataacaagtcaatcctattactcaggaaattccaagggtttttgaagctctgggccaggaacttgggacaaagaacaatacattattgtttatattagggaaatgcaaatgaaaactacagtgagatactacttcatacccactaggatgtctacaatcaaaagatgaaaaataacaaatgttggtaaggatgtgaggtaaatggaacctttgtgcattgctagtgggatagtaagtggtagggctatctttggaaatggcttgtcaaagaggtaaacatagaattaccatttgacctaaaatttccattccaatatgaactaaaagcaggtattcaatcaaatacatatgaatgttcatggcaaaattagtcataacagccaaaaggtagaaacaatccaaatgtccatcaacccataaatgaataaacaaactatggtaaagacatacagtagaaaattagcaatacaaataaatgaagtactaatacatgctataacatggacgaaccttaaaaacattatgctaagtgaaagaagctaagcacaaaaagtcatatactgtataattccatttatatgaaaaggtcagggtaggtaaattcatacaggaagtaagtggattagtggtttccaggggtggggagagagaaggcgagggactgctcattcttttttggagtgatgaaaatgttctagaattagacaatggtgatggctgtacaatcttgtgaagtggctctttaagagccactgaattttccctttcataaccatgaatttttaacaggtgaattacatctcaattttaagaattcaaaatcagctgagcatggtagcacaggcctgtaatctcagtgctgtgggaggccaaggtgagaggatcacttgagcccaggaattcaagacaagcctgggcaacacagcaagagcccatctataccaaaaagctttaaagtatgtaggtgtggtggtgtgtgcctgtagtcccagctacttgggagggtgaggcaggattgcttgagcccaggagttagaggttgcagtgagctatgatcatacctggatgacagagcaggatcctgtcacacatacacacaaaaaaagaattcaaaatcaaagcaatttacatattcattaaagaagaaaaatcatatcatagtctcaatagagattcaaaaacacatttaacaacattaaatacttctgattttaaaaacccttagccaattagaaatataagagtacctaactcaatctgataaaaggcatatataaaaaccttacagctaagaccgtatataatggtgaaatacttaacatttttccctgagataaaaaactaggaaatattgaccattcaatatttgtattcagcattgtagtggaggtcctatctagtgaaataggtcaagaacaagaaatataagccataaaggttaaaaaagaagttgtaaacatttctattcaacaatgatatggttgtttatgtagaaaatcctaaggaatccaccaaaaaactatttcaactaataagtaaatataatgtagcaaagttacagagaaagtgtcaatataaaaaattcacatatttctatatattagcagcaaacaattggaaaataaaactaaattttacctacaatcatatcaaaaacataagctacttaggaaaaaatttttaaaaagtaaagcaagaactctacatcataaactataaaacactgttgagagatactaaggaagacttaaaaatttggagagaaataacatgttaatctagtggaagactcaatatttttaagatatcagttctttccaaattgatccatacatgcaacgcaacctcaatcaagatgccaacagaaattttagaaattgagaaacttactataaaatttatataaaaatacaaagaaccaaaaatagctaaagcaatcttgaaacagaagaacaaaattggaaaatctatatttactgacttgaagatttactataaagctataatcatcaagatgttatgatgctggcataggaacagaaaaatagagcaatgaaataatacaaaaagctcagacacagatctatacttatatggccttttaattttcaataatggcaccaaaggaatgcaatcaaaaatgaaaattcttttaaacgatcagaggtaaggcaactggatatcagtatgggaaaaagtaacctcaacactatatacaaatattaaattgagatgaatcatagagccaacataaaatcgaaaactataatgattctagaataaaatatgggaatatcttcatgacttcggagtaggcaaaggtttctcaaacaggatataaaaagcagtaaccacagaagaaaaatttgacacattagacttgatcacaaactgtaacttttaagctgggtgcagtagcacacacttgtagtcccagctatttgggaggctgaggcaggaggactgcctgaacccagaagttcgagaccagcctgggtaacacagtgagagcctatctctaaatacaataataataataacttctgctcatcaaaatatatctttaaaaaataggcaagcctggccaggcgcagtgtggctcacgcctataatcccagcactctgggaggctgaggtgggttgatcacctgaggtcaagagttcgagaccaacctggccaaccaacatgatgaaaccacatatctactaaaaacaaaaattggccggccgtggtggagggcccctgtaatcccagctactcaggaggctgaggtagaagaaacacttgaacccaggaggcggtgcagttccaggcacactccagcctgggcaagagtgagactccattataaaataaataaaataaaataaataaataaaataaaatggcaagccaaagaggcagaaaatatttgcaaaaaaatctaacaatatgtatgtagaatatagagaatacacaaagaatgcctacaaatcaataatgagaaacaatccacttaaaatgacaaaaaattgaacaaatacatatgtgatgatatgaatacctaataagcacatgaaaaatactcaatatcctttgaatatcatgggaatgcaaagtaaatctataacgaaatactactttataccttgtacaaatggctaaaagtaaaagactaaaagcatcaactcctggaaaggatgtggagaaattatatattgttggtgaaaatatgtaaaaggtataacattttggaaaaaggtctaatggtgtttctataaaatattagtcatacacatgattaatatcctataacacaacaattctgctcaaagtatttcctcatgaaaaatgaaaacagaaggccacaaaaaaaagacttaacagggcatttatatcagctttagtcataatagccaaaaccctgaaaatagccaagaagttcaacaagagaaaattgaaaaacaaatatatttataaaacacaatacaactcagcaacaaaaacaaatgaactatgatacatgaaaccacatggatgaccctcagaaattatgctgaatgaaggaagaagtcttacacaaaacagtatatactgaatgactccaataatataaagtgctagaataaacaaaactaacccacgattaaaaaatcagaaaagtagttgcttggaaactgcaggaggggaggtgcagagatttactgggaagggacatgaggaaaatttctcagataatggtggtaatctagtcttaatgcatttagtttataaaagtgtatacatttgtaaaaacacatcaaatgtaaacttaaaaagtttgtgtacttcaccaaatgtaaatttaacctaaaactaaaacataaacacatattgaaatgtagttagttgtatacatgctaaactatttaggaatgaagtgtcctcatatcagcaattactttgaaatacatcaaaataataaagatgggttaaatttagctacaattaaatgttaaaatagttaaagttagttttaattaaaatgttaattagaaaatctaggtatattgcataattatttcaattttactatttgcattttttcataaaataatagccaagaaaaagtaaataaggtaatatgaaggcattttcagatgaccaaaatctgtgagaatttgtaagtatctgacttgatctaaaaaagtacaaaactaaatgaagtttttcaggcagaaaggacaggatatcaaacttgaatcaaaacaaagaaataaagagttcatgggctgggcgcggcacctcatgcctgtaatcctagcatttcgggaggccgaggcaggtggattgcctgaactcaggagttagagaccagtccaagcaacatggcgaaaccccatctctactaaaaatacaaaaaattagccaggcctggtggtgcgtgcctgtaatcccagctattcgggaggctgaggcacaagaattgcttgaacccaggaggcagaggttgcagtgagcccagatcgtgccactgcactccatcctgggcaacagagtgaaactctgtctcaaaaaaaaaaaaaaaaaaaaaaaaaagagttcatgaaatggcaaatacataattaaatggaaaagaattttttcttcatttctcaaagtctttaaagaaactttaatgccaaaaatagtacagatacatggtgaaatgtataatatatgtaaaagtaaatataaaatgtataacaaaactacccaaaagatgagaggagtaaatagaagtatgtcattataagattcctatcttatatgtgaatgggtataatcaactcataaaacactataaattttaaggatgcataatgtaaactctattgcaataacccaaaaaataaaatatagctaagaagaaaagataaaagacaaaataaaatgaaacaacaaaaaaaacctctgagtctcttgtagcctaattccaagtgcttatttagttgtaatccttctaccctcacactttattatttattaactcagtagtttctgctcttcagataattcccaacaggaaattagactagttaatttaatggatatagaccttttctataccttttatggatatagacaataccacaaaataaaattcaaaatgttcctttgaagtcagggcaactcctaattactaatctcctacctgagtcaatttactgaagtttcctcgctaactgaaggaactgattgaatacagaaaatatagtcagtaaatgaaccttgtaaaaattcatcactgaggttacacacagatgattttttaaaatttttttaattttaatttttgtgcatatacaatagatacaaatatttatgtggtacatgatatattctgataaaggcatacaatgtgtaataatcatatcaggataaatgggttatccattacctcaagcatttatcctttattggtattagaaacaatccaattatactatttcagtaattttaagatgtacaataaattattgttgactatagtcacaatgttgtgctattaaataccagatcttattcattctaattatgtttttgtactgattgactacccctatttcatccccacagccccactaccctttccagcctctggtaaccatcctctctatctccatgagttccaataaacaggtgagaacatgtaaagtttgtctttctgtccctggcttatatcatttaacaaaatgaccttcagtttattctatgtggttgcaaatgacaggctctaattctttcttatggctgaatagtactccattgtgtatatgtaccatattttctttacccattcatctgttaatggacagttaggttgcttccaaatcttggctattgtgaacagtgctgcaacaaatatgggagtgaagatacctttttgatatactgatttcctttcttttgggtatatacctagcagtgggactgctggatcatatgatagccttatttttagttttgttgaggaacctccaaactgttctccatagcagttatacgaatttacattccaccaatagcgtaaaagggtttccttttctccacacccttgccaacatttattcttgtctgtcttttggattaaagccattttaactggagtgagatgatatcttagtgtagttttgatttgcatttctctgatgataaatgatgttcagccccttttcataagcctgtgtgccatgtgtatgtcttcttgtgagaagtgtctactcaaatcttttgcccatttttattggaatattagattttttcctataaagttatttgagctccttatataatctagttattagccccttgtcagacagtttacaaatatttattcccaatctgtgagtgtctcttcactttttaaattgtttcctttgctgtgcagaagctttttaacttgatgtgatgccatttgtccagttctgttttggttgcctatgcttgtggggtattacacaggaaatctttgcccagactgatgtcctagtagagagttttcatcaatgtctccttgtagtagtttcatagcttgaggtcagatttaagtctttaatccattttgatttgaatttttgtttatgttgagagacagaggtctagtttcattcttctgcatacagaaatccagtttcacagcaccatttactgaaaagactttcctgtcctcaatttatgctcttgacgcctttggtaaaaatgaattcattgtaaatgtaaggatttgtttctggtttctatattgtgttccatcagcatatgtgtctatttttatgcaaataccaagctgttttcgttgctctgtagtataatttgaagtcagtaaatttgaatcctccagtttcattctttttgctcatgacagctgttgctattctggatcttttgtggttccatataagttttaggattgttttttctatttctgtaaagaatgtcattggtattttgatagagaatgcattgaatctgtagattgctttgggtagtatgaacattttaacaatattgattagtcccatccataaacatgaaatatatttccatttttgtatcctctttatttcatcagtgttttatagttttcattgtagagatctttcacttcatgattaattcctaggtattttattttatttgtagctattataaatggaattattttcttgatttctttttcagcttgtttgctgttggcatatagaaatgttactgatttttatcttttgattttgtatcatgcaactttactgaattcatttatcacttctaatcatttttttttttggtgtagtctttagttttctccaaatataagatcatattatctgttaacaaggataattcaactttttcctttccaatttgcatgcccttgatttctttctcttatctaattgttctagctaggacttctggtactatgttgaataacagtagtgaaagtgggtatccttgccatgttccagatcttagtaaaaaggctttcagtttttcccccttcagtataatgctattaatagctgtgggcctgtcatacatggcttttattatgttgcttatatccctagtttgttaagggtttttcaccatgaagggttgtggaattttatcaaaggctttttcagcatgaattgaaaggatcatatggtttttgtccttcattctgttgatattatgcatcatgttaattgatttgcgtatgttgaaccatccttgcatccctgggataaagctcacttgatcatgacgaatgatctttctaatgtattgtttgctagtattctgtgggggagttttgcatcaatgattttcagggatattggcctgtagttttctttctttgatgtgtctttttctggtttgggtatcagggtaatattggcctcgtagaatgagcttagaagaattccttcctcctttatttttcagaacagtttgagtacaattggcactaacttttctggaaaagtttggcggaattcagctataaagtcctctagcccagggcatttctttgctgggagactttttattacagcttccatctcattactggttataggtctgttcaggttttggatttttttcatggttcaatcttggtaggttgcatgtgtctagcaatttatccatttcttctagattttccaatttattggcatagagttgttcatagaagtctctaatgatcctttgagtttctatggtttcagttgtgatgtctcctttctcatctctgattttattagttgagtcttctcttttttttcttagtctatctaaaggtttgtaaatcttctttatcttttttaacaaaacaaacttttcatttcactaatattttctattatttcatttgtttcaatttcatttatttctgctgtgatctttattattttttttcttctactaattttgggattggtttgctcttgcttttctagtttttgaataagcatcattatattctttgattttttttaactttattgatgtagatgattatagctgttaacttcccttttaatactgctttggctgtattccacaggttttggtatattgtgttttcattatccattccattattgtttcaagaaatttttcaatttccttcttcatttctttattgaccccctttattagtctgttctcacattgctacaaataccaagactgggtaatttataaagaaaataagttagattgattcacaattctgcatggctggaaaggcctcaggaaacatacaatcttggcagagggaatctcttcacagggcagcaggagacagaaacacatgacaagaaatgtagatggcctctaggagctgacagcagcactcagtcacagtaatcaagaaaacagatacctcagtcctaaaattaattgcgaggaactaaattctgccaacaacctttatcagcttagagaagaattcttccccagagccacaagaaaagaaattgagagttcatttcctctaaccatatcattttatttttaaaaaacatttctaggaatatcataaagaaattcatatttgcatcatactttcaccaaaattcatttgtttgagaaataaaattgtagcacatgattaaaaaaaaagataatagggaaatattcaaactccatgactaacctaaaagtataattcattcattcaatagtccatttgccacatatttactaaatggaaacttttatacttacaactttaggagacaataaataaattacagtatgtatgtcaaaaacgttaactagagaagataaacaattccttccttaattctataactgtagactaacaattataagcctgaagggggaaagatatcttactactagagggttacagtataatataggcatttggaggaggaaaatataatttttgctttggttgagaagaagagtacgaagggaaacagtaagatgtattacttgaagaagtgctgtacattgcactaaagattggagataacagggttgagcaaaaagacatttcagtttttatggtaaatttcaaaattttggcattcactctcctcaatgtgtattaggaataattaaaactaattgtacaatttaggcacattggaaataataagagagttagagagtaatatttagagaagcagtagtagtaattggagttatttaatgagagaattagattgaagtcagatcctatgctaataagatgccttttcctctgggggaaaaaaaaaaagaaatggagaacctccaagtgtttctgaacagagaatggactgatcttcaaaaatattaacatagcagaaaaagtgggaggactgaagtatggctgaagccaggaagaccagttagaacgttacaatgcaatagccaagctgtttgttagtgaagatttaaactaaagaatgtataagacagagatatgtgagaactattgccaagtttgtattaacaacacttggcaattagtaagatataaggtacaagagaggcagaaagcaaaagtttgttgcaagataacaagtctaaatgtagagcatctttcggtattattttccttctttaaacaaaacatgtaaaacaggaagagaattatagatcagttatataaatctctaattcacatgacttcactaccataatttcaaatgcattttgaaactacggtcctcaaaagtaaaaaagatatgaaagcctcaagatccattatcagtttatattataaaataagaatatctaacatctatttctgattactacaacctgtagctcattattcaactctggaccacattccagaatgtgtccaaattctttcgagtatctcattcagtgagtaggcaatgttttaacaggggaaaataaaactcactaatttgagtaagtcagatcatgttttccatcaggctagtaaacagctgcagacatagtctgcttcccatcaaagtcttcacgtataacttctgcaatactaatggtattctggtaaattttcaaaaccataaccctaaaaacgtgacaaactacattttgttaaaggaatatggctctactgcccaccctgcattcacctgcaaacttaacacaatgtagaaactctattacaagtgccaaaactctgctgaatatctgtccatgagctacatttgctgatactttcataggttaagcaaaagtacatgctctgaataattctaacacaaaagggaaatacttcccatacagcacctagacttaaaagaaaaacaatttcctcatgcctgctttgatagcagtgataaaggtatatctgttttttaaatattctctggaaagcatttcaaagaggagttgagatctaaatttctccacttctcagtctcttgaatcttgctttagggtagcattaggtagattaataggcactaaatgtgagatgacttcaaacaaatctaaatgctgtacttttttcttgaaacctaatcactataggaatttaatttgacaattttatattttcaaaaaataattttgatcatttaacttaaactgaagagaaatgctggcaagattgaactatggcacagataacataaaagccactggaaagacagcagctgtctcaaaattaattccttatattaaagcctgaatggactgtaaagaaaatgttgaatattttttttcctttaaaccaggttagccaactatccacacaaataacattagtctataaaatactaacttgataacacctcataaaacaaacttatgttctccttttataatataaattctcaaaagggttttacggccgttaatactaagagagaacgtttgattttctagtgagatctggagcttcacgataggcttaaattgtaattattcccatagtagtagcaaattactactatgacatttcagtacaatattgtttcattcaatattaaatcggtcatgaaaaaaagtcagcaaattgacacagactcttctctaaattcctagttttcattcccctgatccctgtcccaccaaagatttaaaatttaaaatttaaatttaaatttcttaccaaatatttaaaattttcttcaaaatatatatcaagtaagatatatgctttgaatgatgcttatgtttagaaaatcaactgcaaattacgaccagacaactggcagcttatggttttgcaacagttatagacaaaggaacaagtaaaaatcacaaatgtcaagttgcaaccccatctaaataggtttcctgtttacatcagcccttcttgcaggtgcaggtgcttacttttggtagtaaaggaaagaactaatttataaaccttaagaacatcttctcactttctataaacaggttataaaattgattaaaattgcagtacatcaactctacacatatacctgctctgttactggagactaatgtaatccaaatatgtggaaaagtcaaatagttctcagcaaaattaatttagatggatggatcagataacaacttggaactgaacctaaaaggatcattcctactaaaaggcagtaagtactgaatgttatattccaaaatgtacaaagaaaacactgacttttagtctattatcagaataatttaaaaatagtactttatttacacaaatgcttaaatacatctcaatggaaaaaatggaaagacctgttaaggctactatatgttctatttaaaagaaaaaagaaaatgtaactggcataaaagatcatgtaaattttgcatttaatcctactcatgttaatatacatcctcaaagaatgtgcttccatctacactattttatcctcatgaagacaaaagcaaaatcattgaagaaaccactgatgttcattgccacaagatttgtcgtctttcaaacaaagataaaaaatggtaagcacagaaatgcaaaacttttcatgagctaatgatttaatcatactggcaaagcaatattgattgtatccttatataatacaattcaaagttcaaaaacatttttaaaaaaggttgggggatggtggctcatgcctgtgcctgtaatcccaacacctgggaggctaaggcaagaagatcactcgggcctaggagttcaacaccagcctaggcaacataatgagacccctgtatatacaaaaaataaaaaaatagccatgtatggtgatgcacacctgtggtcccaggtactagggtggttgaggtggaaggatcgcttgagcccaggaggtcaaggctacagtaagcagcgatcacagtaagcgaggtcaaggctacagtaagcagcgatcacagtaagcagtgatcgcactactgcactccagcagcctgggtgacaaagcgagaacctgtctcaaaaaaacaaaaaggcaggaggggtgggggtggaatagagttgaggtaaaacaatgaaaacggaaatttatcttttgaatcaccaacttctttcgcctcagttcctttaccaagtaaaagaaggaccatatacaggcagagggggaaatgtggagataagagactaccatactgatgaccagaggactgctctctttgtggcttatggggtcctctggaacttcggggtgttctggaacttttgggagcacaagaccatggataacatcaattttcaggatgtatagcaattctgatcatagctatgtccataaagaccctatttcacctgtgggacttctggatattcccttaatactctaccccctattcttagtgtataatcctttcttttttctaccccaaatactttaaacaaatatgaataattttaagaattccagatatttttcagttagcattaatattgatttagcatgtcactcctgttttgtaggagtgttttttcaaaagtatttgtatggtctctaagacatttgtggtagtcagcctccaggatggcccccaatgagccatgactcatgaaattcacatgtgcattcttgagcaatcctctccaacacagaatacagttaatggctgacctgtgtaaactaacaggatattgcattgcaggaataacagtgtgtgtttgttgacactaggttaccaaagccactgtagcttccaccttgttttctttccttagattgttcactctgagagaagccaaccaccatgctttgagcatgtcaagaggcctgtggaaaggccctcaatgtagaaaagaattaagcctcttgtcaacaactagcaccttctttataagtaaaccatcttagaaacagatcacccaactccagaaaagcttttataacagatgactggaggtccagctgttatcttgactgaaatcttgtgagaccttgagctagaaccatctagttatgctattcctatgttctgatccaaaggaattatatgagttaataaatttttattgttgttttaagccacaaagtgttgaggtaacttgttaagcaataactaattcatactctttcttctaaaaaccaaaaaattaaaaaagtcagtggctcaaacatcttcattaacaacacaatactgtttctctatgagggattgagaactcaagccaagtgaataactcaacaaccctttcttaaaaaaaaaaaaaaaaaaaattaaggtatgcaatcccagaactctgggaggccgaggcaggcagactgcctgagctcaggagttcgcgaccagcctgggcaacacggtgcaaccctgtctgtactaaaatacaaaaaattagccaggcatggcggtgtatgcctgtagtcccagctactcaggaggctgagacaggagaatcacttgaacctgggaggtgaagcttgcagtgagctgagatcgtaccaccgcactccagccggggcgacaaagcgagactccgtctcaaaaaaaaaaattaaattaaggtataatttacataggtaaaatgcatatattatacattttcagtgcatatttcatttagttatgacacacatacaccatataggtaatatctgatcaagatacaaaaatgttcatccccttaaaaagttccctcaaggccattttgaatcagttcttgaattaccccttactctctaacagaataaagcactgtttttctatcaccgaagataaataccgataatcttctatgtctggcttcttttgctcagcgtaatatttataaggttaatccacatgttgtgggtaccagtagctctttctttttcattgttgattaacaggttgagcatccctaatctgaaaatctgcaatccaaaatgttccaaaatccaaaattttttgggcaacaatatgataccacaagtagaaaattccacacataagtatttagtgtaaactttgcttcatgcacaaaattatttaaagtattacataaaattacacccaggctatgtgtataagctatcattcaaacataaatgaagttcgtgtttacacttaagtcccatctacaacatagctcactatgtaaatgcaaatactccaaaatctgggaaaaacaaatcccaaatccgaaacacttctggtcccaaacattatggataaagaattatcaatctgtaccatgtttatgcattctcctgtccatggacatttgagttctacccagtttagagctataatgaagaatgtttctgggaatattctagtgcaaatctttttgcataggtggacatgtatttttctgttctcttggataaatacctagacagagctgggactagagtgaggcaaatgaagtactacagtacaaaatttaaggaggccttataactaggactggaattgctggatcataaaatagatgtttctattaataatttagccttttttatagcattgaaattttaaatgtagacttgccataggttcttctgtcaagaaatctaccatttaaacaaagagcaatagtaggttaacatattagtctataaaaatataacaaattatatttatgaagacaattgatcagccaggcgcggtggctcatgcctgtaatcccagcactttgagaggctgaggcgggcagatcatgaggtcaggagttcgagaccagcctggccaatatggtgaaaccccatctctactaaaaatacaaaaattacccaggcatggtgggcatgcctgtagtcccagctgctcaggaggctgagacagaagaatcacttgaacccgggaggcagaggttgcagtgagccgagatcatgccactgcactccagcctgggtgacagagcgagactctgtctcaaaaaaaaaaaagaaaaaaaaaaagacgattgatgtattatcagatatgatgcatattaaataaaacattaagttaagaataacttgtgctacaatgatctctcaatcagtaaaactccttgttttacagataaggaaaatgattaagagacttgtccaaggatgcctaactagttagggcatattgcatcacacatattgcattgtaaatgcatattttcatcatacatattgcattgtaaatctttacacaaatttaacccaggctcaactaaaatattttttcttacctaaagttgtgggcataattggttttcaattttaatgtcaactagcttttaaagaaaattgctttttagcagcaggagactgtaaatttgaactagtgagcaaggaataatatattattttatttatttatttatttagagatggagtttcactctgttgcccaggctggagtgcagtggcgtgatctcggctcactgcaatctccgcctcccgggttcacgccattctcctgcctcagcctcctgggtagctgggactacaggcgcctgccaccacgcctggttaattttttgtatttttagtagagacagggtttcaccatgttagccagatggtctcgatctcctgacctcgtgatccgcccaccttggcctcccaaagtgctgggattacaggcatgagccaccacacccggccggaataatatattcttttaaataaaaatcaaagattagtgacattacaaaaattataactataaaaacacatttactaaataaggttaaactatttctaaatacatataaaagttatttttcttacctatagtcagattagacttttctaaggaaggatgtaaggctatagtgtacaacaggggttcccaacccccccaccatggactagtcctggaccctgtacctaggactgcgcagcaagaggtgtgcagcaggcaagccagcaaagctccatctgtatttacagttgctccccatcgctacattaccacctgagctctctgcctcctgtcagatcagcagcagcactgattctcataggagcacgaaccctactgtgaaccatgcatgcgagtgatcagggttgcgggctccttataagaatctaacgcctgatcatctgaggtggagctgaggcagtgatgctagcgctggggagtggctgcatatacagattaacattaatagagaggtttgactgcacagagaccataataaatcaattacttgcagactcatcaaaaccctatcagtgagaggcaagtgacaattaagctgtatctggtggtaggcttttgagtggcaagtgagttgatgtacttcaagtgtacagctgcatctggtggcaggctttaagtcaaaatgcaacatttattttagtctgcacgtggcctgcctattattttatttacctcttccatctgcacctccttcccacactgcacacttgtcttggtcacagttttgataagcctacaagctaacccctagtcacaatgagtaaaaaccaaacatcactggagaccttctttaaaaagggggaaagaccccatgatgagacagcagaagactctaagactgccaacaaaaagaaagcttcatttaaaagaaaataccaacagtcctacttaaattataggttcattgtaacagatgattcacattctccaagtatgctttgtatgctatgtggcgaccagctatccaatgaagccataaaaccttcaaaactgctttgtcacatggagaccaagcagactgattaaaagacaagtcttcgcagtttttcaaaagaaaaaaacatgaacacgaagaactgaagtaattactgaaagccaccacttcatcaaacgtgttgacactaagagcatcattcttagcgactaactacatagctaaagctaagaagccctttactatcggtgaagatttgatcctgcctgctgctaaagacatctgtcatgaaattttaggagaggatgccgatcaaaaggtagcacgtgttcctctttcgactagcaccataactagacaaactgatgaaataacagaggatattgaggcacaattgctagaatcaatgagtcaccatggtacacaattcagactgatgagttgaccgatgttgacaacaatgcaacaatgcttgcttttgtgcaatatatttttcaggaggatatgcatgaggatatttatgtgcacttttgttgctaataaacaccaaagctgcagaactattcaagtctttgaatgattaaatatcagagaaactgaattggtcactttacatcggtatatgcagacacagcggccaccatgactggacggctttctggtttcacttctcaggtcaaaaaggttgcttctaaatgtgagtctatgcactgtgccatccatacagaaatgccggctacctgaaaaatgtcacctgaacttaacaacgttttgcaggatatgattaaaattatcaacctcattaaagtatatgcccttggctgggcgcggtggctgacacttgtaatcccagcactttgggaggctgaggtgcgtggatcatgaggtcaggagatcgagatcatcctggctaacacggtgaaaccctgtctctattaaaaataaaaaaattagcaaggcatggtggtgggcgcctgtagtcccagctactcaaaaggctgaggcaggagaatggcatgaacccgggaggaggagcttgcagtgagccaagatcacgccactgcactccagcctgggcgacagagcaagactccatctcaaaaaaaaaaaaaaaagtacatgcccttaactcatatctgttcatgcagctctgtgaggagatggacacagagcatacacgtcttctcttaaacacagaagtaggtggctttctaaaggtggatcactggccagagttttgagttatgagagctgttccagagatttcttttagaaaaatagtcaccactggcagcacatttcagtgacacagaataggtcacaaagcttgcttccttatgtgacatattcaacctgctcaacaaactcaatctgtcacttcaggagagaacaactctgttcaagttcgcagataaagtggctgcattcaaagccaaactggaattatgggggtggcaagtgaacactgggatttctgacatgtttcaaacattagcagagattttgaaagaggctgagccagggccttctttctcccaactggtgcagatcacctatctcagctttcaaaagagtttaagcattacttcccaaccacaaaggacccctgaatgggaaggaatagatccgcaacccatttgtgaataaaccaggtgaattgacttcatctgtgctagaagaggatcaactagacaatatcaaatctccatacattctagattaaagtcaagacagaatatcccaagattggcacaaaatcactccttttcagcctgcttccatttccaacatcctatctttgtgaagcagggttttctgcagtgacagcaaccaaaacgagattacagagcagaatgaacataagcaacagactttgggtgtcactgtctcccatcatccccacatagaaccttctagttgcaggaaagcaagctcagggatcccactgactctacattatggtgagttatataattacttcattatatattacaatataataaaaatagaaataaagtacacagtaaatgtaatgcgcttgtatcatcccaaaatcatccctccaccctccatccatggaaaacctgtcttccacaaaactagtccctggtgccaaaaagtttggggactgctggtatatacatgatatctgcatttttcattctagaggctacccaaaaccaaatcatttaaaggagcaataatagcacttttattcaatttatttgttttgcttctatcaaattactaccatttattaagataaatgcttttcttcccttgaaaaagatttttcatctagaatattgtggtaatggaaaattattaaccagtcagagtaacaatatttttcaaaactaggatggataattataaatctataaacactcgtggcaagatgttttattggtttaatacaacttgatttatacattaagaaagatttttgataattttaaggtcacttcgggaaatctgtgaagaagttcatttaatagtatatttctaataaaagtttagaccacatactttccttgccaagagagtaaatttattgagtctttgaaataattgcatttaaactgtatcattaaattctatccaagctatgattaatatttctccctactctttaatgtgacctttatttaacacagttcactgtgtccctaggaatacaagtatcctatttgaagttacaatgtgatcctttcaggaaaataatcttttttttttttgagatggagtcgcgctcttttgcccaggctggagtgcagtggcgcatcgcggctcaccacaacctccgccccgcgggttcaagcaattctcctgcctcagcatcctgggtagctgggattacaggcacgcaccaccatgcccactgtggtggctcaagcctgtaatcccaccactttgggagggtgaggcgggtggatcacaaggccaggagtttgagaccagcctggccaacatagtgaagccccactcttatactaaaaatacaggaaaataatcttttttttttttttgacatggagtctcgctctgtcacccaggcaggagtgcggtggtgcaatctcggctcaccgtaagctccgcctcctgggttcacgccattctcctttctcagcctcctgagtagctgggactacaggtgcccaccaccacgtccagctaattttttgtatttttagtagagacagggtttcaccgtgttagccaggatggtctcgatctcctgaccttgtgatccgcccgcctcggcctcccaaagtgctggcattacaggcgtgagccaccacgcctggccaggaaaataatcttaatctcagctagtgaaatgcttagtactaagaaggtttcaaattttcatatatccccttttgaagaattttttgtgaaatatttcagagaatgcctacctcacaaaagatgaacactggactatgttaatgttgaattcatatgtaatctgtaaattaaattttctcaagtgaaaatttgcacctacctttatcattaaacaagtaacaaaagaaaccaaacccctgcagtttaaacaaaatgcctttttgtttgccaagttctgcttttcatttaattgttctgatactatacagtacctcacaggtttcctttctcgaagcaagtcttccagactacgttcacaatgttcagccacgaccactagtcgttctgagaaaaacaaagcaaacccatgttatattttatcaatacaacatgttaaaaacaaaataatactctccactgatgatattaatatataacacccataacaatattttaaaagagcctttcaaactctatattaactacattattaccaagtatataggataataaacatctaataaaacaataactatttttttctcttgtatttttcttcctctagagtttttcttacatacgtcaggaaaaataggtggaaagactgtccttggggaaaaaaataactcacccttcttctgacacacattgaaagaaagaagtaaaagattagatgaatatataaagaattttgaaagaagggaaaaggagctaggtacagattgcttgacactctggttttaaacacagacctttgaaattgcattcagaaacttgaaaaaaagtagaaatgatctgaatcataactatagagaaagaaattcaacctagaattattgttaacccttgaacaacgcagggggttcttaaaggtgccaaccccctaaatggtcaaaaatcacctataacttttgactgtcccaaaacttaactactaatttgcctactcttgacttgaagccttattgacaacacataaacagaacagtatctacatttattttatggattcatgacatacctttttttcttattttttcctatatttctaggctacatggttcatctatgagttttttcaaattgtcaaaaatctccaaagaattttccaatataaattcattgggaaaaaaatgcatatttaagtggatgtgtgcagtccaaacccatgttgttcaagggtcaactgaacaacagttgagattaaatattataaaacagtggtagacatgatcaacattaatgatgtcatttttattttccaacagatcaactgatcaagatggcacagttctaagggccagcctatacttttttttgcctcatccattattccaagtcactaacatgatgcttgataatgaatctaagaggaataaaagaaaagtacaactggctttacaagcttttggggatttgacaaggttatttgaggagtttggttcaaaagaagttggagtgttgtcagtatctatgcaaaacagattctaagtaaaataaagaataagtttaacacaaaacacaaagactgagactagataaggtaaaggtgcaaagaaactgcgaataatgataactgtaaaatgaaggtttggtgaaaatgaaaaagtagccaaggtagaaaaaagagacagaagaagataggaaagaggaagttcagagtaagaaatctagtatataaaatagttcagtaatgattggattaaggcatggtcttgaatggggaagtagagatggacaattgtgttcaggcagacatgtcaagtgcaggagcaaagtattatcttggatcttatctaagtttactctgtctagtgaaatgggattatacagaatgatctgaaacacaaaaattaaaaatgctataagtgaatattatcattttcagataaaagattccaattgtagaggaaaaggaataaaatgaaatagcaaatgatgaagctagagagagaggtgagcaggaatatttaacaggaatttaaagaaaattaactttaaaagaacacttaatgagaaaaaaagaaaaagaaaaggaaaccatgcaataaaaggtcaagttacttacttaacaaagaaaagcgtatgcaaaggtaagctccaagcaatttagtacaacagtgaaattccagaagaaaaaagcaggcaacattatcagaaaaccaaaagaagaagctgcattcctttgcttttcatcttaccacgttttgtccattttccttacatttatctggctccctcccctcagtatcctctgtaaatctttacctcttctacccaaattgaaatgctaccagttcctccacctttgattctgggtcttttttactgttttctcatctattcccaaggctgaaaaactctgagattttattgcaagcccaaaactctcttctgaactgcaggcttctatagcctatattataggctttaatataaaagtcacctgaaactcaaccaaacttcaacttataatttactgttaaagtctgtcccctttaatactgtttcagtaaatgatatcactatccagtcaactgctctagctagcaactaaacagtaatctccccttctcaaatccaaataaacagagtcctgttatttttacttctcaaacatttctagaatctatatagtttgctccatctgccacaatctgggcccagccagcatcatctcattagataactacaacaatcttttaactgatcttctcacattaattcctatttctttccaacatattttcacactaaagcccaactgataaaatcataagaagtctgaatatgaaactccctctctagcttcatctatattattttatcttagtttaccaacttccatcacactgatcttccttctggcctcctgccttaggacacttacacatgggttcttattgcctgaaatgatctttcccacatagtggttaagagtatagactattttgtctgggatccaaatcccagttttgctactaattaactatgtgacctcagggaaattttctaacctctctatgccagattttttctgtaagatgaagagaagaatagccacctgcctcacagggttgttgtgaggttgaaatgagttaatatataataaaggcctagaatagtgtgtggcacataacaagcaatagctgattgttagcttttattattactcattattcagggctcagttaaatgtgacttcctcaagggacacttctctcatccccccaacatcgatttgctgtcctacaacatactctattctacattttaattttgttttgtagcacttgtttcaactctaataatttgtatgcattcttattttggtccagccagcatcatcagtaactccaccttatccatggttttactttctgcagtttccaaacattttaaatggaatattctagaaataaaaaattcctaagttttaaattgcatgccattctgagtagcacagtgaaatctctcaccagcaattaatatatgccaaaaagaagacgtggccgggcacggtagctcacgcctgtaatcccagcactttgggaggcaggcggatcacgaggtcaggagaccaccctggctaacacagtgaaaccttgtctctactaaaaatatgaaaaaaaaaaaaaaattagccaggcgtggtggcaggtgcctgtagtcccagctactcgatggctgaggcaggagaatggcatgaacccgggaggcagagcttgtagtgagccgagatcctgccactgcactccagcctgggcaacagagcaagactgtctcaaaaacaacaacaaaaaaaagaagacgaaaagtgcttccttcaagtgaaaaggtgaaagttctcgacttgataaggaaagaaaaaaaaccagttgttaagatacatggtaagaaattttctattcgtgaaattgtgaagaaaaaagaaaatcataccagttttgctctcacgcctcaaactacaaaattatgaccacattgcaagagaagtgtctagttaagatggaaaaggcattaaatttgtgagtagaagacataaacagaagaaacacgttctgactgataagaatcagattcggtacaatcctcagttttagacatccactgggggtgctgggggccttcttggaacatatcccctgaggaaaaggggggcctactgtgatatcttttttcctatcagataatatattttatgatggcaggaatgaggtgggtctcatcacaggtgcctagcagtgcatcagtagttgcacacaggtgcatcacagtagtacatcacaggagcctagtgcacacaggtgtactgcatcacaggtgtctagaatgtcacctacaacatataggcatgtaatataaagataactgttagatgaattaactttagcaaaggcatgatgtggccattagaaatgaagaatctcatatgaccacagtcactgaacagagccctgtcctgtgtagaaaattacatgcccacgttataaactcagtataactcagtagcactgactttcatgtaaaacaaaaacaaaataatttattaaaatgtgcatattccattaattaaccattttaaattggatattcataattcttcatatctataagagatttccaaagtatctggcacaactaaaatttttcaggtttctggaaaccccttcaaaacatcataaacaagtgtttgccaaagcttcaagattctatggaactattaagcatagttttaatactgctgagccataatcctcagcagaacatcaaagtttctcccagagataatggagtgtataccaaaacaatatttccaatatgaaccatttttttaaagaaatctttagagagtcttcattctgaaatctctggaccactgtttaaaaataacatgttataaaaacaatatagtttcacagaataaagcatttaggaatcataatgtgccaaatataaatcatcaatgtagtagcattatttataaaaaataatgtgatgctaagatgaactttaaagagtagaatatacaataattgtgaaatagtcttacttctaacaaagatttgaggaagcaaaagtatgatgtagcgtctctagcctgaactgtgtgttttaggtttgacagggcttggctgtgttcccacccaaatctcatcttgaattctcacgtgttgtgggagggacccagtgggaggtaattgaatcacaggggaggtctttcccatgctgttcttgtgataattaataagtctcatgagatctgatggttctataagggggagtttccttgcacaagttctctttttttggcctgctgctatccatgtaagacgtgacttgctcctccttgccttccaccatgaatgtgaggccccaccagccacgtggaactgtaagtccattaaacgtttttcctgtacaaattacctagttttgggtatgtctttatcagcagtgtgaaaacaggctaatacaaagttaacactaagaaactgaagagaacacacatttaagcaagaataaaggagttgaataaggagtagggggaagtaaaataaagttttttaaagtagtggtttttttgtttaaatttagagaaagaggtgaatcatgaatgtcttaaaataatataaagggttattacaatatatttactgcatcacttttgttattaacagtaaaaatcgagactagctcatcacctttaaaatatgatatttcaataagtgtttatacagttcaaaaccaacaaagaaaaacattatgcttaaagaatagtattggtaccagaacactgtgatggtcagttttatgagtcagcttagctagaatatagaatccagtcattcaatcaaatactaatctagatgttgctgtgaaattattttgtaaatgagtaaagtctataatcagtttactttaagggaaattatcctagataatcagggtaatcctgattcaatcagtttaatagcctttaagagcagaattgaaagccaagtacactggctcacacctataatcccagctacatgagaggctgagacgggaggatcactttaagccaggagttcaagaccagcttgggcaatatagtgagactcctgtctctgaaaaataaataaataaataataaataaatatgagcagaattgaagcttccatgaagaacaataaattccaactgtggatgacagcttgagcttctgcccaagagttcagcttgtccttcttgaagacctgcctcatggatttcaaacttgcctagcagcaccccacaatcatgcaaaccaattcccagcaattcttttttatatattcatataacttacataaataacttatataattatatatataatttgttctgtttctcttatgaaactaatacagattaaaatttatatgctagagatacagaataaattatcttgtagttccatataattctattattctctactttaatttcaaataaaataatttttattcttgatttcaccagcaatcattgaaagatttctggataatcaataccaaataaaaaaggatgcactaccatttaccatcttcactctgcttctaaacacagctgagatttcaagctcacaagaaaagataaaatttgttaacatagtattttcaggctttactggctttttttctcctaaagatatttttctcctattagaaaaaaaattctgaaactctaataaaatgtttgccattcctgagattaaaaacttcatcctgctgagttagcaagaaaatattatcatctttgattagtttcgaatgatctatagaaaacagtgaaagctagacttctgagctaacataacatgtgaaaacataatgttactaaaacagaccacatgtaacaagagtatgtgactccaagtaagaagtcaattgttactgacttaacaataacatgcagggtgggagggggcatgactaacaatagcaagatatctgcatagcaagaacagaataaaagaggaaaagtagaatcaaaatcaaaattctttgaggagacacaaatcaaagtcatgtggtattacaccattgaaaaatatgtgttcatattgagaaatactttcactaaggagactgttcatcagaaacttcaaatttttcaaagtagatgcaactgaaatgactagaatgttttggaacaaacagacttttacataagcaattactctaacggtaaattattccttatacacacaacttttcagaatgctaaacattgccaataaaaacaagataatcaaattccctagcctaatgacaatccatattttcatttcagacaactagacttagaatatataaactttacacatattcatgacctatgttaccctagcagagagggctgctgaaatacaggagtagcagggcaggtcagggaagcagagtaaacagcaatatagtggacagggctaacgggactaaccatgctgttgaactggcctcagagaacaacaatcagtagaacgattacagtttctaagcggatcagttcccacccgactttgataatcaaaaagaaggttcacagggaaaataaggaagaatactccccaaagagaatcatgctataacgcagttcctaattcggtgtttatagaggcccgtttaggtagaggaaggaaaagaaggagctttagaactattttgtcaattgagaaaaggaggcctaggaacagaggaaaaaaccccaaatacataaagtgaagctccaaagaggcttccagatacagtgggaataaacaaagggctcttggtggaaagagtgtggaaagacaggcctctgccaaatttacagatgttcaccacccatggttaatactcagcatctactgtactgtcaaccaaagaatggttttggaaataggataaacttacaactggaaattctttagaatctgtagctggattaagggtaagggctgttgaagtatacagggattgaaaatatctattaattgcttggtgatgtaaaaagctccaaatgatccccgtaatttttcaacatctaattaatgtcactaaagccaggtaacaaataaaaatctttggcaaaaaattattttttgaacaaaaattaactcactgaaagttattttctgggctttcagcaaatggctggagctatctatagtctactattagatatagttaccactagtcttcacagttctctttaagcaaattagaaaaagcacccctccccctagaataaattagagaatcagatttcagctcccacttactccattatccagaagcttttatgcagtgaggcaaaaccctacacagtggccctgactgtgggtctcctaattggtaaatatatgacatggtgcaacactaggtacaggtcaaatcaattttgaaaagtctagtacctgacattagaacttctcaagttagcctttaagtaaagaagataatctctccataccccttgatactctacaccagtgcttttaagcccttttttcttttttttccattaggaatcctttttgaaaatctgcgaaaaactatgcattttcattattcagcaaacacatgtgtacatatgtatatacacatacacaattttatatgtaatttgaaggggttcacagacctcccaaagcctactgaagctgcaattttaaacttaaaatttcatttccttagatgtttactatagactaaaaataatcttcaaagcccttcaactgactgaagagaccatctcttggccaaggggaccccagagtaaccttgaaaactgagttctcagccatgataggacttagggtcagacaacctcattataccccacccccttaaccatgattaggctttcttccctagggacttaacaaaaaccagccctttcaaaagattccacaactgatatcaaccaactacctgacactaccccttcttttttgcctgataagagaccatttgcctgataaccaaccatgaagtggttctggccagtctaccaagaataagcagtaagggttttcgtgtcctctgctccacctttgacatcagagggccaaaaactccaccctcggatcatgaccctcagatgatgctagcattgccattttttatatgtgggacccatgaaggggcttgaaggggaatgaagtttaatgcacatacacacggttctcctttcataaatattcataactcctcccacagcttactgaatatgtatatttggccactctgctcagtataaatttctgttccctttgcccctccctcaaagtatctgtttcaagcttctcacaaaaggctatgcttcccagcctgtcacagtggtcaccctgcaggctataacccttatgataaataaagctctcctttctaagtttatgaacctcttcattcttcagtgtacctccctcacacaaaaaaaggtgggggacaaaaagctacagagacttcccagttcagagattaacaccaaaaagaacaataaagcaaacccataacaacagacataagatcagatcagagatctcagatcctcataccaaataaatttctataccatagtctccatagttcatctagacaacagattgtacaaacattataaagctttaaattgatattttttccacgtttaagtatctagaaattaatttcttaataagctgcctcattataaaaataatttgaagcagttagatttacttctttgccctggcctataagaagtatacaaccaaatttatagtccaactaaaaaaatattaatattactaacctcaaatcttattctgtttcctttctccctgaagaaaatcagaatatgccatctcaaaatatcccactttgacataaggattttgagtgaaggcaattagctctcttctctctccatttctgtctaagcagaacataaatctccctctgtaaagatgaaaggaatttccatttgataaattccatttggaaattatcctctcctacactaggaagaggaaaatgactcttatctacataacaaacttactaagtaattcttatttaccatgcatttctgagtcactttctcaaatcccaaacccctcttcctttgtctaccctcttctctatactttatttccctttgtgaagatggtatataagcctcaattctaactacctccatgagttgcatttctttgtgaaatctgtgcctatagattaaatctgggtttgtttgtttttttctcctgttaaccagccttttatcagtttgattcctgggacctaccattaagcatcagagagtagagaaagttttttttccttttttacatcttcaccttgattatttttctttcatgtactatatataaaatactgtatgaatgtctgcatcttgtctcaaattatttttgaaaaaagtaagcttgtaattaatcaagagacataaatgtctttttaaattaagaataattaataatgatattaagactttgtttcctagaaatatgtcaacaataaaaggccaacatcttttgaaaatccattaatttttgagactaccagcatcatcaaaatgaatgaatgtaagcaaataaaacataacagacagaagagccattgctctgtggtctaaagtcctttatcccaccaaaaccttttatatatgagtttgattaatatatatatattttttattatttcttatctttagagacagggtctagctctgtcacccaggctggagtgcagtggcatgactgtcagaggcgtgtgaaccagagcaactccatcttgaataggggctgggtaaagtgaggctgagacctactgggctgcattcctaagaggttaaggcattcttagtcacaggatgagataggaggtcagcacaagatacaggtcataaagaccttgctgataaaacaggatgcagtgaagaagctagctaaaacccatcaaaaccaaaatggccactagaatgacctctggttgtcctcactgctacactcctaccagtttacaaattccaaggcaacgtcaggaagtgaccttatacggtctgaaaaggggacgcatgaataatccactcattgtttagcatataatcaaaaaataaccataaaaatggacaaccagcagcccttggggctactctggctatggagtagcctttcttttattccttcactttcctaacaaacttgttttcactttactctatggacttgccctgaattccttgccgcacaagatccaagaaccttctcttgggggtctggattgggaccctttcctgtaacatgatcataactcactgcagccccaaactccttgtcacaaatgatcctcctgcctcagcctcctgaatagctaggactacaggaacaagacaccatgcctggctaattttttttttttttttttttttttttttggtagagacagaatcttattacattgcccaagctggtctcaaactcctggcctcaagcaatcttcctgcctcagcatgccaaagtgctaggattataggcatgggccaccatgcttggccttgatattcttcaacgcaaaattaacattctcttctttgtacttccatagcatagcatagcacattgtacatcacctattataacaactattactgtattatttaatattatcatggttgtatttttctctactgtttctgaagctgacttgggacctggggtaatgagttactcatttttgtatatttggcatctagcagaaggagggccatagtatcagtcaagggttaccaaggtattataaccccagtgtacatgtttgtcaaagcagtggacaagaaagacaggttcctaaataaatcttcaactcatcagcacctttattacttttgcttcaaagctaggtttctatcagctctgacttcccaatttgttccctacagagagagacccttaaggcctcaacatggcaccacccatgctcttgcttgagggattaagccaaacatgacaggcatttactaatatttgcagaatcaatcaatcaaagtcaaccttgaacagtaaaagaagtctcaataaaataatgtatactttaacatgtctgtgtgtatatacctatatgtcaatatgaaaaaacaaatttttttttatcatctgctagacaattaactttttttaccactctctttcccaaatctctcacgaagcctcctgacaacatctaactatttacagcactaggtatgtggtagagctcaacagtatttatggtacggaatagctctgattagaattctgtcaatatttgcattattatacacttacagcaacatgtacaatctttcaaaaaataataaaatgtattagcagtccatttttccttaatttccttcgtgtgcccttggatgaattaattgtgaaccttgacttaattgctctgtggtttaattttcttatctgtaaaatgacaggactagttcctttcacacagtaatgttacaaggattaagttaattaaaatatgtaattaaaatatgtaaaacactaagaatattgccttatataaacgctcaataaattttaacgattaataattatcattacaaaaaaaatttctactcagtctataaaacacaaatattctcagagtaaatattttaagagaaataaaccagggaacttgaaagtacagtttagtctattttcagcaaaacagtaaagaaaacattgtttgcatttatcagggtttttaatattaggttgaaacacataaaattgccacttttatagggaaaaagttgaatatcaccaactacatagggtttactttcagatttttttacgtctacaaattattttatgttagaaaaattaaatacatttcactgaaatgcatttaaaatatttttaagaaatgcaaccttaccctgcaattaagcttccaaaaataattctgaaataattaaaaatattgccaccataagaatctttaagtggagaatgaaagaacctgattacactactaaaaacgcagtaaacatcttcctcaaacactgactttttaaccaatagggttcaacttttctaattcagttctctaaatgggctgctatataaaaagactaatggagtttaaaaaaaaaaatctactgactcccttttcatttgaagacagttgccaaaatcattactttcaatcataaaatatattgttagataattcttctaaagttcctaacattagaacttcatttccttcatatagataaagaaatatgtttaagaatagacggtttccctgaaaaagaaaattaaaaatcctgattctcagatctgagaaacattaatcattcaaatatagttgttaattcattcattcagctaacaaacacttattgagtgctctgaggtcacaagtaaaggtccttatcctcaagaactaagaatcctcagaggagaaaaattaaatagaaaataataaaatgtgataaaagctataaaagaacttaggaaaaagacttagctcagattgcagggaatggagcatagcataatccatgagagaaaattgcaaagtacaaaatcaaggatatgtgaatcaaaaaacctcaaagcaactcagcttggctggcatgaagggttaaattagtggaaacaacaagcaatacatcgaaagaggacagcacagactagatcaaggactagatgaaggattttgtatgcaatagcctagtaaagagtttgaattttacctggtagatttgcaagtaaatggggaagtgtacgagagagaggcagggtgggggaaaaggatgagagaaagaaggacatgtgtgcactggtactgatgatagctttatatatttagtggatatagtatttataacttagggtaacaaagtagagaacataaataggaaaaaaaagaaaataacttaccatgctttcccctagaaatatccacatactggcagagtctgggatgggtgatggttttaaggatttgaaagcgccctaaaattttgatggaatttggtgtgagaggaagtccattgcttccacaaacatcatgtggcagagccgaggcaaagaaggtaaaggctcccatttcagcgtccttcaggggaaacatttttggagtcctaggtcttctaagataatctggaaaaggagagaattttaggacagaccaaacattaagccagacagaccaaatcttaagcatgattaacatacaacttggaggaaaatgccaacctgaacacttcacagtaaaaatatcaaagtataagaaaattctaaaatatcagaggacaaaacaactcagcataaatttatattgcagctctaaatcaaactctaagattttcaatggcataaaaaagaaaagattattccattctcaatgacatttgacagtttaaagagtagaggaagtttgttactgcatcttcatattattaataaggctcttctctttttttttttttttttttttttttttgagacagtctcgcactgtcacccaggctggagtgcagtggtgtgatctccgcgcactgcaacctctgcctcccgggttcaagcaattctccttcctcagcctcccgagtagaggcacccacgaccacacccagttaactttttgtatttttagtagagatggggtttcactatgttggccaggctggtcttgaactcctgacctcgtgatccacccgcctcggcctctcaaagtgctgggattacaggcgtgagccaccacacccagccaataaggctcctctctttacctaaagattgaataacccacacaccactgacaaccttccttctcatacagtgaggtaggtcaggaaagaggaaatataggtaccaactagtaacgaataggggaccttattaatagtagtaaagcttaaactagattaaaagaaggctctataatattaaataaccaattttcatttttatgctagatattttacataatgtatgatctgctttaatccttttaataatcctgacagagctattggctccagtttagagatagttgttccatgtgtatagcatgaggcgtcctatttgcacttactccaaaataaatggtgccccaaagttgcgtaaagtagtagcctggagagtaggaaacttgctccatatcaatctgaatcacattaaggcaaccataacaacaaaaaaaagggtcttctgacacaaaaatcttttacccatggacctcactaagaagacattctactggtaaagccctgcatttttcccttctcagcttaatgataaatatgctggaattccaattcaataaatccactttgacaagaaaccttactgaaatcattaaaaataaaatattataaaacgtataaacccttaacaaggaagaaaagagaaacaggccatgaggtgatgaaagatttctagaaacttgtacaaaacaaaatatataaggaagagtgaagcagaaagaaataagctacaacctgtaatagtcaagaggtttgtttggtcccttcagattcagaggcttcagactcagagaaggcgggaacaatgttaaacagcagtcagagggtttgaaatcagaagggtgaagtgttgaataattagaagcgtcaattctgccaccagccccacaacattggcagttatttacactccatgaaaaaaagaaaaagataaggttcttccctaaagaagctgaacaaactgagaactacactagttgctatggacactggtgagaagagcaaactcctcacaattccggaatttgtaggaccccagctaagatttggctgttcacccagccatcctaaaacaaaatatatccgtcaataagcctgtccatatatgcaaagctcccaggaagccttagctcttaaataatgagttgtctgagaatcatcagatagttgaggaaagactacagtatcaagggcaaacaatgaaataaacctccaaaaatctggctttggaagcaactgaaataatttatgaaaaaataacacaaaaaccaactctaacaaacatagagagatttgaggagatattgcatccattacataaaacaagttatagaaaaacacattatacaaaagaataaagagaaatggccaatagatacatgagaagataaacaacctcatgaataatcaaggaattgcacattaaaaccacaaaaaatttttatctactggacagtcaaaaattaagaaatctgataacacataatgttagaaggatgtggaaaaataggatctctaatttgctgtaagtgggagtgtaaattagtaaaatcactagatatgttttacactatcttgctattatattcctacagaaactcctacacacacacacacacacacacacacacacacacacacacacacacagagtggacctgtgcaagaaagatcaaggcagtattattgctcctaatatccccaagctggagacaatttaaatgtccaatggtaggtaaatggttaaataaattgtgctttattcacctgtatacataatgaaaaataagcaaactatagccatatttaatagcatagatgaatcttagaaatataatattgagtgaaaaaagtaacataaaatattccagttttcataaaactcaaaaacaaaaaataaaacaaataattctggaatacttatatctattgtaagaatatattcaataagtaagggaatttaaaaaaaatactcagaatatgggttactaccaaattaaagtggggtaaggttagggaaaaattcataaaaagcttcaaaaatcttgagtaatagcctagtttttagctggtgaattaatgggtgttcatgttatcattatgcttggtaatttccatgctctgtatctatatttatctacatatgtgtgtgttaataccacatatttcataattaaaagaatttaaataaaataaattgattctcaacaaaagcaaaagagttcaacaggaaaaggaaagtcctttttacaaatggtgctggaaaaagatattcatataaaaaaataataacctcaacttctactgatacatccacaaaaatctaagatggaacataggcttaagcgtaaaaggtaaaactgttagtcttctaattgaaaacataagcgaatatctttacaaccttaggctaggcaaagatttcttagacacaatagaacaaagcactagccacaaaagacaattttgacaaagtagacttcatcaaaattaaaaacatctgcatatccaaaggcacccctgagaaaataaaaattcgagttaaagggaaatattatttacatctgtctgtatatacatatgacattatgtatatatatgaccttttaaaatcaaacatatgtgtgtctgtatataattgacctgtattcggagtctataaagaaataccacaattcaataataaaacaagccaatacataaataggtaaaagtcacaaacatattttcacacaaggcatgaaaataataagcacatgaaaaagttcttaatatcattaattgggggaaatgcaaatgaaaatcacaatgacaaacctttaacttctacaatggctaaaatttaaatgactggcagtaacaagtgttgagaatgtggaagtggagctttgctatattgctagtgggagcgtaaaatggcaaaagaattttggaaaatatttggaaaacttttctaaagttaaaaatatccctaacttatgactcagaaattccactctttaaccaagaaaaatgaaaacatttgtccataaaaaaaaacactgtatgagtatgttcataggaactgtactcttaatagctaaaaaccagaagcaatgcaaatgtcccataagtgaatcaattaacatatttgtaccatgaaattctatttaacaaaaatggaacaaacatgtcaaaacatggatatactcaaaaacataaagtttatgaaagaagcagacacaaaagagttcatactgtatgactccatttaaatgtaattccagaactatagttctaaactatagtattaataaaaaaatcagaagatagtactgtagatgggggagaggggttgaataagcagagaaacagaggaactttctgtagtggtagaaatattctctatctcgattgtggtggtagtggttttatggatgagtacatgcatcaaaactcattaaattggccacttaaaatcaatgtgttttaatatgtatcaaattttatctcacacaaaataaaacagcttatgagaagataaacactgctatacattttcaaagcatcaaacgtaactagaaaattgtaaacatttcagacagaaaaaactgattctgctatcaacaagttaaagtgagactggcattctcatcagcaataatgaaagtcagaagagagcctggtgcagtggcttgtgcctgtgatcccagatacttgagaggctgaggtgggaggatcacgtgaggtcaggagtttcagaccagactgagcaacacagtgagactccagctcaaaaaaaaggaaaaaaaaaaagttagaagacatggaaggattgagagttgaaggaaaatacttttgattctatatacagccaaattatcagtcataagagcaaattataatttacagctatacgaacattaaaaaataaaattacctttcacttgccttttgtgagcaagtttccttaggatatattccagggaaatagggggaagcccaataacagaagatgaggggctaagaaacaatgttatttacccaagaatgaatataagcccaggataggagcaatacaaaaggactagaatgcaatctgttcaaattaaacagaaagccattgggctttaaggggaaaatcttcaaacagaggaatggaagcttgcttctatgtgcatcatacaaagaatgagaagattcagtgaagaaagcacatccacctacctattccccaggagaaagcagaaaggcaattaagaaagtggggacggttaaaaactatgtattacatactccaaaatataaagcatgctcaactacagcatattttgcccttggcaggaaagaaataaaaacccatttgaccttgatatcataaataatctccttagtatggcacagggatcatgaagttaaaactctggggaaaaaaacatatcagagcatacagcttggacttgctctaagtaacaactataaagccataatactgtaaacattttattttttttattggtttttggcacgtgaataaagcgcaaatgttatagttaagaaatatattactaactttgacaatgtacaagtaaatgtccagctaagagaaagtgggcataaatgtagtttctgaagtgataaagaaaaaggtagaatcactacttttctcgttttaccaaacaaggagtcaaatatattttcaaaagttgatgtgaaaaaagtagtttacgtatattattttgaattataaagtaaccaatacaaaaactaaaaattatgattatgactcttccaaaattcagaggagattgtgaatggtgtgggctatttctagaagtcaacggaaaaagaattagcagttcaacttagggctatctcaagaagtcaacaaaaagaattaacagtttaacttattatttaacctacagacctaaaattagaaaaggttaaaagtggttatctttgaagaacagtactgagagtaggacaggtgagacagttgcactttattattcaatcctactacgctatactacttgattttttttttttttttttttttttttgagacagagtctcactctgtcatcaaggctggagtgcagtggcatgatctcggctcactgcatccttccacctcccgggttcaagcgattctgtgcctcagcctccagagtggctgggattacaggcgcccgccaccacgcccggctaatttttgtatttttagtagagacggggtttcaccatcctggccaggctggtcttgaactcctgacctcaggtgatccacccgcctcgacctcccaaagtgctaggactacaggcgtgagccaccgcgcccgaccattttattttcaatcagatgtctttatcatcacatagctgaaaataaaataaccaaataaaacacaatgatcgaaaaagataaaacactaattagcataatcagtgttctttttccactacctcttaaatggttgtacataaaaaggctcacacacaaaaatacacacacatacattcacttacacctcgtgagtggaagaaaactaccgggggaaaaaaaacgtagagatgagagattagatgagggaaacagcagtgcaagcagttgggcttgaaaattcattcattcaacaaatattttgaagcccctattttaagtcagttgtttttccagctggtgggcaaaggataatgaacaagtcagactctgtgccctcaaagaacttagagttttaaacgactcgaatggggaaagaaagtaaaaaatagggcaaaagacgccgattttatcatgaataaaatttcacatttcttcaacaggaaaatgatactaattcatttattttatatatacattctctcaagaggttatttttgtctcaaatagatagaaaccaggacagggatccttgaaaagcagccactgacaatcctcaagtaacttccttcctctgcttcactttctcctactgctcaagggggtgttacactttgacgactgactaaacctcgagggccagaaacaaaccaaagcaaaattctgcctccaaggtgagtaatggaggggcggattctagattctctaacctcctttagccttcctttgaggcagtgacagagcgattactaagcctacggttcccaaacgactcaggtgaacctgatttacaggaaaggcgggctgtagctagggatggagacagtacctatcagcaagcggctccacagctcggttctctatctattctgaagacatgcggggccactcactgctcctgatagtcctctacctcccacagaccccacccactacgacacggaaaactggattacccaaatacctgcctctgagtctggggacgcaggcaagcacaaagacaagggggatggagcttctacacagggccccagcgctgtcgctgtggctgctgctgccgctacggcttagtgcaccagacgctgcatttcaggtgctcctacaaaagaggccactcctggaacgccgggagctcagacgctgccctttgctcgcgagccaagtcagccaaggttaaccttcgcggaacccggcgaggagcgcaagcctggccttccccaaacacagatccgagcttttcaccctctaccctcccctcagcctggccttttcttccgccctcacagccaccgcgacccaacgct

SEQ ID NO: 1673 - DNA, 270192 bp, Homo sapiens; identical to SEQ ID NO: 1672

SEQ ID NO: 1674 - DNA, 270630 bp, Homo sapiens
ccttgtttgggtgaaatgagttactaaatgtagcatttatttataaggaatgcattgtgaatagtttctcagttttcattatggaaagatgatgatttcagcccacattcagtgtatgtttctaaataacacaatcgacaggactgtctgttcagtacaatggaggacagctttttcagggcaaatgggatttcttgataatgctaaatctgtcttgtcagctgaatttcttgggctttatgtggcagtgtggtaaaaatatatgatcagatttcactgttaagaaaattctttcagcaatacatgtagagtcaagtttcttgcatggataactgaacatgtgggttatgagattttaaaaaatgtctcgtgacaaactttacggaaatgcaacaatctggacatctagttttgtctgagagtggcgtggatatgaagaactgtgctgttggtgctgatgccacactaagttttggcagtcacactcttggttcttcatatttgaggagatgggatggtgaggaggcctgttggctttattttattaatgccaccatctagaatacagattcttggatatttcatcttcacaaggtgagctgcaaactggaaaaaaaaagaggcaaaatttttagaggatatacagaagacatctccaacctcatgttttttctcagaatttgaaagacaaaattaatttaatgttatgattgctgccaccactgtataataagttgtcaacttggttattaatataaattaaatcactcttttatatgctgacgctgacaatttctttatcttatggaataaatgtctcttcagttctcttttatgatttttttgaatatgtgataaatatacatggtaaacaattcaaattcagtagtaaagggtatacaatgagaagtaaactcattccacttctgttcccagtcctccctctccagaggtcattaatgttactatttttaggtattcttccagtaatagtcaaaacaagctcaaatgtacattgaaaaaattttgatattatggtccacttcaatgtcccacagagagcccataaaccagttgtaacatgtttttggagcaatcacaactaacattttgagtccacaaacctggaatgaatttgaaggacagatccaggaagacttctagatgtctagcacaagaggactttgtaaaagttatcaagacatatacacagacgacttagctaaaatctacctatccaggatcatcgattgcctttccttattctttgcactttatgataaagcatccctcaactgcgtatcaatcccaatatagcatactgctttatgctcagaccttttcttgggcagattgtccaatgttgggcacatgctccatttcccaccaattcctgtcccctctttagcgcctcctcaatagtaacccccacacataacctcaaacctgcctaacttctattcattttcctgctcaggcacttccttctctagaagctaagttgccattagggtccctgcttctcagctcccgaagtttcttgtatgaatctcaatctttggccttacctcatttatttaaattatccatttaagagcttccttctattttgttttcttcttggtagctggcagatggtaggggctcaatatatgtttgctggattgaactaaactatgccaaatgaccataaaacctagggcaaaattatgaagtaaagaagtttttctttggccctttgcctattttatctctgttccttctctttgatagtgtcctattcctcctcattgagtatttgtgtcttcaagttcttttcaattactgtctctactaaaacctgatcttagatccttcaataaaaatgactaatctgctcacagtgctattgcttcttggggctatttgaagcttaatacttagtaatatctcaaggcagcaatctaaactttagggttcaaaagaatgggctgagtggtttggccaggacaagttcaaggcctcactcccagagattctgctttattgatctggggctcagggataggtatttttaaataagcacctgtagatgattctaaagcaggtggcccatggacaattttttgaataatactgtcttaagtcaaaaggataaaggtctcggtcagtaggtggaataaataatgctggactgggatcttagcaatctccaaaataactcacataaatgggtcttagtactgctaaccctacttatcttctctgtgattctctgcagtggctccacagagattcaaacggctgttcatatttcacatcctatcctctcttagagctaacagatgggaatccttgatagtaactaatgttgaagagaaacagtgctcctgtatttcaaaaggtgtcaagtgagctggtgtgagctggtcttcatcctgttcttacttctctttgaaccccagtccttaagaaagcaagcaccagattcatctgcctgagtcatgtgcaggcagcacagtccctggtaccatatgattattgaaacatcttggctgcattctcctacatgcacaattcaattaccatttaggccagaattctaagataaacataacattactgaaaaagccttgtggataagcagtcttaactttcagttctttcaaaacattgtggaaatcagaaaatgagtaacgaaggactgtacatgcaactaatctcccttaaactatgctgtagagctggaaagagttctgttattgtaaggaagtccctaacaaccaggctgctactgagctggaaaatggtaaagacaaagcaggcagaacagagcactttgcaacaatcaggttgctgctgtgtgggaggtctaagaagaagagtagaaatggagtgcaaggagatagcaaatgtttagatgccttgaaaagaagcaggctgtgtttaagaaaaagagcaactgttgagttttcacataagattatgagttatgctcctctgatgctctgctgtgttttcaattatccatgttaaatactggcccctggcagtgaaaccacgactgcatcttttctactgctatggaaacatttctttgctcagttattcggtcattcatttatcaaacatttcactgagcacctactaagtaggtaccaggcactgttccagtttttggagtgcttagagttcagtgggggagatagtattagacaattaatatgaagtagtatgggtagcataaaagcagaagtttagggatcttagcagtccagagataataagccgagtttctgaatttaacaggggctggggagctggtttctttcttctttccttttatttctctttcattactgactcttaaagggaatgagaatccagatgagatggccacagttgctatacttatcagacaatattctttgtggctatagcttgacaggttagggaggaaagaaaaggctgtgaatgtgctggggtagatttccacagtgttaaataagtcacatcatacatggagaagatatacagtgggacaggggagaaccaggcatctagggtatagggtttcttccatctttcatttttcatctggcagggcttttgactgtatactccacagagtgcagactccacccagaaattacaaatctacacttactgagcaacatccttggtgggggtggcaggatatcatactgaaccagtggttataaagtcagcagaatcatctggttgcttttattaaacagcaataacaaggtttgttgcagactaataataagtagagtttcttgggacagatctctgacatcagttgtttttaaaaggctccccctttcccaggtgattctaatgtgtaactagcattgagagtcatttaattagataatgggattcatttgcaggtcaggtttgtctgggacctcaaactgcaattcctatacgtatatgtggagagcaagtcactttgcactagaagaggctgctgtgtttgtagggctgaaatttgtgagagctgaactttatcagacatagtagaatttaatgtgaaacagattattgcagataaaaagggagatttcataatgataaaaaattcaatttgctgaaaagatatgacaattctaaatctgtgagcattcaataactaagactcagaatataaaaatgtgatagcactgaatggcaaaacagacaaatccaccatgatggtaggtgaaataacaaccagaaaaaaaacggtaagatgcaatacttgaacaatgcaattaacaaatctacttaagggacagatacagaacactaatacccaatgccttcagaataaaattctttttgagtacatgtgaaacatttccaaaattgaccaattcaaaaaagcaactcaactttcagatttttaaaggattgaaattattcagattatgttctttgatgacagtaaatattatgctggaaatcagtaacaaaagggtgactagaaaaatctctaactctttctaaattaagcaatatgcctctaaacattacaggtcaaagaattcacaatgaaaattagaaaatattctcaactgattaataatgaaaataacataaaaactcgtgggttgccactaaggcccactatagggctacatcccatgtagagagaatgggggtcttcaaattgcacaactagctgagatctatatagcaacatcccacgtgagggggccagatatgatatctcctggcacagtatctggggacttccagacctcatttttgtggacagtactccatgtggggagggcaaagcttttgtattttcacagttcctctggtttttaggatctggtgctggaattcatttctaggatgtggtcaggcacaccttaatacagcagtgtctgaatatggaaggttcttgcgggtgccactctatcttgttttctctctttatcttgcatctgaacttggattaagagactggcatgtttgcccggagaaagttaagttgtgcagtagcaggagaataagtgaagaaaagggatttttaagcagccacagagtactgtgggtgaactaaggccaaaaaattaaaagctgatgataggtaggattcatgaggtatgtagaacagaatcatgtctctcactgggccctctaggacacaggtttgggaataactcacagtagcagcaggaaactaagaaagtttggggttctggaagatttagggaggaacacatggcaggacaattaggttacctgatacgagtttgaagttgatactggagactggacaattggcatggactaactaagaccctgacaaagctcaaacagagaagtcttttatctcttccattttatctggccattcctttccctccaaataatcctacatttggggtatgaaaattttactttcggttgagcatggtattgaataaagaaactggcaattatcctataataagcagctgtagtaatttgtttttcttcatcttatggacgtgaggcagatgctattagtcttatgcctcctcttgaccctctggaatgcttaatatgacacatattcaatatttctggcactgtgtgaccatggctaggctgatgcttcacacaaattaggtgcatatttctaagagcttggctagacaaggcagataagcatatttgagatgaaaaacagaatatggggtgatttctcaatctagagtacagtgtggtcttggaatgaatataaatgaagtgctgtcttgttccaattatttaagaaatttctgagctcattaataaagttcttaatcagtagaactgcccatctcagtgctctcaatgagaaacataagagctgtggcaaggattagtaggaaagaggtgggaatgatttatctaatactgcactgatttcttcccttgattatataattaaatataattttgaatgtcactttttgtttcaatccttattgtgttcccccatactgagataaatattttgtgtcctgctagttttccgtattcagatctttttaactcattgaagtttattttcttaatagcattatataaggtataaaactggttttcatagtaataatatctagtaacaattaggcagtggttgctgtattttctaatttcactcacagaaataaaaccagcagcagagcaaagccaagaaggtgaatgcacaggccagtaatcattttataccctaccataggcacttgtgacaaggaaggagaagaacaggtaattccagcatattagtgtgttatatatgagaaaatgctaattatgtatttttaaaaagtgggagagtctagaagaatagtcattacatggtccagctttctcatccatgtttattttataaataactactccaatgttatctgggatattttgaagccatactaatagtattctttagtattgtccacaaaaagggttctaataaacttttaaccaagttgtttctaatttttttggaaccaatctttgaggttaggaaatttgatagtgtaaggatttttatcttaaaaaatatttttatagtttgtgttacataaggagatattataaatatctagagtgtgctaactcaatgcattttcatgttttaatttcccattacccaaagttactatctttatttcatgtcttcccattctttctctgtacatttttattttaaaaaaagtcaaaaaatatataaatatagacaagaaaggtataacgagctgctaggtccccaacactcagcttcaacaattgtaacttgtagctaaattgtatcatttattccttccatgccctcttcccacctttgtactgttttgatgcaaacccagatattttatcatttcatacataaacatgtatcactgaaataacaggatttaaaaaatatatacccatagtactatcacacctagaaaaaagccccaataatactcttcctgtaaaatataatcaaatattcagcaagtgttcaaattttgaattagctcataactcataaacgtcctctctctctcttcccctccctctctttgtctatccatctgttcatccataattaaatttgttgagtcaggatccaaacaagggccacgcactgtgactgacggacatcttttaaggctcttttaatctaatggtttgtcctatctcttttcatttctttgcaagaagcctattctctctcaaattctccccaaacttttgtctctaccactcccccaaaatactcttattaagactggcagtaatctccacattgtcaaatccaatttttaaaactcattctgaatctgacttggcctatcagcatcatatgacacatttgatcatgccctcctttcttcaaaactttcttccattagccttcagtacaccaatctctcctggttctactacttcactagctgtgccttctcatctcccttggtggatttatcttatctttttgacttcgtgctccattgcttagtcctctgacctcttctctatctacattcctcccctaaatgatttcatttagtcccacaggtttaagtcctatctatacactgatgactgtaaatttgtctttactatcttccctggaatttaaactcatgaatctgcttcctcaacatctattagacactttgatatctactaggcttcacaaacttaacagtttcaaaggggaacacttgattcctaccctcctctacccaatcctctcctgaagtcttccttatctcaggaaatggcaatttcagtcttctagttatctaactaataaacctggatatgtttctttttttctttaccaatgtatcctgtaactttcaaaacatattcagaatctgatcacttctcactgcctgtactaatattgtattagctcaagtgatggttatttcttacctagattattgttaacaacctatcaactggtctcccctgcctccactctttccgctatggtctaaccctcacacaacgtgagtgatccttttaaaatataagacagacatttcacataacctgtcacaaagcattttaacggcctgtagctttattcagaatacattcctaagtcttttccatagtctatgaggtcttacatgatctgcaaatctgcaaacaatttcccaactccccaactccccatcatctacctctctaatctcatctcccagtccaaaccaccatcatctcttacttagattactgcaagaacttcttgaatgactgcttctatccttgcccagtataatctttctctacatgacaatcatcaaaagaatgattctcttaaaatatgagtcggatgatataacaccctttgttccacatcttctattggctttccatctcagaataagagctccactaatcactctacaaagaaaagaagccatcagcactctttttcctcgtgttaaccttatttgatcatttataaccactttatatatatatctaaactatatatatgtatgtatgtttattgatggtctctcccaaatattgtaagttccatgacagtaggaacttaattttacttgttactgtttctccaatgcctagaacagtgactgctagtacacagtatttgctctaatatatgttgaataactgattcattcattcaacaaatactttctgagcatctactgtgtgtcaggcactatgctagggactggttaagctgttttacttccagtggaggaggcagaaaggattttagagcaaatagtaaggaatctgactggctctggtaagagtcaaatgctagttgcttttatcttttactaatagagtcttcacccaactcttgtatgagttgaacaggcaagatgattttttaaaatgatatcttaggtaaaagacatctacacaaaaatatatttatacaataattttgatgaagtttataactatagaaataataaatgcttgtgacatatgttactatatgtaacatatcatctatatccacccatgatagacaatatcctcacttcatttccacagttaaggaagagaagtagatagaagagtttagagaggatgcagtgaaagttttactttctactcttaggctccatgctatcataatcagattctccatatctttctacctttgtctgcagccaaaactgctctgttcaaagaagccccgtgctttcttagttacttttttctcaatgagtttggcaatttttagtggatcactcaatagaagtgtgaaaaaaaaagataaatggatatcttcatgaacaattataaattttcctctcctattttactttcatatgtaattctaacaaaatctcataaggattaaaggaaagaaagataatttaaaatttttaaattataagttttaaatagaaatgtcaagacaaataaatatttttcctatggtgcataacatcttagcatgagtgtgagtcaatgcaacttcatagtttggtttgttgaaagttcaattatacacacacacacacacacacacacatatatataattttttttcttctaacatgtcaaaatggtcttttcctttcctttctcttctagttccctttgatcttattttctttgtaaatttcttctactaatcacttgcacttatgcaatttttttcttatttttaagctaatttataatggagacagtcaatttttatggtttcttgaaacaaatacaagttattaatatatcttttaagggtcttttcaacaatctctgaaacaaatacaagttattaatatatcttttaagggtcttttcaacaatctcttattgagactatcacctggaatttgtctttctttctagaataattcatttataagcttttaaaggtaattatggaaattatggaaaattataccataattatgataattatggaaaatgaagccctacacctttttttcatgttctgtagaatactgtttattacataagtgggaggattcaatacacatctagtagaagtcttctttgaattctagtctgaatctccaaatgctcagctgattatttttccagtgatgtaccattagcacttcaaattcaatatgtccaaaattaatcacattcttttcaaacctacgttattcttctcttctctatctctggtaacagtatcagcaacctccccaaacacccaacctggagactttaaggtctttttttaattaatttttttttttttttttgtagaaacaaggtctcgctttgttgcccagactggtatcgaactcctgggatcaagtgatccttcctccttagcctcccatagtgctaggattacaggtgtgagccaccacacccagccaagttcttatatctgtctctaagtatctctctctctctttatatataaatatagatagatagatgtggatagatatacacatatattttaaacctcctttgtctgcacatttaattagttacaaagctgtgtcaatttaggacttgtcttgtatccattccttttttttttttcattcttcttctacttcattttagagtccaattattgttggattagttcctaagtggtcctaatgcttctaggttttcctcatccagttctctgctgactggtggtaacattatggaaggttctcagaaaatcctgagacttcagtcagtatcatacagagatttcttccttactagggttattgtccttaagcaaagtaagtcaagatccatggatcccttccaagaaatagtttgcttaccatagtaaagacaatgtgtactatttaaaatttctttttggaagttacattttgataatagttaagtctaacatccctttgcatttcaagaaagacaaattcattacacacacacttgcttactcctaatacaaatacatacattaacttatatttacatgaaaggttaacaagaagagaagactgtcctttagtgttacaaagaaagtaaggaaagaaagtgaccaggtgccttgaatcacatagtaacagcaggggattatttccccagtctcattttgaaagtcacagagctttggctatgagtctcaggcaaacccttctattgtctcttcctcacagccttgtgagctttgttcactctgagggctaccaactatttagatagtgagagactgaaagcttaagagagagggtcaatgtaaaggtaagaatctagcattgagatagactgggagtattagggaaaatctctgttccttggtgttttaaaatttgtttaattgggatcaagggcaaaagaaagggaagatgcttaaattttggcaaaccttaatacaaataaaaaagttattttccaaacgactttccaaaatatagctgatagtgtcactttccttttctaaaaacctttaatagctcccgactgctaaaatgaaaactctttaacatagcactcaaggtcctctatcataatcagattctccgtacctttccagctttatcagcagccaaactgctcttcaaagaagccctgtgctttccaatgctactgtgctgtttcctttgcttgaaatactccctcctgactgtggtcctccccaacaatttgtattactgaaatcctacccatagttgaaggtctaggtctattatcaccctctctgtaaagctttcagaattcctcacttagatgaaatttcttccttcgcagtactatttccagaactttaattataaatctcatatagcacatgtcacaatgttgcattctgccttcaattttaatcatttgtatacatgtctaagcttcctaacaagactgaaagttttatgagagcaagggactatatctttttcatttctcttgcctcacaagtttccatttgtaggcattcactgttcattgtcctgaattaaactagtacttgacactagtgttttttcttttgcctttctctttagggcaacttgtgcaaaggtgtagtctactgcaaactattattttcacatgctttgttcattaacttaatcaatttgcctatcaaatatttattgagtgttttctatttgaaaggcaccatgctaggggctggggatataacaatgcaacatagtccctctccttaatgaactagatggggatatgaataagtaaacaggtgattacaataccatttgataaatgctacctagagccatcatttatggttgttcaaattgtgccttgtacgagaaagcctgaaaaagggagtaagtggagcatgaaaagttgcccatcccttcctttctaagctttgtgccctcacatggtgctgtatttccctgaaggaagcatgggatttatctaatgcataaataaagttgctctctatatgtaaactaagtaaaagattttctatgaggatttaagagtgatacttagttccagacttgagttgttaaggaagacttccatgaagaaatgctatataaacagcatttcaaaacaaatgggagttacctagattaacagaagtgggaataatgctccaaatgaggagaaaaacaaaaagagaatataaggaactgcaagtaggtaattatggctgaaacctaagagggtgagggagcagcggccaggaaggaccttggaacacagagcagaatccagatcatggagagccttataaaagatgattaggattcgaacttcattttgaaggcaacggaaagtcatagatattttagcaactagtcatagggtattttggcaactatcaaatttacatttcaaaaagctcagtctagtgtagggcagaagtgagggatgggaagttgcaggcaggaacagtggggagctgcagtaagtctttcaataagtcaggtacaagatatcagcaacctgagtgaaaacagttgtgcagtaaagatggagataattttagacctagttaacagagtaataagtcaaataatactttttcatataatttcttgccattagtcaagaaggataaaatactacttcaaataaacaggctgggtggtttggaggaaagtgtaggaactttgtagacagatagccctgggtctgaatcactactctgccatttgtcagctgtgggatcttggccaagtttcttagcctttttggccttagttttgttacctgttaaatgtgtaataataattcagttaaacagtacacttagagggttgttggaaaaattgtatatacaggaacacctcatttattgtgctttgctatagtgcatgtcacaattattgcatttttaaccaattgaagggttgtggcaatcctgtgtcaagcaagtctattggtaccatttttacaatagcatgtgctcacttcatacctctaagttccattctagtaattattgcaatatttgaaacgttttcattattattatatctgttatgatgatctgtgataagtgatctcagatgctgctattgtaattactttgggggatatgagccatacctatataagatggcaaacttagtgaataaatgtgttttgactgctccactgaatagccatttctgtttctctccttctccttaagcctccctatttcctgagacacaaaaatattaaaaatattaaaattaggccaattaataacctcaaaatggcctttggtgttcaaatgaaaggaagagtcacataattttcactttaaataaaaaatctagaaataagattaagattagtgaggaaggcatgttgatagccaagatagcccaaaagttgggcattttgggccaaacagccaagttgtgaatgcaaaggaaaaattcttaaacgaaattaaaggtgctactccagtgaacacacaaacgataagaaagcaaaacagccttcttactgatacagggaaagtttttgtggtctggataggagatcaaactagccacaccattctcttaatcaccatctgcagagccaggccttagctctccaattctatgaaggctgtgagagatgaggaagctggagaagaaaagttggaagctagcagacattggttcatgagctttaagaaaagaagctgtctccataactaaaagtgtaaggtgaagcaacaggtactaatggagaaactgcagttatcctatccagaatatctagctaagattgctgatgacactaaacagattttcaatgcaaatgaagcagcctttgattggaagaagatgccatctagggctttcataactagagataagagatcaatgcctggcttcaaggcttcaaaggataggctgactctcctgttagaggctaatgtagatggtgactttcagttgaagctaatactcactgaccattccaaaatcctagggcccttaagaattatgccaaatctactctgcctgtgttctataaatggaacaacaaagtccggacgacagcacacctgtttgcagcatggttactgaatattttaagttctttgttgtgacctactactcagaaaaaaagattcctttcaaaatattattgctcattgacaatgcacctggtcacccaagagctctgacggagaacatacaaagagatgaatgttgtcttcatgcattctaacacattttgcaatccatggatgaaggagtcatttcaaccttcaggtcttattctttaagaaatacattttgtaaggctgtagctgctatagatagtgactcctctgatgcatctgggcaaaataaattgaaatcctctggaaataatccaccattctagatgcctttcaaaacatttgtgactcttgggaggtcacaatatcaacatgaaatggagtttggaagaagttgattccaaccctcatggatgactttgaggagttcaagacttcagtggaggtagaaagtgcagatatggtggaaatagtaaaagaactagaattagaagcagagcctgagatgtggctgaactgctgcaatctcatgataaaacttggatggatgaggagttgcttcttatgaatgtgcaaaaaaaaaagtgttttcttgagatgcaatctacttctggtgaagatgctgtgtcatttttgacaacaaagcatttattatataaatttatttgataaagcaacaacaggattggagagtattgacttgatttggaaagaagttcttctgtgagtaaaatgctgttaaatagcactgcatgctacagagaaatctttcatgaagagtcaattgatacggcaaacgtcattgttgtcttatgttaagaaattgccacagccacttcaatctttagccaccattgccctttaggaacctttagcaaccatcagtcagtagctatcagtgtggaggcaagaccttgcaccagtgaaaagattatgatttagagaaggcttgggtgactgttagcatacttttttttttttttttagcaataaagcattttttgattaaggtatgtatgtacttaatttagatataatgctgttgcatacttactagactacagtatagtgtaaaccacttttatatgcactgggagacaaaaaaattgtgtgatgcattttattgccatatttgcctcattgggttggtctggaactgaatttgcagtatctttgaggtgtgcctgtgtttctgtgagtgtgtgtgtgtgtgtgtgtatatgcccgattcacaggcagatccttattacaagatggtttccttctatcctctcttcttccgttatcctttccttaatcactccttttataggagagaaatttacaacactttgcaaacgcatagattcaaatgtaaaatgcaaacttgtccccaaatggaatgtgagatacggctttatggtgttcatggtgaactctttatgatggaggagtgatttttaccagtgactcttaatgtactgggtcacaaacgctttggcaatcagataaagactatgaatattgtgtctcaaaaaatggcatttatgtggaacactttacacataatttcaattagttcaaaaacctcctgaaattcatgatgaactccaggttaaaaagttttcttttatactatgttttaatttttaaaattatgttagtgacttagtgtttgtgaatatggcaattaggatcttcctatagatttatagattagtgattaataatagtttctacttttaaacaagtccttccagaaatggctatgtggaaatttttttgaaaagcaaactatgatagaaaagtttgcttgaaaacaattcttgttcttaaaaacatgcactggcttatgtgagaagacaaggctcttctgataaaattccatcatctaatatcattttgtatcaggagccctaataagtcttgtggtaaattttcttttgatctatgacatttgggaactgaatttcagcaacaagcatttatcagcttctgtttacactagacaactgagactagtaaacccacactgtgttcaagccactggtcatattacacaaagtacgctatgccctgaaaagaatgtatacaataaaaactgagattcaaaaaacagttaggactatgatggatcacagccaagttccaacctctgtgggtcaaatgggagggcaactatggttagtttcttattcagccacagacattcctgtggtaaggagtaattaaatggtgggctgtggagtacagggtgggtatgtagaataacacatattgagacaagataactttcatcctgtgtcaggtcacaaatgtgagtgccaaagatcacaagattaagatgatgactttgcagtttttcctggaaattggaaaaaagcttgctctctctttttaaaaactgcttatattttaccatataatatttctagtaaacatgttaaaaaaccaagaaaaccaatgtctggattaggtgtattaaggccctcttcactactactttgctttttactacacaaaacttatgaaaagctataagaataaggactcaacaggagtttttagttcatgagtctttcgaagtaatcttttatcacttaacaaatcagagttatgtagaagagtttccactgttactcccaacttttatatgatgtccagcatgttcaaggtgcattaatatataaactattttcttataatctaatataaacctacagactaaaacatttgctgacgagcaaggcaagaaaaatgtcaggaagaaagccaagtttaaccatagccagtgcttataggtataacaagatcaagaaagaattccttgcatacttgaagctgataaaggatattcacttctcattctttaactaaatgcttaaggtataaagaggtctaataaattttagaacaggtaaaaagacccatgacacgtttagaagttctagaagtatcatattaatctgaagaactagatagatactatctggagctagagaagtttaatacagggacaacacatatgctgaattggtttacagtgtcttatgaagttattttgactcttttgaacacataattgtagaaggataatctcaggtgcctgagaccaaaggctagaggaagagcttgagcaaaggggggaaggtgacagggctaaagagagaagggtgccacggtctgaatgtttgtgtcttccccaaattcatatgttaaaatcttaaccccaaggtaatgatattaggagggagggcctttgggggtgatgaggtcatgaggggagacccttcatgaatagaattagtacctgataaaaaggacctgagagagcttccttgccccttcttccacatgaagacacagcataaagatggccatatatgaactatgaagtgggctcttaccagagcctttatcttggacttagtctccagaactgtgagaaataaatttctattgttataagccacccaatctttggtattttgttcttgtagcctgaatgaacaaagagactagcaaaaggtaaaggctaccaatgatcaccacaatatcttaaaacttggtttagcttggttaaggaatccaggaagtaatggggagccgggagaggggggaaaagcctcatattaccacaacacaaattaacttccaacctatcatctacagatcaaatatactagggctacaggggagtgtaaattaacacaattgggttgttaccttattttaaaaagtagatgcaatggcatgtcttgcttattatgaatctgatcatttttatttaaaaacaactgaaatcacattttaaacttaattattacatgccacatgtagaaagtatcagttactcacactgtttagtgatagaatatccacataaactgtctcttgtctaggtttctagacaagaataaaatattattcagatatacattactcttttctattttttgttttgctttaaagaataattgcccatctgcctgcaactagatatgtttagatgaatatttcttttgataacaaaagaaaagtattaactttgtgccaagaatataacaatttaagggtaagatgaactgtctctaatattttctgaaaagataagacaaagtgagaggcaaagattcctccagtttcttttgtagatatccttttgaatgtgatacactgttggggataaaatattagtggtctcataatcacaaaatattatctagatatagttaataattaattttagtcttatgagtttcagagactaacataccaataagacatttacactttttcttaaaactaaagttataaaaacactaattggagctttcaatttcttctattctatgttgttggccagttttccagtctgagacccatcactgtctctagagttgcatcccattaccttattttcccacagggaggaaaacagcacaataacacattaagcatgctatggtaccaactcattattcttactaaacatcacgatttactttcaggaaagagatggattcactatggagtttttacaagctgaaactttgaccttatgttagaagtagggtaatgtgggtaatggttgccatgggtatcaaaacaaattatacattttccactaggtaacatttgattaatgtcaaaataaaaattctcctttatatctgaacactctgctcaaggatataaaaatgtacctttttatatccttgtttacttaatacatgatatggtagactagctctccctattgatctgaatagttattgcttcaattcccagatttatatacttgttctctgagattaattcagcatgcttcagttttgtaagaggtatctttctggggctctctgtatatatcctgctggcatgttttgtttctaagcccagagaatctaattacagtttagtagccaaagatgtaatatctcacatgactttttaaaaaacgattatttttgcaacagcacaagagtgagactttgccgtgtttttcattttaaatgtgacacaataaaggcttgaattgacttcatgcttgttttgatacaaaggtcttcctaccaatagatgcagtcgacatttgtttggcttgtcaaattaaactcatccatacagcaacaaggattagcacaaaaacgggtctaccctgtgaacagtaccatacatttcagagatctaggactccacttcactcattagagattatctgatttttcttaagacttagtaatatagctttgcttacagcatatttgactatacttgattatactatacactatagctcattgctttatttaacctttaagataaagtgaattaaggaataactgacaagtgggatttagcaagactaaattctggcctagagaagcctctacatggtaccttaagtaaactaagatctttgcagtccttctttactctgttctggtgaaaagcaatgttttatctagataaaaaatggcagattccaaaggttttctgatgtatttaatgtggaagcagggccaaatacaaatacaaaaggggaagtggtaattgtaaagaaaccatcttatagcaataaaccgctaatcaattgtaattacaggaaatagttaatgaatacatattaaaatggtatcacatggcttctgattatataatacttattcaggcacatgaataagctgtatttctcagatccattctgtcttctatgtgagtttagataatatatccaatacatctggtcactgtatagtaatttctgcatatctgtatgacaaaagacactccagtactaatttgtatgtcaaatggatgattttaatgctgtcagctgccagctgcagcacactgattttcacttagaagaaaagctgttagtttccgaagattcacttaaaaaaaaacccaaaataccttcagaggttaaaaaagacctcatcagaacaactcttatgaaaacttcttcactactactgatcagaaagtgtagggctcagataagcgggtgatattagggtagcctgaacacattaaattctataccttatttgaaaaaattgaggtaaaacatatataacataaaatttttccttttaaccatttttaagtgtagaattcagtggttttaagtacgcttgcaatactgtacaaccatcaccactagttatttccaatttttttcatcatctcagagaaactttggactcattaagcattaatttccattcctccctcccccagcccgtggtaccactaatctacttcctgtctccatgaatttgctgattgttgatattttatataaatgaaattatacaatatttgtcctttttatatgtggattatacttagcataatatttacatggttcattcactctgcatcaaatatcagaacttcgtgtctttttatggctgaacattacactgtatatactaccttttgtttattaatttatctgttgatagacacttgggttgtttccacctttgacttgtcaataatgctacaatgaacattggtgtacaatatctgtttgagtccctgttttcaattctttttggtaagcatctagcagtcaaattactgactcatatggcaattccatatttactttttcaagcaagtgccaaaatattttctatagaagctacatcattttacaatcccactattaatgcaccagggttctaatttctcctcatccttgccaacacttgggtgtgaagagctatctcactgtggttttaatttttatttccctaatgactaatgatactgattatcttttccatgtgcttattggccatttgtatatcttcctcagagaaatgtctactcaagtcttttgcccatttcttaatatcgttgtctgttgttgagctgtaggagttgttagtgaatagaaatacaactgatttttgcatattgattttgtattctggtattaagtccttatcaggcatatgatttacaaatattttctcccattttatgggttgtcttttcactctcttcaaagtgtcctttgaagcacaaattcttacttttagaagtccaacttactgtttgttgtctgtgctcttggtgtcatatgtaagaaaccactgtcaaatccaaggttatgaagatttatctccacattttcctctaagagttttatagttgtagattgtaaatttagtctttggtccattttgagttaaattttatatatggtttaatgtaagggtccaatttcattttttgcgtgtggatattcagttttcccagcaccatttgttgaataatctatcttttctcactaaatggtcttggcacctttgtcaaatatcaattttccatagacgtgagggtttatttctgggctctcaatttaattccattggtctatatgtctatcattatgcctgtatcgttttgattactatagctttgtagtaaattctcaaatcaagaagtatgagtcctctgactttgttctttttcaagattgttttgggtattatgggtccctagaaatttaatatgaattttagtatggatttttttaattaaaaaatgcaattgggatttttataggtactgcatggaagttacacattgttttgggtagtattgtcatcaaaacaattattccaacacatgaacatgggatgtctatctatttagatattcaatttctttttattttattttttattttttattatagtttaagttctagggtacatgtgcacaacgtgcaggtttgttacatatgtatacacatgacaagttggtttgctgtactcattaactggtcatttacattaggtatttctcctaatgctatccctcccccatccccccaccccacaccaggccccagtgtgtggtgctccctgccctgtgtccaagtgttctcattgttcaattcccacctatgagtgagaacatgtggtgtttggtttgcagtccttgtgatagtttgctcagaatgatttccagcttcatctatgtccctagagaagacatgaactcatccttttttatggctgcataatatttcatggtgtatatgtgccacattttcttaatccagtctatcattgatggatatttgggttggttccaagtctttgctattgtgaatagtgccacaataaacatacgtgtgcatgcatctttatagtagcatgatttataatcctttggctatatacccagtaatgggatcactgggtcaaatggtatttctggttctagatccttgaggaatcgccacactgtcttccacaatggttgaactagtttacacccccaacagtgtaaaagtgttcctatttctccacgtcctctccagcacctgttgctttctgactttttaatgatcgccattctaactggtgtgagatggtatctcattgtggttttgatttgcatttctgatgaccagtgatcatgagcattttttcacgtgtctgttggctgcataaatgtcttcttttgagaagtgtctgttcatgtccttcgcccactttttgatggggttgtttgattttttcttgtaaatttgtttaagttctttatagattccggatattagccctttgtcagatgagtagattgcaaaaattttctcccattctataggttgcctgttcactctgatggtagtttcttttgctgtgcagaagctctttagtttaattagatctcatttgtcaattttggcttttgttgccattgcttttggtgttttagacatgaagtccttgcccatgcctatgtcctgaatggtattgcccaggttttcttctagggtttttatggttttaggtctaatatttaagtctttcatccatctggaattaatttttgtataaggtgtaaggaagggatccagtttaagctttctacatatggctagccagttttcccagcatcatttattaaatagggaatcctttccccatttcttgtttttgtcaggtctatcaaagatcagagggttgtagatgtgtggtgttatttctgaggcctctgttctgttctgttagtctatatctctgttttggtaccagtaccatgatgttttggttactgtagccttgtagtatagtttgaagtcaggtagcatgatgcctccagctttgttcttttggcttagaattgtcttgacaatgccaactgttttttggttccatatgaactttaaagtagttttttccattctgtgaagaaagtcattggtagtttgatggggatggcattgaatctataaattaccctgggcagtatggccattttcacgatatggattcttcctatccatgagcatggaatgttctttcatttgtttgtgtcctcttttattttgttgagcagtggtttgtagttctccttgaagaggtccttcacatctcttgtaagttggattcctaggtatttcattctctttgtagcagttgtgaatgggagttcactcatgatttggttgtttgtctgttactggtgtgaaggaatgcttgtgatttttgcacattgattttgtatcctgagactttgctgaagttgcttatcagcttaaggagattttgggctgagacgatggggttttctaaatatacattcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaaggcttccagttttagcccattcagtatgatattggctgtgggtttgtcataaatagctcttattattttgagatacgttccatcaatacctagtttactgagagcttttagcatgaagggctgttgaattttgtcaaaggtgttctctgcatctattgagataatcatgtggtttttgtctttggttctatttatgtgatggattacgtttattgatttgtgtatgttgagccagccttccattgcagggatgaagccgacttgatcttggtggataagctttttgatatgctgctggattcagtttgccagtattttattgaggattttcgcatgggtgttcatcatggatattggtctaaaattctcttttttgtgtgtgtgtctctgccaggctttggtatcaggatgatgctggcctcgtaaaatgagttagggaggattccccctttttctattgattggaatagtttcagaaggaatggtacccgctcgtctttgtaattctggtagaattgggctgtgaatccatctggtcctcgactttttttggttggtaggctattaattattgcctcaatttcagagcctgttattggtctgttcagggattcaagttcttcctggtttagtcttgggaggatgtatgtgtccaggaatttatccatttcttctagattttctagtttatttgtgtagaggtgtttatagtattttctgatggtagtttgtatttctgtgggatcggtggtgatatcccttttattagtcttgctagtggtctatctattttgttgaccttttcaacaaaccagctcttggattcagtgattttttgaaaggttttttgtttctctatctccttcagttctgctctaatcttaattatttcttgccttctgctagcttttgaatttgtttgctcttgcttctctagttcttctaattgtgatgttagggtgtcgattttagatctttcctgctttctcttgtgggcatttagtgctataaatgtccttctacacactgctttaaatgtgtcccagaggttttggtatgttgcgtctttgttctcattggtttcaaagaacacctttatttctgccttcatttcattatttacccagtagtcattcaggagcaggttgttcagtttccatgtagttgtgtggttttgagtgaatttcttaatcctgagttctagtttgattgcactgtggtctgagagacagtttattataatttctgttcttttgcatttgctgaggagtgctttactcccaactatgtggtcaattttggaataaaggcaatgtggtgccaagaagaatgtatattctgttgatttgggctgaagagttctgtagatgtctattaggtgtgcttggtgcagaggtgagttcaagtcctggatatccttgttaaccttctgtcttgttgatctgtctcatactgacagtgggatgttgaagtctcccattattattgtgtgggagtctaagtctctttgtaggtctctaggacttgctttatgaatctgggtgctcctgtatagggtccatatatatttaggatagttagctcttcttgctgaattgatccctttactattatgtaatggccttaattgtctcttttgatctttgttggtttaaagtctgttttatcagagactaggattgcaaccccttcctttttttgctttccatttgcttggtagatcttcctccttccctttattttgagcctatgtgtgtctctgcacgtgacatgggtctcctgaatgcagcagtgatgggtattgactctttatccaatttgccagtctgtgtcttttaattagggcatttagcccatttacatttaagattaatattgttatgtgtgaatttgatcctgtcattatgacgctagctggttattttgcccattatttgatgcagtttcttcctagcatcgatagtctttacaatttggcatgtttttgcagtggctggtactggttgttcctttccatgtttagtgcttcctttaggggctcttgtaaggtaggcctgttggcgacaaaatctctcagcatttgcttgtctgtaaaggattttatttctccttcacttatgaaacttagtttggctggatatgaaattctgggttgaaaattcttttctttgagaatgttgaatattggcccctactctcttctggctggtagagtgtctgccgagagatctgctgttagtttgatgggcttccctttgtgggtaacccaatctttctctctggtgcctgttaacattttttccttcattttaaccttggttaatccgaaaattatgtgtgttggggttgctcttctcaaggagtatgtttgtagtgttctctgtatcttctgaatttgaatgttggcctgccttgctaggttggggaagttctcctggataatagcctgaagagtgttttccagcttggttccattctccctgtcactttcaagtacaccaatcaaacagagatttggtcttttcacagagtcccatatttcttggaggctttgttcgtttctttttattcttttttctctaaacttctcttctctcttcatttcattaatttgatcttcaatcactgatacgcttctttccacttgatcgaatcagctactgaagcttgtgcatgtgtcacatagctctcgtgccatggttttcagctccatcaggtcacttaaggtcttctctacactgtttattctagttagccattcgtctaatcctttttcaaggattttagcttccttgcgatgggttcgaacatcctcctttagcttggagaagtttgttattattgaccttctgaaggctacttctgtcaacttgtcaaagtcattctccgtccacctttgttctgttgctggcaagaagctgtaatcttttgcaggaggagaggtgctctggtttttagaattttcagcttttctgctctggtttctccctatctttgtggttttatctatctttggtctttgatgatggtgacctacagatggggttttggtgtggatgccctttttgttgatgttgatgctattcctttctgtttgttagtcttccttctaacaggtccctcagctgcaggtctgttggagtttgccagagttccactccagaccctgtttgcctgggtatcaccagcggaggctgaagaacagcaaatactgcagaacagcaaatactgctgcctgatccttactctggaagcttcgtatcagaggggcacctgggtgtatgaggtgtcagtcagcccctactgggaggtatctcccagttaggctgcacgggtgtcagggacccacttgaggcagtttttccattctcagagctcaaataccatgctgggagaacgactgctctcttcagagctgtcagactgggacgtttaagtctgcagaagtttctgatgccttttgttcagctgtgccctgccccagagctggagtctacagaggcacgtaggcctcattgagctgcggtgggctccacccagtttgagcttcctggctgctttgtttacccactcaagtcttagcaatggtggacactcttcccccagctaggctgccgcctcacagttcgatctcagactgctgtgccagcagtgagcaaggttccatgggcatgggacccactgagccaggcacaggatataatctcctggagtgccgtttgctaagaccattggaaaagtgcagtattaagctggaatgtcccaattttcctggtacggtctgtcatggcttcccttggctaggaaagggaaatcccccaaccccctgcgtttcccaggtgaggcaatgccctgccctgcttcagcttgcccatgggctgcacccactgtccaagcagtcccaatgagatgaaccaggtacctcagctggaaatgcagaaatcacctgtcttcttcattgatcacactgggagctgcagaccagagctgttcctattcagccatcttggaacagacctccaacatagtacattttctactttttaaaaaaactttctatgaaggaatggaagattggctcaaattctagaacttttttattatcatcatacataagataaaatagtatttattaaatttacatgtatgtaaataagtactagaaaacaaaattaatagttgatgttaactgagtgctcactagtatcaggctctgtgatgaaccatatatgcctaatctaaaatcttcacaagaattctgtgaggtaggtatttttagccccttttatgatgacttagaataaataatttgtgcaaattaacacagctggtaagaaatagaacacagaaaccaatgtaggttgactaaaagattcatgtatttagatactacccttatccaaataacagtccaggtacaaattagccctaagaataaactgaggggggctcacttataaagacattaattatgaaggtacaggtgctatataagagaatcataagagatagtgcagttacctggggctagcaaaagcagagctgttgccatccctacagccagagggaccagttgttggtaaatgtgttgtggagagaaggcttcctggagagaagtgttacccttcaacagagggacaagccaacctgacataattctggagggaagggcacagcaggagaaatattctgtccccattctctcctatagcttgccagagctcccgactggttaacaactggaagccaggagacatggaagttagcttcctggggtgaataaggtaaaaaaggatggagaatagatctatgatgggaggtggggcaaagaaaaggtatccaggacaaccatggatacataatataattccaacaaatatgctttaaactgagacacttcaaaattagtgggaaggaaaaacaataggcctacagatctgtacagcagacaaaaagatgtaaagtacatgcaagtaaatatgtaaagttctcttctgccccatgctgagaaaagtattaaagatacattgctataaaaatgtttaaaacagtttcttgaaacgatttcctaatgttggattgaagcatactagctgagcatataatttgttcagtaattgtctataagtatgcctgagtatggaggacgtgaagaagaaagaattatttatcatagcatctggtttctgataagtatgatattgactgacttatttggaatgtgatggctctttaataaaaatatatgatactagtagcaataaataatctgaatagtcatgcttcgagattgccttcacattttaaacttttatttttactagcactttgattggcaatatagtgttctatacaatgccttgtacatcatagatgacgtatttaattgattatttaatgaaagaaatgagttacctattgacttatatatatgtttttacctttatggtaaaattaaaatgaacagaagcctagggtttagtacaatgagtaagatattagaaaacatttggcaatcttaaaaagataattatacaaggtctgtttattagatatcatctttaaaattgttaatgttttatgaaaatagagccctaagcatgttagcacatacagcataaaagtttatttcaggtcttgctttcacacactgggagaacactgtgatctgtgaaagtcagaataagcctgttttagaaaacaggatatgtggcagcattcacactcaaaagccttcggagctcactgagttaagggtgtgatttatagagtcatacagactggtgtttcaatcctggctctgacacaggcaaatgagattaactttgagtctaagttttctaatgtgtaagatgtataaaacaatagctctgtagaggatggcagggggccataggtaggtgccctggcagtggcagctcaggtgctgtgggtaggaagtgctccagtgggaggcaccataggcaggcagttcttgagtggggatgctgcaggttagaagtgtatggcatccatgactgggattattaccatttttgggatttctttaggccatatattacttggaacctaaacatgtgattttacatagtgtatctgcactataattgaaagttgagatttttcactggaatgacatagcaacataaattaatgtagcagcagcaacagcagcagtattgtggtagcagtaaaaaataataatttaacaacttacatcaaaataatatagacactatggctttagtgagaggttgtcatgtaaattcaagaaatgcagagaacccttgtgagatactatgtaagacaaccatccccaagacacacagtcatcagattctccaaggtagatgtgaaagaaaaaatcgtataggtaactagagagaagcggcgggtcacttacaaagggaactctgtcaggctcagtagacctttccgcagaaactttacaagccagaagagactgggagcctattttcaatatctttaaataaaagaaatcccaagcaataattttatagcccaccaactaagcttcataagcaaaagagaacgcaattctttccagacaagcaaaagctaagggaggctgactgcagtggctcatgcttataatcctagcattttgggaggctgaggtgggcagattgcttgagccccaggagtttgaaacaagcctgggaagcaaagagagaccctatccctacaaaaaaatacaaaattacccaggtgtggtgacatgcacctgtagtcccagctacttaagagactgaggtgggatcatttgagcccaggatgcagaggttgcagtgagctgagattgtactactgcactccagctggggagatagatagagcaagagtgtaccttaaaaaaacaaaaaagctacgggaatctgatagcagtagacctgttttacaagagctcctaaaggaagtgctaaacatggaaatgaaagagcaatatttgtcaccataaaaacacacttaagaacataccccattgacactataatgcaactatacaattaagtctacataacaaccagctaaaagcgtgatgataagaccaaatcctcacatagcaatatcgaccatgaatgtaaacaggctaaatgcctcgattaaatggtatagagtgtcaaggcggataaagaagcaagacccaaatgtttgctgtcttcaagagatccatctcagaagtaacagcaataggcttaaagtaaaggaatggagaaagattgattaggtaaatagaaaacagaaacagcaggggttgctattcttataccagacaaacaaacattaaagcaacaacaatcgaacaaagaaaaatattacataataataaggggctcaatccatcaagaagacttaactattctaaatatatacatacccaaaattagagttcccagatccataaaaaaggttcttagagatctatgaggaaatacagacaaacacacgataacaatgggagatttcaacaccaccttgacagtgttacatcatcaaggcagaaaactaacaaatattttctggacttaaactcaatacttgaccaattagacctaatagacactacagaacactccatccaacaacagaatacatattcttctcatctgcacatggcacatactttaagatcaatgacatgctaaaccataaagaaagtttcaacaaattaaaaaaattgaaatcataccaaacacattctcagaccacagcatagtaaaaacagcaatcaatactaagatctattaaaaccatacaattacatgttaacctactcttgaatgacttttgggtaaataacaaaattaaggcagaaatcaaaacattatttgaaatgaatgaaaacagacacaacataccagtttgggacacagttacagttgcattaagaggaagattcatagcactaaactcctacgtgaagaagttagaaagctctcaaattaacaatcttgcattatacctcgaggaactataaaaataggaacaaaccaaacccaaagctagcagaagaaaagaaataaccaaaatcagagctgaactgaataaaactgagatgcgaaaatccagacaaagtatcaatgcccccaaaagttggttcttcaaaagatgaaacaagattgaaactgctaattaattagattaataaagaaaaaagaagatccaaataaacccaatctgaagtgacaaaggtgacatttcaaccaaccctacaaaaatacaaaagttcaccagagaatattatgaacacctctatgcacacaattaggaaatctagaagacattgataaattcctggaaacacatagccttctaagattgaaccaggaagaaattacaatttggaacagacctataacaagttctgatattgaatcagtaataaaaagcctaccaaccaaaaaaagccctgaaccagatggattcacagccaaattctcccagacataaaaagaagagctgatgtcagtcctattctaactattcaaaaaaaaaaaaatcaaggagaggagattcttctgcagctcattctatgaagccagcatcatcctcataccaaaatctggcagagatacaatgaaaaaaggaaacttcaggtcaatatctctgatgaacatgcaaaaatcttcaacaaaatacatgcaaaccaaatccagcagtgcatcaaaaaactaatgcactaagattaaataggccatattcctgggatgcaaggttggcttaacatatgcaactaaataaatatgattcactacataaacaaaattaaaaacaaaaaccatgatcatctcagtatatgcagaaaaggtctttaatatatgtgaaagtctcaataaatgtagaaaaggtcttcaataaaattaaacatcccttcatgttaaacatcctcaacaaattaggcatcaaaaaaacatacctcaaaataaaaagaggcatttaggacaaacccacagccaatatcataataaacaggcaaaagctggacacattctccttgaaaactggaacaagacaaggatgcctgttctcaacattggtattcaacatagcactggaagtcttagccagggcaatcaggcaagagaaagaaagaaaagagatcgaataggaaaagaggaagtcaaataatctttcttcacagatgatatgattgtatacctagaaaaccctagagatgctgccaataggcttttataaccaataagcaatttcaggacacaaaataaatgtacaaaaataagtagcatttctatatatcattagcattcaagctgagaggcaaatcaaggacataaatccatttacaatagccacaaacaaaaatatctaggaatatatctaactaagaaggtgaaagatctctaccaggagagttatgagacactggtgaaagaaattatagacaatataaacaaatggaaaaatgttccatgctcatgaaaaggaagtgtattagtctgttcttgcattgttataaataattgcctgagactgggtattcataaagaaaaaaagtttcattggctcacagttctgcaggctatacaggaagcatggctgaggaagcttcaggaaatgtacaatcatgatggaaggtgaggaggaagcaggcgcatcgtacatggctgcagcaggaggaagacaacaaagagagaggtgctacacacttttaaaacaaccagatcttctaagaactcactatcacaagaataacaagcagaaaatccacctccatgatcaaatcacctcccaccaggcccctcctctaacaattcgacatgagatttggctgggaacacaaattcaaaccatattgggaagagttaagattgataaaatggccatactgcccaaagcaatctacagattcaacattattcctgtgaaactaccaatgtcatttatgacagaattagaaaaagctattctaaagttggcatgaaccaaaaaaaaaaaagtccaaatcatcaaagtaatcctaagcaaaacaaagagccatcacacttcctgacttcaaattatactacaaggctatagtaacccaaacagcatgatactggtacagaaacagacatagactcatggaaaaggatagagaaaccagaaagaaagccagatactgacaaccagttgatctttgacaaagtcaactataatacataatggggaaaggactctctattcaataaatagtgctgggacattctagccaaatgcagaagattgaaactggatcccctccttttaccatatacaaaaactgactccagatggattaaagacttaaatgtaagaccgaaagcaatcaaaaccctagaagaaaaccttggcaataccattctgggcagtggccaggaaaggatttatgactaattcctcaaaagctattgcaacaaaagcaaaaattgacaaatgggacctaattaaactgaagagcttctgcacaaccaaatatttaaatatcatcagagtgtacagacaacctacaaaatggaagaaaatttttgcaatctatccatctgacaaaggtctaatatccagagactataaggaacttaaaacaaattcacaattaaaaaaaaacccattagaaagtggacaaaaaacatgaacagatacctctcaaaagaagaaattcacacagccaacgaacgtaaggaagaaagctcaacatcactgatcattagagaaatgcaaattaaaacctcaatgagataccatctcatgccagtcagaatggagattattaaaaagtcaaacaacatatgctggcaaggttgcagagaaaaaggaacacttttacacattggtgttagtgtaagttagttgaaccattgtggaactaactggaattgccatcagtatggcgattcctcaaagatctagaagcaaaaataccatttgacccagcaatcctattacttggtatatgcccaaaggaatataaatcattctgttataaagatacatgtgcatatatattcactgcagcactattcacaatagcaaagacatggaatcaaccttaatgcacatcaatgatagactggtagtacatatacaccatggaatactatgcagccataaaaaggaatgagatcatgtcctttgcagggacatggaaggagttggaagctgttatcctcagcaaactaatgcaggcacagaaaaccaaatatgttctcacttacaagtgggagctgaacgatgggaacacacggccacatggtggtgaggggaacaacacacactggggcctgttgggggagctgggggagggagagcatcaggaagaatagctaatggatgctgggcttaatacctaggtgatggattgatctatgcaggaaacaacgatggcacacacttacctgtgtaacaaacctgcacatcctgtatgtaacctggaacttaatctacagaatgggagaatatatttgcaaactatgcctccaacaaaggtctagtatccagaatctataagaaacttaaatcaaaaagcaaaaaacaaatatcccagttttaaaactggcaaaagacatgaacaaatacatctcaaaataagaaatatatgccactaacaaatatatgaaaaaatgctcatcatcactaatcgtcagtgaaatgcaaatcaaaaccacaatgagataccatctcacatcagtcaaaatggctattaccaaaatgtcaaaacacaagaaatgctggtgaggttgcatagaaaagggagcacttatacactgctggtggaaatgtaaatcagttcagtcattgtgaaaagcagtgtggagatttctcagagaacttaaaactaccatttgacctagcaatcctactatatgatatatacccaaaggataataaattcttctgccaaaaatacatatgcatgtggatatatattgtagcactattcacaatagcaaagacatggagtcaacaaagatgcccatcaacagtggactgaatagtacatatataccatggaataccatgcagccacagaaagaatgaagtcatatcttttgcagaaacatggaagcagctggacgccattatcctaagtgaactaatgcaggaacagaaaaccaaacgctacatgttgtcacttataagtgggagctaaacaatgggtactcatggacacacagaagggaataatagatattaaagactgcttgaggaagaatggtggggagagagacatggtttttagggctacctgtcaggtactatgctcactacacaggatgagggggtcatttgtacacgaaggatcagcaacataaaatttattaacaaacctgtacatgtacctctagaacttcaacttaaaaaaatagaaaaaaaaatagaaaaaaataaaaatacttgagactgggtaatttataaagaaaagaagttcagggggcagggccaagatggctgactagaagcagcagcattccgaggctcgcataggaaagaaaccataataagcctgtgaatccttcactggcaaccaaggtatccaggttctctcatcaaaattgactagaaggctggcatgactgactgagagaaggaagagcagtgtggtgtggcggtccacctgtgatccacacagggaaggggaacttccctcaagccaagggaggcagtgagtgagcacactacccagccaggggaaactgtgcttttcaaattgaactgtgcaacccatggattggaagatacacttgcgaacccattccaccagggcctagcgtcccaaccctagaatgtgcagattctcacagcctctcagctggaatctgcttaagcccacctaactcttgcggggagaggcgaccagcactggctgcggctacctgctgtctaagccatttgagctccttggggaaggggcagcagccagccctgggactagcaactacctaacactctaagctccctgggcaggggaagcgtggcacccatttgtatagctccaggctgggctttttccctgctggagcaagggaggctggaccacttggtcccaagacttgtccccacagcccaaaacaccggctgtggcagtctgcggccaaagtgccttttcaggtctaaccctgacccaccttcctcagtgggcggggcttccctgaacaatctccaataactccagccagaggctcagggacagaattcagatctccctgggccagagcccctgggggatcggggaggtggcctcagtctctgcagaccagccaacttagcctctcctcctggtagttctgaggaatccaggcagctcagacgagtgggtttccccccagtgaaacacaccctctagaacaaggaataaagtacttcattaaacaggtcctgctccctgtgccacccaactgggtgagaccatccaacaggggttatcagacaccttatacaggagtgatcctactggcatcaggttggtgcccctcaaggtcagaggtcccagaagatggagcaggcacccatctttgctggtctccagcctccttgagtgacatctccaggcacaggagcaaataagatgaatagggaagtgaacccccaggaaactgcagcagccctacagaagagggacttgactattgaaacaaaaacaagtacaaagtgacaacagcaccaaaaacaacaaaaagacccccataaaaaccccatgcaagggtcagcagcctcaaagaccaaaactagacaaactcatgaagatgggaaagaatcaacaaaaaaatgctgaaaaccccaaaagccagagtgcctcctctcctccaaatgatcgcagtgtctctccaaggtgcagaactggatggaggatcaaatggacaaagtgacagaagaaggctccagaagatgggtaataaaaaactatgacgaggtaaaggaacatgttctaacccaatgcaaagaagctaagaagactgatgaaaggttagaggaattgctaactagaataactagtgtagagaggaacataaacgacctgaaggggctggaaaacacagcatgagaactttgtgaagaatacatgagtatcaacagccaaactgaccacatggaagaaaggatattggagtttgaagaccaccttactgaaataagacacagagacaagtatagagaaaaaagaatgaaaaggaatgaacaaaacctccaagaaatatgggacttaataaaaagactgaacctatgatcgaccggagtaccagaaggagacagggaaaatggaaacaagctggaaaacacacttcaggatattagccaggagaacttccccaacctagcaaaacagaccaacatgcaaatcaggaaatacagagaacaccaccgttaagatactccacgagaagatcaaccccaagacacataatcattagattctccaaggttgaaatgaaggaaaaactgttaagagcagccagggaaaaaggccaggtaacctacaaagggaagcccatcagactaacagcggacttctcaggagaaactctacaagccagaagagactgggggctaatatttaacattcttaaagaattttcaacccagaatctcatatccagccaaactaagcttcataagcggaggagagataaaatcctttacagacaagcaaatgctgaggaatttcattaccaccaggtcagtcctgcaagagctcctgaaagaagcactaaaaatggaaaaaacaaaacaaaacaaaaccagtgccagccactgcaaaaacacaccaaaaaataaagaccaatgacattatgaagaaactgcatcaactagtatgcaaattaaccaaatagcatcatgatgacaggatcaaattcacacataacaatactacccttaaatgtcaatgggctaaatgccccaattaaaagacacagactggcaaattggataaggagtcaagacccattggtgtgctgtattcaggagactcattttatgtgcagacatacacaggctcaaaataaagggatggaggaaaatttaccaagcaaatggaaagaaaaacaaaacaaaacaaaacaaaacaaaacaaaacgggttgcaatcttagtcgctgacaaaacagactttaaaccaacaaagatcataaaagacaaagaagggcattacacaatggtaaagggaacaattcagcaagaagagctatattctgaatatgtattcacccaatataggagcacccagattcataaaataagttcttacagacctacaaagagacatagactctgacacgataacagtgggagacttcaacaccccactgtcagtattagatcaatgagacataaaattaaggatattcaggacttgaactcagctctggatcaagtaaacctagtaaacatctacagaactctctactccaacagaatatacattcttctcagtgccacatggcacttattctaaaattcaaccacataattggaagtaaaacactcctcagcaaatgcaaaagaactgaaatcataacagtttctcagaacacagttcaatcaaattagaactcaggattaagaaactcactcaaaaccacatagtttcatggaaattgaacaacctgttccttaatgactcctgggtaaataacaaaattaaggcagaaatcaagttccttgaaatcaatgagaacaaagagacaatgcaccagaatccctgagacacagttaaagaactgttaagagggaagttttagccctaaatgtccacatcagaaagctaaaaagatctcaaatcgacaccctaacatcacaattaaaagagcaaaagaggcaagagcaaacttatccaaaagctagcagaagacaagaaataactaaaagaagaattgaaggagatagagacatgaaaaaccctccaaaaaaatcaatccaggagcttttttttgaaaaaattaacaaaatagactgttaactagactaatgaagaaaaagagagaagaatcaaatagacaggataaaaatgataaacaggatataaccattgatgccacggaaatacaaactaccatcagagaatactataaacatctctatgcaaagaaactagaaaatctagaagaaatggatacattctgggatgcatacaccctaccaagactaaaccaggaagaagttgaatccctgaatataccaataacaagctctgaaactgaggcagtaattaatagcctaccaaccaaaaaaagcccaggaccagatggattcacagctgaattctaccagaaatacaaagaggagctggtaccattccttctgaaactattccagacaactgaaaaggagggactcctccctaactaattttatgaagccagcatcatcctgatatcaaaaccgggaagagacacaacaaacaaagaaaatctcatgtcaatatccctgatgaacattgatgagaaaatcctcaataaaatactggcaaacccaatccagtggcacatcaaaaaacttatccatcacgatcaagtcagcttcatccctgcgatgtaaagctggctcaacagatgcaaatcgataaatgtaatccatcacataaaccaaaccaaagacaaaaatcacatgattatgtcaacagatgcagaaaaggcctttgataaaattcagcatccattcatgttaaaaactctcaataaactcggtattgatggaacatatctcaaaataataagagttatttatgacaaactcacagccaatttcatattgaatgggcaaaagctggaagcattccctttaaaaactggtacaatacaaggatgccctctctcaccactcctattcaacacagtataggaagttctggccagggaaatcaggcaagagaaagaaataaagggtattcaaataggaagagaggaagtcaagttgtctctgtttgcagataacatgattttatatttataaaaccacatcatctcagccccaaaacttcttgaactgataggcaacttcagtaaagtctcagaataaaaaatcaatgtgcaaaaatcacaagcattcctttacaccaacaataggcaggcagaaagctaaatcatgagtgaactcccattgaaaatcactaaaacagaataaaatacctaggaatacagctaacaagggatgtgaatgcctctttaaggaaaactacaaaccactgctcaagcaaataagacaggacacaaacaaatgaaaaaacattccatcctcatggataggaagaatcaatatcatgaaaatggccatactgcccaaagtaagttacagattcagtgctattcccatcacactaccagtgacattcttcacagaattagaaaaaactattttaaatttcatatgaaatcaaagaagaccccatataggcaagacaatcctaagcaaacaagaacaaaattggaggcatcatgctagatgacttcaaactatactacatggctacagtgaccaaaacagcatggtatttgtacatatagaccaacggagcaggaccaacatacagaccaatggagcagaacagagatctcagaaataataccacatgtctacaaccatctgatcttcaacaaacctgacaaaaacgagcagtggggaaaggatctcctattcagtaaatggtgctgggaagactggctagccatatgcaggaaactggaactggcctggagccctaccttatgtcttatacaaaaattaactcaagatggattaaagacttaaaggtaaaacccaaaaccatacaaaccctagaagaaaacctaggcaatagcattcacacataggcatgggcaaagacttcatgacaaaaatgccaaaagcaattgtaacaaaagccaaaattgacaaatgggatctaattaaactgaagagctcctgcacagcaaaataaactgtcatcagagtgaacaggcaactacagaatgggagaaaattcttgcaatctacctatctgacgaaggtctaacatccagaatttacaaggaacttaaacatatttacaagaaaaaaacaaaccatcccatcaaaaagtaggcaaagcatatatgaacagctcctcctcaaaagaagacgtttacacagtcaacaaacatgaaaaaaagctcaacatcactggtcatcagagcaaatcaaaaccacaatgagatactatttcacgccagtcaaaatggtgattattaaaaagtcaggaaactatagatgctgctgaaggtgtggagaaataggaacacttacactgttggtaggaatgtaaattagttcaaccattgtagaagacagtatggtgattcctcaaggatctagaaccagaaaaaccatctggacccagcaatcccactactgggtatatacccaaggaatagaaatcattctattataaagacacatactcatgtatatttattgcagcactatttatgcccatcaatgatagactggataaagaaaatctggaataaaactggataaagaaaaccatggaatactatgaagccataaaaaggaatgacatcatgtcctttgcagggacatggatgaagctggaagccatcatcctcagcaaactaatagaggagcagaaaaccaaacaccgcatgttctcgctcacaaatgcgagttgaacattgagaacacatggacacagagaggggaacaatacaccccatggctgttgggtgctggtgggcgagggaagggatcttagaggacaggtcagtaggtccagcaaaccaccatggcacacatataactatgtaacaaacctgcatgttctgtacatgtatcctttttttttttaatagaagaaattaaagaggtttaattggctcatggttctgtaggctttacaggaagtgtggtaccaacatcttctggtgaggcctcaggaagcttacaatcctgacagaaggcaacagggagttagcatgtcacatggccagagtgggaacaagagagagaggaggtggagccaggctcctttaaaccatcaactctcataacaactctcacatgaattagcagagcaagaactcacttattaccactgggagggcaccaaaccattcatgagcgatcttcccccataatccaaacacctccttaaaaggctccacattgaacatagggattatgttatctcatttgaaatgagatttggaggggacaaacatccaaaccacatcattctgcctctgatcccctaagtcttatgtcctcctcacatatcagaatacaaccaagcctctgcaatagtccaccaaattcttaacctgcttcagcattaactcaagtctcaagtgccaagtgtcaagtctcacgtatcatctggagatgagtccattgatcctatgagcctgtgagatcaaaaacaagttatttactgccaatatacaatggtgctacagatattgggtatgcattatcatttgaaaagggagaaattggccaaaagagaggcaatacgcccacacaagtctgaaactcagcaggacactcattaaatcttaaagctccaaaacaatctcctttgacatgtcctacatcctgggcagaatggtgtgagatgtaggctatgaaggccttggacaggtttgtccctgtggctttccaaggtgcagccctcatggctgctgtcacaggttggagttgagtacctatggcttttccatactgcggttgcaagcttccaatggctctaccagtctcaggtctggagggtggcatcccacttcccaaagctccactagccggttccctggtggggactctgcaggggctccactctacgtttcccattggcactgccctagtatagtttctctgtgggggctctgctcctgtagtaggcttctgcctgggtatccagacttccccacacgtgctctggaatccaggtgggagttgcgaagcttccttcacatttgcattctgtgcatctgcaggctgaacatcacatgaaagctgccagggattacggcttgctccctctagggtggcagcctgagctttaccttggcccagttaagctgtggccggagcctgagtggtcacgatgcagggagcactgtcctgaggctgtgcagggaagtggggtcctgggcctgaccactgaaaccattcttcttccctaggcctctaggcctgtgatgacaagggctgtccctaagaactctgaaatgccttcaaggccttttacccattgtcttggctattagcacttggctcccttttagtcacgctaatctctctagcaaatggttgctctgtagcctgcttggattttttctaccatagggctgggctacaagttttccaaatttttatgctctgcttcccttttaaatataactttaagtcttttatttgcttccatatatgacttagggtgttagaagaagccataccacttcttgaatgctttgctgcttagattttttttttctgccaggtatcttgtcatcataattaagtttaaactcagatccctatgacatgaacacactgttgtcaagttctttgccagggtgtaacatgggtaatcttaactccaggtcccaataactctctcatttccacctaagacttaatcagcctggactttattgtccatacagctatcagcattttggttataactatttaatcagtctctaagaagtttcaaacttttactcattttcctgtcttcttctgagccttccaaactctttcaacctctgcctattacccagttccaaagctgtttccacattttcaggtatttaacagcaacaccccactcctggtaccaattatctgtgttagtttgttcttgtgttgctataaagaagtacctgagactgggcaatctattaaaaaaagatggttaactggctcacagttttgcaggttttacagaaagcatggtgctgacatctatctctgatgaaacctcacaaagcttacaatcatggtggaaggtaacagggagccagcatgtcacatggcatgagcaggaacaagagaaaggaggaagagccagacttttaaacaacgagctctcatgtgaactaacagagtgagaactcacttattaccatggagaggacatcaagccattcacgaaggatctgcccccatgaccaaacacctcccactgtgtccggaactggtgggttcttggtctcactgacttcaagaatgcagccacggacccttgtggtgagtgttacagttcttaaaggcagcgcgtccagagtttgttccttctgatattcggatgtgtttggagtttcttccttctggtgggttcgtggtctcgctggctcatgagtgaagctgcagacctttgcagtgagtgttacagctcttaaggcggcacatctggagttgttcgttcctcccggtgggttcgtggtcttgatgggttcaggagtgaagctgcagaccttcgtggtgagtgttacagctcataaaggcagtgtggacccaaagaatgagcagtagcaagatttactgcaaagagcaaaagaacaaagcttccacagtgtggaaggggacctgagcaggttgccactgctggctggggcagcctgcttttattctcttatctggccccaaccacatcctgctgattggtccattttacagagagctaattggtctgttttacagagagctgattggtctgttttgacagggtgctgattagtgcatttacaatccctgagctagacacaaaagttctccacctccccactagattagctagatacagagtgctgattggtgtatttacaaaccctgagctagacacagagtgctgactggtgcatttacaaaccttgagctagatacagagtgccgattggtgtattcacaatcccttagctagacataaagattctccaagtccccaccagattagctagatacagagtgctgattggtgcatccacaaaccctgagctagacacagggtgctgactggtatgtttacaaaccttgagctagatacagagtgctgattggtgtatttacaatcccttagctagacataaaggttctccaagtccccactagactcaggagcccagctggcttcacccagtggatcccacactggggccgcaggtggagctgcctgccagtcccacaccgtgcacccacactcctcagcccttgggcagtcgatgggaccaggtgctgtgaagcagggggcagcactcgttggggagtcttgggccgggcaggagcccacggtgggttggggggaggctcaggcatggtgggctgcaggtcccgagccctgccctgcgggcaggcagctaaggcccggtgagaaatcaagtgcagcgctggtgggccagcactgctgggggacctggcgcaccctccgcagctgctggcctgagtgctaagcccctcactgcccagagccggccggctgctcccagtgcggggccgtcaagcccacgcccacctggaactctaactggcctgcaagcaatgtgcgcagtcccggttcccgcctgtgcctcttcctccacacctccccgcaggctgagggagctggctccagcctcggccatcccaggaaggggctcccacagtgcagtggcgagctgaagggctcctcaagtgcagccagagtgggtgctgaggccgaggaggtgccaagagtgagcgagggctgcaagggctgccagcatgctgtcacctctcaccaccaggccagcctccaacattggagattacatttcaacatgagatttggaggggacaaatagccaaaccatgtgtgttactattttctgactttctctgaaataggtgtattgagattgttctctgttggatggtagatacagttatataaaagataggtgagtgatttataacttagaagtaatatccacttgcatacttctttagtatggttagttaagtttcatcattaagaatgactttcatttagtgtcaaaagttaatcctggccaggtgcggaggctcacgcctgtaatcccagcactttgggaggccgaggcgggcagatcactaggtcaggagattgagaccaccctgtctaacatggtgaaaccccgtctctactaaaaatacgaaaaaattagctgggcgtggtggtgggtgcctgtagtgccagctactcgggaggctgaggcaggagaatggtgtgaatctgggagatggagcttgtagtgagctgagattgcaccactgcactccagcctgggcgaaagggcgagactcgtctcaaacaaacaaacaaacaaaaagttaatgctgctatcagtcctgtacttctgagacatggattgttggatgcttaaaatggtttatgatcaatagtcttaaagttctaatctgacttttacagttttaaatttctaacaaagatggaaaaaacagacactgggccctacttgaggctggagggtgggaggaggaagagaagcagaaaaaataactattgggtactaggcttagtacctcggtgataaaataacctgtacaacaaatgcctatgacatgtttacctatataacatacctgcacatgtatccctgaacctaaaataaaagttaataaaaatttattacaaattaaaaataatatacaacaccaagagtgagccctgatgtaaactgtggacttgggatgataatgatgtgtcaatgaaggttcattagttgtaacaaatgtaccactctgatgggggaggctgataatgggaaaggttgtgcatgtgtggggtagtggtatatgggaaatttctattcctctcgattttgctctgtgaaaagcaaaaacttaaaagacttaaaaattatagtgaaggcatcaaatttggaaaaatcaatagcctagttccttactatgaaatcatatggcatagttctctaaatgtaacccttacatgttgttttcatggacttcatacacactcgctctaggaataaaagagcaaagtattttcatgtttccttttttctgagtttgtatcagtatggggtatgtgcaggtggggatgggagggttacctttagccaatatcagaattgaattgaatggaggaattataattttccaataaaaaaattcaagaagtgttttttgcctcccaggtggtaaaatcatgcatactttttatttccttttttggtctctctatattttccaagtgttcaacaaagtgtggttattagtttttataataaaagacattttaggttatttctctgattactaagagtaaaaaaaaaataaagttttaaagttctaatctgaaattttcagtgaccacatttcaggagtgctcaaaggaatatgtacaatcaaggcaaatattttgtctccactcctgatttccctgatgacagaattttcctaagcatattcctggcctttctctttgtccctctattctctgtgccctgggaggttgaaggatttatttgattggtaaatttgggaaggctcagtcctgcttatcttccttttagaaaaaagctgtctgcagggagcaagttacctctgctacttttctaggagcagattcttcccttttagagaaagatcctgtactcgttcaacgttgcctatatctagataccttctctggctgcttgtttttaagtaagtccatttggctctcatactaagctacagtcttcaacttgtcttttattaaaaaataaagatatttttggccttcatatgctactctttgttttatttttcaatttgcttagaacatagccatggaagaaggaagccattttattgtttcatgtacttctcatgtctgacagttgacattctccctgaattctctatcattaaaaagctttgagtctctagtaaacacaatttctaaatctaacaaatctcatcatgaccagctctcagagcctacacttgaacactactgtttttctccagtggagggaattcaagctacttctttacaatttcagaaagcagttagaaaaaaacagccttaggctattttgattttttaaggttactgttgattctgatgctgaacactgaaggaaaaatgcttcaattaaaggcagacaaactcttccatataagaacacagacaaatcttcaaagctcatagtatttgtgaccaactcctgaagaaatatacttttagataaccttcatatagaaggcaggtaaatcactcatcatatgtacatatgacatttctgaatatacttacctcagctgtgtgttttgccacatgccccacgatgacaatgaccttccctttgaagttctggagcatagcagtgtaagggccctgggtaagctccccttctgcagtgaaggcagcactgaatggaatgttgatgcttcctgaaatgtgaccacgaataaagctgagaaggaaagtttaaggaaaacatttatttgtgtgcaatcctgagtgtctgagggaaactcacagagctaagtgactcccagaagatagtactaaacatcttccagcttatgtgagtattttatctaaatgaagtaaggcacctccaggagaaaaaaaaaagttaaatttgaaaatgaagtagaaaagagaaaggaagatgactagccaaagatataaaaggatcttacatcaaaagcatctctcattacataaacacagatatgggtaaacaataactacacttaaagaggttctataaagagtggagatggtggagatggactacatatcttacaatttaaattttctagtcagctgctgcttcatctttttttttaaagaaaagggtatgacattaataatgagagaaagaactgtaaataagttctgaaaaatgaaaggagagagaatcaacattaacattccagtaggcattgtttagttgaagttttctagaatgggcagagaatttatgatcatgggtagattacctttgaacttcatcagcattagtttctcaaacatttctaattattcaatattcccaattgcagttttcctgaagagtaatgacttttctctcagaatataattactctgatggtacttttttaaaaaactgaaagtacttttattttcagtaaagatctacttaaaatgaaaattttttataacacatactaagaacctaacaaacaactcatatattctcagcacctatatctacatctgtgaggcctgaatcagttgccagagagtgtttccatatttatcaaacaaccttttcaactatgaacatctttcctttttttagtgtgtttagagtagcaaaagcaatacaaatctatcctggtgaaatgctgtagcagacatgtttgggctgcctgcccacctgctgttttcttgtttggaagagcaccaaccactgaccctgaggaaagggtgagcctaggttgtcgtgttggtatcagatgaccctgctacaaccatgactgacaggatggtggaggggagggtgatggtggatatatgatgcaggctgagccaatgagattctctcccttgaaaatcagaaataaaagacataaaagataatgctcagactgtgttaagctttacatgtaaaatcacctttaagtgcctcttccataaaatttgttcagccatccataaaatttgttcagccacgtattagaaaattagaagaccctgactctaaaagaagaactgtttaatagatacattcagtgaatactgtatttggttaaaaaagtacccatctatatctaaataaccatacctagtaactatatctataatcatagataagtattaaggtgattttgtaggctcgatatcacctatttattatgtgcctttaaagaagattttaatctaaactcctttcagttactaaaagtatgtcataaagttattatcctattatccttgtgatttattatttgtttaaaaaatctagattaaatattaaaatgcttcacaaaatatgacggcaacagagtcttttttgaaagagaaagtttttcaaaatacaaaatgattccaaaccttttttaggctacactttggaaaataaggcacaaaagaaacagagttttaaaccacactttccttattcttaatctacttcaaccaaaatgtcctggataatatctaagaacactcatccaagaacactcttgtcatgaaacttatagcacaaaaatgattgggtaagcatgaatgtctgtagacatggtggtcaaacctctaaatcgtctatcattactggaaaacagcagaggagaatgtattactggcaaaaaacagaggagaatgagattggcctagttataaataagtatatttataatgaatagcctgttgtttatataagttggataatgaagacaactttggttatttagaaatctcttcttgtttccttggaaagtatttacatggcctacaatacaatttcccatgtgacacagacagcattaggtgaaatagaactgctttaggcaacttctagacatttgagaggtggtcagattatattgtaaatctaggtaggtgaatacttttttcacttgttgagtacttcataatcagaataaaatatgaggtatttggaaaatgagcaaacaacagatttctgtatattttttattagaaagaataaataaataaagaggaaaatagaagaaaatttttgacatatggtgactctgaatgaccatagttgactatcatcagtcatgagtaaaatctggcaaggaaagagacatgatagagaatatgttgagataagcacatttttccatgctctaagaactttggttttatttcactgtattacagtggaaaacaagtatacataggaccttcacacaaaggtagggttagagatgaacacgcaacactacatatttttgaagtatgactgtcactttactgctttctgtataatatagataaaaatctgaatcctctacactaatgttttacattttaaaaaggcctttctcattacataaacacagatatggggtaaacaataaccacacttaaagaggttctataatgagtgtaatactcaacagtcagtcactatgctattttataaactaagagtttaaaaagctacagcttcaaagaacccagttcagaggaaatattactattaaggaaatagtagccaaagtacttatggggtgattagccccaatcacatatatatcatgatactgtaatcccaacaatgacattacaatttttggttaggttttggcaaaagtggcaatggtatccataaacactaatttttaacttccagtgttcataggaaattagaattttttatgacatacttgaaagcgttaaaagataaaaaacatcattacagaagtcagcagtaattacaatgaaatctctagactggaataataatagttatgaaagcataaaagcatccagttattgtagcagtcactttaccacgtgtttggatatggttgtttactatgctgaatgcactacaggatatattccagtaaacatatgaattttctttggcatatggtgaccttacactatatatcttaccctgtcttggagtaagttgtacccctccctgcaaataagccattcagctcaatattccatttggcagatactaccaaaagtatttgaatgtgtgctaagaacaaaatcaaaaatttgcattaaacagaatttgatagcccaatgcacagacagatttaaaaaattactgtaaacttctgataaataagttggattatcagaatagcattaacaggtagggatgatgtatattatcttctaggtttctaagatattaaaactttcctgtattcataattcagtctacaaaacaatgctgtaagtagatatgctgtacttcaatcaaacagaaaaaaatcaggtataagaatataggtacagtgtataggtaaattacatggtagttaaccaagtatgttcagaaagactcttcaatttacaaaaagatttgaaaattcctttaaaatattgtttaaaattcagcacagaaaccagctcatgtttttttacatcctaaaagagcacagcatttttgctggatgccacacttagtgacatcgtatctttaaagacaacacacaccaatatttcaccaaaccattcaagaagatctacctacctttgttttttggctgtttgtctgctgggttaactaattataattagtattatagacctttcagcccaaactgaaagttttacctttagtatatcaacagcgaaaaagaaatatgaaattaaacccacagttctctcatatataccataactaaatagcattaactgatataaaaatgatgtttagatatcatgattttctttgctaaatctattgatagtctgaatggcatcaccatcccccaaatcaaccagtcaaaaatctcatttccaacatcttatcagtagcaacatccaatattctacagctctaataaatcttgtactcacatttttattcccattaccccttgcctatttcagatattgatttgtcttgagcttaaactactgtagtaactgttttctccaacttttgtcttttctcttggaaatacacttgatttacaatattgacagagaaaaaatttaaaagcaaagtgttctgattattgtatcctttctgagaaactttctatgactgcctataggacaaagcccatatttctcagttcagtcctcatgaatagaacctaactactttaattccaaccaaactaaatcatgcactgttaccaatatgttttctatctcctgtagttttctctgcccaaatatctttttctcatttttgcgcattcaaacatccatccttcaaatgtttcatccatgaaagtttcccttcccacagtatctgtacatatcttataacagcaatttgattttatataaaattttctaatgaaaatgacttctatctaaacaactgataggaacaatgtgtattatatttatttcgtctttgaatctcttgcaaggattaatagaatgcttagaacatcacttacatatttggtgagtaaatgaatttcagaattttgccaaacctggagtaactagtatcggcagcaaatatgctaaggtgccttctggccaccccaaccagtggcaccagtatctaacaatgcttgcaagtgtcaacgatatagaatttccctttgtcagcacacactttgagaaaagggaaagaaacagcaacaaaagtaatttctctcaatcttcttcagcataggctcactaaaaccggtttatttagggaaaagctagggacctcactctttatgacaggatatgaatgaatgattatacacatcaaatttctggataattcaatcctaattttgcctgcaagattatctctaccctcatccatcctctacaatgcattaaagtaatttttctgaaataaaaatctgagcatggcacctacctgtttagaattttttaagtttcttactgcctttggaataaaacccaaatttcttagcatgttatgagacattttcaatgaggctacttttacctactctagtttcattactaattctcatatattccagacatgctcatccacaattcttgtaacttcctaaatgtgtctgtctcaccttctctgggcctcaaacaatgtgatttttcaatgctttctctcttttctttgttaggttactaacttctacttgttttttaagaatcatgtcagacatcacctggtttaggtgcccatcctatatttccatgacatttgggtatgcttcagacataggccatttcatattatactgcaattatctatttcatgtatctattttagttataagactgtgagcttctggtgggcaggggtgctataactaaactctatatccccattgcctggcaaagcaggtcctcaaacaggactggctggctgattgaatgagactgtatggcactctaggaactggggtcatggatggttctcacagcaaatcggagctctttaacagctaatacacctttcataactagcaatccagacatgaagacattgctcagcagttgctatcatatactcccacattatacaaagcccactcaaatatgggaatacaattggatggaaattttaatttagatagattgaacctaagcccaaatgagatgaaaaaaaccttactaaaccttctcatcagtatctgtcctgctctgctcatgagtatctttaaattgctttgaagaagtttttataaatcaattattaaggacaaagagacaagagtaatactagtgttcactaaggatgaatgtgccataatgaaataatgaatacaactgggtttatgtgtttttcaaaaaacaaatttaagcctgaggttgtctttggtatagttttagatactaacttttttttaaaaatcaaaaggtaagagttttacaagtaaagctcagccttgagcaaaaactcagccttgatttcaagcaaatgagtaacattcctttaaagtattgctgtttacagataaaataaattggatccacaattacatgactaagacctctcttaatatgaacttccaagaaaactgaaaccctaaatatttacaactattaaagaaaacaagagtttgcttgtgtattaccatggaaactattaacatcacttctgaaattcatgtcactacatgaaaacattttctattgcctccttataaaatgcaatttttgtttgctttgaaattctcaaaatatactgaagaacaaatatatctgacttgatttttacctagattaacatttcatgtttctatcttctaaaagcaaacaaaaaaacgtgatttcaacaaaaactgttgttttgcctctctgagcctttggctttaatattaagagtttagactatattagggtttcttcttattctaaagttttgggattatgtttttattgttaagtgggtaaagtttgtcttcatgtccttcagctttcttcttctgtattctccattcccttggcccacattggggtttgggtagttccctaagattgctggcaccttaatgtgctgcttgtctcctacaatcacaaaaactgaacatagattaaaatattaccacctgcaggctttttgtattttaactgagactattcataacacaagctaaatgactgaagcctcaacagtagcgtttcaggcatcaagtgaaggttctgaagggggcttggtggtagtagtgaggctgtcccttaaatttattggtagacagcttattttgcctgtggataagattgcctccctccctgtcataagcaaccacttaaatcattttacataggttaaaaaaaaagacgagatgaaatatatttttagacattaaatctcctggaagcacaatttaggaaaaaaaaacttcacctataatgaagatgtaagaactgtgttaggcaaagacttcccatttaaatgatgtataaaagcaaaacagaagataaacatgatacagggacattataaataatttgaacaacatttcaaaaataatttgcttcctctagggaaggaaaaggtgttagagaaagtttcttttttttccatattgtacagggtcacattttgcggcaagagagaaataaaactatttcaaaaatatcctagtattaaatatgtaatcacttcttaaacagattgttaaagtcacataaatcctagactttaattgcgaagatttaccttggtaagcattaagagttactgtacaaagataattactttaaaaatattattaaaatttcaatgggctttaaaaaacatcagcatattagtagctttagggaaatttttattaaaaagattttgaatgaattaaatattataaattaagtcaatataatagggaaggatctttctatcatgtttcctccctcaaagtgttgcaatactgctttctaaaatttgaaatacttcagttttcctcgattctgtggctacatctgtataaagataaccacaggtagatttgttcagttggtatctgggattagtcctcttatacacacaggtgctgaaggtaatagcttattttgtgtgtaagatttgaagaaatgtgtataacatctgaatgaatatatctagtgtagaggaatcaatgcatgtctcactgactcattaatttctattaactcatttgtttcaatcttgtttatgcttaactgtccctatgcagagaccagataggcacctgtaaaatagtgtaaaatttagaagcacaagactggctctgcaattactagttatatggccttgggaaagttgcttaacctctttaaacttcagtttatcagtaaaacagagataacaacagtatatacagcataggactagcaccatgcttggtacagtgtaagaacttaaagactgctattattagaagtcaatttacttcaatctattcaagaagcagctagtgtgcgtggctagaagcagctagtgtgtgtggctctcatggagaaaaacagaagggggcaagtaaataccacaccttcagctgaaacatccaggtatttgcagtgggactaatcaaggaaacaacttgacctttagagaatgaagaaaagtaagacaggacaacgacccacctgggaataacatggaaccaggggatactcccccacccaagggaagtggtgagtgaatgaacggccccagaaaaacacacttctctcacaggtctttgcaaccctcaggtcaggagatctccttgtgaacccactccaccagggccttcagtcttcagtctgacggacagagctacatgaagtcttggcagagcaactgctcaggcataggtggagaccctgaagccttagattattattgggctttctggcaaaagtagctgcagctttggcaaagtagaaggttagactcctgtacatacccgtaggaaagaggccgaatccagaaggctgagtagcaacaacccataggccccacttccatggcacctcacaagataagacctactggcttgggatccagccagctaccagcagtggcactgcacctccctaagaaggagttcccagggagatgggtgggttgccatctttgctgttcagacaccttagccattccagccttcaggctttggacagtctgagctgactcagagcagaaggaatcccacagcacagcatagatgctctaccaaaatgtggccagaatgcaaactgcttttttaagcaggttctgatcctgttcctcctcactgggcaggacctcccaaccagggtctccagccactttgtacaagtgcctttaaaccacagtctgagctgactcaaggcagaaggaatcccacagcacagcatagatgctctaccaaaatgtggccagaatacaaactgcttttttaagcgggttctgatcctgttcctcctcactgggcaggacctcccaaccagggtctccagacacttggtataggtgcctttaaaccaccaacaggtccatacctccctgggacaaagctcccagagggaggaacaggccgccatctttgctgtttcacagctttcactggtgacacctccaggttctggaaaatccgagatgactagggcctagagtgggccccaagcatactgcagcagccctacagaaaagtgggcagactattacatgggttcctgttcccacatctccttactgggcagatcctccaggcctggggttccagccaccccaaccagagctatcgagccagtgcgaactcagcaactccctgcccagagcctacaggggcaaataaaagcctctctgccactgtctctgcagtggaactgccctagccacccttgaactaatgaagaagcaaagaccttaactgtcttatccatacctccaacaagctgcagttgaaccaaggagaggaggccagtccatctcccacaggtcccacacactccccaaaactcatcaccagacaggaaactcctggcttgggcccacagaacaaacctccattttgggctgacttcgctgagtgattgatgacctgcatctctctggggcggagcccccaggagtcaaaaaaaaatgacccttggccacaaccactactaagatctcttcctctactgcctctaagctggggaaggaatataaactctgagatcatcccagagctgcagtgggcagcccaggagtgccaagtcatgaactatagcaggcactcaagggggagaggagcccacactttcagagcactgagagggaacatggctgcaactatgaggaaacataagggagccacactactgaacaaaagtctaccaactgacaaataaggctaagtgtcacctgctggataaaccccaaagcttcaacacaaaaaatacctcactaacgtaacccactctaaagccagagacagtcagtcagcttccaataaagactctatacaaatactcatcccagtgaaaatatccagaaaataagtctattgactgtactcaatctacaccacagttaaaggaacacccacatgcagagatgagaaagaaccaatgcaagaactccagtaactaaagtggccagagtatcatgtgtcctccaaatgactgcatcagtcctccaacaagagttcttaatcatgccgaactggctggaatgacagaaacagaattcagaatatggacaggaacaaagataatcgaaatgaaaaacacaggaatttcacaatacaatctccagtattaacagcagaataaaccaagccgatgaaagaatctcacaattcgaagactggttctttgaagtaaggcagtcagactaaaataaaaaaaaaaagaataaaaaggaatgaacaaagcctctgaaaattatgggattatgtaaagagactgaatatatgaatcattggcatccctgaaagagaggggaagaaagcaaacaacttggaaaatgtatttcaggatatcttccatgaaaacttccctaaccttgctaaagaggccaagagtcaaattcaggaaatacagagaactcctgcaagattctacgcaagatcatacatgagacacataattgtcaaattttccaaggtcgaaatgagagaaagaaggttaaaggcatctagagagaactcgggcaggtcacctacaaagggattcccatcaggctaacagcagacctctcagctgaaaccctaaaagccagaagagattaggggcctatattgaatgttctgaaagaaaaaaaatctttaaccaagaatttcatatctagctaaactaaactctctaagtgaagaagaaataagatccttttcagataagcaaatgttaagggacttcattactaccagacctgccttacaagagatcttgaaagcagcactgaatatagaaagatcactaccagtgaatacaaaagcacacttaaacacacagaccgacgtcactgtaaagcaaccacacaaacaagccaacataaccaccagctaacagcacaatgacaaaacccaatccacacatatcaatatgaaccttgaatgtaaagggtgaaaataccccacttaaaaggtagagtggcaaacaggataaaaaagtaagacccaataatatgctctcttcaagagactatctcacacataatgacacacttataagctcaaaataaagggatggagaaaaatctaccaaaaaaataaaaaacagaaaaaagcagggattgcaatcctaatttcagataaaacagatttcaaaccaacaacgatttaaaaaaaaagacaagggcattatataatggtaaagggttcaatttaataagacctaactattctaaatatatatgaacccaatacaggagcacccagattcataaagcaagttcttagagacctacaaagagacatcgactcccacacaataatagtgggaaacttcaacactccaatgacagtattatacagatcactgaagcagaaaattaacaaagatattcaggacctaaactcagcattggaccaaatgaatctgacacacctttacagacgtctccaccccaaaccaacagaatatacattcttctcattaccacatggcacatactctaaaatcgaccacataactggacataaaacaatcctcaataaatgtataagaactgaagtcattccaaacactctctcagaccacagcaaaataaaaatagaagtcaacacaataaaaatcactcaaaatcatacaattacatagaaattaaacaacatgctcccgattgacttttgggtaaaaaataaaaggcagaaatcaagaagttcttttaaagtaaagagaacaaagatacaacataccagaatctctgggacacagctaaggcagtgttaagagggaaatacaatatcaccaaatgtccacatcaaaaagttagaaagatgttaaattaacaacctaacttcacaatggaaagaattagagaagtgagaacaaaacaacctcaaagctaatagaactgagaaataattacaaaaatcagggtgaagtgaaggaaatcaaggcatgaaaaactattcaaaagagcaataaattcaggagttggttttttgaaaaaattaacaagataggccactagctagactaagaagaaagaagatccaaataaacacaattagaaatgactaatgaaatgtaaccactgaccccacagaaatgaaaataaccatatgctctatgtacacaaatagaaaacctagaagagatggaaaaattcctggacatatacaccctccgaagactgagccagaaagaaactgattccctgaacagaccaataatgatctctgaagttcaatcagtaataaatagcctaccaaccaaaaaaaacccaggacctgatggattcataaccaaattctaccagatgtacaaggaagagctggtaccattcctactgtgactattccaaaaaaattgagaagaagggacttatacctaactcattctatgaggccagcatcatcttcataccaaagcctggcagagacacagtaaaaaaggaaaacttcaggccaatatccttgatgaatgtcgatgcaaaaatcctcaatgaaatacttgtaaactgaatccagcagcacatcaaaaagctgcttcaccatgatcaagtaggcttcatccccgggatgcaagattggctcaacatgcaaaaaatcaataaatgtgattcattacataagcagaactaaagacagaaactacataattaactcaacagatccagaaaagacttttgataaaattcaacatctgttcacgttgacaactctcaataaaccagctattgaaggaatatacttcaaaataataagagctatctatgacaaaaccacagtcaacattatactgaaggggcaaaagctggaagcattccccttgaaaactggcacaagacaaggatgccctctctcaccacttctatgcaacatactattgaaagtcctagtcagagcaatgaggcaagagaaagaaataaagctcattcgaataggaagggaagaagtcaaactatctctgtagatgacatgattctatatctagaaaaacatgcagtcttgacccaaaagctccttcagctgataaacaacttcagtgaggttgcaggatacaaaagcaatgtacaaaaatcactagcattcctatacaccaacgacaaccaacctgaaagcaaaatcagaaaggcaatcccattcacaactgacacacacatacacacacacacacacacacacacacacactccctaggaatacagcacaccagggaggtgaaggacccctacaatgagaattacaaaacactactcaaagaaatcagagaagacacaaacaaatggaaagacatcccatgctatggatcggaaggatcaatatcatgaaaatggctgtactgcccaaagcaatatacagtttcaatgctactcctatcaaactaccagtgacattaacagaacaagaaaaaactattttaaaattcatatggaaccaaaaaagggcccgaatatccaagacgatgctaagcaaaaagaagaaagctggagacatcatgctacccaacttcaaactacactataaggccacagtaaccaaaacagcatggcagtagtacagaaacaggcacatagactaatggaacagaatagagagcctagaaataaggccacacatctatgaccatctgatctctgacaaagctgacagaaaacaagaaatgggaaaaagactccctattcaataaatggtgatggaataactggctagtcatatgcggaagattgaagatggaccccttccttacaccatatacaaaaatctactcaaggtgggttaaagactttaatgtaaaacccaaaactataaaaaccctggaagacaacctaggcaataccatcctaaacctaggaatgggtttagatttcatgaaagaaaccaaaagcaatcacaacaaaagcaaaaattgacaaatggggcctaattaaacttaagagcttctgcacagcaaaagaaactatcaacagagtaaacagactgtaggagattggtcagggtggtggaaaaaattgtagaaagacacaaaccttcttggacgtccaggaggttttataaaagctttggaaaagcatttggctgaaggcagccaaaccctcttatccggagcccgagagcgaaggttacataacaaggggatataaaggaattgatctagataagttagtttatttaggccttggaacctggcctttaatcatccacgtgcaggactgctctctccagggagggtgaccatgttaattacccacaagtgtgttgactcaaagcctttgtcattaaatctgtactaaataaatgccagcagcaccagcttgtcagggctgcggctgctacaactctttctgtcagcggtctggtcccttagcctactctttcactcaatacttgtgtctaagtacattctttcatccatcattcagccagggtctatgggtcagacccagcaggtggtgctccacatgaggaatgctgcaatggactgcgatagaaccctcaaaaatgaaggtgaaaagactgcgcagtcagtaagtcagtaagtcattggtgcccactcaggatttccaagttggagagaactgttcaggctagggtttcatcataggacaacagttatcagctcaacagcaacagtatataaaagcattgaaacagctgcttaaaggtagcagagccttggtttcgcaggctcaattaagagacctaatgcaaactactgtttcccataacccatggtttctgaaagaaggtgcactaaacttggagatctgggaacaagtgggtagaaatcttaaacaacatgatgtacaagggcaatgggtcccaataacatctttaacgttatgggctttagttagggtggctctggtcctactctacacagaagagcctaaaaagggaagggaggaagaactgtcacctaccttactgcctccatctccctcagccccgctgtctccaggaaaaaataacaaagaggaaatggaggttttgcctgaggcccctcatccaaaaaattggaaaaaagacaagggatatgctgtcttacgcaagcagcattagatggggagctcttagcctgcctggtaatgcaagatcaacaaggcaatcatttcttttaatgcttataaagagctaaaaaaaaaaaagcattaaagaaaacggagccactagcccatttacaagagggttaactgaggccactctgcagacctctttctaacaatggccactgttatttctcccctacccctaacgtggctctctcaaaatcctatttgggtagaacagtagcctttaaagggagagaaattataaagagcccatgaattagccgaggagcaattaaaagctgaccatatagaaccgtcatacagtccttgtaatttgcccattttcatcattccccaaaagtctggtaaatggagacttttgcatgacttacgtgctattgatgctaatttgcaacctatggggccccttcagcaggggctcccctcccacgtggcaattcctcgagactggcctataatcattattgacttaaaaggctgctcttatactattccccttgcagaacgggacagagaaaaatttgcatttacaataccagctatcaataatgaaaggccagctcactgatttcattggaaagtgcttcctcaaggaatgctgaacagtcctaccatgtgtcagtatcatgtaaatcaagcttggctccccagtagaaaagaatttcctaattgcaggattactcattttacagatgatattttactagcagccccaacagagctagtacttttcaagtcacatgcctctgtcgtaaagaatacacagttaagaggtttaatcatagaacctggaaaagtacagatgtctttctccttggaaatatcttgggtacatactaatttcccagtcagtaagacctcaaaaggttaaattaaatactagcaacttacataccttaaatgatgatcagaaattactaggtaatattaactggatttgccccaccttggacataactactgataagttacagaacttgttttccatcttaaaaggcaatgctgccctagactctcctaggtatttaactcctgcagcacaaagggaaattgaagagatagagcaagctatttctcagagacaactagattgcattgatacatggtattcagttcaattatttgtttttcccactaaacactcccctacagatgaccccagggctacgcttcctagaatgggttttttgctcacataccgggactaaaacactctttccctatatccagttagtcagtaaagtcatttattcaggatgcagatgatgcaatcagttgctaggttatgaccctgatatcatcaggattcctttaagtaaaaagcaattcaaggcagtattgccttatctatggacctgcaaatagcactctctgattacaaaggccatatagagcatgcccttcctgctgacaaactccttcagttcttatcttgtacttctgtggttttgcctactaaaacagttcaatcccccatatctaatgctttaacagtgtttactgatggctctggtaaacatggaaaagtcactttctggtggaaatcacgtaattccctcacttgttctggatttactagcgctcagagggctgagattggagccttactattggccttggaaactttttccattcagctcatcaatattgttagtgagtctgcttactctgtttatttattgcagaaccttgagagggccctcattaagtccactctggagcccaccctgtatgcactttttctccgacttcagcatttgctagatcaacatacacatcctatttttatcatacatatttgagcccacagctcactgcctggcccactggcttatgaccatgatcaagcagacgtacaagttagaacatcactgtttgaccaagccacccagtcacatcaatttttccaccaaaactggagaaacttatctgaacaatttcaacttacccagagactagctaaacaaattaaccggcaatgcccagattgccagctcacaggcacgttccctccttatacaggtgttaaccctagaggactagaacctaatcagttatggcaaacaccatgttacacatgtgcctgaatttgaaaaactaagatatgtacatgtatccattaataacaattctcaattagcgctcatgcctttcctggagagtccacccgatatgtcattaaacatcgtcttttaacttttgcatttatggggtggcctacaaaaattaaaactaataatggtctggcttatgccagctcacaatttcaacaattttgtcacagtggaatatccaacattccacaggcatcccttataacctccaaggagaggccatagtagaacatactcactctatccttaaaaatatgctcagaaaacaaaaaagggggaatatgagtaaggaccctgcaacactactagcacaagccttatttacccttaattttgaaaatttagatgataaatttcaattagctgtagaaaagcactttgctaaaacctctcaagacataaaacctgcagttttatggaaagatgtaaacagtaatgtacggtgtggtccaaatgaattgttaacatgtgggagaggatatgcttgtgttcacaccccctcaggtcctctttggattccagcacgatccatcaaaccttaccatagcatggctaggacccaacctggtaccagaaataaagaaaatgaccctataggacctacagccccagaaaatgtggcttcctcggacgacataggccctggacaggacgctgaagaagagaagtcagaagactgagcgaatctgctctggacacagacaccattcactccagataatttgttccttcctatgctttattaacctttttaattctttcactttacctgcaaccctcacctgctactctctattgggcccatctcttagatacgcctttcttcagccctattatttaaacaaacacccccttctcagcttctaacaacacgactgcttggctaagagggaatgacatgccccaagtggggttcctcaataacggcacacattggactaagatgccaagtaacactacatgtcactccttaattggaaaagaatgtggctaattatactcatatttgtcttctattatttactaattctaggatgcaaagccggaatgcgagcagtgcccgccacacctgacaaacctgctgctgcacacatctgtactcttcaatcaacaaaacctgatgctaaaaacagaaaagggggagatgtaggagatcagtcagggtggtgggaaaaattgtagaaagatgcaaaccttcttggaaggcggggaggttttacaacagcttcggaaatggatttggctgaaggtagccaaaccctcttatctggaccttgagagcaaaggttagatagcaaagagatataaaggaattgatctaggtaagttagtttaacttggaacctggcctttaatcatccccatgcatgactgctatctccgggcagggtgactatgttaattacgcaaaagtgtgttgactcaaagcctttgtcattaaatctgtaactaaataaatgcctgcagcaccagcttgtcagggctacagctgctgactctttacagcaccctgctcggggtctataagcagccaggtcctctagcccgctttttcactggatacctgcgtctgactgcattcttacatccgttgttcggccagggtctgcagattggacctggcaacagacaacctacagaatggaagaaatatctttaagattaaaatagggtgttataatgttattttttatggttttatgggagaattgctatgaataaagactcaagcaaaagaaatacaaattaaaaagttaaaaacattaaacagattctaaactcctgaagtataagatcagaagaacttccagactaggggttcttgaccagttaaatagaatttaatgcctcattcgggagtccactcatccactctgcaaagagtttctagtattgctgaaaccctaacaaccagggatatcaacatttatactctctccaaactcagaaaaatagaaagtagcaacttttcacaaaatgataagaatatatcatttgaaattgtgagctctccaattgtactgtcagaaacctaagattctatgaattacttaataaagtctgtaaatgtgtaatttgaatttcatttcaaaaattggaattgaaaatattaacatgaaaacttattgctgattgagtatccttaatccaaaaatctaaaatctgaaatgctccaaaatcaaactttttgagcaacaacatcaggatcaaaggaaatactcattagagccttttggattagatattctgaactggtaagtatatacatataatggaaatattccaaaatcctacaaaatatgaaacctgaaatactgtcacaaacattttggacacaggatactcaacctgtatatgccaattttagcatataagaaaccattaacctgctaaccctcatttatagcatttatagttagtaaatgttataaatctgaacttatgaagcaaattagttataacattcatttatattttatatattgagtttctaagaaagattttaaaagttgctctgtttttaaacaaagtgaaaaccatttatctagattctagaaaatacacaatcaaagaatctgaagataatgaaaatagaaggagaagagactgaactgttactattttgtaactcttcatactctaatgccaatcaaacccactggatgttacagtatgttcaatagtaaaatcttcgtaaataacattttgtagttagtgaaaatacatgttctatgtaagccagtgttttgaaaattataatgaacacaaggtcagtgttgagatgtagcaaactttttctctaggctatgaggtaaaacaggtgtatacttactctttatctttgccacaattcctatctacagcatgaaggattcaaatgccttcaagaatagcaatatacaccagagaaacacaaaaaacaacaaaatatcccaatattctggcattgtttggaaaatatcatcaggtctctggtatgtaatgttatcttataaaaccttatgcaagaccattctggcatccagtttgagagtaatttaactacttgaattcagaagaatcccagaattttttttttttaaccacacaacacttaaatgaaaggatgcaatacaaataagcagtaccaccctttaaaacagcatatgcaaaggatactcttcactattccggatgtcaaccaccaggagctttggtttactggactttgttttcttgctgggtgttttgaagtggcctgtcactgtgagctcacacaagtcaatcaggtcctctgctgaaatccgtggtgatacttctgacttcaggtcatttaatgggatggattctcttgactgaaaaaaaaaatgtacaaaaaaaaatattgagaatattatagaaaaacaaattatccccagtaatagaatatcttgataccaaacaatacagcatataagagaagaggaaactatctaattttcacagtctattgtgtaattcagtggtctccaacccccaggccatggactggtactggtccatggcttgttaggaactgggccacacagcaggaagtgaatggtaagcaagtcagcaaagcttcagctgtatttacagttgttccccattgctccgttatagtccgagctccgcctcctgtcagatcagtggtggaattagattctcataggagtacaaaccctgttgtgaactatgtatgtgagggatctaggttgcaagctctttatgagaatctaatgcctgatgatctgtcattgtctcccatcacctctagataggatcatctagttgcaggaaaacaacctcagggctctcactgattctagcttatggtaagttgtataattatttcattttatattacaatgtaataataatataaataaagtgcacaataaatgtaacgtgcttgattcatcctgaaatcatcccccccccatctcaaacccagtccatggaaacactgtcttctaggaaaccagtccctggtgccaaaacggctggggaccgctggtgtaactgataccttactattgaggtttacttctttgttatttacacttataggaaagcattattgttttgattgactgcaagctcctgggtcaaacatgtagaaagagatgaggcaaagatttccttatgagagtgctttaaaaaaaacagctcctttaagtacatttcacttttctttaaatataaactactgttgttttgaattgcattaattttaactcaggtaatatgagaaattgcactgtaattaggcatacatagtaattaaagaaactggttctaatatatgtgttggacttttataatataatttatgttatatataaatggttgagtggaaacttgattctcagagatgaataaagagcaccctaatgctttcttaaatagtaaaccaaactaacaatgtgtcttaactgtgaaggaggtaacttaagactccaggctatcaaacccatccattggtttgtgtctatgatattgcataaaaatgattcagactaagggctatttacaattattctctatgtttcttagtagaagaaggatgagcctttccccataataggcaatgcaatacaacacaactaaattcaacataaatttattgagcactagtgatctcttgaaatcttatgtgacatgacttgagaatttaaacactttaggctgggcgcggtggctcacacctgtaatcccagcactttgggaggctgaagtgggtggattacgaggtcaggaaatggagaccatcctggctaaaccggtgaaaccctgtctctactaaaaatacaaaaaattagccgggcgtggcagtgggcgcctgtagtcccagctacttgggaggctgagacaggagaatggcgtgaacccgggaggcggagcttgcagtgagccaacatagtgccactgcactccagcctgggtgatagagtgagactccgtctcaaaaaaaaaaaaaacaaaaaaacacacaaacactttaaaaaatcaagtgattaacatatgaggattcaaaaaatttttaatttatgtttcataagttatcaaaatagagtctaataattatctcgtttactcattttctcttttttctcagttacattgtggaattctacacttagaatatccaatttagaatttgtaggtaacaaaaaataaaccatataaatcatttaccagatagatttatttaaaaaaatggttttcaattggagtttcatgtcagctctcaccccttgggtttccccagttgtactctgaatttttcagtggtaaagcacttgttctcttacttcattaacttttaaatagaaatggaaattgctaagctttatgggtttatagcttttaataaaaaataggcattaagaatcttaattttttaatattaagaattaaagctacttaaacatcctgaaattaaaagtgcttcagaaagattaaagggttttgaaatcagcaagccatacaatcaatgcttccatctcctttttcattagattgcaatctctacaggtattttttccagccttcacatgaagtcatacatttatgaagataaaataaagaactttttgattagcccagttccacttttagtcattttgtgatgaatgcggcatttcaaactgaagtttcacctgagtgaaaagagtgccctgactaagaagaggatttgtccaaagtattctttatgaagaactgagtggtttaaataaagatttgacctaagcattagttccaatcaaatgtatcatatgggaggagtttttcaaaggaaagagtattgctatatgaaatggtaagaagagaaggagaggaattgctgacaaatttaaatgttctaaacttctgtgaatgtgtatgtgtaaagaactttaatgtatacaagttcttctgcaaatgaattttaggagattagtaaattaaatttagaaaaaattatactactttgctttatgaagaaaataattacaatattaaaaacagagaatttagtttttcatacttttataagcaaatttactagtcatttaaaatttccacttagaggcataaaagtaaaactgtacaacttttgtcttatttagtattatagatattgtgtgtctatatcacattttccttatgtgaatgggggtttcaaattcatgagactttgtttacaggtaatggacaagatttaggataattataaaacaacactggaaatgtccatcaatttatcatttctgcccaaaagcctttacatacactgcatgttaaacttagatgtccacccagaaataaatcaatgtatttacagccaactgattcttgacaaagccaccaagaactttcagtaggggaaaggacagtcttttcaataaatggtgctagaaaaactgaatatctatatgcagaaaaatgaaactagacccctatctcttactatatgcaaaaatcagataaagatgaattaaagacttgaatataagacctgaaactataaagctactaggagaaaacattgtggaaatgcttcaggacactggtctgggaaatgattgtttggataagacctcaaaagcacaggcaacagaagcaaaactagacatagaattacaacattctaaaaagcttcttcacagcaaagaaaacaataaactcagtaaagagacaacttgcagaatgggagaaaatatgtgcaaactctccatcagacaagggattaataaccagaatatataaggaactcaatagcaataataaaataatctaatttactaacgggcaaatgatctgaataaacatttctcaagagaaaacatacaaatggccaaaaggtacatggaaaaaaaaatggtcaacaccactaataaagagagaaatgcaaatcaaaaccacaatgtgagaggagccaagatggccgaataggaacagctcgggtctacagctcccagcctgagcgacgcagaagatgggtgatttctgcatttccatctgaggtaccgggttcatctcactagagagtgccagacagtgggcgcaggtaaatgggtgcgcgcaccgtgcgcgagccgaagcagggcaaggcattgcctcactggggaagcgcaaggggtcagggagttccctttccgagtcaaagaaaggggtgactgatgcacctggaaaatcgggtcactcccacccgaatattgcgcttttcggacccccttaaaaaacggcgcaccacgagattatatcccgcacctggctcggagggtcttacgcccacagagtctcgctgattgctagcacagcagtctgagatcaaactgcaaggcggcagcgaggctgggggaggggcgcccaccattgcccaggcttgcttaggtaaacaaagcagctgggaagcttgaactgggtggagcccaccacagctcaaggaggcctgcctgcctctgtaggctccacctctgggggcagggtacagacaaacaaaaagacagtagtaacctctgcagacttaaatgtccctgtctgacagctttgaagagagcagtggttctctcagcacgcagctggagatctgagaaccagcagactgtctcctcaggtgggtccctgacccctgacccccgagcagcctaactgggaggcaccccccagcaggggcacactgacacctcacacggcagggtattctaacagacctgtagctgagggtcctgtctgttagaaggaaaactaacaaacagaaaggacatccacaccaaaaacccatctgtacatcaccatcatcaaagaccaaaagcagataaaaccacaaagatgggaaaaaaacagaacagaaaaactggaaactctaaaacgcagagctcctctcctcctccaaaggaacgcagttcctcaccagcaacggaacaaagctggatggagaatgactttgacaagctgagagaagaaggcttcagacgatcaaattactctgagctacgggaggacattcaaaccaaaggcaaagaagttgaaaactttgaaaaaaagttagaagaatgtataactagaataacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaacaaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccctaaatcaacagaatatacatttttttcagcaccacaccacacctattccaaaattgaccacatacttggaagtaaagctctcctcagcaaatgtaaaagaatagagattataacaaactatctctcagaccacagtgcaatcaaactagaactcaggattaagaatcttactcaaaaccactcaactacatggaaactgaacaacctgctcctgaatgactactggatacatgacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattcacaccctaacatcacaattaaaagaactagaaaagcaagagcaaacacattcaaaagctagcagaaggcaagaaataactaaaatcagagcagaactgaaggaaatagagacagaaaaaacccttcaaaaaattactgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctaaaagaaatggataaattcctcgacacatacactctcccaagactaaaccaggaagaagttgaatctctgaatagaccaataacaggagctgaaattgtggcaataatcaatagtttaccaaccaagaagagtccaggaccagatggattcacagttgaattctaccagaggtacaaggaggaactggtaccattccttctgaaactattccaatcaatagaaaaagagggaatcctccctaactcattttatgaggccagcatcatcctgataccaaagcctggcagagacacagcaaaaaaagcgaattttagaccaacatccctgatgaacattgatgcaaaaatcctcaataaaatactggcaaaacgaatccagcagcacatcaaaaagcttatccactatcatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaatgaggtattgatgggacgtatttcaaaataataagagctatctatgacaaacccacagccaatatcatactgaatgggcaaaaactggaagcatttcctttgaaaactggcacaagacagggatgccttctctcaccactcctattcaacatagtgttggaagttctggccagggcaattaggcaggagaaagaaataaagggtattcaattaggaaaagaggaagtcacattgtccctgtttgcagatgacatgagtgtatatctagaaaaccccattgtctcagcccaaaatctccttcagctgataagcaacttcagcaaagtctcaggatacaaaatcaatgtagaaaaatcacaagcattcttatacaccaacaacaaacagagagccaaatcatgagtgaactcccattcacaattgcttcaaagagaataaaacatctaggaatccaacttacaaggcatgtgaaggacctcttcaaggagaactacaaatcactgctcaaggaaataaaagaggatacaaacaaatggaagaacatttcatgctcatgggtaggaagaatcaatatcatgaaaatggccatactgcccaaggtaatttacagattcaatgccatccccataaagctaccaatgactttcttcacagaattggaaaaaactactttcaagttcatatggaaccaaaaaagagcccacatcgccaaggcaatcctaagccaaaagaacaaagctggaggcatcacactacctgacttcaaactatactacaaggctacagtaaccaaaagagagatatagatcaatggaacagaacagagccctcagaaataacgtcgcatatctacaactacctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagacaaaattgacaaacgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaacaaacaaccccatcaacaagtgggcgaaggacatgaacagacacttctcaaaagaagacatttatgcagccaaaaaacacatgaaaaattgctcattatcactggccatcagagaaatgcaaatcaaaaccacaatgagataccatctcacaccagttagaatggcaatcattaaaaagtcaggaaacaacaggtgctggagaggatgtggagaaatagggacatttttacactgttggtggaactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcattattcacaatagcaaagacttggagccaacccaaatgtccaacaatgatagactggattaagaaaatgtggcacatatacaccatggaatactatgcagccataaaaaatgatgagttcatgtcctttgtagggacatggatgaaattggaaatcatcattttcagtaaactatcgcaagaacaaaaaaccaaacaccgcatattctcactcataggtgggaactgaacaatgaaatcacatggacataggaaggggaatatcacactctggggactgttgtgggctggggggagggggaagggatagcattgggagatatacctaatgctagatgacgagttagtgggtgcagcgcaccagcatggcacatgtatacatatgtaactaacctgcacaatgtgcacatgtaccctaaaacttaaagtataaaaaaaaaaaaaaaaacacaatgtgatatcatctcacctgggttaaaattgccgttatcaaaaaggcaaaaagcatggacgttagtaaggatgtggagaaaggagaatgctagtacactgttggtgggaatgtaaattagtatagccactatggaaaacagcatggaggttcctcaaaaaactaaaagcagttgcaccatatgatccagcaatcccactgctgggtatatacccaaaagaaaggaaatgaggatatcgaagaaatatgcactcccatgttcattacagcgctattcacaatagccaagatacagaactaacctaaatgtctatcaatggatgaataaagaaaatatatatttattaatatacacaatgaattactattcagccattaaaaaagaatgaaatcctgccgagtgaggtggcccatgcttgtaatcccattattttattgtgccactgcactccagcctggataacagatcgaaactccatctcaaaaataaataaataaatgaataaaataaaagaatgaaatcctatcattttcagcaaaatggatggaattggaggtcatcatgttaagtgaaataagccaggcacagaaaggcaaatattgcatgttctgactcgtatgtggaaactaaataagttgatctcatggaagtagagagtagaacagtagttgctgggaaaggtggacagggtgggtttgggacatagggggagagtggtggggtggaggtggtggtgttgtgggagatggggatgaagagaggctggttaatgaatatggaaatacagttagatagaaggaataagttctagtactcaatagcacagaagagtgactatagttaacaataatttattgtgtatttcaaaagagctagatttgaaatatttccaacacaaagcaacgataaagacttatggagtaaatctatataaagtatttagaatggcgtctggcaagatatgtgctctataaatttttatcttatacctcttttctcacccctcaccatcttgtcccttatgctttagcattagcacactacttgccttttcacgccactgtgcctttgcacatgttgttccttcgcttagaaagccacaacctgtgcatttaataaatccctgcttgcctttcaaatctcagttcaaacactactttctctgtgaagaaggcctttctttttaactcctgactgacaaagtttctcttctatgtcttcacaggtatctggtatacatctttattataatgagatgagtcatttcccactagactaaaagcttctcaagcatgaaaaaattatttttataccttattttcctcaggacccagtgtattatctgacacacagaaagtattaagatatatatatattgattataaaggaataaaatagtatttccaaatcatctactgttcatgagtaacattgtgctatgaggtatgtatatgtaacgaaaactgtgcaagtacctctattatagtaattactatttgtgagatattgtctatttctccacttgacttacagtctccttgaatggaggttccacgtgttttcatatttgtatctcgaaaagctagcacaaggtctgcaacaaaaaaactcaatggatatttgatgaatgaatgaatgagtgaataaaaatatgattaaatgattctgcagagcagaatcaattcttatgtctggattatcagacaaactcttcagggatggcaaagtcatcacatgctctctggcatctgagcaccatgatggttaataaagaacactaaaatgtatgtctgcctcaataatttgtcaacaaagtcatcttttgtttcctcaactgaaaaactggagatgacagttgctaccatttaaagctttcaaaactgtgctctaattaactgaaagaagttggctgggtgtggtggctcatgcctgtattccccagctctttgggaggccgaggcgggcagatcacaaggtgaggagatcgagactattctggccaacgtggtgaaaccccatctctaccaaaaatacaaaaattagctgggtgtggtggcatgtgcctgtaatcccagctactcgggaggctgaggcaggagaatcgcttgaacccaggaggcggatattgcagtgagctgagatcgtgccactgcactccagcctggtgacagagcaagactccgtctcaaaaaaaaaaaaaaaaaaaaaagaagttaggtgaatataaaggagaccaaaaataaacaaaaaatcctaaaccatctttaggaaaataggcaaaataatttaataaatatatcaacgaagagaaaaacagacaaatattagtgttgacattttggggtaaacaaagttcaaaaatctgtaaatggactgagtgcgtgcatgtgtctgagagggagagaaattacaaatcagaaaaactgtgtttttatattctttttctttctcatttttaatcatattatgagaacatatataagcatacagaaatatttaaaaaatacaatactctgtacaattctataatacattaaaaaatattgatccaaatattccccaaatagtagaaaacctcagaaaacctacatgttcataggcctaagtacacctgaatcaactggggtgtgttcatgtgtgtgtgtgcatgtttgtgtgtgtgtgtgtatgtgttcaaaagtcagaaagtcatagaaaacctcaataggcctttttaaatatagctaaaattttaaagttttcaaatgattacgctgaagaaagatgccaagcacaatttttttccaaacaattctatcttattttcaaagtatagggaattctcatgatataataactgctcaaaggcaaaaaaaattgaaaaagtgccccaggccattttatttatgaagctgccttaagctaatatttaaatctgacaaggatagcactacacacacacacacgcgtacacacacatgcgtgcacacaccacccccacccagtattccttagaaaaacagattttaaaactctaaaaactctagaggctgaatgcaatagcagtttttaatacttccataaaaatgacttaggacatatttcaggaatgaaagatgattcaatattaggaaaattttaaatatagctcatcaacttaattggtcaaaggatacaaatatgtaatcaacactataagttacataaggccagatgtgatacaaattcacatcgactcccaattttagaaaaagaaaaccccattgtagagcataccagaagaacacttaattagaatgaaacatgttttttgagacagctattctttatcttaaacatttgacattctacttatcaatgaatcactagaagcagagttactgaaatcaagatgcatatagtcctagaaaacccagaataatccgaggaaaatccaataaaactgcaaagaatttcattagggtttagttacaacatacacacaacaaaatgattagcttttctatacagcagcagtaggcagaaaatataatagacaaaagcttacattcatgatatcacaatattcatccaaaataaactacctagaattaaccttatatttaaagaaaatgaaatagtttcaggcaagacatttgaaaaaataaggagaggggatattagatgctttctagaaagattcaatattataaaaactttatttttccttagggtaatgtatataagtataatcaaaatcctaaaataaatcatattttctattttgaaacttaaattttgaagtttatttgacaaactagacaaaaatgccaagaaaatattggaaaataataaataaaacacactgtcatatattaaaaatgtacaaagttaacatcgtatgatattgcatcaggaaagaccaaaagattaattggatataatggaatgcacagaagcagactcaaatacatataaatatttggaaaagaaaaggatgtcatgtcaaatcactgggtgatgatttgaaatggcatcattctattcttttattttgttctttattatttagaatatagtactgggataacttgttaactggaagaaagtaaaactgtgtttctatcttacataatacagaaaaatgatttatatagactaagcacttattttatttcaatttccaggatacatgtgcaggacgtgcaggtttgttacataggaaagagggccatggtggtttgctgcacctattgacccatcacctaggtattaagccccatatgcattagctatttatcctgatgctctccctctctccgccccctggacaggccccagtgtgtgttgttcccctccctgtgcccatgtgttctcattgttcagctcccacttataagtgaacatgcggtgtttggttttctgttcctgcgttagtttgctgaggataatggcttacagctagatgaagcacttcttaagtataaagaaatgaaattacaaaagaacaagaaaaagtattgatgacttgaaacatttacgtgtatagcaaagatgaattcttaaagaagagtaatgtatgtgaagaatacaaatttaagatgtccttcttgtaacaaataaaaatcctgctttgtcaaaaaaaaggggagatataaacatatacttgacaaaagaagaaacacaaataggtaataaaaatgttttacgtcattaataatcacagaaatataaagaagtatttacagtcatagaaatacaaaaagtaggtaagtattctggttatcttctgtttgtccctccagattcactctccactggtctccaccttgctttctgccctatgtggcaacctgtttagactgcgtcaagagggactttcaatcctctgctttaaaatgggtacagacaataggaagagtgaggtcacagtattcattcccctagtatattggcttggctgtgtcccttgaccaaaggtcactgtgcttctgaagacagtgctctctacttgcctctcttatctatcttctggtaaccacttattcccttaactaggggtggtaacaggtctgtagctaatatccataatttactccattactgctttcatttccccccaaagtaccatcttgtaattaccatctctaaataaattcattttaagtgtcctaatttgagggtactaattattggtgatggaaagagatacctagtgaatgtataaatcaacattaacttctggagaaaaatgtgtaatatgtattaaaatatgcacatcttttaatctagaaatttcttagaaatttgttctatggacagtcacagattataaaaagttgcacagaaaaaacatttatcaaacatactgtttttcttaaattgtgaaaaacaaaaataatgttaatacacaataaaagaggatagaacaaataaatagcactgaactcatgtaaagaaatcccattcaccaattaaaactatgtttacaaaaaatatttcctaatgaagaaaatgttcaggatatattattaaggggatattatatattatcaagggaaaaaagaccctgtaatactataaattaattatggaccacttttgcgctaaatacacacacacacacacacacacacacacacacacacacaccacacagaaactgcaaaagtggttatttctgagtagtggaattaattttatttttgttcttcctgattttctgtgtttaggttttattcattaatgatgagctacttttgaataattaaaaacataaaaatatgcaacttgttttcaatcagcattattaaactctcttaaatacttcataactatgaatctaattgttttaagataattctgatgaaatgtttacagcaatgtaaaaagactttccaaatgagaagtcatgactatacttataataggtaatagatctggcactgaaaaacatgcagagatgttaaaaagataataaatattatctttaaattcagattgatatggactagctgggtcccccccaaatctcaccttgaactgtagtaatccccacatgtcaaagatagggccaggtggagataattgaatcatgggggtggtttctcccatactgttctcatggtagtgagtaagtctcacgagatctgatgggtttgtaaatgggagttcccctgcacaagctcttgcctgccgccatgtaagatatgactttgctcctcatttgccttccaccatgacaggcctcccgagccatgtggaactgtcagtcaattaaacatgtttcctttataaattacccagttttgggtatgtcattattagcagcatgaaaagagattaatacagtaggccaggcgccgtggctcatgcctgtaatcccagaactctgggaggccaaggcgggcggatcacctgaggttgggagtttgagaccagcctgaccaagatggagaaaccccgtctctactaaaaagacaaaaattagctgggcatggtggcgcatgcctgtaatcccagctacttgggaggctgaggcaggagaattgcttgaatccaggaggcggaggttgcagcgagccaagatcgcatcactgcactccagcctgggcaacaaaagcaaaactccatctcaaaaaataaataaataaaaatacagcaaattggtaccagtagagtgtggtgctgctgtaaagatgcccaaaaatgtggaagcaagtttggaactgagtaacagacagaagttggaacagtttggagggctcagaagaagatggaaaaaggtgggaaagtttggaacttcctagagacttatgaatggctttgaccaaaatgctgatagtgatatgaacaataaggtccaggctgaggtagtctcagatgttgacgaggaacttcttgggactggagtaaagatcactcttgctatgaaaagagactggcagcatttgcccctgcactagagatctgtggaactttgaacttgatagagatgattgagggtatctggtggaagaaatttccaagttgtaaagcattcaagaggaagcagagcaaaaaagtttgaaaaatttgaaggttggcaatgtgataaaagaaaaaccaattttctgggaagaaattcaagccagctgcagaaatttgcataactaatgaggaaccaaatgttaatcaccaagacaatggggaaaatgtctccagggcatgtaggagaccttcatggcagcccatcctatcacaggcctggaggcctaggagcaaaaaatggttttgtgggtggggcccagggccccactgctctatgaagcctcatgacatggtgccctgcaacacaactgcttcagctccagccctggctaaagggggccaatgtacagctcaaggctttgcttcagggggtgcaagccccaagccttggtggcttacatgtagtgttgggcctgtgctgcacagaagtgcacagaagtcaagaattgaggtttagaaatatctgcctagatttcagaggatgtttgagacacctggacgtccatgcaaaagtttgctgctggggcagagctctcatggaggacctctgtagggcactgcctaatggagctgtgagaagagggccacagtcctccaaatctgagaatggtagatccactgagagcttgcactgtgagcctggaaaagccacagacactcaatgctagctcatgtaagcagctgggagtggggctgtaccctacaatgccagaggggcagagctgcccaaggctatgggagcacacctcttgtatcatgtgacctggatgtaagacatggagtcaaaggagatcattatggaacttaaagtttaatgactgccttattggagtctgaacttgcatgagacctgtggccctcttgttttggccaatttctcccctttggaatgggtgtatttacccaatgcctgtacccccactgtatttgggaaatgactaacttgcttttgattttacaggctcataagcagaaaggacttgccttgtctcagatgagactttggactgtggacttttgagttaatgctgaaatgagttaagactttgggggactgttgagaaggcatgattggttttgaaatgtgaggacatgagatttgggaggggccagggacagaatgatatggtttggctgtgtccccacccaaatctcaccttgaactgtaataatccccaagtgtgaagggtggggtcaggtggaaataattgaatcatgggggtcctttcccccatactgttctcatggtagtgaataagtctcatgagatctgatggttttataaatgggagttccccttgcctgctgatatgtaagatgtgactttgctcctcattcaccttccaccatgactgtgaggccttcccagcaaatggaactgtgagtcaattaaacctctttcctttataaattactcagtcttgggtatatctttattagtagattgagaacagactaatacacagaaaaagtccaaaaatgataaaaagagatcattaaataggacaggctttcatgcattcaaggctggaaaacacacaaaagataacatacacaagtcaataaaaaatgttttaggttcactgaaatgtttcattggtaaggcctactctaccatttacatgaagaaatttttaaataaactgatgtttatctacattttcacaaaacatatttagaatttagagaaaagggcccattggctacatgtaagaatatttaggctggtcgtgatggctcacgcctgtaatcccagcactttgggaggccgatgtgggccttggccacttgaagtcaggagttcgagacaaggctggccaacatgaaaccccatctctaccaaaactacaaaaattagccgggcatggtggtgggtgcctgtaataccagctactcaggaggctgaggcaggagaattgcttgaacctgggaggtggaggctgcagtgaatgcagatcatgccactgcactccagcctgggcaacaagagtgagattccgtctcaaacaaaaacaaaaacaaaaaaaaaaacaaaacaaaaagccaaagtaggcatattggtaaggcaggtaacatctttcaaatagctgactaggtactaaatagtttgtttcaacataatgacagtacactttttgttttgaggacaatgtataaaagtaaaactctgagatttttttttaaagtgacgtataatgtttctaggagggaaactggattaatagaaacatgctaatgaccacagagagccaggtacaccaacagcttaaattccttatatttcatttgcatattctgtggtaattataatagcatcctgcacagagaaggtgctaaaaggtttgataaatgaatgtatgtataaaagcatgctgagtgatgttgtccctaaaaggctatactatgctagtctgctataagtgaagctaccaacaaaatctgtccaaggactaactgagaagggacagagtgactctactacttctgactgtcaccccaacatcccttctcctcctatcctttataaggagataggtttggggaagtggggaattgactttgtggaaaacacagtatttaagatacgatgtacttccattcctaaactataggttagagtagtgggcatttttagccactcaaattctccccttgcaaggcaaatgtgtagttcccaggacaatcattgtagagatttgggcatacctaaaataaggcatgggtgacattctacattgcagtggaatgtctacttcagcagaagacattaatttaccttgtacctctctgagcaggtgagaagtagggagagagatggtagtactgacagagtgggtggtaggcacctaccttcttgacttttctttcctaagctgtaaaatgagaatgatgctgctcttctatttacctcacaaaaatactgtgagaatcaaccagtacagtcaatctaaagtgcttggtagactgtagatctttacataaaatgttattaaaattggatcccaaatgaagcaggtttaatttcctgataaaatcgtcttaatatcatctaaatgttgggtaatcattaattgacaaatagttgatgaactagcctgtgctggccattttgagaaagatgaaatatcatttctacctcaaagactccacaatccagttgggaaggcaagactaacaggaatgaattagtaataaaactatacaataataatagaaaatatatagatattttatatataataaatgtatacttgtatacatttacttactcatttaagtcttacaataatcctgagggaggttctattattttattcatattatagataaggaaattcaggtgcagagaaggtaaaaacctgccaaaggcaatataacagtaacagaatcaggattcaaatttggtcagtctggctctggagaatgtacacttaaccacatcactaccctgcctctcttgtaagattccatgtatggaaccaaaggtgcatactatgagaactcagggaaagagtgaaacacaatatgggcagaagtagttagtaatatattggtggagtaagtggcacttgagtaaggaaaaccaagtagggtttggaaaagaagaaaagagaaggaagactgttgtagaagtgggttactataaaagctctggaggagcgcagaaaaatttgataaatagttactgaatacctattaggtaccactcacggtacttgggatatttcaattaacaaaacaaagatacttgttcttataaaagttaaagtcaatgggtgtaaaaatgacaatggagagactagtctcactgaattgaccatccatcctgagaatcagagaaaatagtattgaataggtagacaagtgccagattatgagatctctgaaagacagagaagtctgaggatatagatcaaacttacagatatgtactgcaggatttttcgaggaatgtgtcacatagtaataacagtatcttaggaatattaatttggctgtttttccaagaatgaaatagaaatgggaaaaattaaagggagaaagacttgctagaaagtgtattttattaatatctagattaagtgatggcattggtaatcgagagctttgctcaattctttatctcctttttttattcagtttttcctttactgttatttttccttttctgttatttttccttggtctataaatacatgcaattccatccatctacagtaaacagaaggtaaattaaaacaataaataataaaactactcttcaaggagtgaatcactcccaagctactacctctctacctccttctcatctctattttctccttaccattgtctcctgaactcactgcaacttggtttctgtcatgatacaggaggagtagttcatttggccagaaaagaagtggaaaactggggaacgcttctttgaaaaggtaatatttcagtggagattgaaaggatgaataggagtttgccgtataaataactgggggttttcaagtatagtattctgtgtgaaattgggaaggtacttcgattctatttctaaggcactggttctacctttaggaggtatgctgaagaaatcctctcatttaaagtctttttattctccccctcccccaccaacttaacctggtatgaatgatgcagaaagttcagtcagcatcctattttaatttgaatcctaatttcctgaagcttagttcacaaatagccaatcaaagtttctcaggtttatagcccctactctataaatcactgccactggtctctttcaatataccatgagctcctgttttcatacctccattgcccagcagagagcctggaactcagtagctattcagtaaaattggttagattaatgaaatgataaagaaagaaagatagatgtatgagagcctgtataggaaaatacagaaagagaaaatatacaggagttaaaggtcaaggatgagtgaataatggctcttaagttttgaacatggttgattagaaaaaaagatattaacagtgacagatggcagataaagggaagatatgtttaaatctagatatgtgaaactgagatggtacagtgacacttgtcactgtcaaagatgtggttagagataaaaagtggcatctggaagaagtcatggttagaatatcatattcttggaatgatcagcatagaaattgcagtttaggttatgagaaaggataaacaatttaaagaaaaaagaaaaaaaattgacaaatatctcaattttggcaggcaatctatataatgctgagaaaaatcttaaattgtataatattaataagacttgtaaaaacataaatttgagatttttagggtaatattaatcaattctcatttttccaaatgtttacaataaacagactctaatttcatagtggtaggtatttcaagctcatgcaagagggggtacaggctttgtaaatggcacagactatcactctcaaaggaattttaacaagaaaagttaccttcaaaaactatcaatctacaaatatcattttgatccatatatttaaaacaataaattgtttcagtgacattttcaagttttcatttctccctcttagttttaaataggaagaggtttctattcataaaatttagaaatacagcatctgatgtggagtttgaaataactatcatactctgaaagctgcatagtatagctctcacactagagagaatctcctcccctcaaacagaagagagacaacatacatgaatatgaaatataaagaaaagtagagacagattttttttttcagtgattagagactttatgctaaaacgttcacagatgtactctggaaaaattgtgtacaagctaagcttctgtaaagagagtaattttttctttgctatacggtatcattctggagacattttatctctctgggcctcagttttctcaaatgatgggcaggagtagacagtatttgtacagtcatgtgttgcttaacaaagggaatatgttctaagaaatgtgtcattaggcaagtgtgttgtgcaaacatcatagggtgtatttacacaaacaaagatggcatatatacttatttcatgtattttttaatatggaaaaccaaatgtcgcagaaccattactgaatatcaattatttcctctagttgatctgtaatgccagtatcaattgctatatatcaggtttctgtatatgctctatcataatctcatgggaccacggtcatgtatgtaatccgttgttgactgaaatgttgttatgtgctgcatgactgtattttctattaagtatataattctattaccttattttttaaatttatattcaactggcaaaaggtcccaaaactcttgcttactttctgagacaaaagttaaaaaccaatacataatacttaatgactccactggagtttctatttaaggagattcagaagtgattctaattatgagactcagttaagtgttgttcatgaacatggcatgcttatataatcttagatcaataagaacttgtttatttgaaaagacaaataattgggaaatatttcatacagtttaagtggaagaggttacagtaagtgaagaactctagtgtcactgacttataaggcaaaaacagggtcaaagtggcaatgtagggtggtgttggtgttggtgttgctttgctactaggatatacgtttctattaatatccagaaataattatttaaaataaaaccagaaccaggtaagtttcctacactcaggtgaacaatatgaaaaagttaatgagagcagccctacttagctggataacttctgaaggtagaacttttgataattttcttctgaaatgtgatagagatgctattcacacagcaccgttatggtcaagtttcaatggcaatactgatctggagtttcagtgagtagagtcagctggtgacaagaggtcacagtaatttagttagtagaactgatgttttcatctcaaactctaattttccaaggtacaatcttgaattgggctgctgactatattacccttcactctcacccttatcctcttccttgtatactaaagtgattagtgctagcatttttgctctggtcctccttgtcacttggaatattctccttgcccccacatcactctcctcactagataaccaaaggatgtcaactaaatgatcaaaatactctctggccagacacttattccctgaggaagaaagtctggagatctgcctctcttcattctcactgctgtgccaaatacaaggtaaacaaggtctctaaagtacttgtgatattaactgttattgccatgattgatttctgggaaatattcagctaatatcatgcatcagccaaccatttacatttgaatgcaattaagatgtcccaaataaaggaaaattcaaaagtttcagcaataaacacaaaagactgtttaacattttaaatgagaaggaagagtattcagctgtctctaatctttaatcatttattttaacacaccacaaatcatcccagatgattcttacaagaatatagctacagaagcatcaatgtctacaatgtgtttagctgtgaatactgcaaacttcttttaaataggagaaaaaattctgatttttatgagatcagaaaggttatgtacatgccacagccaaccttaaaaccagagatcatagagatgtactttgagtttgtaatagtatgacatatattatggaatatgaactcataaatttgaatggttcctttctataacattaaattggttggtacacattttttcatattttcttattgaaaataaaagcatctcaggggtaagctaattattcatttaagctctgaataaagttctacattctgaaacacaaattgggcatgaacaagtacaggatttctacaagaaaatataacaaattattttatgtacaaaaagcctgttaaatataatagcagttataatgaattaaaattatcagctatataataagtgaattgtaatagatgtatataatagatgaattgtaatagatgaattacaataatatttattgtagatatattcaattttacagttgttaaattaaaaaaggtcttcatatcttcctgttggtttactttaatatgcaataaaaggtaatctaagacaagaaaaagtatttgataaatggagttatgggcaatatttattgtggtgaagtaaatctttaaaatactatagtgtctataaaatgtacagatacatttcaacacatatattttatttaaaaaaagtttaagttcttttgcatttctggccacattgccagagatatttgaatgtgtttacaggcatttttcatataaataaaataaaatagctattctattgcaaaaccagatgataaatttattggttaaaacacatgaggctactttaattgaaatggtaataatgctacaaataaaaaaaactacatataatcaagaattaaccaacaaatgacaaatgggaatataaagccacaagttggtactagcctctcaagaaagaaaatttaagagtacttattattgtgtatcactagaaacaacaatcacctttccaaacaatccaggtacaaataatgtcttagttttaaatttaactgaaatttattatttaactttggctgaaaaattttcagtaaggtttcattgtttttcaagtctagttaaattttttttttttctaattccctctcaaatcacaggattgctcattctatgaatttctgtaatatctccacccagtggtgatcagagactttaaatatacccttgacttaaaccgaaagtttggtagtttctgataggatcaaggccctccacataaatagaaattaggacagagcctagatttaaagctggctctaaaatcaaaatagtctaaaatggcaaagctcagtaatccatagtcatggcttatatttagttcctattgaataccagacagtgtgttgataagatatatgataaaactctcaagaaatcagaatgcatgatacttttatgacataataaaatttatctctcaagcaaaaagacagcaaaacaatagaaacactgccatttaatgtaagtgtaagataaagatgtccaccattaccattgttatttaatattgttctagagaaaaaggtgaagcaattaaataatagaaagatataagatgtataaaattgaaaaaggtaaaattataatttgtagatgataaatagaaaatttgaatcaaatgaaaaataattacaaataatgagagaacagtaatatggctgataaaaagtaataatggtaatggtgaaaacttgcagagtatttatatataccagcagtatatataaatattctccatatattaactcaatcctcccaataatcctctgaagtatataatattattatcaccattttatgaacaaggaaacaggcacagaaaagtcaagagaattgttcaaggttacacagctggtgtggcagtgctgtgattcaaaagtttaagagtctatgtccttaatcactatatcaaactgttggtgaaatcaacaatctttctatgtatcaaaaacaatcaaataaaatgtaatgaaataagatatcccaataataacaacaaaaggctaaaatatctagtaataaccctgaaaagaattatctagaaaaccttaaaattccacagaggatcctaaaaaggaggaccttaaatggaaagacataccctgtttttggaaaaaataatcatgccataggttaattttcttcatttagctataagtttaattcaatcacaatactaaaataatttttcccaagggataaagaaaaaagaaagctaattctacaatttatgtagaaacacagcaccaaacacatggtataattataatcttaactcttggtactagaaaagtaataaactaagaaatatcattttaaccgaaaaaaggacaaagaaatagcaaaatacatgtgggaatctagtttatcataaaaccatatttagaatcaatgggttatccaagaaaataaagattatttttattaactaattcaaatatccatttgataagtataaaagtttaaaatttgttaattaagtcaaatctgtcaggactatttagcttcgctttgctaagtgttctagttaatttctgtaggatatctaaacaataatctataattcagatagatgtattttggaaaaacttcagtttagcagggtttttaagttgctcatttttggtttggagaacaaaggatgaaacaacatttagcagtaattctctaacagatgtgacaatgctgcagataaaagcttctttttcctttttcattatgtaccttgctttattaaattctgtgttagcacctgtacaaagcaggttgacaaactgaatttttagcagtaagtttatatgtaatttttgaatctcatataacatggcctatttattttgcacattttataggaaatcctgagagaagggctggaataaacagggcatttacatactaggattttaaaatcagtagactcactgaatcctttatataacaactgtgtctgttgttgctagcctttccgtagaattgtgccaaaatccatttctctttaaatgccaaggatgtcagagatacatgaaatgacatccttgaactttaaggctgcataaggaagatctcagtgcaagaccccagatcttcattagcaagttagaattaccctatctgtgcccatcactcttcatgaagaaaatatattctatagactttctggtggaaaaacatcactacaggagctgtctcaaatcaatactgagttaagtcaggctgcaaagaaataaaaactgtcaccagcataaccttcctagcaactgcaatgtgaatatgttaatactgtgtcaaggcatagccctgatgtctgtaggaagcgtgcctttgtttcaaatcagttcagctactagcttgggacaatcctaagtgaaatactatatcctatatcatgacaatgttatttttaccaacgataacaataattcatatttattttcttcttttgtgtttctcatcaagaaatccatcccaacattcttctaccccaaatttctaaatatctctttcttttcttccccacaacccaccaaaaaaccccaaatcttcctcaatacaatatattctagaaatactctagtgcaactcttatctggctctgggtgtttttcctgcccctttttcacttgttgtgcttacagggcactgctcaattcagaagacacttgtgcatacttcaatttctacattgagaaaagtggcatttactcatttgatgatttaggatgagaaaacccagagatttctataacttagaggaagaaaacatttttactatacgagtacaaattatgatttcccgaagataatgtcacaaaaaaggaaaatagtaaatgtctttaaatatagtggcaaattaccatgtaaattttctattttctaagcttcagactgctgcagtgaaaaaaaatttgatttttaaaatcagaaatatttaggttggtgcaagagggactgcagtctttgtcattaaaagtaaaggcaggccgggtgccgtggctcacccctgtaatcccagcactttgggaggccaaggcgggcggaccacctgaggtcaggagttcatgaccagcttgaccaacatggtgaaagctcgtctctactaaaaatacaaaattagccgggcatggtggtgcacacctgcaatcccagctattcgggaggctgaggcaggagaatcgcttgaacccaggaggcagaggttgcagtgagccgagactgtgccattgcacttcatcccgggcaacaagagcgaaactctgtctaaaaaaaaaaaaaaaaagtaaaggcaaaacccgcaattactcttgcaccaacctaacatatgaagaatcactgagtaaaagaaatggtaaccatgcatcgctaattaacagtttctggaccaggaaatagagacttatccttaagttactgtgttacacttacttatttatactctgcctctttccataaaggatttcagacaactattgacttagtatacccttccaaacaatctaatacattttttaaaaatcctgcctttactttctggtgtttgaattaaattatgtcccaaatttggaactgatatactgtgggaaaggaaattgatataaaatgataaaaatcttgttaactgtaaattgaagagctctgtttcgaataaaagttgagtaagttgagtctggaaaataaacagcacagttgtagggggcatggcaggggcattgctcaacttattctcctttgtctgaattgaggatatgttcccagacacctctcctcatgtaccctcaattaccaaggtaattggaaaagatgcagtccatgctactatgaaatggggtctctgaagacctctctgtaattgcaaagcccttcacaagctgaagtgttgaaaagtgcctggcacatggtaggtgtacaataaatgctgaatgaataaaacttaagtcaaaattcttttaaaattatgagagggacaaaaggaaaagtaagtctgttctttttaaaaaaatgattatctttcttttggcttttccttaatctcaagcaatattttctcttgcttctttacatttctcctctaacttgttcatatttttttgggctgggcatggtggctcacgcctgtaatcccagcactttgggagaccgagacaggtggatcacctgaggttgggagttcgagaccagcctgaccatcatggagaaaccccgtctctactaaaaatacaaaattagccaggcatggtggtatacgcccataatcccagctactcaggtggctgaggcaggaaaatcgcttgaactgggaggcggaggttgcagggagctgagatcgctactgcactccagcctgggcaacaagagtgaaactccgtgtcaaaaaaaaaaaaaaaaaggccaggtgcggtggcttatgcctgtaatcccagcactttgggaggcctaggggggcagatcaggaaatcaagagattgagaccatcctggccaacatggtgaaacctcgtctctactaaaaagacaaaaattagctgggagtggtcgcgtgagcctgtagtcccagctacttgtgaggctgaggcaggagaattgcttgaacccaggaggtggaggttgcagtgagccaagatcacaccactgcactccagcctggtgagacagtgagactccatctcagaaacagcaacaccacaaaacaaaacaaaaaaacttgttcatatttttaagttttcaggagaaagaacatttcaatttgtggtgctttccatggcatataacaactgtgtttatactcatgctcacacatattcacatattaacaccatgtaattacaacaagcctaccttggagatatggagggttcagtcctaaaccatgacaaaaaagtgaatattgcagtaaaattagggacttaatttttttgatttcccagtacatatagaagttgtttatactataatctattagatgtgcgaaaacatgatctagaagaagataatgtatgtcttctcttgagaagtgtctgttcatgtcctttgcccacttttttaatggggttgtttttctcttgtaaatttgtttaagttccttatagacatgaacagatatttttcaaaacaagacacatatgtagccaataagcatatgaagcaaatcttaatatcactgatcattagagaaatgcaaatcaaaaccacaatgagataccatctcacaccagtcagaatggcgattactaaaaagtcaaaaaaacagatgctggcaaggttgtagagaaaagggaacacttacacactgtttgtgggagtaaaaatgagtccaaccattgtggaaagcagtagggtgattcctcaaagagctaaaagcagagctcccattcaacccagccatcccattactgagtatatacccagaagaatataaatcgttctaccataaagacacatgcatgcaaatgttcactgcagcactgttcataatagcaaagacctagaatcagcctaagtgcccatcaatgacagactggataaagaaaatgtggtacatatacatatacatgtaatacatatacatatacatatacatgtaatacatatacatatacatggaatactatgcagccacaaaaaagaatgagatcatgtcttttatgggaacatggatggagctgaaggctattatcctcagcaaactaatgcagaaacagaaaaccaaatactgcatgttctcttataagtgggagctaaatgataagaacatatgaacacaaagaaggaaacagacactggggtctacttgaggagggagagtggaaagagagagaagaacaaaaaaggtaactattgggtactgagctcaatacctgggtgatgtaataatatgtataaacccctgtgacacgtgtttatctatgtaacaaatcttcacatgtatccccaaacctaaaataatagttaaaaaatactttattgctaaaatatgctaacggtcatctaagcccccagcaagtcataatctttttgctggtggacggtcttgcctcaatgttgaggacttttaactaatcaaagtaatggttgctgaaggctgaggtggctgtggctacggcagcttcttaaaataagacaacagtgaagtttgctgcatcaatggactcttcctttcacaaaagatttctctgtagcatgcaatgccatttgatagcatttcacccacaaaagaacttctctccatattcactcctctcaaaccttgctgttgctttatcaaataagtttacataatattctaaatgcattgttatcattccaacaatgctcacagcatctgtaccaggagtagattccattctaagaaactttttttgctcattcttaagaagcaactcctcatccattcaagttttaccatgagattacagctactcagtcacatctcacattccagttctaattctagttctctatttctaccacatctgcaatcactacctcagtgaagtcttgaactcctcaaagttatcaatgagggttggaatcaacttcttacaaacaccttttcatattgatattgtgatctccttccatgaatcacaactgttctgaaaggcatctagaatggtggatcctttccaggggatttcaatttactttgcccagattgatcagagaagtcactatctatggcagctatggccttacaaaatgtatttcttaaaaagtaagacttgaaagttgaaatgattgcttcatccatgcactggagaatggatattattgttgcgggaagtcagggaccccaaacagagggaccggctgaagccatggcagaagaacgtggattgtgaagatttcatggacatttattagttccccaaattaatactttcaaaatttcttatgcctgtctttactgcaatctctaaacataaattgtgaagatttcatggacacttatcacttccccaatcagtacccttgtgatttcctatgcctgtctttactttaatctcttaatcctgtcatctcataagccgaggaggatgtatgtcccctcaggaccctgtgataattgcattaactgcataaattgtagagcatgtgtgtttaaacaatatgaaatctgggcaccttgaaaaaagaacaggataacagcaatgtttaggaaacaagagagataaccttaaactctgaccaccagtgagccaggcagaacagagtcatatttctcttctttcaaaagcaaatgggagaaatattgctgaattctttttctcagcaaggaacatccctgggaaagagaacatgcgcctgggggtgggcctctgaactggcccccctgggcgtggccatcttctatggtcgaggctgtaggggtgaaatataccccagtctcccatagcgctcccaggcatattagcaagaggaaattcccacctaataaattttggtcagaccagttgctctcaaaacctgtctcctgataagatgttatcaatgacaatggtgcccgaaacttcattagcaattttaatttcaccccagtcctgtggtcctgtgatctcaccctgcctccatttgccttgtgatattctattaccttgtggagtacgtgatctctgtgacccacacctattcgcacactccctccccttttgaaagtccctaataaaaacttgctggttttgcggcttgtggggcatcacggaacctatcgacatgtgatgtctcccccggatgcccagctttaaaatttctctcttttgtactctgtccctttatttctcaaaccagctgacgcttagggaaaatagaaaagaacctacatgactatcagggcaggttccccaatatattatgttatcattcatgaagacaatatttattttcctgtacatatccatcagagctcttgggtgatgaggtgcactgttataatgagcagtaatattttgaaagaaatctttttccctgagcagtaggtctaaatagtgagcttaaaatatttagtaaaccacactgtaaacaggtgtgctgtcatccagacttggttgttccatttatagaacacaggcagagtagatttagtataattcttaagagccctaggattttggaatggtcaatgagtattagcttcaactgaaagtcaccatctatatcagcccctaacaggagagtcagcctatcttttgaagctttgaagccttgaagccaggcattgatctcttctctctagctatgaaagccctagatggtatcttcttccaactgaaggctgcttcgtctacattgaaaatctgctgtatagttgctagattttgggattacttccttcagcttctccaccagtacttgctgcttcaccctgtacttttacgttttgaagacagttcttttcttaaatcttatgaaccaacctctgctagcttccaacttttcttctgtaccttcctgatctctcatggccttacagaaccaaagagagttagggctttgctctggattaggctttggcttaagggaatgttgtggctgactcaatcttctatccagaccactaaaactttctccatatcagcaggaagtctgctttgctttcttatcatctgttgttcactcgagtagcatttttaatttcctttaagaatttttcctttgcatcacaatttgcctaactggtagaagaagtctagcttttgggctatcttggcttttgacatgccttcctcactaagcttaatcatttctagcttttgatttaaagtaagagatgtgtgattcttcctttcacttgaacactttgagtccattatagggctactaattgatctaatttcaatatctttgtttctcaaggaatagggagacacatgaagagggagaaaaatggaggaatggctggttgggggagcaatgagaacgcacatatttatcacttaagtttgccattttaaatgggctccgtttgtggtgcaccaaaacaagtacaatagcaacatcaaagagcactgatcacagatcaccgtaacagatataataataatgaaaaagtttgaaatattgcaagaattaccaaagtatgacacaaagacacaaagtgggcacatattgttagaaaaatggctccattagacttgcatgatacaagggtactaccaacttttaatttgtataaaacagcaataacagtgaaagtgcagtgatgagaagcaaaacaaactcaagtgtgcctttactgcatatcttctaagttgaagtaatgggtttaccttttactgatttcaagaaagaaaacataaagcagggaatgtaacttttttgagtcctggatagatttctcactctaatttatttccacatgaatgactttagaaattctgttgttcctgtttagaaactgctttcacaaaatggcgtaagaagagtgggggagtcagggagacagaattaaaagagagttgccctttggcagtaaaaataaaaagagaggcttagagagtgagtaggctgagattgttgaatagtgaaaagggctgttgcttttgttcatgaagaaaaagttaacttgcggcaaaaggttagaataataacaataaaacaagtagactagtataaaaatacacacaaaagcacaaaaataacactatgatcacaaatatgaatgccttattgagatattttcccccatatgaataatcatttgtttagttacaaagatatgagttgtgagaaccctgtatgcacatgttgttaagcaacacatagggactttagtaaaaacataagttacaggagatacccctcaatcactgatttagtagatatgatgtgtgcatcgagtcctaaaaatgcactttcaacaactattatagaagatttttgaggaccatttttcagatacattgctttacagaaaatagagtaaaacattagctggaatgaactttctgttaattcactaaaaaaattattcaataccaactatatgctaggggctaagataagcactgggggtacaggggtgaacaagatccaatctctcccctgtgcctggatgtggaataaatgataaaagaaacacaaagataagtatgtaattataatccatgccatgaagacaaagtagaaagagctagcatagttgatgaataaggaactgtgactaaattaactgaatgctttgttgaaatgagagttaacactagtataaccttttttgtagtaactacatcaaataaatacaaatatattgagaacatactatttctcagagctttgaattaagctctgagggtccaatgataagaacagtcctttccttaatgcacccataagttaccagtgaagaaagaaaggtaggtttttatgtatgtatgtttgcttttcaaaacttttattttttatttttcattttttaatttttgtgagtccatagtacgtaaatatatttatgcattacatgagatattttgatataagcatgcaatgcataataataattccatccaggttaatgggagtccatcatctcaagcatttatcctttgtgttacaaaaaatctaattatacacttctagttattttaaaatgtacaattacattacttttgattataatcaccctgtgcaccagcaaatactaggtcttattcattcttttgaactatttttttgtaccaattaaccattcccaattctcaacacacaccccacccccactacccttcccagcctctggtaacaatccttgtactctctatatccatgagttcaatttattttaatttttatcacccacaaataagtgagaacacacaaagtctgtctttttgtgcttgacttattttattgaaaataatgtcctccagttccatctgtgttgtcgcaaatgacagaatgtcattcttctttatggtcttttgtggttgcatataacaaccaattctaaacaattttagaattgtttcttctatttctgtgaagaatgccatcagcattttaatagggattgcattaaatctgtagattgttttgcgttgcatggacatcttaacaatattaattttttcaacccatgaacatggaatctctttcctttttttgtatcctcttcaatttcttgtattaatgtttcatagttttcactgtagaggtctttcacttctttggttaattcctaagtattttgttttatttgtagctattgtaagtgggattactttcctggtttcttcttcagattgtttgtggttagcatataaaaatgcttctgatttttatatatgttgctttttaccctgcaactttgctgaatttatcacttctaatactgttttttatggagtctttaggtttttccaaataaaagatcatgtcatcttcaaacaaggataatttgacttctttctttctaatctagatgccctttatttttctctttgtctaattgctctggctagtacttccagtagtgtgatgaataacagtagttaaagtgggccatgcttgttacattcttgatcttagaggaaaggctttcagtttttccccattcaacatcatgctcattatggtccgtcatgtatggtttttattgtcctgaggtatgttccttctaaacccagttttgtgagggttttttaatcataaaaagatgttaaattttatcaaatgtgtttccagtatcaattgaaatgttcatatggtttttgtaccttattctattgatatgacataacacattaattgatttgcatatattgaaccatcgttacattccagggataaatcccacttggtcatgatgaatgatcttttcaatgtgttgttaaatttggtttgctaaattttttttgagaatttttgcatcaacattcatctgtaatattggcctacagttttctttttttgatttgtgtttatctggttttggtatcagggtaatactggcctcatagaataagtttggaaatcttccctccactatttttcagaatagtctgaatagaattggtacacgttctctttaaatgtttgatagaattaagacgtgaggccactgggtcctgtcatttctttgctggtagaatttttattatggcttcactctcattacttgttgttgatctattcagattttggacttcatcatggttcaatcttggtaggttgtatgtatctaggcatttgtccacctcttctagattttccaatttattggcatatagttgctcgcagcagctgctaatcctttgaatttctgcaataacagtagtaatgtctccttttaaatctctgtttatttggatcttctcgttttttggttagtctggctaaacatttgttaattttgtttaacttttcaaaaaaaccaactctttgtttcattgatcttctgtactgttttcttcatttcaaattaatttatttttgctcttttccttattcttttcttctagtaattttgggtttggtttgctcattttactaattctttaagatgcatcattaggttatttatttgatgtttttcttcttttttgatgtaggcacttatagctattaacttccctcagtactgtttttgctgtacttcataggttttatgttgtgtcgccattataattcatttccaaataattttcaatttccttcttgatttcttcattgacctactagtcattgaagagcatgctgtttaatttccatgtgtttgcataaatttctcttgtaattgatttctagttttattccatgtggtcagagaacatgcttgatattatttcgattttctgaatgttttaagatttgctttgtcttaaacatatggtctatctctggatagagaacatatggtctatctcagaataatccatgtgatgaggaaattaatatgtattctgtggctgttgaatgaaatgttctgtaaatttggtccatttggtctataatgcaggttaagttcaatgcttctttgatgattttctgtctggaagatgtatccagtgctgaaacaagagtgttgaagtctccaggttttattgtatgggttccatctctctctttagtgctaataagttgggtactccagtactgaattcatatatgtttacactgcttatatatcctcttgctgaactgacccatttaccattatataatgactttcttcgtctcttcttagagttttttttttccttgaattctattttgtctgatgtaaatatagctactccagctcttttttggtttccattggcatgcaatatctttttccatccccttatttttagtcaacatgtgtctttataggtgaagtgtgtttcttgtaggtaacaaacagatcattaggtcttgcttttttaatccattcaaccattctatatcttttcattaaggagtttattccatttactttcagtattattgataagaacttacccctgccattttgttatttgatttctggttgttttgagatattctcttccttctttccttccttcctgtcttccttttagtgaaggggattttctattgtgatatgatttaatttctttttattttttatgtatctgtggtgtgttttttgatttgacgttaccatgaggctttcaaataatatattataatccattattttaagctgataatattaacactgtttgcatagaacaaatgaacaagcaaaaagaaaattaaaactctacacttagttcccctactttttagctttttgtttttcctgtttatatcttaaagtactgtcaatgtcttgaaatgttgttgtagttattatttgacatgatttggacatgtctctccacccaaatctcatgtcaaattgtaattctcaatattggatgtggggcctggtgagaggtgattggatcatgggagtcatttctcatggcttaacaccaccgtccttggtgttgtcgtcgcaatagtgagttcttgtgtaaagtatgtagcatctcccccctctcttattcctgtttctgccacgtaagatgcctgctatcactttgccttctgccatgagaaaaatttccttgaggcctccgcaaaggcagacaggtgctgccttgcttcctgtacagtggaactgtgagtcaattaaatttcttttctttataaattacccagtctcaggtattttattacagttatagcagtttgagaatgggcaaatacattatttgtgattgggtcatcattttgtcttcctagttagtataagagtagtttacacaccagagtcacagtgtgataatattctgtgtttttctgtgtactattactagtgagtttttttttttaaccctcagataatctattactcattaaaagtcttttctttttgtttgaagtactgcctttagcacttgtaggataggtctggtattgatgaaatccttcactttttgtttgtctgggaagttttatttctcattcatgttttaatgacatttttggaggatacactattctagggtaaaatttttttttttttcagcactttaaatatgtcatgccactctctcatgacctgtgaggtttccactgaaaagtctgctgccggacatataagagttccattgtatgttatttgtttcttttatccttttaggatcctttctttatctttgacctttcagagtttaattattaaatgccttgaggtagtcttctttgaatcaaatgtgctagatgttctataatcttcttgtacttgaatattgatatctttctctacatttgggaagttctctgtaataattatcactcattaacatcctttttattcaaaggggtaataactttctatccctatctgtgtttctctctcctctttaagtccagtaactcttagatttgaccttttgaagctatttcctagaccctataggtatgcttcattgttttttattcttttctcttttgtctcctctgactgtgtattttcaaacggcctgtcttcaagctcactaactccttctgcttgatacattctattagaggactgtgatgcattcttcagtatgccaattgcactttttcaagtatagaattcctgcttgtttctctttaattatttcaatctcttatgaaatttatctggtagaattctgaattccttctctgtgtcatcttgaatttctttgagtttcctaaaacagctagtttgaatttcgagtctaaaaggtcacatatctccgtttctccaggattggtccctggtggcttatttagttcatttagtgaggtcatgctttcctggatgatcttaatgtgtgtggatgttcatctgtgtctggacattgaagagttaggtatttattgtagtcttcacagtctgggctaatttgaacctgtatttcctgcaaggcttttcaggtactcagaagacttgagtgttgtgatctaagctatatctgtattaacggacaccccaaacccagtaacactattgttcttgcagacttgtagaggtactgcgttcatggtcttagataagatccagaattctctgcagagactgttgttctttccccttactttctcctaaaaaaaaatagagcctctttctctctattctgagccacctagagcttggggtggtgtgacacaagcatctttgtggccaccaccactggtaccacactgaatcagactgaaagccagcatagcactgggtctcgcccaaggcttgctgtcataactactatcatggctactgcctgtgttcactcaaggtcctgggactgtacaatcattaggtggtaaagccagccagggtttttccttcccttcagggcagaagttcctccaggcaggtccagaggtgccatctgcgagccagggacttatgtcaaaaaccttagaagtgtgcctagtgttctattgtactgtggctaagctggcactcaaatcatgagacacagtatttcccattcttccctctgctttccataggcagaagggcctcaccctatgaccaccatcacaaacccatggagagtattgctaggctactgctgatgttctcttaaggcccaggagctcttcatcgagcttgtggtgaatgctgcctggcctgggactcactcttcagtgtagtttccctttggcccacggcaggtccagaaatgctgtccaagagccaagtcctggaattgggggccacaagagcctgcttggtactctacttccctgtggctgagttggtacctaaggtgtaagacaaagctcccttacttttccctctaatgttctcaatcatagtctctccccatagccatcatagctagtaatgtgctgagtttcacctgaagccagcaagtctcagagtggcatactacctgggtatttctactggttattcagggcccaagggcactttattcagtagttgatgggtcctgccaggactgagtccttcccttcaaggcagcaggttcccttctggcccagggtgtgtctagaaatgtctgggagctaggtcctggaaagggggattcatgactctgactggtattctatcctactgtggatgagctggtttccaagatgtaagacagagacctctttattcttctccctcctctccttaagtggaaagaaggtgtcttttttggagccccatgctgtgcagcctgggtttggggtaggggtggtgcaagtactctcttagccactctggctgtgtctcaacaggttacgtgcctccttagtccactcactttaatctaagttaagcactaggactccccaagagttgcagtccttgtggcctacactgcctttgaagtttatttagagccccagaacactttagcccagggtgataaggcttgccagaactgaagtttggaccactgggatgggcaattcccctctggctagagttggtttaaatatcttctctgagggtgggcattagctaagtgcagcctggttttgcattctgctgtaacaggatatcactgagttcaatgcaatgtcacaattcctgctggggggtgggcaaggggtggtattggtgattcaagactgtttctaccctcctcagtgcctttttcagtgacatgaagttaaaaccaggtactgtgagtgctcatctagtttttggttcttatgaaggtgctttgcttgtgtagacagttgttaaattggtgtctgtgcagaagacatgctcggtgaagacttcaatttggccatcttactttgccccctccctatcatttcatttaagaatctatgatacagttcttgatctttaggaatttatgttaaaagagaagatgaaggcagacatagaggccttaaagcagaagtatgtatagggtatacctaaaactgaacgaaatctaatttctgtgctacagcatagaaaaattagagggaacaatactgacagaaaatcttggtaaagttgtcaagggaaatattacattgggacttttagaccatgttagaagtttgaattttattgtcagtataataataagagtcttggtaaacattttgattaaaaaagattatggtagctgaagtctgaaaaatggattaaagataaatgagaatggatgcagagagaccagtcagaaaattgtacaacaggccgggcgtggtggctcatgcccataatcccagcactttgggaggttgtggatcacctgaggtcaggagttcgagaccagcctggccaacatggtaaaaccctgcttctactaaaaatacaaaattagccgggtgtggtagcacatgcctgtaatcatggtgaacatgagtaaaatattgtcagcagaattggagagaagtatacagattaataaacaaaagtttttgattgactaaatttggaaggtaaggcaggagtcaaaaatgaagctactaacctaaatgaagtagttaagttcttagaaacacaaagcttaccaagactaaaatcagaaagagttaaaaaatctaactagatctagtactagcagggaaattgaatcagtaataaaaaatctcctaagaaagaaaagtcctagatctgatggcttaactggtgaattctaccaaatatctaaagaacacaaatccttctcaaacttttctaaaaagctgaagagggtggaatacttcctaactcattgtgtaagcccagcattaccctgattccaaagccatacaaagacactgcaaaaacggaatactaaagacaaatgtcccttaagaatattgaaacaacaatcttcaacaaaatagtagcaaactgaattcaaaagcatattaaaattatacagcatgatcaattgggatttattcctagaatgcaaggatgtttcgccacaggaaaatcaatccatatgatacattacattaacagaatggagagaaaaaaaaaaaacaaccacatgatcatctaaattgataccaaaaaaagaacaaaatcaaactgtttcatgataaaaacatttaataactaggaatagaaggaaacttcctcaacacaataaaagtcatatatgaaaaacccacagaaaacatgctcaatggtgaaaggctgagagcttttcctctgacataatgaataaacaaggatgcctgcttttgggatgtattttcaacatagtactggaagtcctagctggagaaattaggcaagaaaaagaaaagccatccactgaaaagtaagaagtaaataatctgtttgcagatgatgtgatcttatatctaaaaaataccctaaacattacacaaaacactgttagaactaataatggaattcaacaaagtagcaggatacagaaaaaaatagacaaaaatcagttgtatttctatatactaacaatgaacaatcagaaaaggaattaatgaagacaatttgatttacaatagcatcaaaaggaataaaatacttaggaattaaccagggaggtgaaagacttgtgcaatgaaaacaacaaaagaatgctgaaagaaatttagaaagacataaataaatgaaaacacaagccacgtttatggattgaaagatataatattgttaagatatcaatattactcaaagccacctacagattcaacacattcttatcaaagtatcaatgatgtttttagcagaaatagaaagacctatcccaaaattcatatggaatctcaagagacctaaaatagacaaaacaatcttgaaaagaaagaacaaagccagaagactcagacttcctgattgcaaaatttatttcaaaactattgtaataaaacagtatgatactggcataaaggcagacagacatatagaccaacagactagagctagaaataaaccctcctatatatggtcaaataagttctgagaagggtagctaagaccattcagtggggtaaagaacagtcttttcagcagatgtttctggaaaaactgtatatctccatgcaaaagaatgaagctgaactctcacctaataacatatacaaaaattaaatcaaaataaatcaaagacttaaatgtatggccaaaaactttaagactcttagaagaaaacatagggcaaaagcttcatgatactggagttggcacttgatttctaggagatgacaccaaagccctaggtgacagagaaaaaacagtcaaattgaactttgtgaaataaaatattttgtgcatcaaaagacactcaacagagtaaaatggcaacctacagaatgaaatatttgcaaatcatatatttaatatgagaataatattgagaatatatagagaactcctaaaactcaacaaaaaaagaaacaactcaaaagaccttgaatagggcatttctccagagaagatatacaaatggctaagaagtacatgaaaagatgctcactatcactaatcatcagggaaatataaatcaaaactacaatgagattccactgcacatttattattcaaaaaaaagaagaaaaaaagaaaaaaaatcaaaatagaaaagtgttcgcaagtttgagaagaaactgaaaccaacccttgcacactgttggtaaaaatgtaaactgatacagctgctgtagaaaacagtatggcagttcctcaaaaaactaaagatagataacatatgatcctgaaattccacttttggatatatgccaaaaggaactgaaaccagaatcttgaagagatatttatacacccatgttcatagcagcattgtttacaatcgctaaaatgtgggagtaacccaagtgtctactgatgaatgaatggataaacaaaatgtggtatatatacaaaataggtattatttagccttaagaagaaaaaaaaaatctgaccaaaactatatgattccaactctatgaggtacttagagtagtcaaaatcatagagacagaagtagaattgtggttgtggagaggaggggagaataaggaattacaatggaatgggtacagaggtgcagttttacaagatgaaaagagttatggagatagatggtggtgatggttgcacaacattatgaatgtatttaataccactaactgtacacttaaaatggttaaggtggtaaattttacgttgtgtgtatttttatcacaataaaaaaattagaaaagatccctacaaatacaaataaatgcatatatatttaacttaaaagggtttgtacatattcagaaacctatataaactatattagagcaaccagtattagaattcacggagaacaagctaaaaacacaaaggctcagggcctatcttttaaacaagaggggcctcattttttcttagctttcctggagaggataatatacatcaacatttgcaaaccactgttttataaatgattgtgcagagagaccaaggagtgagggtcagggcagaaagaaagaagtaaaaggaaataggagaaagtgtctgacccagtccaataattgtaatgtgttgtaaactaaggagacattattagctcagctatttgcatttgagatatacaaataatattaagtattactaccatgataacatttctgtaccaaggaatggtttgcagcttgttaaccagaattaggtgtgtctgtgtgtgtgtgtgtgtgtgtgtgtgtgtatgtgtgtatgtaagaagactttcaagacatattgctaagcaaaaaaagagagaagtttgggctggagctaataaccggaagccatggtaactgtaggatgcaagtatgaaacatgaaacaacacaaatgctatgattccatttatttaaaagttagattacatgtttccatcccagccactcccaaatctcatgtcctcacatttcaaaccacagttatgccttttctacagtctcccaaagccttatttcagggttaactcaaaagtccacagtccaaagtctcatctgagacaaagcagtctcttctacctacgagactgtaaaatcaaaagcaagttagttacttcctagatacaatgggggtacaggcaatagaaaaatatacccattccaattgggagaaattggccaaaacaacagggctacaggcctcatgcaagtccaaaattcagcagggcagccagatcttaaagctccaaaatgatctcccttgacttcatgtcacacatccaggtcatgctgatgcaagagatgggcacccatggccttgggcagccccgcctctgtggctttgcaagatatagccccactttccactgctttcataggatggtgttgactgtctgcagcttttccagatgcatagtgcaagctgttggtggatctaccattctggggtctggaggatggtggccctcttctcactgctccactaggcagtgccccagtggggactctgtgtgggagttctgacccaacatttcccttctgcactgccttagcagaggttctctgttagggctctgcctctccagcaaaattctgcctggatatccaggcatttccatacatcctccgaaatctaggtggaggttctcaaacctcgatttttgacttctatgcaccaacaggccaaacaccatgtgggaaactgcaaggcttagggtttacacccttagaagcaagggtctgagctgtgccttggcctctttcagccacagctgaagctgaagtcactgggacacaggcgaacatgttctgacactgcacagaatagcagcagcctaggaaaccatttttctgtcctaggtctccaggcctatgatgggagaggctgctgtgaaggtctctgacatgccctggagacattttccccattgctttggtgattagcatttggctcctcattacttatgcaaatgtctgcagctggcttgaatttctccccaggaaatgggtttttcttttcttcacattatcaggctgcaaattttccaaacttttatggtctgcttcctcttggacactttgccacttggaaatttcttctgccagataccctaaatcatctctctcaagttcaaagttccacatatttccagggcaggggcaaaatgctgccagtttctttgctaaagcatagcaagcgtgacctttactccagttcccaaaaagttcctcatctccatctgagaccatctcagcctggacttcatcatccatatcactatcagcattttggtcaaagccattcaataagtctctagggagttccaaattttcccacatctgcctgtcttctgagtattccaagtctctaggaagctccaaattttcccacattttcatgtcttcttctgagccctccaaactgttccaacctcagcctgttatccagttccaaaatcacttccacattttcggtatccttatagcagcacccaactgtaccagtacctatttaatatattagtttgttctcatactgctcataaagacataccccaaactgggtaatttataaaggaaagaggtttcacagttcagcaatgcttggcaggcttcaggaaacttacaatcatggtagaatgggaagcaaacatgtccttctttacttggtggcaagaaagagaatgagagccaagcaaaggagaaagtccattagaaaatcaacagatcttatgagaactcactcactattatgagaacagtataggggaaattgcccctattattcaattactccacctggtcctgtccttgacacatgggaattactacaattcaagatcagactttgggtgggaacacagtcaaaccatatcaatctctgtctgggaatttgtttgcctttcttcttctctacacttggaatatagaaagaaaaattcatattttaatccaggaaatcaaggtcttttgatatcctatccccaaatccaactatcccttattttcttatgttggattattattattatttgcttattttttgggccaatggtagaataagattatacattactatggaaaaacaaatttcaaaagatatgattttctataaaatgtcttctacttaacttctagagggctgatacattttacccctacatgtagctgccagggtttctagtcttcatctttcactaaaattgtgcctatcataatagctctaaaattgcctacagaacattagataatggcagaagaattgaaccagtaaaaagaacagatgcaaagctaacctttttgttttcaatgcatctattgctctaaataatttcagcagacagtgtttagttctcctttaggttaacattttaccctcaatatgttagcaaaaaaaaggatacataattgtacttttccttatacttactgtaaaaagatttcttcttatttaagagtaggtatgcagatgattgcatgagtatatgttaatgtattttctagagaaatagagaaaaattaaaaaatgcttgaaaagccaagtgtacagtaggatatgatatatattaatatatatgtttcaataaataagagtgaaaaacacatttacagtactgataaaatggcaatttataagttaacttgtattaagtaaggtttctgagtctctttacctctaaaatggggatcaaacatctcagagatttgtttagggggagataaaaataatgtatctgggtacctgaaaatcataaagcactgtggtgttatttttaaactgttcataatctaaaaagtagtgttgttattattgagatgaaactttgtagactggcatttatatttgaattttggaaactatttgaaccaaaagtataaaaatgtgctttaaataagattttatctacagtaaactcatgtttaatctatactgaaagcataccttataaactgaaggtaatgcaataaatgctatcatttttatggtaatagtatatacaagcagttagcattatgtaaataaaaaaattaatttaataaaatcttgggttagtatatgtattcataatgaggtattcaaagaacttaacaataattattgctcatttacatactgcatgtaagtaataccagtcataaatatgtgattaaaatttaacaaagaaatagattttaaaaaatcaaagattaagtagagattttcccaaaatacattccgttcaaaaacattcaatctattaaccaagattacatatctttacttattattttcttcaattaataaacttcagtcagaattctcaagcagttttagctatttaagagaaaactgatgggaaagactttggcactagatgaaataattattttggcaattctttagtttagggatgaaaatagtattaagactaagaagtaaaggtcaaagtgaaattttaaactgaatttactgaggtaaaactgccagaaagattccttctttgaaaagccagcctccctaatccttactctccacactgtttttatagtggtttctaaatgtaaagtgatagtaatgagctaacatagctgaggaaaaacagaatactagaacatcatgtcctttgtacagattatttagatatagaagactgtcataaagttcttgggcagactgcaaagtaaaaaaaattaactgttaattactaaacttgtaataatgattttttactcttttggagtgcttattatgtactagacactgaattaggagctttacgtatatcattattaaagtaaccctgccagggtggtattattttaagtatgctaatgattacaaatagggaactagagaggttatgtgaattattcaagattatatgaagaaaaaggaacaggcttgaaatttgaaaccaagtccatctaacagcaaagctcatgctttttctattataaaactctgcttcagggaataaatacaatagatgcatgcagaaatgaaagtaaaattgatttttcttctaatatccacttttaaccttccattctactagtaatagagtacaatttatctcagtttataaaagccgcttttaaaatctgtttttgactcagacataagaatatataatatgaacctgaattctgattatgctaattttaataaatattctttttacagcatgcatacattatttttgtatctgctttctattatactaatatatttgaaccttcaaataaacaatattaaaaatgtagacatttcagataaaaaagaacaaaaatcaaaaatattttatgtacagaattctataaacataaaaaattaaacaaaataggtacttttagaaaaaattttgagaaaataaacatgttaactaaatagaaatacttttcaaacaacatgaacttacagaagtggtttttcagacaagtttcctcaatttatgtaaaagaggtaattccttttatagaaaatgattaaatagcagacaggagaaataaataaaatttaaaaaataatttcaacttttattttagatttaggagtacatgtgcaggtttgtcacaagggtatattgtatgatgctgaggtttagggtgattcctgtcagccaggtagtgaccacagtacccaataggtaatataatcttaagaccaaagcctgacaaggacaaaaagcaaaagaaaattatagacttatctaatctataaacataggtgcataaatttttttaaaaactagcaaatcaaatatagccagtatgtctttttgttagtgaccaagtagactttatctcaggaatgtaatgaccattaaatataagaaactgtaataatataatacattatcacaataaaagatgaaataatcccaaattaatacaaaataagcatttgataaaatttaacattcatgataaacactcaaatacagaaaagatggtacaataattgtctcaataaagagtataaaaaacgtcaaacttaaatgatgaaattagaagcattttcattaaactcgggaacaagtaagtctacctactcttaaactagaggttctgtccaaagcaatagacaataaacaattggaaacataataacttgaaagaaagagataaacttattcatatatataggggtgtgtgtgtgtgtattatatacacactgtatatatatatatagagagagagagagagaactatatatatagaactgtatatatagaactgtatatatatatatagaactgtatatatatatatttatatatatatacaattggttgaattcgctacaagctattagtcttagagaatcaataccaacatacttagacacgaaacagaacacctttaattaacacataggtcaaaatattaactaaatggaaatgaaaacacaacatcaaaattggtggaatgcatcaaaaacaatgctcagaggaaaatgtacagctttgaatgtatatattagaaataagggaagttctaaaatcaatgatctaagcttccaccttagaaaactagaaaaagaacagcaaattaagttcaaagtgagtagaagaaaaataaaaatcagagcagaaatcaatgaaattgaaaacagtaaatcaaagagatcaatgacaccaaaagctggctccttgcaaagatgaataaaatcaataagcctttaaccagctaagaaaaaaaagattattcaaattacaaatagcagaaatgaaagagatctcagtacagatcccatagacaataaaatgataacaaaggaatactatgaaccattctatgcccataaatttgatagcctggataaaatggcttgaaagacacaatatgacaaaacttatatgagaagaattagataatctgaataggcctgcatctattaaagaaattcaatcaataattaagaacatttccaaacagaaagtatcagacccagatgaattcactggtaaattctattaaagactgaaggaagaaattatgccaactgtctacaatttctttgagaggacagaagcaaaacgaatatgtcctaactcattctatgaggccagtattaccctaaatactaaaactagacaaagacattacaagaaaacagtatctctcatgaacatagataccaaaatcctcaacaaaatattatcaaagtcaaatccaacaatgtataaaacaaattatataccatgaacaagtagaatttatcccaggcatgcaaggctgttttaacatatgaaaattaattaatgtaattcttgcaccaacaagctaaagaagaaaattcacatgatcatacaaatagatacaggaaacacattctacaaaatccaacatgcattcatgataaaaaatctctcagcaaattgggaataaaagagaccttactcaacttgtaaaaaacatctacaaaaacctacagctcacacaatactttctggtgacaccctagaagccttcctgctaagatcaggaacaaggtaaggatgtcctctcaccatttctttttaacattatattagatgttgtatctaatgcaataacacaaacaaagaaaataagaggtgtactaattggcaaggaagaaataaaactgtccatttttcaaataatgtgatcatatatgtagaaaatctgaaggaactgagcaaaaaactggagctaataagtaactacagcaaggtagcaggactcgaagttaatataaaaggtcaaacgctttcctgtatacctgcaatgtacaaatggaatttgaaataaaaaataataccacttacatcagcattcctcaaaatcaaatacttagatataagtctaactatatatatataagatctaaatgagaaaaactataaaaatctgatgaaagaaatccaacaactagataaatgaaaaaatattccatttcctggataggagactcaataaaggttgaatatctctagttccaaaatccataatccaaaatgttccaaaatcggaaacattctgagtaccaagatgatagtcaaaggaaatgctcattggagcaatctggattttgtatttttggattaggaatgctcaatcagtaagtataatgcaaatattccaaaatcagaacaaataaaatatctgaagcacttttggtcccaagcatctttgaaaagagacaatcaacctgtattgtcaacagttcttcccaaattgatatgtagattcaatgtaatcccaatcaaaatagcagcaagttattttgtaggtatcaacaaactaattttaaagtttatttggaaacaaagactcagaataaccaacacagtattaaaaagaacagttggaggactgacacttctgagcttcaagacaaattataaatcaaaacagcatagtattggcaaaagaacagacaaacatcaatgaaaaagaatagagagttcagaaatcaacccacataaatacaaccaactaatctgtgaaaggaacaaaggcaataaaatggaaaagtcagtctttttaacaaatgtttttctgctataaagaggatataattcaaaatttgaaacaaagaaactattaaataagtttgtatttagaactgctgaatttcaaagtttcaagctatcttacaggtcatctagaacagtgttcctcaacttttttggcaccaaggactgtcttcatggaagacaatttttccatggacccagggtgtggcagatggttttgggataattcaagcatattacatttattgtgtactttatttctattattattacatcataatatataatgaaataattacatgactcttcataatgtacaatcagtgggagccctgagcttgttttcctgctacttaatggtcccatctggggataatgggagatagtgacagatcatcaggcattagattctcataaggaatatgcaacctagatccctcacatgcgcagttcacaagaggatttgtgctcctatgagactgtaatgctgctgctaatctgacaggaagcagcgctcaggtggtaatgcaagtaagggagcagtggccgtaaatacagataaagctttgctggtgtgcctgccattcacctcctgctgtatggcctggttcctgtgactggtaccagtctgtggcctgggggttggggatccctgatctagaacaacatttaccatttactgacaaattagttctctcaccaaaattcattacatggaaatatcttcagctgaatatttctagtatttgagaacttactttcttccaggcaggcagaagacaactactacttttggaaaactataatgcaaatatttatttataagtgtgggttcttattcttttctctctcaggatattttagaaatatcttataatctttcatatatatattcatttagctgtttccctctctatcatctgtatatctagaggcagagattgtaattattgaaattgctctgtattcaatcataagcagggtcatgtttataagtgaccttaatataatttgattgtgatggaaatatatgaacaaatgaatgtacccatatatttggggacataaataaaatcatagaaagtgccatatctgaaaagcaatacatacatattaacagaaattcaatttcgtggaaataattatgatactatgataatattagaatattcgaaatgtatgaattattataactgaaagctttgttgaccatatttataaactgtgtttagtaagaatgataatgttgaaacacctacatggcatagttttacaaatgctgtttcttctgtcaaccaacaataagttcctgctctattaacaactctttttctatttttttaattctttctttgcttctgtaatctctcactatataaccaattgatatataaacagatactacaaatgcatacaaaaaaagcaaaacttgctacctggaggagtacgtcaaaataatcttcctaactctataaccaaatagatataatggttttctggaatatttctatgaatcaaatcatgtgttagaaaatatctacattaaaaggacataaatgacaccattaagaacaataaagatactagggtatattaattttaacatccatctccttttagagtttgtaaactaaatccgcaaatacataccagatctgtctttggaggatctggacactcagcagagaaataaggtgccgaacttctgcctccactgctgtcagaagatggctttggaggttgagcatgctgtctgtaagtagcacttttaggagtccaacaaaacaggttgatagattctctcacacagcgttcaatgtcaatttctagatagaaatgttttaaaaaagcaaatgtatagaatttagattgctcttttaatgtaataaacaccatctctcctaagtgaatatatctaaatatggctaagatgataagttattagaaaaaatgtcagtaaaaaaaacaatgtatatattaatcagcatatttatgactggattgatggaaatatttggtataatttgcttatatatatttgtaaatgtatctacttatgttttcatgtgtgtcttttacttggaattatctacatatacatatgtatatatttcagagtatcattatttaaatgccacagaatagaacacatctccttatttaaaaatctgccaaatttatgctgatgtttccacttttccaatgtgaaacaaaagttatagggggagaatacaatttgggaataggtagacaaaagatttagaagatgttgattgctgattcagaatgaattctagtaaagtgaactgacagttttactgccattaaataagatataaaattatcagaaaaaatttttcagaatctcaattcagcatttctcaattttttttttcctgtttttgagatagagtcttgttctgtctcctaggctggagtgcagtggtgcaatcacggctcactgcaaccttggcctcccaggttcaagcaattctcgtgcctcagccttcctagaagctgggattacaggcctatgccacaacacccggctaattttttgtatttttagtagacatggggtttcgccatgttgcccaggctgttcttgaattcctgacctcaggcaatccacctgcctcggcctcccaaaattctagggttacagggatcatccaccatgcccaactagcatttctccattctttaataatctcttgagttaaatgaagaaaggttttaaagtttaatcaagtaaggtttaaatgcacttgactaaaagataaaatagaaacactttcatattagatttccttttgtttctcatgtttgaaatgtaagcatctttaatgcagaggtaatatacatagaaaggttactacaactctatattgtttgtgttttggatgagactgtatctctttaggaggccaacagtcctgatgagaagttagccagtcctctatggcgaaagtagaaagatcacagaaaggcggagaaattcaagaagttgactgtgatggagtttagcactgactagtttttatctttccatatttctaaaagtacaaatggcatatattctcatttcctctgtaaaagtccaagtgtcgggctcaggcaggcaatggagaaaaatatattacatgtcagaaagtggtaagttctttttttctccccctctttttgaaatgaagggcttgtaaggggaaaaggaaataggcattaagtaaattctgtggatagtgcatgagtaatcatttagagttatctgctgtggtaaggtgaagaaatctggaagagggaaaaagaaggtaacactgaccatctattatgtgacaggtattgtatactttcacttaatccatttaattcttacaatgattttattaaagacaggtatcgtaattcttcttcccaccttctatttctgctaaagacaaagaaactaagacacaaggaagttaagtgatttgttaagtatgttactatgagtagaagtctgaagttactataaggttataaggcatcttttgttacttcctaacttagatttggaatatgaaaagatagtctgataagaccagttactcaattaggcattccttagtgatgtttaccaacttcacagctcattacttccatggctacaaaaagaggtcagatttcatcacctcatatgctattcctaatataaaaactataaaacagagtgaaacaagctttgaggcatgggcctatttatttgggcaatggataatatagtgaagctctctaacaatatcaacttgttatttcacaaagaaaatacaaacacaaactagaagaaaaatcaaggtttaagacaggtttctctagcctgtttaagaaaaaagagatagcacaattcattttagaaaactttcaattcaaatagttaagataaaaatttggcagctaatgagagaaaatactcaaccatctaaagtctgtctacttaacacagtttagtttccaaaggaaagggtttcagtccatagattttgtatttgcagggctcaaatcaatttgacacatctgtcaccagcaaagtttgaaggtgagtcagtgatctagagtaaaggttgtagtgcagtccttcaatcactggcattggaaaagttatttttatctgcttccaagacatcccatcaacaccataaaaggtttacagtgaatcttgatgatgtactggcatccatcccgattctaccctgatggttagttctaacagatatctcattttccatttcacttgactcatgtcacctctcatctcaaaacccttccaaagcacattatcataatcaaaatataatgcaaaagtactttgtgaagtgtacattaaaatgcacaattactcctacaaagtaatctctcattacatggcactactgttttttaaccttgcattataattattgagacaatgcattgtgaataaaacatggattatggtttcccaggtttgaattaaagctccatgaggtattttgcaactctgggtaaaataacttctctaaatctattaatttcttcattggcacccattagtattagatctttcagaaatactgaactattttcaatatgataaacacaaccatttgggcaaggatagatggaaaagacagctttcctgagcctgctcttctctcactttaatggctataaattccttctgaaatttattgcatagctattgtcctggaacttctctttaccattatccaattctcttaggctatcccctatatttgattcctaactttttgggtaagacattatttaccactctttcatatttacttctcattttgatgaaacacattatccagcagctacaaagaaagagtacacaggaggtaaactattcaaaaaccttcaatgaatatcattaatctgcccttgactgatagtttgaccagatacagcattctagggttgaatttttttcttctgagttattaaaggtagagctccaatgtctgctgctgagaagtctgataaaattctgatttaggattatttgtacatgattttctgtttctctgttaagttttaggatccctgtattatgaaatttcatggtgatatacttacgcatatacttcattgtgctgggcatttggtggatccctgagtagtccttcagttacacaaaaagtatgtttttgatgtttgtgataatttgtttctttttaaatcttctattctataagaatcttgaacttcctgaatttaatttctaataattttgtcattttgttcttactttccacgtgtatttttgtttcatactctgtgagatttcctaaattttatcatcttacattttcatcacaaacatcattgcatttctatatcaatttcaatttccaggccaggcacggtggctcatgcctataatcctagcactttgggaggccaaggtaggaggatcacttgaggccaggagtttgagaccagcctggccaacatggtgaaaccctgtctctactaaacaaaaatacaaaaattagccaaatgtggtggagtgcacctgtaaccccagctacttaggaggctgagacacgagaattgcttgaacctgggaggtgaaggctgcagtgagcagtgatcacgcctgtatcacgcttgtactccagcctggctacagagcaagactctctcaaaaaaaaaaaaaagaaaaaaaaatcaatttccagattttcaacaattttcattgttatgtttaaaagttctgttttttcatagttaattttctcatagttatctttctgaataaattattttttcagtttatactattctgtatcttaattggaagctttcctcagagattttgtgatctttgattctacatatttacaagaacagcaccaaaaatcagattgaatttttttttttttttttttatgtgggctggggttagtgactggtggattaactataaggtaatttggggacatggttattttgttagaagactcctaagtaagatatttctccttctgggaacattgagtttttccagataattctctgatcttctaagctcatccttgccagccttcccagatatgaccataggaggggcctgtataactatatacattcactcactcctgctctctgctatgcctattggctctgagtctcaagactcagtgactctactactccagagaatgcctctccatatttaccattaaaatggtcacttttgtaaaatttgacaaagtaaaaatatttcaaccacaacaatgaagaatgctgcctctttctacaccaaattctctccattatacttccttgatattgggcaacattacaatggctgtgcatgctctacatataactaagagtaagctgaacatatttactttggtttaataggtcatatttttgttatctgaagtaacttctgggtattgacaaagatgctctccttaaccaaagtctagccaggctccttagagcccttttttgactagggtccaaactttgcctataaagacttgaacaaaacatgaagatggcttggtttttctactttactgttatttttaaattaatacataaaattgtacatagtttatgtattaattaaatatggaatacatgtgatattttgctatatgcatacaatgtgtaatgatcaaaacagggtaatcagaacatctaccaattcgaatatttattttcttatgttgggaacattttaaatctagctattttgaaatatataacaaattattgttaactatagtcatcctactgtgctgtctattgaacaacagagcttattccttcggtctaactgtattttgtatccattaaccaacctctctcttcatccccatcccccagcccattcttcttagcctctagcaactatcaatctactctcaacctcaacttatttagtttcccaagtatgagttagaatatgtgatactgtgaatatgacatagtctttctgtgcctggcttatttcacttaatgtgatgacctccaattacatccatgttgttgcaaatgacaggatttcattgccttttatcgctgaatggtaattcattgtgtttttatgtacgttttctttattcattcattcattgatagacacttaagttgattctgtatgttggctattgtgaatagtgctgcaataaacatgagagtgcagacatctctgcgatatcctgatttcctttcttttggacatatatccagcagtgggaatgctggatcttatggtgcttctatttctacttttttgaggaacctccatactgtttttcatagtagctatactaatttacattcccactaacagtgtactaacatcccactttctgcaccatctattatttttctcttcttcgtaatagccttttaaacttggataaaatttcattggggttttgatttgcatttctctgataattagtgatattgagtactttttcatatacttgttggccatttttaagtgttttttttttttttaaatacagggtctcactaagttacccaggttagagtgtaatgactacagacatgatcatagactatgacctacgacaagcctgaaacttctgggctcaagtgatcttatatcacagcatcctgaatacttgggactacaagtatacaccatcacatctgtctctatgtctccttttcagaaatgtctattcagatcatctacccgttttttaaataggattgttttttggctattcatttgagttctttatgtactctggctactaatcctttgttggttgaagagtttgcacatttcctcccattctgtaggttgtttcttcactctgttgattgtttcctttgctgtgaagaattttagcttgatgtaattctatttgtctactttggctttggttgcctgtgtttttgtggtctgacctcaaaaatccttgcctagtagatcaatgttgtgagacatttccacaacgtggtctagtagtttcatgtcttacatttaagtctttaataaagtttgatttaatttttgcatatggtgagagacaggggtctagtttcattagtctgcatatggagatacagttttcccagcaccatttattaaaaaaaacctgtcttttccccaatgtatattgttggcacctgtgtcaaaagtaagttggctgtaaatgtgtgaatttatttctgagttatctattccatttcattggtctatgtgcaggtttttatgtcagtacaatgctgttttggttactacagctctgtagtatatttgggaattagtgtgaggcctctagttttcttccctttactcaagattgcttttgctacttggggtcttctgtggttccataaaaattttaggattattttttcgaattctgttaagagtgtcattggtattttgatagaaattacattgaacctgtagatcactttgggtagcatgaacatgttaacattattaattcttctaatctataagcacatgatatcttttcattttttattgccctctataatttatttcattagtgtttgttctcattgtggagatctctcacttcttttgttaaatttgttcctacatattttattttatttgtagctatttcaagcagaactgcttccttgatttctttttcagattgttcactgttggtttaaagaaatgctactgatttttatatgttgattttgtatcccaatttactgaattcgcaaatctgttctaacagttttttggtgaagtcttgagggttttccaaatataaggtcatgtcatctgtgaaaaagaataatttgagttctttctttccaattgaatgtgttaatttttttttctgttgcctaattgctctgtctagaatttccagtactctgttgaataaaagtagtgaaaggaggcatctttttcttctagattttacaaaaaagcctgttggtttttccctattcagtgtagtagctgtggggttgtcacatatggcctttattgttctgaggtgtggtcctcttatacccagttctttgagaatttttatcatgaaggaatgttgaattttatcaaatacttttctagtatctattgaaagaatcatatgggttttgttcttgatcctgttaagtgatgtagcatgtttattgatttgcatatgttgaatcatcactgaattcctgggatgaatcccccttgaccatggtgaatgatttttttaacgtgttgttgaattcagttgcttgtatttttgttgagaatttttcatctatgtccatcagggatattggtatttagaatgagtttgaaagtatcctctcctcttcattttttttttaagaatttgagagaatttgcattagttctttcagcaacataggcatccactgctggacttttctttgatgggagacttttttattacagctgcttatcttgttattaattgttgatctgttcaggttttctatttcttcatggttcaatcctgctaagctgtatgtgtccagaaatttattcatctcttcatggttttccaacttgttagtgtatagttgttcataatagtctctaatgatcctttgtaattctgtagtataatttgtctgcattctgtagtaaaatgtctcagtttacataagattttatttatttgggcctagtcccttttttgctagtctagctaaaggattattgattttgctaatcttttcaaaaaccaacttttccttttgttgatcttttgtattgttttcttagcctgaatttcattcgtttttattctgctctttattatttttccttctaccaatgttttgtttgttcctgcttttctacttccttgaggtgcattgttaagttctttatttgaattatttctacttttctgatgcaggtgtttactgcaataaactaccctcttagaactgtttttgctgtatcccatatattttggtatatttccattttcatttgcacattttctgttaaatacaggaatactataatttcctttataatttcttcattgacccatttgctattcagaagcacatcatttgatttccataaatctgtagtttctaatgttccttttcttaatgatttctaattttattccattgtgatctaaaaataaatttgatataattttgatttttgaaaatttaagacttgtttcgtgaacacagggtccatcttggagaatgttccatgtgcttttgagaaaaatgtgtattctgcagctgttggatggaacgttctgtaaatgtctgttaggtccatttggtctacagtacagtttaactccagtgtttctgtgttgactttctgtctggatgacctgtgtattgctagaagtggggtgctgagtccccttctattataacactgcactcaatctctctctttaggttaattaatatttgttttatattctgatgctccagagttggttgggtgtatatataattgttatatcctcttgctatattgacttttatcatcatataatggacttcttttgtcttttttaaaactattattgaattaaaatctattttatctgatatatgtacagttgcttcagctctctctatagtttctgaatcttctctcatcccttcacttttagtctctgcatgtcttcaaaggtagagtttcttgtagacagcatatagttgtgtctttttttttaaatcaattcagccattctagctctttttattggataattaatttaattggataaattaaacctatttatattcaagattattaataataggtaagaatttgctactgttattttattacttgctatttgcttgttttgtagacactttcttccttttatcctctcttaaagtcttcctttgtggttaggtgattttctctagtagtatgttttttttcctccttctttttattatactttaagttctgggttacatgtgcagaatgtgcagttttgttacacaggtatacatgtgccatggtggtctgcagcacccatcaacccgtcacctacattaggtatttctcctaatgttatccttcccctagcccccaccccgcacaggccccaatgtgtgatgttcccctctctgtgtccatgtgtcctcattgttcaactcccacttacgagggggaacatgcagtatttggttttctatcttgtgataattcgctgagaatgatggtttccagcttcatccatgtccctgcaaaggacatgaactcatcttttttatggctgcatagtattccatggtatatatgtgccacaatttcttaatccagtctatcattgatggacatttgggttggttccaagtctttgctattgtgaatagtgccacaataaacgtatgtgtgcatgtctcttttttgtagaatgatttataattctttgggtatatacccagtaatgggattactgggtcaaatggtatttctagttctagatccttgaggaatcgccacaatggctgaactaatttacactcccaccaacagtgtaaaagcattcctatttttccacaacctctccagcatctgttgtttcttgactttttaatgatcaccattctaactggtgtgagatggtctcattgtggttttgatttgcatttctctaatgaccagtgatgatgagcattttttcatatgtctgttggctgcataaatgtcttcttttgagaagtgtctgttcatatcctttgcccattttttgatggggttcttggcttttttcttgtaaatttgtttaagttctttatagatgctggatattagccctttgtcagatggatagattgcaaaaattttctcccattctgtaggttgcctgttcactctgatgatagattcttttgctgtgcagaagctctttagtttaattagatcccatttgtcaattttggcttttgttgccattgcttttggtgttttagacatgaagtctttgcccatgcctatgtcctgaatggtattgcccaggttttcttgtaggatttttatggttctaggtcttacgtttaagtctttgatccatcttgagttgatttttgtataaggtgtaaggacggggtccagtttcagttttctgcatatggctagccagttatcccaacaccatttattaaatagggaatcttttccccattgcttgtgtgtgtcaggtttgttaaagatcagatgattgtagatgtgtggtgttatttctgaggcctctgttctgttctattggtctatatatctgtttttgtacagtaccatgctgttttggttactatagccttgtagcagagtttgaagtcaggaagcatgatgcctccagctttgttcttcttgccaaggattgtgttggctatgtgggctcttttttggttccatatgaagtttaaagtagttttttccaattctgaaaagaaagtcattggtagcttgatggggatagcattgaatctataaattactttgggcagtaaggctattttcacaatattgattcttcctatccatgagcatggaatgtttttccattggtttgtgtcctttcttatttccttgagcagtggtttgtagttctctttgaagaggtccttcacatcccttgtaagttggattcctaggtattttattctcttagtagcaattgtgaatgggagttcactcatgatttggctctctgtttatgtgttattagtgcacagaaatacttgtgatttttgcacattgattttgtatcctgagactttgctgcagttgcttatcagcttaaggagattcggggctgagatgatggggttttctaaatatacaatcatgtcatctgcaaacagagacaatttgacttcctctcttcctatatgaataccctttatttctttctcttgcctgactgccctggccagaaagtccaaaactatgttgaataggagtggtgagagagggcatccttgtcctgtgccagttttcaaagggaatccttccagtttttgcccgttcagtatgatattggctgtgggtccgtcacaaatagctcttattatgttgagatacattccatcagtacctagtttattgagagtttttagcatgaaaggctgttgaattttgttgaaggccttttctgcatctattgagataatcatgtggtttttgtcattggttctgtcttataatgtcttatgacatcgaactatcccaacaataacacaatgaaattatcactgtagaagaagactgaaaattataaagttccttatcttattagtggagaagaaagtagagggaataaaatatgcatattatgaagcactctctgtaaggtaaggtctaaggacaatactctgacaccttcaagttgacagcacatctatcactacttaatgtactgacataaaataaaattatagtggatagaaatggcatagaattagtcttccaacaaagaattaataaccttgagtaactcactgatccacgtttaaggactgttagtagtaagtatcaactacacttcaaggaatacagcatagaatgttattacttaagagagaattctaaaatattagaaatctctcaggactttgtcatataatttattttggtaaagagctaaattcaataatactcttttaccacattcttgaagttatccctggacagctgctctctttctactgcttagaatcatagcatttcaggtggccaatccatcttccatactacagccagaatcatttttctaaaatatagataggatcatgtcatttctgtgcttaaaactttccaattgcatataaaataatatccaatttcctcagcatatcatgcaaggcccccataaccattcctctacctattttaccaacttttatcactaccaccagtaccaccaccccagcccatccacttcaggtttctctctctcaacctatcctctactaacatcctatttacaataagacagccatgagcctcacatatctgtgttatccttatactattttctaagctgccaatgctttctctccatcctactacagagctacactatgtcttatttatttttatggccccagtgcataatactgtgcctgtcatatagtatttattaaacatgtaatcagtgagtaaacttacataggtctcatagaaagtggacacaatttcctgaccagcagttcacacaatttgtatgcttcacatctcaaaaacactaaagaaagttggtgagttttcttattgctaaacattattggatgttttccaaaagtaattacaatcttgctttgcttttttgttccaaacatagtatttttcacaagtcccacttactgcagtttagtctcactgacaccattagtaatctatacaacatttttgcattatttgtccttgttatgatccttctcatgtatttagctgattcatgcttcaaacatcatcaagatcacaaaaaatccctttatgctcctagcaggtattgaggaaaaaaagagccattctaaatatgccaagagcattataattctccctaataagtgaaatatttttatgacagcctaacttactagggcttcaccaaagcctaactgactacaggaaactttagactctgacaagtaagatcttgaaattatacttgtcattttgtcactaaaaatctctaacagtgcctcagcttctaaatctagctgccccgtaatatcttaagcatgtatctaaaacttaactcactatctttgtcagtaccatgctcactcatttcctaatatgttcccattacccaccttgattaaaatataaggaatacttccatacactaaacattccactggagattctatagagaaattctaaaagggaagttgaattatctaactgaaaatattagagaactaatacacaaggcagtcaagtgacttaccaggacaagggagtaataccctatgtattaataattaagataacccaagttagaagtatcagtcacacttacagattaccactggatcatctttaaataattatgcatgaatattctgttctggtacaaagaaataataaaccaccaataagactagtcgtatacatatatagagatacatgtgttttatatatatagatacacccactcctagaagtcaacagatatttaaataaatgaatataattttaaaacacaatcttcttagttaatgtctaaggagaaaaggatggtacaatatgttaccgggctccagatataattcacccagcctttcaactctggtatatgtgcatgcaattactggcacattttcctaagcatctatcatttctgttgtttaatacctacaatgaaatgagaaataaataggaaatgcaatacattactgatatatgggtaaactgttttctattcttaacatagttgtcttaatgagttaacagttgagtaggtagatactttgatgcaaagtatctgtatctactctacctatagagcaggtatttgcagcagcttggaaaatttagcactaggtcagttgcagccatcgttttctctctttcttttacacttcacggtgaatcagaacaaaacaggagtctttgatttttgtggcaagtagaaccttgttccaagttcaataagcagttttcgtatgattgataatttgcacagaaggattaaaatggcttgaaattttaagtaattaaatgtgctttcttgtaataaaaatattctagtcattccctctatgctataaacactctggtatattatttctataaatactctggtatattatttctcttttctcctatctagtctatgtgtatgtgtccatatgtctagtgtatgtgtgtggtaagaacacaacatgagattcaccctcttaccacgaaattttaagtgcacaccatatcattaactgtatattaattgttgtacagcagatccctagaaattatatcttgtataactttatactcactgaacaacaacttcccatttcccactacccatgtttaatcattctatttctgcttctataattctgctttagatggctcatataagtggaatcatgctgtatttgttcctgtgacaagaacttacattttttaaaagattccatgatgattctagaacaacaccctcacatgttaatgggaagactgagacctagagaaaggaaaaggatcacaacattgtgagcagcagcctgggttcaggaagcaccctttctttcattcttgtttttccaactttaattttaggttcaaggagtacatgtatgggtgtgttatatgggtaggttgcgtgctgcagaggtttggtgtatagattatttcattacccaggtaattagcatagaacccaataggtattttttcgatcttcttcctcctcccatctttcatcctcaagtaggccctggtgtctattgttctcttcgttgtgtccatgtgcactcaatgtttagtttctacttataagtgagaacatgtggtatttgattttctgttcctgcataagtatgttaaagataatggcttccagctccatccatattgctgcaaagggcatgatctcattcattttatgactgtgtagtattccatggtgtatatgtatcacaattttctttatgcagtccaccattgatgggcatttaggttgattttatgtttttgctatttttgaatagtgttgtgatgaacatacacatgcatgtgtctttatggcagaatgatttataatcctttgggtatatgcctagtaatgggattgttgggttgaatggaagctctgttttaagttctttcagaaatctccagagtgcttttgacagtggctgaactagtttacattcccgcaggcagtgtataagggttcccttttccttgcaacatcaccagcatctgttatttgttggctttttaatcatagccattctgactggtattagatagtatctcattgtggttttgatttgcatttctctaatgattagtgatgttgaacattttttcatatgcttgttggccatacagatgtcttcttttgagaagtgtctgttcatgtactttttacatttttaaaggggtcatttgtgttttccttgttggtttaagttgtttttaagactctggatagtagacctttgtcaaataaatagtctgcaaatattttctcccattttgtaggttgtctgtttactctgttgatagtttcttttgctgtgcagaagcttaaagagcttaattaggtcccacttgtcaatttttgtttctgttgcaattgcaattgctcttgaggacttagtcataaatactttcccaaggcccaggtccagattggtgtttcctaagttttcttctaggattcttattgtttgtggtcttatatttaaacctttattccctctcgagttaatcttcatatatgatgaaaggaagcgctccagtttcaatcttctgcatacagctagctagctatcccagcaccatttactgaatagggaatcctttcctcactgcttatttttgtcaactttgttgaagattagatggctgtaggtgtgtggctttaattctgcgttctctaacccattccattgatctatgtgtatgtttttgtaccagtaccgtgctgttttgtttactgtatccttgtagtagagtttgaaattgggtagtgtgatgtctccagctttgttctttttgcttaggattgctttggtgattcgggctcttttttggttccatataaattttagaatatttttttctaattctgtgataaatgttgttggtagtttgataggaatagcactgaatctataaattcctttgggcaatatggccattttaacaacattgattcttctgatccatgagcatggaatgtttttccatttgtttgtgtcatctatgatttttttttttcctttttttcttttttgagatggagtcttgctctgttgcccaggctggagtgcagtggcactatcttggctcactgaaacctctgcttcccaggttcaagctattctcttgcctcagcctcctgagtagccagaattacaggcgcatgccaccacgcccaactaattttgtatttttagtagagatggggtttcaacatattgatcaggctggtctcgaactcctgaccttgtgatctgcccacttcagcctcccaaagtgctgggattacaggcatgagccactgtgctcagccatctatgatttctttaagcagtgttttgtagttatcgttgtagagatctttcacctcctttgggtagatgtactcttaagtaatgtatttttttattggctattgtaagtgagattgtgttcttgattgggctctcagcttggacacagtgtacagaagtgctactgatttatatatattgattttttatcctaaaacttggctaaagttttcatcaaatctaggagctcttgagcagaggctatggggatttctaggcataaaatcataccacttgtgaaaagagacagtttgatttcttttcttcctattcggatgcctttaatttctttatcttgcctgactgttgtaactaggacttccagtactatgtggaataggagtggtgagagtgggcatacttgtcttgtttaaattctcaaggggaatatgcatccagtttttgcccattcagcctcatgctggctgttggtttctcacagatggctcttattatttcaaggtatattcttttgatgccttaaatctctctcttaaatttaatacattttggtccttacattcttattgcaatatctatcagcagtatatgtagggatattttaaacagtttctgacttttaaaggtttttgaggttaattacttttaatctacttcaaaagtgaaaaatgctctatatattttgttttgcaaatctaaggcacatataaacattcaatagtaaagcaaatataaacctaatgccatcattggtatcttgaaacaaaatatgcttaataacactgatctaaactataagataatttttggactgctcaaaaaattcagaaagcaggaatcctttcacaaaccagaaacccttatcaaccataaaacaagcagctctgctatagagaaaggccttcctatcagattcttgacaatttgggaccaggtttaagatgtataagaactcagatctactctaaattttcaagataagtaaaaattctgatcacctctaacattatttttcattacagttcccaatacgtacgaaatatttcttttaaactttataaagtatttacatgttgcaaaattagttgtatgcttcaagagcaacaattaggttagtgttatgtgaattctttcagcttcctagaatcacgttacaatttcagagtcttcatcagtcatgctcctggctgctattttcatgaccatttattagcttggaggtgatgtattgtaatatctgtttttaaattttccccttttccataaaataatgcagtatttccaccacaaacaagactgacataacctgaggttttaaaagtaatttttcataaagttttatttcagtgactatacaccatgccaatataaacaaattaactactttctcacttatccttaactaattttaaactcacaagactttaatatgccatccagattttaatgtttatatgtaatttttacagatgggtgggggagagaaggaccactgctaaaacctccaaatttaatttccattttgattgtccttttgcaattccaaggtgtacttagaaacagacatgcagtgagccaaaattgtgccactgcacttcagcctgggtgacagagtgagactccatctcaaaaaaaaaaaaaaaaagaaaaatagacatgcatgacatgcatgaatatcatgtagctacaagcagaaaatgggaataattaattctcagcttcaggtaaagtggcatcaatcttacaggcttgacaatacaaaactttcactgaacaactgtgtactacagttgctctactctttcacaaatcatttctccatcccatatctggctataagccagggagaaaaaatgatggataactattgggagcacttatgttaagaatcctttgcttcactcatgatagatcaccttgaaaaaaatgtagagagatcagaaagctctacaaatattaatatcaattatagcattcgtattttggtacctgatgttattttaaatacttatttcattacttcaaaaatactgaaaaaatatctcaacaaatatatttttaaaaatctttaatgtggcctacaagatgctgcatgatccttctttgtctacctctccattcacttttctagccactcctctccactttcccatttgctccaacttccttcagctgtttcaggcctttgagcattttattccctctgtctacaagattttcctctctttccactccccactccccaatatcacttaaataatttcaaatattatcttaggtatcatttacttaagaaaaactgcctaactccctgttttaaactcctattgttttctgcagtattcatcaccatgataactatttaacaaagaggtcacaaattagtagcctactggctataataagctatttgattaagtcttatagtttcaaaaatctaagccactgtttataatggaaagattacacataaatcttacagtaaccctatttaatttatatttatccctagattacaataaaaaactattgactgaaaacccaaattgtttcccatttatatacttaaacatctctaaaatactttaaaaactttggatataaatgtagtataactaaatttacttggcagcacttttgctttattaagataagtactgaataatggaaaagttatagtagtcaactgtccactcatctgatggtgatattgaaccacaacattgatacctgctttctttgctttggttaagcatttcatgaaaatataactgctgcttagatgaatatgaacatttgttttagctaaaacttcacaattacactatatctctgactaaaataagttttacttcaagtaaactcaaagccttattgttttaagagaccaaataaattctctcaaattctatgctacataaaatataagtgtgaaaataaaatcagaggtcaccagattcttgtcctacttatccaaatacacgcagaacacattcaatctaaacatatgaagaagaagaacttttttttttttcttttttatggagacagagtctcactctgttgcccaggctggagtgcagaggcgccatgtcggctcactgcaagctccgcctcctgggttcatgccattctcctgcctcagcctcccaactagctgagactacaggcgcctgccaccacgcccgtctaatttgttgtatttttagtagagatagagtttcaccatgttagccaggttggtaagaagaacttttaagtacatacaaaattttcttaaatagtcagctctctatatctatgggttctgcatccatggatttaaccaattgctcagtgaacatatttggggaataaaaatgaatgtctgtgtctgtactgagcatgacgttttttcttgtcattattccctaaacaatacagtataacaactatttacatagcatttccattgtattaggcattagaagttatcgcgagatgatctgaagtataaaggtggatgtgcataggttacatgcaaagggacttgagcatttgtggattacagaatctgggggagtcctgaaaccaatcccccatcgataccgggggatgactgaacttgtatttcactgaatatcttgctataaaatgaaaatagtattattcatacatacttttaacagatagaatgctcatcagttaaaaatatcaaatttgtgcctactgtgaacatttgaacttatttatttgaagtttatactattactaataaataatattttgttcaggaatgaggtggtaatgtaaatggaaaggaagaagacatagataagctaggcagctttgaaaatatgtggaaaatgtcattcctgttcatccagttaagtgctttaataggacctatcatcaatgcattgagatgttaggagcagggatgctgggactgaatttaagagttattaatataagatgaaatatcttgggtctttgcatgtaggataacctatttataagcaaaacagattaattatttcatggaaagatgaatttgcagtaagagcaattaagcaaagaaacccaattgtaccagctgacactacatcaactaaatagatttcattcctatttgaatagcatgctctgaacaacatgagtgtttaataaggtttgacagatgttatgatatagtgactagaaaggataaaattaccagaatttcatttttaaggcctaaaacaagcaagataacatctcttgaatgatcattagtaagaatactgtacaattcctttcagttttgaattaatcgagaaactttattctaatcttataccatctgtaaagtaaacccaaagcaggcaattttaaagacatagaataatttttcctatggaattaagacagaaatatgtcagtcgaccataaaatacacagttgcatgaattttttaacagacaagcagagttgccactaatctccctataaagtataaaaacagatgcttcaccagtgtttaacaggagcatttatgtattgaattggaaaggcaatacatttgcttgatttgaaaatgtacaatcagcattcctaatatatatatttttagaactggccagaaaatgtattttaatcctaatcaatcatcttatgtttactttggcaagctggaaatgacaagaaatcatctgcataatataaacagtattcccagtttgcgaaactagcttatttattactgttcaaaacaaaaaaatagataacttgattttcataatctcccagaaaaaaatatgacctaaactattcattcatagtaagaaataactcactttaattaaaatttgataagtcagaaagctgatgataatagtttcaattttgagggaagggggaataaaaagttttaaataaatccaaggtatttttcttattattttcccacaaatgataaaaaatttcaacagagaggcggtaaagtaccaagtacagatcatccattaaacataaaaatgagggctggcagtaggtttcttatttttcttgagagtaattaataaagacataatcttaagggaccttccttttgttttttatttggttttcaggcaaatttgattctgggataattttaagtgtgtttattatcagcagtaacttgggcctgcctgaaaatatggagaacagcacaagggatgctgtcaataaagtactgtgaagttttttcacctaaaaaaactgaagtttctgcaaaaatatagatttagttacatcctaggtaacgacattaatttcatctttttacccatagcttcaaagctcagactatagttatccatatttctacatttaagcattcaactcctaggtttacaaactccttacttgtgaatactctatatagcttaacatattctcctgcattgcatgacatagatgatttgtcctcccaagagggcagtatttccttttgtcaaatcgtaaaattgttagcaagcagctttggctgggaggcaacaaagttttgtgaattgtatctttttataaacacagattcttaaacaccttcccaagtggcctttctatactttccatcactgaagagaaacagcccctgtcctaagcaaaagagcaaatatgatattgcccccaacttcctggcattttacccatttagtagcattaccaagatggaagtaaatcacagtgagcgggtatgacccagatttgtatttacaatgctgggtcagcagaagaagcagtatatgagagaaagaatccagagaggatgatgaggcccaaacagaagagatgctgaaggcctggatggttatttttgccaatggcttaagaatgtgtcattatttcatagtcaaatttcatttaatggctccatttatttagatctatacctggtaaatcggagaagagaagaatacactcattaaagccattagccaaaagccggtcccgcagctgctgaagaattgctactccaatacagaatgggaaagaggaattcccaagtagtaaggtatcccagaggtggaaaattttgtgtagtggaaatacatctgtaaaacgataaaaatacaaataaattaaaaaaccaaaataacaattaaaacaataacaacttactttactagttctataattattaccttatggtcaaaactattacttcagagctaatactaccaaactctttttatgaaatgtttatttggctttgaaaatttatagcttcctaaggcatcttaaaaaattgataatcaaacagataatatttttaaccctattaaccattcataatatttcttcccagaactttccagttatattattctcacagatttatctagatgaactttagtgttgttttaggtacagtaaaataacgtatctattatattctctaaacaactgttttaataaattcccaccaaaaatcctatgagcaacttcctattttttgtaacttcctttttcttattaacaatactatgtatatcttccaggccactgcataaatatctacttcaaatattattacagttaccatgtaaaccatattttattagtaaggatgtccactttattaatatttgtagcaaattaaagtattacgcattcacataatctgcttaatttctagaggaatcctagtttaaaaaataaaagttactgaagaatctctgaaaattaagcctgatttgattgtaatagttgcccttataagctttatgtaaatattatagttaattttttttcaaaggggggcagagtttgtacaaatatcatgaaatgtccaataggtttttattttatagaattctcactttgatattcagggatcagaacaactgaaattcttttctacctaactctattatgttagaaacacataaaaatacttactaaatctgctcaatgttattgtaaatataaaatatggggaggcatcgggctgtccttttgctaatacaatatcaaaaaaaccgggggaagtcatacttacgagtaaacatggtaagaaaccaagggatggcatagagctatgagtggaaaaaggggtacagggaatggataaaaaggaaataaaaaagataattagaatgattaccaataaactaaatggtaaatgtaagttctatgttttggtctactttattggttaaaataaaagagaatgtagtgttaagtttagcctaaagctgcctccttaaatgttttaagttcggcctaaagatttctccatacatagtgaatcatatctaactggatgtgtaaacagactgtagcaaatgctgagctgtaaccaatctagctgtttctgtacctcacttttgttttctgtatgtcacttttctttttctgtccataaatcttccaccatgtggctatgctggagtgtctgaacctcttctggcttgggggctgccaatttatgaattggtctttcctcaattaaactctgttaaatttaatttgtcaaaggtttttcttttaacataggtaattacagttattacaaatactcttatataatgatactatccacattacaaatgtagatgactcttttggcaaagattattcacagaatgtctttatttcaccaaaggatagactcaagaccatggctaatccaaatgcaatgctggtatactaatttcaagggtatattttactttacaggtttgtacagaatatttctgagattttaaagatccttgtgttagttaattgactgcatcaggtgatacctaggtatctggttaaatgtgtgtgtttgtgtgtgtgtgtgtgtttgtgtgtgatggtgtttccagataagatcagcatttgaatcagtggactcagtaaactgtcctctccagtgtgggtaggtatcatgtaatcaactgagagcctgaacaaaacaaaggtagaggaaggaggaatgtgcctcttcttttctacctcactgcttgagccggaacatttcatctaatcttcccctgcctttagactgggatttgtatcaccagcttcctggttctcagacctttggaatcagaattacaaacacctctagactctcaattataccactggctttcctgggtatccagctttcaaacagcatattgtgggatatctcagcctccataaatgtgtgagccaattactcataataaatctcctctatctatgtttatatatctcctattggttctgtttctctagagaaccctaatacagtcctcataagttttgaggtactcttaattgtatttttaagaattaattagatactttttaaatgttcaaaatgtctcaataaaaggtattatgaagcatgtgctttttgttaccacttaattaacaggatgcttcataacagactaaaagtaataagatctaatattaccattattaataatttgacaaatttattctcctaagtttactacctagaaatatatacatacacacatatatagctatatatatagtatatatcgttctatatacacacatatagacatatacattttcaaattttagaaggttttagaagtgacaaatcatccttaatttataaaagtagagtaaaaatctcctttgtcaatagcaagtatcaaaaatcaacaataatttactgaaaaagcactaattttatttcactttatgagttaatacaggctgctattaaagacttctttactacctacagggttagtttaaataaatattatttcagcacctagcaattatgaatttatgagtaaaaggtgcatattgtctttgcatttcactcaattgagtatttatactatcaagatgacagtcaagaactttataagtatattaaaatctaagtactacatgtgaaataaaacccactcatctccaccatatcatcattttttataggctgacatttagatacatttttctagggacaatataaatggaaaaaggaaaaagtacaaaggtatatgacttcactgtaatgagtaagggttgtagaaaacaataaaacataaattgttcatttaaatttaaattaaaaaataaagtcagcaaaattagtttcattgctattattcaacatctcttttaaagacacgacatcaatattaccttctccctttttgatgaaagctaactgtcattaagaatcttcttcaaattatttcagcaactagctaacagtgcctttctcctatactagtctttgtaattagcttcatcaagatctatggaagaattctgcttctgaccaaggtggcataacaggaaccagatttacctcctgaactgaaacacctaaaaatcagaccaaatatataaaacaacaatttgtacatcttagagagtggtacctgagagaggagaaacaaatgaaatgaaccctaaaattgcccaatttactgcatgcaaagaagttccaggccactgacagggaggaagaacccagaaagagcttggtggttgtcctaagctgaatatgcagagtaggaaatctggggagatcaaggtggctatactcttcaggagagtgtcctggaagattctgccagagagagagatgcatagagaaagctccagaagtctgctgaagattcccctcaaatctttgctaattactgaagagtgtgtgtgtgtgtgtgtgtgtgtgtacacagaaaacatatctgagtgtgtgtgtgtgtgtgtgtgtgtgtatatatatatatatatatataatacaaagtagggcagaaaccacttcaaatgatcagagtgaaaaaatgccaagatcataaaatgccaagaagagttcattttttcactaaccagaatgaaaacaacaaaacaaaacaaaacaaaacaaaaaaacacccacaactgttataaacaaggcattagggagagtagtcagaagagcattgctttagtaatggaggaaaattatgctccaaaaccaagctgctctggccccattaaataaaccttaaaagcaagccttgaaaggatcaaattgtttcagtgtaacttaactgcacccaatcacactcatggtcacccccaaactgcctcttttttctaccaacaccattattatagtcacttaggtagaaaaatcttaggtataaaagtaagtctgatagatattatttttacaaggtctcttcagtcttctgtttctatccattcatactgaactaatcttgttttggttctcattcttctttcatggactactgcaaatgtttcatagttgttcaggttctacctggtccaatatttcctttagccaaattgatttttctaaatatgcaactgtgatgacatcattcctctgttccaccacatcaatatgttcccactgcataccaaattaagtacaattttgtactcatgcatttaaggccactgtgaattagtgaaaaagccaaggacttggagtcagaaaacatacaactgagttttgactctgatgattactggatagcgtgccttggtcaagttagttaacctctgtgaatcccagatcttcgtttttgaaataggaaaactaatgtctgtcttaactatgtcatagagatggtgtgatgtggaaataatatatgtgaaaatgctttgtaaacagtaacaacctgcaaatttaaagtagtattattattaatatcagtataagaaactctaaatttctttgcaccttactacttccctacacatgttctacttcctgagaaggcagatttactatgatctgaacacactactttcctaacgatgcactttgcattttcttctttgaatgctccttcctgatcatttccatcaatccaaagctctacaagatttttccaagcctgcctcaaatgccacttgttctgtgaaaactttttgtatattttttatgatacctatcccactatgctttgtatcatatataatatagttgtattatatataatcatggtaatcatttttatattataattacctatcacaacatacttgtactatacttaattctgggtatattcattcactctttcattcattcatgcttgcttttgttcatttattcaatatgaaatgctttgtgctaaatgccacgtgtcccactctagcagaagagtcagacatacgaacagatacctaaaatgctttactattaagtacgacaatacaagttctggtataaggtaatggcagcaaagttacaggagcttatggcctttcctatcatattctctgcaggagaatgataggattcttgtgaataaatgttattttactcatttattcattaattcaatatttactaagtgcctaatacatgccagatctgtgttaggtgataggctatagcagtgaacaaagcatagttccaggctacagggaacttacaataagagcagtagatattcattaaatagtctctcaacccactctaatcaagttcttgcctccacctcaccactgaaactgttcttaccttggtcatcaataatttctatgtcattaaatctaatggccaattctcaattgcaatctttctttaccaatcagcaggatttgacaaagttgactattcccacttcttcagaacatttttttccctccacttggcttccaaaacaccatactcacctagttttgttcttatctttctgattgctccttatccatctcctttgttggttcctcttcctctctctcactctcaacctggagtgtcccaggttcagttcttagataccttttcttttcttttctatttttctccaaataactgtgtagtttgaggaccctatttcagctccatccctaaacctctcctacaaattctgaaactgtatatccaaatgcctgttttctccacttgcatgtctaacagatacacatatcctaaaacgagcttctgagacttccttcaaaatctatacctccaagtagtttccaaatctcagttagaagcaactctatcccctttcaattgctcaggtacttgactcctctcttcctcacacactgtatatttgtcaccagtagtcctgctggctctaccttcaaaagatatgcagcatataaaaacttcccactacttccactgctaatatcttgattcgagccaacattatctcttgcctagactattgcaatagtccatgactagtttcctagattccattcttgcccatccttcgatttttctcagcatagcagccagaatgaccttgttaaaatctttacatgagacatcactcctctgctcaaaagcatcagtggctttccacctctaacaataaaagccaaagtcctaatgatgatcaacaaaactatgtaatatggccctctattacctatttgaccttatcttcttgttcactgtgctctagttacaatggtctactggctgctcctccacatctctgatatgcttccacatcagggctgtagcaactgctgctgctttcgcttggtttgctctttcctttgctttcttaaagcatttattcataagtcaacttttctgtgaggttttcttggttaccttacttatttcaaaattcatggccaggtgcagtggctcattcccacaatctcagcactttgggaggccaaagcgggaggactgcttgagccaagaatccaagaccagcctgggtaacatagggagacctcatgtctacaaaaaatttaaaaagtagatgggtctggtggcgcatgcctgtggtcccagctacttgggaggctgaggagggaggattacttgagcccaagaggttgagactgcaatgagccataatcacaccactgcactccagcctaggtgacagagcaagaccctgtctcagaaataaataatgaaaattcaatctcttctttacctgagcacataacatccatacctctgctttagcttttttttttaaattagaacttaccactacctaccatataatatatttatcttcattattgtctatttactctagaatatgaggtcagatatttttgtctatctcttattttattgctgatatattatccatggcatagaaaaatgtctggcacataataggcacacaaatatttgttgaaaggatcaatcaaatatttgttgaaagaatgaatgaaaaacacaatgaaaatcaatgaaagtgataaattaaaagatccaaatagtcatgagattatatattttcttaagaagttttcaacaaatatgaaataatgagaaaatgagttagtccttccttgcttaatattggggaaaaatccttcatattaaataatggcatgtatttaaaaaaattaaacttgagattttgttatatacctatactttgataataattataaaaaattatttaaaataagcaaaacaaagcttattctaatgatatttgaaaagtaataattagttcaagttgaataaatatctttaatataacatataacagctcctaggtgcttaccagaaccagttatctcttaccaattaaggataattaagattaataaataagtaatgtactctgtgagatagtaatgtctattattttttctttctatatttctcccgtttaaaatattgatattttcatcttaaataattactcaggatattggcacagcttcataatatagcctgatataaaaaagacatcaagatacaataattttgaataccaggtgggttttgattaaaaagaaaagcaatttaatattagagatattattagctatttcctgatttaatagaaaatgaaatccaatgaaaagaaatcatacatactctaagtattttctccagatcatgaaattatgtacaattgatttggtgtagtgctattctacacagtcagctaagtaaatactgccccctagcaatatcaagcaagagtagtgatatttagcatttcatgagatccttccatgtggtctggtaatgtcaaatttagaaccatcaataggaaaaacaaaggaagggagaaccatcaataggaaaaacaaaggaagggggataattttcttgattttgaaaagcagaaaattatgttttactactacaaagaggagtccctttctattgattttcttaatccacatcctttataagcatactatattgtctatcttaagtcagaagtattttcatatttaaattattatatgccttctctgtaatacatattgaccattagtttaatgcttttgcaatgattctttatatgtacattaggaaacatatatacagacattccagaaaagaatgtgtaaaaatctgcactttgcgacctgataaagttatctccttgaacctttaggattattgtgaagattagttaatggatctagaacatctggcatttagtaaacttaaatataggagttacaatgatcacccagaatcttcagtaatggaaaagtattttaacaagccaaagttctgaggtaacctcattaagtcatataacaaaagatacacacttttttttttttaaattaggagaggcatgagcagaaaataaaaagaatagactcctaggcactgtataaaatattttatttatcagtaacaattatttcatcaataccaattaattattctcaactatgcttaaaaatactaataagaaaacagaagaatgatggaatcatctacaaggatagcacagtactaaaataaatcatcactattatgccatccttcatttttctttttgtgctagccatagtattgcaccatctttcaagaagatatgaaagatgtacagagacaccatcattatagattttttgttgtttttttacgttttcattgaacacagctaaagattgagaattttccattttccacctttattattaaaaagaaaagagaaaactgtttcataacaggggaaaatgttttacaattactggactaatcagaagatgaatgcaaaaagatagcaacagtttaactcaagtcaaatggtaaaattagtcacacaagtgatattgcaaattgtgagtgctcagatgacagtctcttaggtgaatttcctcaaacacagctatcagagtaaacaataaataagtctggaattctcattcagtcagtcattcaatgtgaagggcctcaccacacaatattttgcaataagaaacctggaccattttactttgctaaaaggatatatgagagtaatatttgattttttatgatatttgtgcaccaaaatttttgatacagtttaagcaaataaatgctataagtgtatgtgtttgcaatgtaattataaatagatgatatagaaataaaaattaaatttattctaatttgtgttcataaatctaaaaatgaaaatgttttcaaattatggaataaaagacagctgttcttcaaccaagttatgagctctgtcagtgtttcattttgatgactgtgttataaccatgcaagtgcaagaagaaccagaaatcagctagaacctatgagagacatatttgaaatacggaatcagtatttatatgatggatatccttcaggctcatgtatgacagctgagcagtaagttcaaaggacatatacacatatatattttcacatatatatatatatatatatactttcaaaataaggaatatatgacataaaattttgggtttgttgtgtttaaattcttaatattttaatacagttttttactatgctttattctacttctgcaaattattcacaaaatgacttaaacatataaaaataatgtaaaagatcccttggacccaaaaagtaaatggttaatttttttcctctatataccaaagattatattagttatatcttttacaggtcatgatttctctaaataaaaaaagaaacaaataaaaaataactaactgtataaacataccttttattatttattctcagttggcttacaatattgaacaaaagaactatacactgaaaacttacaagaaaatcactcagataatttaatggttctgagatctacattatcatttttgggaaagatgagctattattccagaatatatttcaattatttcattgattactacaaaaaacttttcaaaattttcaaacataattcattctaatttactttaagtaaaagaaagactataaaacatgttatgtagcactttgttgagatagagaagtaccttaaaatcaagcaattaaaaagattaaaattcaaagtggcagaaaatctcatcaattcagacaaccttgaaagtctttattgttattagtaccatacctcctctgacagagtattcattaactgatgtagcaaaataatatatccattatagcttgtaatataatgttcttctaaatatgaatcatgctaataaaagaaataatgcaacatgatcaaactctagtaatattaaataaagaacaataccccttaacaattatagtgtgcctggagctgtgttgaacagtttatatgcattctctaaacttcattatgaggtagaatttattataatctacatcaatggtaagagggttgcagggaaaaaactaaaactaaagctaaaaatagattatgtaattagtatatggaatagccagaatttagaaccctggaccatttggcacaagtgtctgagtacttaacctctacaccagctttcttaaatcttggtcacaggccctggcggtccttaagtcccttcggggtccaccaattcaaagctatttttgtaataatactaagatgatttgctctttttactggattgatatttatgctaatggtgcaaagccactggtggataaaactgctggcatgttagcacaatttaaggcacaggcaccgaagtataataatggtcatgtgaaggagtaaaaattattaaatttattaaatatctcttttaaaatttgtgaaataaaatggaagtaagtgtaaagcacttgtgctatctactgaagtacaaagaggtaaagcacttgggtaatcatctgtgagctaatattgatggtttctgcaagaaatactatgtttatttgaaagaatgacagacaaacaatgatttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacacgcgtgagccaccgcgcccggcccaaacaatgatttttttaaatgtacaaagtgaaacagttactttaagaaaaaatgagagcttttaggcgaagattaaaattttggaaagctaatatctgccactgtgaaattggtcggttcccaatacttaatcactttttggagaagacctgttgtgatattaataaatgtgattttaaaaatattctataatgaaatgcttcatagttggaagatctgtgtaactcagcaaccaatatttttcaatgacaaattcatgacactacaaaattatgtatgagtaaaagagccatctaaattgcaagatagagtgatggattttagtataacagagtatgagaagttcactgacatggttttagactgtacatagcaactagctttaagaaacaatgaggccaggcacagtggatcacgcttgtaatcccagcactttgggaggccaaggcaggtggatcacttgaagtcaggagttcaagaccagcctggccaacatggtgaagccctctccactaaaaatacaaaaaaaaaaaaaaaaaaaaaaaaaaaaattagccaggcatggtggcaaacacctgtaatcccagttacttgggaggctgaggcaggagaatcgcttgaacccgggaggcagaggttgcagtgagccgagatcactgcacttccagcctgagtgatggagtgagactctgtctcaaaaaaaaaacaacaaaaaaaacaaaaaaaaccactgctctgagaagtttaagaaactaccgctatctgagaaactattaacgtgtctgtgtgaggtcacattttcttcatatagttaaacaagtaaaaagattataaaaatgtaaaagattataaaaaggtaaaacaataccactattgcatttttggggaaaaatgtaactatttctcagaaaaatatgttactttggttaacatgcaatggttttgttattgttatttttaaatgaattataaatacataaatatattttaaatctctataaatatcgatagctataactcatgtaaacaaaaactctttgaggtcctcaataatttttcagaatataaaggggttctgagagcaaaatgttttagaactgctccattatgccatacttcctttcacctgtttctggacagcataaggaatcattagattagaaacagatgtgggggtaatgcaaatgaggatttactgaattggaaaacttgctagatatttaacttgtgtgtatagttttttggctagaaagtaccaaaaatgtcattttatcatccctgatactattaatagccactttgatttctaaaatctgggcactttctgaaaggtaatcaagcttcactacgagagagagactttaataagccatttgtattcaaaggccttaatggatccaatgccagtagaatggggtttgtactaatgttggggacatagcagctaccagacaagaggacacatcacaggactcttcagagagactataacaggctagtaggactcttattatgagatattctaaataaggtggatattcctagtttttcctgtaattacatcttgataaaatctgaaaagctcattgtcagtattctctttagactaaaatctaaaatttatttacgtaacaacataatgaagataaagaacaaatgaaggaacaaatacataaatatttctgagcagtttaaactcggctgaatatacattttgaaaatgattgtgataagcttttaagtagtataagcatcctttcagattgtagttaaatgtcaatggctttaccagcatatcatggaatttgttagctttatctttagctgtgacagtaggttgaaaaggcacatatagtactgatacactccttatcatttctcttaatggttacctgacaactcttcataatttgcaagctgaatactattcacagaatttcaggaaaacagttcccttaagaatgaatcatactttcctgatctcattttaaatgaggcctactatatttttaaaagcagaaacacatatcaagacaaaaatgataaatatcaccctgtctccaattttatcaaatacacattattcaccctatttatatgtaaatcacataactaccatgaaatgtataatctaggcatcacatcagtgtacaatatttctaactattcaagctttagcagtgctcagtattcagagttccgtgacccagagcaaaaggaaaaaagccagaaatcacaatctctactgcaatggaagcctgaatttcaatgatgaaagattaatgagggcttactttgataggtttagttcttgagtaggaaactcggtttggtaaatcattatcaaagtacccactcttttacttgatgaatctagcttgtattgttgttagaggcatagaaagttacctcaataattaaaggtagaacattaaagacaaccattcagaatttttaaaaaatgctatatacacaaactaataaaatacaactaaaatatgttattaatagagttaaaaaatgtttttaaaagtcctccatttcatcatgcccctcccataagtactcactgtcaataatgtctacattgaaacattaaatctgttcacaaaattgaatttaaaaaaggcctcatcatttttatattatccacaggcttgaaaaacagctgaattaaaaaacaaacacaaagaaaaagatttcaaaaaacagtcttcctattaacattttagctttctttgttgaataactttgcccactctctgtgacaagaaaacagttgtagatgggactcttcttcaggttaagatatattatttcccctcatttctttctgtttactctaaaattcttaacaagtgacagaaccgtttgctagaggacattcagaaatacatgtgaattaattactcagaaatgagtgtagaggcatttttttgtaatgatgattagaggattgctagtggcaatgagtggttgggggtcagggatgctcagcatttgccatgtgctggatattcctatcccacaaagaattacttcccatcccatatgacttaaaactgtctctgaagactaatcacactaccattgatagcagcaggaggcagaaaaatccctaggcagatggggcaagtccccagtgtaatccaatcttaaaccaaagacagtttaaggtctgaaaaccaagatacaggtctcatacatatctacagaatgtattgagaacctctcccgtatggcacactttcctctgattgatccctaccattcacctattttacatatacctacccttccctaattagttttttacactgttgtggccatctttgagtggtgccttttttttttttttttagctttttttgcatactcacaaaccaattagcacatacactcccattctgagcatataaaagccccaggctcagccacactttgggctacccacttttaggtggtgggaagactacccaacttcaggtaagggtgctgtccaactcaggcttccttctctgctgagagctgttttgttactgagtaaaactctttgcctcactcaaccgctagctgtcagcacaaccttattcttggacatgggaaaagaactcaggacccaccaaacggcaagtgcaaacaaagctgtaaccctgtagcacacccctcctgcttgccaaacaatgggagaagggacctctgggcaccacacacctccatttgttgggctgtggatgtgagactgaaagaactgttagcatgctgtaacaccccctttggggctttggggtcacatgcccacctctgttcaagtgtcacagcattcccctcatccagacgccggctcccaaggtggaagtaggtcatggcatgcctggctcagccgcagagcaagtgcaggatctgggccagagctcaagccaagcacagcctgcctggccaggtgggcagggtacctagtggggcaagcccagggccaagtgagacatgggcaggggcaatgcccaccatgaagatctctgctggcaaagtgacactgaaaaaatcctctgtcactatacaaatcaatattactttcttaataacactacaattgcagaacttttttacaagaagttaagcaataatgctccagtaattttatgtgtagatcataacagggaagcataaataaatatattatgtcacaattatttagttattgagtaattcactcaccctgcatagcagcacacttaacaccaatgtactctccactcagatttaacaagcattaacattttgccacatttactctaaaattttttaaaccaaaataaaatatgaccaatacaatagaagccccttttgtactactcctgaatttcaatcctctctttttaaatttatgttttatactttctgtaaccttaataagaattatttcttagataaaaaaatacaaatataatattccatatttaagtcttctaatggatctagaatttatttttatgtgtggtatgaagttaggctttcatttacactgccctccacatccacatagttactcaatcaggaccatcaacaatgctttcttttctaattgattgtatggtcatctctgtcatatatcaccaaattctatacagggatgggtctgttttgtgttctctcttgtattttactagcttctattaatatcactaatgttgttctggttaattgcctgacttttttttaatctcctttggccaatatctttaagtttttatatttatctcttataagtactatcaagatagattttcaaaaatatctgaaaatctcctttaataagccatttaattagcttacattctttctatgttctttctgcttttataagattaaatgtcttttctttgttctatcctgcacccctccattggtttagaagttacatattctctctttattcttttcaggattaccattaaattaaaattttaatgtgcattattgaacttctgaatttcttgtgaggagagacatttactgtcctttgttctagactatcttttcaaatatgtttgtataaaaaacagccttggaaagcagaaatggaatctccttctagacaaaagacagatttactaatagccttagaagaaaaagacaggctctctctcttgaacaaagggaaggcaaaaaaaaaatccaattccttaagctcatggtttctctcttgtaatgtaatccactacatatgcaggtatcatctgggtccttgatgttgtttccataggatttgagagcaagagaaaccaacacaaatatgctaatgttcatgctgcttgctgtactgttagtgataatgtccttggtctctggcccaggaatcttgcattttctgcctgtatccagaaaacagtaataggctaacttataagctttcaaggagggtacaatcaaatctcagatctgaaaggttccctgacttaatgtctaaataaaatgagcattccctctaaataatgctaaaacattagaacacattttaactgattcccacctacttttacctttcacgttattatttagaattttattttcaccttattattagcccttcccaaagtggatttatatatatttaagtaactttttacacagatttataaacttgtagtatttgatgagtgataatatttaaagagggtggaaaagtgcttggtacacagtaaacatttaatatgtattcacattaattatgttttaacaatatttttaactcaacattgtttcttacatcatactcattcagaattcaattttctgattaactaaagttatttgtccttgtgtgtttcctttcttaatattatctctgttcatgaatatgtctaaggatttttattggattatctttataattctacacattattttttaaagagatgaagtgttgctatgttgttttggtctcaaactcctagcctcaagtgatcctcctgcctcagcctttcaagcataagccaccgcacctggtttccaaacatacttgtctacataaatgttttctgtttctgttcagtgctgagcacaatttaattaggtgcctttacaaaaattttttgaaaataattatcttttttagtctaaattttaaatacttaatattcttttttactcaaaaatctaacaccattaccaacttggcagtcagctccttgacagcttcttcaactctagccataagattggatctatattgtattatacctcacatttataatgatattatactccaacagccttttatttttattctttaattttaaaaatcagtttttattgattttttaaattccttatataagtatttttcaaatttaggtttataaaatcatcttattaaatgtagacttttcaaaaataacacaatgcatcacatgtaggaggcagaaaacattgttttgtaaaacttattttagttgtatacacacatacacaacaccactcgaattctgtgtgccccaggtctcaatataaaatgtatttcttcccatgcattgtgagaataaacagtttttaagaaactgctttatagtattctattaaacatgatcacataatatagttttaggaagtttttaacattacaaaaaaaacaccttaaatgaaaacaattaaaaattgcacttaagccccctcggtacccataactcctgtaaccctacataatcataattaatattctagagtatagcctttcaacttttcctatgtatatacacatatacactaaattctattttatgaaaatgagataataccataatattattttataaattacatttcctactttaatgatatgtaatgtgaacattttggttttttatcaataatttttaataaagtatcttcctaaaaaattataattgcttgaggtcaggtgccttcagcttaacttttgaatgaataatacattcacagtgttaaaaaaaattttttaatgtcaaatgtaacaagaaaacaatttcctttgcacccacgctaccacttgcatccccatcaccaagcagctaacttttgttattaatttattttcctctccactttcatttgttatttttaattgataagtaataattgtatacatttattggatacaatgtgatgttttgatatatgtttattcaacagcctttaaaaagggcttgattctatgtgacaaacaacaaataaaaaacaggctaagtcacgctacagctaacgtttgattttcaactctgacttttagcttgatgtggactacagagaaaagaaaacccaaaatctatctaagctcccaaagtagtatcaagtaaaacacagaagttactttcacttaagtatagacttcctatatcttcaaaatcaggcctgaatatcataaaatccaagtgaaaagcctacacagcacagtttaatacaacactatcactaatgattttctcaaaactatcaactatgctaagaaaaatgacttattttcattacttaaggtggaaatatggaaagtagccacaaacttactaatacaaggctacaattagtagcagtaacttgttcagatatgcactatgacaacaaaaattaagaaaatacactcttctgtgctaataatttctgctttttttttttaaccacatgttctattaatgcaccaagtacttacatctggaatgaaaccaatctcattgagatgattactcagctctggatcatgaaatgcaatcatctgagagaagacagtcagatactctgaaattacaaagtttgagacaatcatcatttttacacagtactccaagaacattatattcaaatatagttttatttatacattgaatgagatttaatttctccatgagaatactttacgtgataattttgttttgttactattttaattacttactgctaattattaaacaagcacaccaacaaactgtcataacctattttctgccttcagagttatcagttcatttcttgagtcacaaattgtacacatgataaataatgttttcctgttaaactctacaagcacattttctctggtaatattaaatctgctttgtatttcttgaatgttcagaaagtgtagcagatccttaaatgaaggagaacatttataagcagtcacaaatggaataataatgtctcaaatttgtttatatatacagataaaacatatgcctctatataggcatctgttccagttctaatttatttccatctaagacttagcaatttggcatatttagaaataagaataccgggggaggaaccaagatggccgaataggaacagctcaggtctacagctcccagcctgagcgacgcagaagacaggtgatttctgcatttccatttgaggtaccgggttcatctcactagggagtgacagacagtgggcgcaggcaagtgggtgcgcgcaccgtgcgcgagccaaagcagggcgaggcattgcctcactcgggaagcgcaaggggtcagggagttccctttcctaatcaaagaaaggggtgacggacggcacctggacaatcgggtcactcccacccgaatactgcgcttttccgacgggcttaaaaaacggcacaccacgagattatatcctgcacctggctcagagggtcctaccccacggagtctccctgattgctagcacagcagtctgagatcaaactgcaaggcggcagcgaggctgggggaggggcgcccaccattgcccaggcttgcttaggtaaacaaagcagcccggaagctcgaactgggtggagcctaccacagctcaaggaggcctgcgtgcctctgtaggctccacctctgggggcagggcacagacaaacaaaaagacagcagtaacctctgcagacttaaatgtctctgtctgacagctttgaagagagcagtggttctcccagcatgcagctggaggtctgagaaccagcagactgccccctcaagtgggtccctgacccctgacccccgagcagcctaactgggaggcaccctccagcaggggcacactgacacctcacacggcagggtactccaacagacctgcagctgagggtcctgtctgttagaaggaaaactaacaaacagaaaggacatccacaccaaaaacccatctgtacatcacaatcatcaaagaccaaaagtagataaaaccacaaagatggggaaaaaacagaacagaaaaactggaaactctaaaaatcagagcgcctctcctcctccaaaggaacgcggctcctcaccagcaacggaacacagctggacggagaatgactttgacgagctgagagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcgtcaggagccgatgcgatcaactggaagaaagggtatcagcaatggaagatgaaatgaatgaaatgaagtgagaaggaaagtttagagaaaaaagaataaaaagaaacgagcaaagcctccaagcaatatgggactatgtgaaaagaccaaatctacgtctgattggtgtacctgaaagtgatggggagaatggaaccaagttggaaaacactctgcaggatattatccaggagaatttccccaatctagcaaggcaggccaacgttcagattcaggaaatacagagaatgccacaaagatactccttgagaagagcaactccaagacacataatagtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacctagaatttcatatccagccaaactaagcttcataagtgaaggagaaataaaatactttacagacaagcaaatgctgagagattttgtcaccaccaggcctgccctaaaagagctcctgaaggaagcagtaaacatggaaaggaacaaccggtaccagccgctgcaaaatcatgccaaaatgtaatgaccatcgagactacgaagaaactgcatcaactaaggagcaaaataaccagctaacatcataatgacaggatcaaattcacacataacacgattaactttaaatgtaaatggactaaaggctccagttaaaagacacagactggcaaattggataaagagtcaagacccatcagtgtgctgtattcaggataccaatctcacgtgcagagacacacataggctaaaaataaaaggatggaggaagatctaccaagcaaagggaaaacaaaaaaaggcaggggttgcgatcctagtctctgataaaacagactttaaaccagcaaagatcaaaagagacaaagaaggccataacataatggtaaagggatcaattcaacaagaagagctaactatcctaaatatatatgcactcaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacccaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctcctcctgaatgactactgggtacgtaacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaacaagaaaagcaagagcaaacacattcaaaagctagcagaaggcaagaaataactaaaatcagagcagaactgaaggaaatagagacacaaaaaacccttcaaaaaattactgaatccaggagctggttttctgaaaggatcaacaaaattgatagaccgctagcaagaataataaagaaaaaaagagagaagaatcaaatagacgcaataaaaaatgataaaggggatatcaccaccgatcccacagaaatacaaactaccatcagagaatactacaaacacctctatgcaaataaactagaaaacctagaagaaatgggtaaattccttgacacatacactctcccaagactaaaccaggaagaagttcaatctctgaatagaccaataacaggatctgagattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactgccaaaccaaatccagcagcacatcaaaatgcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatacttcaaaataataagagctatctatgagaaacccacagccaatatcatactgaatgggcaaaaactggaagcattccctttgaaaactggcacaagacagggatgacctctctcaccactcctattcaacatagtgttggaagttctggccagggcaattaggcaggagaaggaaataaagggcattcagttaggaaaagaggaagtcaaattgtccctgtttgcagatgacatgattgtatatctagaaaaccccattgtctcagccccaaatctcctttagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaatcaaagaggatacaaacaaatggaagagcattccatgctcatgggtaggaagaatcaatattgtgaaaatggccatactgcccaaggtaatttatagattcaatgctatccccataaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaatagagccctcagaaataacgccgcatatctacaactatctgatctttcacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacatacgcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaacatgggagaaaatattcgcaacctactcatctgacaaagggctaatatccagaatctacaatgaactcaaacaaatttacaagaaaaaaacaaacaaccccatcaaaaagtgggcaaaggacatgaacagacacctctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgtggcattattcacgatagcaaagacttggaaccaacccaaatgtctaacaatgatagactggattaagaaaatgtggcacatatacaccatggaatactatgcagccataaataatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaacatcacactctggggcctgttgtggggtggggggaggggggagggatagcactgggagatatacctaatgctagatgacgagttagtgggtgcagcacaccagcatggcacatgtatacgtatgtaactaacccgcacaatgtgcacatgtaccctaaaacttaaagtataataataaaaaaataaaaaaataaaaaataaataaaaataaaaattaaaagtataaaaaaagacataagaataccatgtttaatcagaaagtagagatacggtaggcaattaaaaatatattttgttgattctaattctattagaattcatagagttcagttgaaatatgaggaatatgttcatttttttcattcttccaaagttactattcttgccagtttactcactatgcactaatctaaacaagatagtgctaacaatctactcaagggcaagtaactattatatttttactaattaaaaaaccaagattaatacatatttcaatgagctcaacttttttttttttaaatatagactgggttttgctatgttgtctaggctggtctcaaactcctgggctcaagcaatcctcctgtattggccacccaaagtgctgagattacaggtgacaacctcatttttttgaaattgaaatgacaataacatcataaaacttttcccttcataatcacaactttctcctacagtaaagtaacatctatttttaaaaccgattatttggtgaaaataatcttcaaaaaataatgtctgccttgttatttgttaaatttttaaagtttttagcttttaatatttgaacaaatagtactaaattattgacagtccatcagtacaagtagtcttcccttacttttctcaaataatcctttgcttccaatgatcacatgaattttatagataacatggtttggctgtgtccccacccaaatctcaacttgaattgtatcttccagaattcccacatgttgtgggagggaccggggtgtggtaattgaatcatgggagctgctcttgcccgtgctattctcataatagtgaataagtctcacgagatctgacgggttcttcaggggtttctgcttttgcttcttcctcatcttctcctgccgctgccatgtaagaagtgccttttgcctcctgccatcattctggggcttccccagccatgtggaaatgtaagtccaattaaacctctctttttttttccagtatcgggcatgtctttatcagcagcatgaaaatggataaatacaatagatatttccctataagcaaacatcttacatgtcacatatcctacacagaagagcttcagggcaaaaagaaaaaaagatgaggtgctgtattccatgacaagctgaattcctcatttaatgtgaacttttacccatgctggatttaaaaaaaaaaagatactcaagtaatactttttcttgacttgatgttaattctactgccacaaaatgcattctatccgtccattgtctcaccttttcctctctgcacaaaaaaggtacaatttacatcagtttcaagagttatagatcaaagtgaagacccaaaatatatctgaagggcccagggaacttctgggtttaacttttctttaactttttaatttctccttccaattagtggtggtgtgtttgtaattccaatttactcagaagccagagatatgtgacatcaacaattacaagcattcaactatatatcaatgaaagcatacagttattaacttctaaaaagcatgcttcattttaaaacagaaattcacacctcaggcaattttccacagctatgctccagtttattaaatatcattcttatttgagtctgataaaaataattactatgtaaaattacatggctaattaaggatctgctgaagaaatctaatccatcatgaaaacactgtcctgccaccacacccagctaatttttgtatttttagtagagacggggtttcaccctgtttgccaggctggtctcgaactcctgacctcaggtgatctgcccggcttggcctcccaaagtgctgggattgcaggcatgagccactgtgcctggccaacactgatgattggatttatatgttataactgcatatacatatatatacacacacacacagacataaaatatataaatttattttatgtattattaaaagttatatgttatatatcacttcatatatgcaaatataatttgtaaaactagcataagttttggttgctcaggacaggctttcaaatgagataacaatatggcctgttatatttacaaagttctgtctctaaagggagcacatgtgacagctgatgaaatctgcactatgtaatattctcagttatttcaaaaaagcttttaaaagccccttggtgtaaatttttaaaatatcaaaataaatatatgccttttgatttgcaaatcaaagaattcaagagtagttacaaaaaaaaaagaaaaacagaataaaacaaaggattcaatggaatcatagaatcttgactctttttaaggagacattaaaatattgttaaagctctgtaattgacatggacacaaagaagggaataacagactccaggaccgcttgagggaggaaggtgagaggagagagatgattgaaaacctacctgtctggtactatgcttattacctgggtgatgaaataatctgtacaccaaatccccatgacatgcaatttacatatataacaaatctgtacatgtaccctgaatctaaaagttaaaaaaaatctgtaattgtgatttatactatataataaggatatgaatctagagtcttaacttcaaaaatagtgttttctaacctacacatgacctatatagaggtaaatggtattatttaaacaaataaattaaggttcttattaaatttcccatttaagcttcaagtgaagtttattatattacagtataaaatctatctaatataaattttcttcattttatatttgtaaaaccttataacttttaatttttccaatgaaatataaaatgaaaataaattgtcatcttcccttctaattgctctgtattaaaaatttttgtttctctcctttaaaatggcttgttatatatattaacatgacaatccccaataaatttattgtaagaattttatatgacactatcatatttttgtgcaactgtttataaataagccatctgttttccaaaaaatatatgcagagacaaaatttcagaaagccctacatataggtatccttatttttcccttccgaaaagtttttcagctttgactcttttagctaggataagaagatgaaagatgatgggtgggatttaaaacaaatgttttcctcagctcacacatcagaaatggtattctcaattccataactatttgttgttttccatcagactactagtctatcatgaagatgataaatatagataggttgggagttatgtatctgttgtcaactaagaatgtgcccaaaccaaaccatttggtgataatgttgactcactgcactcaaaagcagggttattttaatgcaaatgaacctgaattacttcccattacaaagttttctgctgtaaaatttggcctatctagtaaaggcacaaaaaacaagcaccaacttttataactaagtggaaagaaggggttcaaaagaagagaaaggaaagagaaaagtaatctttagagctacatttgtgaaccactttctttccttctcacatatcttgctctagctaaaaaaagaatctacagatgagcccacttaatagttatcataataatatttctagtaaaggtaggtaggacatttactgtttcaggaaaaatctcctcagtcacatgatacaagatattcttaaaaatcccaagactgtatatactacaatctccaaatatcattaaagtcattaagcaaagatgtgcactaagctgcacatatattaaaagtaatggaaaaaaacacaactgcttttgcaccaacctaatacaatgcactacctttctaaatacataacttttggagtgaaattgcatattctctcgctctcattgttacagtttggtgggaaagaagagttttataccccacctttgacaactggactttagactttgtatgtctgtcttcctctttctccttccaagagttactgaatatatatgtgtagtatgaacttatctcctagtttgcctgagagagtcccagttggcatctgtagacccagcatctggtacagtgcccctttaaactctcagaaacatcccaatttagttgtacagtcaatctagctatatgtggtactatattaaatgttggggacatcacagtgaagaacatacgattctttccctcaaaagatttagaaagatatacaggtaaacagaaaattggggaaactttctcctaatttcccagatttatatgatatctcctcttatctttacctttccgacttgtagcaaccacatcttccaaaacactacaagagtatgtttaatgtgccaaagtttcattggccaaatatagtctacctggttcctcactggcctgaagctgcctttctcctcaatagcctaagatatacctgtcctgcaagttataaacttgttttccaatatggctgaaatgctaatcaacagatttctttctaattcctccatctttttccatacaattaatactctaagattctgaaccttagaataattttaataatcttagataatctcaacagccaatcctgagttgcataatcagtatgttatttttaaatgttcccatgtattgatagtttgtcaactcaataacaatgtttctggtgataatttgatagtacaaacgataataagaaatattcatttaagtcagaaagtaattaaatttattatatcttaaatatatctgcaggtaacaagtcaatagaactaagtttaaaaaaacagggtatcttgattaaattgagcattcttttactgatctataagaggtaaagcattttagagtctcatgagtgtatatatattttagaaaaaactttaaaatacaaaatattttaagttctattagcgtatagtaataataacttttttttttcaaagaacaattcaagttgctattgaacatagaaacttttaacttccggaaaggcaattcaaagattcagtaaatatgcatttctacaattggcttttaaatggattagtttcttacgacttaggatttttcccaaaatttgtggagaagaaagtgtacatgtgatatttatgccaaccaaaaatcaattactactttgaagtgtaaagcttaaaactctacaaaataaagagaaacacagtaacaaagaagtaaactaataagagctatttctaattctaagcctaaaataaacactttgaagaaaaataaaccactgttctatcaaactttagtaaccaatatacagtgtactgtttcagctccttctttagctttccatctctctttcctacccgacagatcagatttgattagtggatattttatcatcccattttacactcttttacttcagtcctcttctttgttccctgtcctaagaatgtctttacctattctcaccaatgaaattcctactcaaacttcaaattgatcaagtatcttccttttatgaaacctttccagaatgctatctcttctttttgctaccacacacaagaaaattgaaaccccctaaacttcttgctctgtgctaacataatagtatgtatacttgtctcctagacttataagtagtcattttcacatttatttaccgtatcatagtatgaagtcctttgggaaaggaataaatgttatttattgaaagaatctcaattctgtaagcagcacttggcatggcacagtgtcagcacagttatatactgaaagactaaattaattgaaactgttttttttcttatgtaacatatggtcaatataaaatttggacaaatgatttaaaacaccttgtctattgatttttttttagcataatattaaagaacatttatggtggctttaaagaagttcaaaattaaataccaattcaagatttcaaatgcaattttatagaaatcataactgaggaaattattaatacttagagaaacaagcaatcaataattgttgagaggtcttttaattataatattggatgttaaaatgtattactgataaaattgatcaaactaaagaacagtctttttggtcttttttttgtttgtttttgagacggagtctcgctctgtcacccaggctggagtgcagtggcgcaatctcggttcactgcaagctctacctcccaggttcaagtgattctcctgcctcagcctcccaagtagctgggattacaggcgcctgccaccatgcccagctatttttgtatttttagtagagacagggtttcaccgtgttggccaggctggtctcgaactcctgacgtcgtgatctgccctcctcggcctcccaaagtgctgggattacaggcgtgagccactgcgcccagcttttttggcctttctgacaagtctctccaaattcatgttgtgtacactacagtctctaatttaataaattaaacaagacattgtcttgcatatctgtatagtatgccttttaaaagtgtgttaaggctggccgcagtggctcaagcctgtaattccagcactttgggagggagaggtgagcgaatggcttgagctcctgagtttgagatcagcctggggaacatggccaaactcttatctctacaaaaaaatacaaaaattagccagatgtggtgatgcatgcctgtagtctcagctactcaggaggctgaggtggaagggtggcttgagcacaggaggtggaggttgcagtgagctgagattgtgccatggcactctaacctgggtgaaagagccagaccttgtatcaaaaaagtgtgttaaaaaagcctgcaattagaaagtgtggaaatttgtctttttcatattggaaattcattattaatatacaatgtatgtatctgagatatgaaacagtagaaaaataaaattttgggaggaagataatttctatgttttgtaacaggcatctagaaatagaaatagaaatcaatgtaacagaagatgtctcatatggtcttttaagaggtggccatctagccaggtatcatccagccatctaagaaacagtctaatcagctcatgttataagtcctgtttttattgcttatttgaggattccccaatattttcatctttctaaagtatagaaatttagcccaacactgtatattaattgggcttttatatttggaaagttcagtaaacactacaatttcatgttagctttgaaactaacagcattatattgctgacatatttagctgatgattattaaatttctttttatacggcacaaatactaacctgcttattttttacttttaatcttctcagtgtctttggtcaccatttgacagattatttaaattgcatagtttctgaaatcttgtgatattacccaaggttttattaaatccactcatttttctattaactgaaatctgaaagagtacactatcaattctataataaacatcactgataagggtaagaaggaagctattagtaagaatggggcacatccctcttaataaggtacaggacacaaccttatggaacattacttcataaattttgaagaaggtataacatggtccttgaagtcaatgaccttattaaggtaatctataagcaaaaaacaacttccactacaaaatgcactcctccttaattagaaaaagtcaaagcaaaaagctgtaccttctaaaaatctttcttgaattaatctcaactttatacaagtccacactgtagaaaatgtgcaaagaattggacacatctatgtcaaaccaaaccatttcaaaatacaaaagccaatggattttgcgtttcaaaattaacatagagataatggatcattatttccatttctaactcctatctacactgtagacacagatatataggaatgaacacatgattcaatttgcttgtaaacacaaaatttttaaaaagttttaattatttttctctatacctcaaggtacatgatgctgaaaaaacaaatgtttttatgtgctaagctatttatccatattctgttcctcctacttttagctttacttttttgagtttacattttcctttctgcttcctttctaattattttcccattatatcaacctctgatactctaattttatattcatttctaaccaagtaaaattattactaattgagatcccacttactcagaatttttgatgaatcagatacaacatctagtattcctacttcacttatgaaaactggagaattacataaaaccataatgatatatataatacagaatcaggttcaagttgtttaaaataacgtaggaagaattatatatagttaaaaacaagatcaaaaggatatctgataagcatcacaaaaacagtaaatgggagagtgagcagctttgtagtctgctctaaaagaacagaaaaactataagaaaattccctggccttaaaatacacagaatcttgttgaaaggatataaaacagtataaaatgtcacaataataacactagcaaaaactagtacttacagtaacagtaacattaagaaataaataatagcacttattgaatatttctatgtaccagaaatttacatattatgtttaacctctacaatatttttattgtagatatgagaaaaatgttacctacacaacttaaataataagtagtgaaacttaaattttaaacacttttctgttttaaaagtgtgggttttcttgttttgttttcaatttctgtgggtacatagaacatgcatatatttatggggtaaatgagatacattgatatagacatgcaatgcataatctcattcagggaaaatgaggtatccatcacctcaagtatttttcttttgtgttaaaaacaatccaattatatacttacttattttaaaatgtacaattaaattattattaactgtagtcaccctgttgtgctagcaaatacaaggtcttatttattctttcggttatttttttttttttacccattcacaatgtgtatcctccaactcctaccctccactacccttcccagcctgtggtaaccatcattctactctctatctccatgagttcaaatgttttgattttcagatcccaccaataagtgagaacatgtgaagcctgtctttttgtgcctggcttatttcatttaacataataacctccagttccaaccatgttgttgaaaatgacgggatcccattttttcttatggctgaatagtactccattgtgtattaagtgccacattttctttacccacttgtctgttgatggacacttaggttgcttccaaatcttggctatcatgaatggtgctgcaataaacatgggagtgcagatatctctctgacactcatttcctttcttttgggtatatacctagcagtaggattgctggatcatatggtaggtttactttcagtttattgaagaacctctaaactgttctccatagtggttatactaacttacattaccaccaacagtgcatgagggttcctttttctctacatcctcaccagcatttgttattgcctatcttttgggtaaaagccattttaagcagagtgacacgatatctcattgtagttttgacttgaatttctctgatcatcaatgatgttgagcaccttttcagaagcctgtttgccatgtgtatgtcttcttttgagaaatgtgtaatcaaatcttttgccctttttaaaatcagattattagattttttttctatagagttatctgagcttcctatatattctggctgttaatctcttatcaggtgggtagttttcaaacattttctcccattctgtgagttgtctcctaactttgttgattgtctcctttgctgttcagaaggtttttaacttgatgtgatctcatttgtccatttttgctttgtttgcctctgcttatggggtattactcgacatctttgcctggaccaacgtcctggagagcttccccagtgttttcttatagtagtttcataatttgaggtcttagatttaagactttaaaccattttgatttgatttttgtgtatgttgacagatagaggtctagtttcattcttctgcatatgaagatctaatttcctcagaactatttgttgaagagactttaagaacagtgaatgttcttgacacctttgttgaaaatgtgttcattgtaagtgtatagatttgcttctgggttctctattctgttctattggtctatgtgtctgtttttatgccagtaccattttgtttcagttactatagctctgtagtataatttgaagtcagataatgtgattcctccagttttgttctttttgctcaggacagctttggctattctgggtcttttgtgggtccatataaattttaggatttttttttctatctaaatctgcgtatttttaacttctattctattacttccaaaaaagagttcaggaaattatagtacaagtttgaatgtggctaaagttgtcctgaatgaattcacaaacaggttacgctatgacatgaactcttaaggaggaggtatattttagggaagttgaagaaagagggagtatattttgggtatgcatgcatgggaaatgagataaatgtaaagtatttttaatactctgcttacacaattaaacatttaaactttttactaatttacaatggacttgcccatggtgaagctttttgtgagcaattttgattgtgaaaaacacaaacggcagtctcttattttctcaaactcgcatgcctgcaattgaactgaaatgagatcagatatcaaatatccattagaaaaataccataattctttgtggatttggaggaaagactgaactttctaatttctctttatggattttattggatggaccatcatcgtatttttggggtcaaaatcttaaatttaatcaaatattacatcagcacaccagtacatcagtagtttctctgtagaaagacatggaagacatttgcttaccttgtattacatgtgagttgtcttttaagaagaagttatacaggtatttgggaataaaagcagacatacatgcataagccaaggctaaaagagaataaggcaaaggcatgtaaaaaattagttaacagggtagatgaccatcagtaatgcattcacttagcacatattccttgaaactactattaaataacagttatgatagccaagtgctagaaaaacaaaattaagagataaaagcctctatgctttaaaatagaaaatatttttattttagacaacaaaaaataataattctataacttcaatttcaaactagcatggcaatcattatcacacaataatcacaacttttattacctaaacgttgtttcttaaaatttctaagcatgatcattattagtaagttatacggacctcacgatccttaactgctgctgatgcaaacaagagtctacgaactatggatttaggaatagtgttataattcacattttcaaacacagacccctgactatgtttgggtcagtatgagtgatcattggctatgcctaactaaacatagtaaaaaactctagtctagattaatgagtgagaatatcacagaacagagtattttaaaaacaattcaaagagtaaaatttcatttctctgggattatgctatttttacttaattccagaaaccgatgcaaattcggtcatgaaatagaatctgaaaatagggagatcttcagataaggcatctagacattcaagctatatacagtaacacactctatatgtgatttcagggattggagttaatcgaatttagtatttattgaaaagcctacaataataaagttattgcagaagggcaggaaaaaaaaaacctgccattgaaaaagggctgtcaaaaaatattacaacattagtatataagtattagaatacaagatagacacaagataaatttttataaatacaaagtgctttatgggctgaagaaggagaatgagaaaagtcttcattaaggaagaggtatccaaaatgataggctttggagatgcaaggttatggaaaagtgccaccataattgatttctttacaaattctttagaaagtatacttagacaaaaattaatctctaaagaatttagaataatcaaattccactaaatttctagtaatagctttagcataactgaaactctccagtaataaattaatccttcacatctctaaaatgagtctataatagattatttcacagaaatctaccagggagagaataagagccttaaaacaaaaacaaaaacctttcatgtgtgaatcaaatattttagaatattatgcgcaatgattatttaaatgttaaagaggcttaccttcattattgaagtttagatataggaatggagcacaaagtgagtcaagacctaacacagaggggttgggagaaagaagtcaaataaatataatctagtagaattgaagatatataccttattcaattctttgcattacctccaagtagattaaacattagaagtattatccatccagaaatatgttacttcatgagttactgtggggagtgagtgatagtgtagcacacagtatgtgtccaatatgaatcagttattattatctatattattatgagttgaaaagagaaatacaataatagaaaaatgtaagaatgttacaatgctttggatattgtcccatctctgactctaaatgtacaatcttggcaattacttaacatcttctggcatactttctcatctaggacatggagttttgcctatgttgtttttctttgggattatgaaaaaaaattctttaaaaattgtgaagtggattccaaatatatgacatttcttttattgataataatgatatgcatgtattgtcatgttgaaagaatgtacataaatctacctacaactgttaggaggatatagaatagctctgaaatacacagagctaagaaaaataacagctttatttaaactatggtaagaaatagagaactgaaatataaaagtagccacttataacaacacattcaaaaatagggttggaatgggtttctcattctttatcaaacacaaaaaataataatggcaaagctaaaaataaaagatatgaaccattaaagatacaagaaaaaaaagacaataaataaaatgaggactttaggatgatagactatttttaagtgctaatagccatggtaagtataaattagaaatcattaactataagaatctcaactagccccaattgatttaacaatttgcataggcgtttaaaaaatgtatccacaaagatcacaacagctccaaatattctttctgctttgctaatcaacttgtatattaaatattatgttttttaatgatatctactaggatttagacaaagatttttaaaaatgtttggatgtaaacctctcaaaaaatgaatcagagcgtcaatattgactttccccaaagacaaggatgtttagatattttaatttttttaaatgtcagttatgcaacaattttctaatactccagaggagttttaatgactacaaaagttaccttgccaatacacaagatcaggatgagacactacccaggcttttaatacacgcctaaattttgcatgaccttctggtgatgataacagttcatcgtactgatgacagcgaggaatatccacttcaatctgttaaaatagcaaaataataaggtgaaacagtaattgtgtaatcagcaataaacccttaatccttgttcattaaataaggaaaaggagaagctataatatgaatttcaaaacagaccaacttcttaagtgcctaattttttgaattttttaattgatcttatggaaagactaaagaagttgtatgtatacctaaacaggagaattagaccatttcttttgaaaggtatgtatgtgttaatatacttttcaaaaatattttcctttataatctggtccaaatgaagggcaaatttttcagatgaagaactacagtatttttaaaaaggtaacttgacctaaagtcctttaaggtattgttcttactaatttataagcataagagttatggtttctctaacaatatatgtatgcagcagtgtctctgtattcatgagagaaagaggctttcttcatgctccttcctaaaatttaaatatttggcagaattatcttaggttgcttaagaaaacctaaatcatacttgtctatctgtaggaattggagtgtctttatcaattgcatcgtacttggcatgaatagctccctgcaaaaaataaaagaagatatattaatttatcatatccttaatacaaatagtaatatagagaaatctattttttacaaatatctatctttggaaacctacccaactacagataagcacattcaaactcagggtagaactcatcttaagagaaattctctgtgtctttgacaatctgtgatgaaggtctctgataagtgacaatttgccattttgctgaggcaaactcttgaattatacataccagaacataaatgtcatggattaattacttagctagtaagtatgtttggccaacctcccagaccctacaacataacacaaccttgttatgttatatctataattacatgatagaatcattagggcctaaagaggtcatttacgcttttcagttagactgttaaaatttagaaataactgaatgaacgactacaaattttggtcgtgttctataggaccaagcatgaaaaaaatattattattctggcttattatcatggtagagaaagagccaggaagtagggttcaaactccaatatcggctattatcaacttctttgagacattaatttaatgagagttggacaacctgatacctgaagtcctcttgaactttagcattatattgttctacaagtctaatgattaatgtatgatattgaacaattggcattcttgtaaagtaaccaactaaactcaaaggtatttgtagactcttatcaagggaatcaggaatgaagaaaggaaattcttcaaacagaggattgaaaaggattaaaaatagttgaggatttctaaaaattttttagagtcagggtctagttctatcacccaggctagagtgcagtggcacaaccaaggttcactgcagcctcgaactcctgggctcaagtaatccttctgcctcagctttccaagaagctgggaccacaggcatgtgccaccattccagactggaattctttaaaaaggaaggataattatctataagagaatataagaagacaagatgacaaagaaattgacaagaaatgaaaaaaatctggcaagaatttggcccattattatgattgatgtcatcggagttctctgttagtattgcaggccaccataatttgtgacacatctttcctcacaaccacagagaaagtgctatttctcttggtagcatagtccaggtggaataggtgtgccaaaagtcactaaattatgttagtgattttgacaagtcagattagatggaaagatttctccaaatttagacagaaccatttataaacaatcatattctataacaagcatactttataagcaggactacccatttataactgatatatattcttaaaatattctatggtaataatcaaaacattttctgtgaccactattaaatgaaacattaaatagcataatctaataaaccctccattatatttttctattctattgttttcctatattctttccacttaaaattgccaaatattctaatgcttatattttactatataattttctaataactagaaaaatatatatttggaaagcactctccttctccatcctttctttgcataattaatcagcttctaaccttttcttttttccttacctcaactcccagaagagcagcccaggttaaacctctcataagaggaggaatgtcaactcttgcttctttccagatttggttttttttatatggataagcctatgatatcaaaaaagaaatgaaaacgtctcaaattacctagtgccatcttttagtctagacagttctgaatatacccatgataaaacttaagtgacttgcaataaatttcaaagtatgtgcaattattgtgtctggtgttattaatacacataaataagcagtagaatgaatgaatccctaacaccttgaaaaactcgtattatataattaagaagagcagctgattctacctgatttttaatccttcctctctatttgatgctctggggggattttaaatgagtcagatggaggataatagtaccagtctcatacgggttaaataagataatgcaggtaaagcactctgttaaaaacgtggtgatagagaagtgatcaataactataagctactattatgagtacttccgcattttgcatataaatttatacttttataaatttgtgtcttaggagaaatttctagaagagtattaataggacaaaggcaacagatgttgttaaggttcttgatatatgcattcaaattgttttacaaaatgtttcagtacattcacatttattccaacagaatgagagttccaatatcattgcatctgtgctcactttgctaatgcagtatggaaaatcactcctattttaatttgtatttttttcattcccagtgaagatgaacaatttgcatagatttactagctgtatttatattatgtactctatccatttctctgtttcaatattgatgtttttcctgttgacttttaagtcttcttttaaaaaataaagacattattccttttttaacatgattttgcatatgttaccacaccttgtttttactttttaattttacttactaagaacatgtatcatttttaaaatgaaagaaagctaactgaacaagataggtcataaaaattaatcttcttattactcaagattccctaagaattattgaaaaaattaaaaaaaaattccatatgggctattgttaacactttatactttagaatccatacctttagcagcctgtcgaagagaataattctatttagttggtactctgtatccttctctctgatgattaaagggagcgtggcagctgcagacaactcattattgctgtttgaatgaggtaaattagactggctgtaaaagagaacaaaagcaataaaaaaaaaaaatggacaaaaggtacaaaattttctttttttttcctaactctaccaacagtgatttcagaaaaagcacaaaattttaataaaccaaaacctcaggttattattttctatttaggaaacatttttcaaagaaaatgtataaaattcttataaatctaatataaatagaaagaaaaataaatctaaaatgagactacatatactcactcatcttcaagtaatgggtaaaatgcttctccaccaacatctttcaatctctgtgtatttaaagacaaaatatttatgtataaacatattgggcagaaaccctgatctgtgtttaaaaagacaagtaatataacaactataaatttataaagggacctagaaaagtataaaatagagtctaaaaatcagttcttaccataaacatgcaagcatacaatgcctctactgattacggtttggctgtgaaaaacaactatttttttcttatctataggtatcactcataaatgttagacacttatcatgatatattttccaaacagaactcagaattactagcactagtataaaacttaatgaatgggaaaaaaattttaagttatatgaagaaagatgattaaaaagaggtactatatagccatgtatatactaaaagaacaacttagatttatttttgctttggcataatacaagctaagtcaaaaagaaaggtgctagaaaaaggattccaaaatatttctcacatcatactttgaacatgtatgattcaaatagctaataaatcaatggagagagttcacttaatgacaaaatcattttaataaatgttgttccaaataacaaccctgacaggattacaggtattcttcaaaatcataagcaggaaggcagtagtaaagtaaaatgttaaccacatcctaagcaaggtgattaaagttaatgccatcttgcctgctgctctgctgttcaacttccaacttgaaggcagaatgtctgctcctatggggattgacatagaaattcaagctgtgtgtgcagcaagcactgatcttctgctgattagagtctttgtgcacccatgtgagttattcccagaatttttaaagcttaagaaaaatcttttactcaaactaagaattcagcaaacactgaatttatgcctggttctactctaaaaatcaatgtgctatgtacttatcctattttaaaaaacctttaggtatatctttcatatattaaaattttaagttaggaaataaaattttcccaagttttactgcattattaatacacataaatctttttaaagattagttttcagtatactgtatgtcatagattttatctaattaagtatcttgtctgtcttttctaaataaaaacttagcacattaggatttttaaaaggtgaatgaaaacactaaagataaaaattattatatggtttccatatcattttaagattcagcaaattaatatttcttaataactacagaagaagagtattttaaatttcacaagtagaactgtaaaggaattgagacatttagatttgaagcctacattcatttaacttggattatatttaaattgaagaaacaaattaagagcaaaacaaaatcagctgaaatcatatattttggatgtaatttattgttcgctgcagggtattattacttattttgttactttccacatcctttctttcaaagagattataaattcagagtactgagtaggaatagttatatattttaattttctgttgctggcattatggcagacaagagattctaatactctcctactatataacatgtaaaatattaaatggttagataagctttaaaacataaggaaaatgcagtgataacagatataaaaccaggcctagagagaaagtagttaataactgtggtctagagatttagaccataatgggataagggtttgggaacctacataacagaccttcagaatggagaagacccttctaaagccacgtaaagaaaaaactaggggaattgctggcttagacagaaaacaaggataggtacctatttcagctttggctatgaatggttaaaaataaaaaggctaggacttccactttcttatacaaaatataaacagcttagaaggcatcattcttcctctaacaagaaaaatgctgaacaaactgaaaatcaagaactcgtctcacatctgtcagaatcagagcattgtgatgtcctcaaagctggagggaccctcgaatacagggaatcacagctcaacaggaacagagccactgctggagtctgttaagatcaattaaaaggtaattatctaatacttgcaggctgagcacagactaatacgagagagaaaaacttctggaggccctgccttagggaggccttccttgcttccatgagattaacctctgcaggtcccaccaggttctcagggtgaagatctgagaaaaatacccttgacttcctgcagggggaggtggaaagtaaccaatctgaaatacagccagagtactctgttttccttgagaggcctgtcttaaagggaaactcttcggtcaggtcttaactaacttgggttttacagaaatctaaccaacttgggaaggaaatattcaactccagtccactctagtctttgatgtaggggaacagaaatacccaactccagcccctctagctttcctgtctcatgttggggaggaggagtgggagaagctgagaagccttgtgaaggtcacagcccaggaacacaggctcactaaaaaactgggacttaatgataagattataaaatacttctcccctatactttactatgatattaatagggcttctacataataacaggattcattccttcatttagttattatataggaagaaaacatataacacatcaaatgaagagaagtacaatggaggaaaaaaacaaaacaggataaagaatacaagggataggtgtggcgttgctattttataaaggatggccaacaaaagcccaccaataggtgacattttagcagagaatgtaaagaaaagaaatggaagcaccggaagagtgttacaggcagtgggaagagcaagtttaaaggccttaaaacatataactttagaaaatgatttaaaaacaaaataaacaacctgagtaaacttataaccattaagcagactgaagtaatgattacacccaaatagggataaggagcccttacaatatggttttaaagctaactcccatgaaacattcaagaaatagatacatgtaatcatataaagtctttcagaaaatagaaaaaaaaaggcaacactctcctatttattttatgagactagtatacccctgataccaaactagcatcgtgcagtaaaagaaaagaaactcacaggcctatctcaaatagaaacagaaatgcaaaaattctaaacaaaatattagaaaatcaaaacacaaatgtataaaaaaggaaaaatgaaatcatgatctgtttgggtttatcccagaaatacaaacatggctcaacattgaaaaaccccatcaacataattaaatccattaacataatacataaaaaagcatatgaccatcccaatagatacagtaaaaacactcagtgaaattcaacacccattcataacaaaacttataactaagaatagaagacctctataactcaatgcaacaaatatcatacttaattatgaaatataaaaagcaaacttttaaaaccagaaattagacaggagtgcccactatttgtttctattcaatagcgttatagacgctcagcaaaaataatgagaaaagatgaagtgagtagataagaatttggaaatgaaggaaaaaaccctaccttaattcacaaagaaaaccacagggaatctatagacatattatttaaaaaagaataggttcagcaatgttgcctgacacaaaatccacataaaaaaatcaattgtgttactaatcatgcacaaaacagtagttgaaatagtattttaaaaaatattattgatttattttttaaaatcctctactggtatacttaagatttggtacattttactacatgaaaaaatattattgatgtatattttaaactcatctactggtatacttaagatctatacattttactatatgaaaattttgcctagaaaagaactataaacaaatcttaaactctaatgtgtaagctgaattgtagtaatgtcttcattttactttgaaatgcaagaacaaaaaatatgatggattgatgaatagctagaaagatagacatgtgataaagcatgtaaaatgttaattatagaatctaggtcagggattagcaaactgtttctatgcagggccatatgacaaatatttttagctttgtgggccatgcagtctctatcgcaactactcaattctgccaatgcagaacaaaacagctatacataataggtcaatgaataggtgtgacttgattttgctaatagatcatatcaatgcttgatgtaggtggtaagttgttcactgtaaatgcttttcaacttttctgtttaaaaatttttataataaaatgttggaaaaaatcatactcatacttacatatatatatatattctatatacaagagcaataataaattaccttagaaataaatctgataactgatatacagacattaaaaataaaattgttatataaaataagacaaataaatgacatatttatttaagcatgttcaagaaataaaaccctacattttaaatacatcaattctctacaaattaacttatcaattcaatgcaatgtcaatcaaaaccctataattttttatgaagttctttatgatgattataaaaatcagctagtagaggaagatgttaaagagttcctactccattttgaggacaaaaaaactgaaggtcttcccttgctagatatcaacagttcacataaaactacagattaaggcaatgtggtatttgctaaaattagaaaaacaggccaacaaatcagaatatcaaggcccagaaacatatccatatacatagaaaaagttggtattatagatcaaaaaagtgaagagaaaactattcaatatatggtactgagacaaggggtatttttttaatcaatgaaatatgatattggataccttccttacaacttaatctaaaataaattctaggtggattaaagaactaaatgtgaaacaattatttaaatcttttataaggaaatatataaaaacattataaaacatacttataaccttgctattactttaaataagttacaagaaaaaatatatcaaaatatatttgactataaaagaaaatactgataaaaatttagaattctattcaataaaagaatcaaaaagttgaaggaaaagccacagattagaatatatttccatgacatacagctcacaaagatacgatatcagggacatagtttcaaaagtcctcaaatcaataagaaatcactcaacagaaaaactgacaagagatatgaactagtaatacatagaagaggtaggtgaactgctagaatatgtgaaaagacttacaactgcactataatcaggaaattaaaaattagtattacagcaaaatacctttccataccattagattaacaattttttaaaatgtgataaaagaaagtgttaccaggtaaataaagaaatgagaacagttacccaatgatggcgaaaagataaactgataaaatcatttttgtgaacaatcaggtaataaagctgaagttgtacagatgcaattctactctggggcacatattttacagaagctctcccatattttgtgaaatcaaagaggcatacaagatttcttgtgtatctgtaaggttttaattaaagaaaaaaacctaaagcagaactgtcaaaatatctttcttacatttcttagctggcataacgacaatgtcacagtggtatcatctaaaagcgagcttctatctcgaccttgtccaaagctttcaccatcctcaaagagaaaactgaaaagaaatttttaaaaataatatgtacacaaaatccagtttattgtttcttctagaaagtaaagtttattctaagtcatcaatcccttcatcaaaaaagaattaaactttagactggatgtttaataaaacaatgtttttttaattattattattatactttaagttttagggtacatgtgcacaatgtgcaggttagttacatatgtatacatgtgccgtgctggtgtgctgcacccattaactcgtcatttagcattaggtatatctcctaaagctatccctccccctccccccaccccacaacagtccccagagtgtgatgttacccttcctgtgtccatgtgttctcactgttcaattctcacctatgagtgagaatatgcggtgtttggttttttgttcttgcgatagtttactgagaatgatgatttccaatttcatccatgtccctacaaaggacatgaactcatcattttttatggctgcatagtattccatggtatatatgtgccacatatacataaacatatacatatgtgccacatatacattgcatataaaacaatgtattgagatttcttcaaacaagtctcattttcaaatatctcttgagttggtatgaatgtaagtatagagaatttcagaaaaacaaaagtgtcatttacaaccctttgttcatgcagtttcaatgctaacagtactctcctgacattaactcaatgtgttcccaagaaactttatacgtgtagaaaaagataaagggaagatgaaagaaaaagcatattggatagtaacctcatagaagaaaggatattaaataataaatgaataaaatttgtttacaatttcaataaattacttttaagaatctacatatcctttaaaccatttcttcttggaatttccgtaatcttacctctaactttctacttaattcaatgtatgaatggtataatcaaagttaacatttaaaaatcagattaagagagaaaaaaatagaaactagtcaatccaaacaatacaaaagtttaaaaagtaaagaaaaaaatgatgagcagatgacttctacagttgcctacaataatcaaaactaagtctagaaatctaaaaattaaaattttattttattttgagacagggtctctcattcactcaggctgaagtgcagtagcatgatcttggctcactgcagcctcaacttccctgggctcaggtgattctcccacctgcagctgcctgagtagctaggactacaggcacacaacaccacgcccagctaattttttttctttgtagagacagggttttgccatgttgcccaggctgatctcaaactcctaggttcaagcaatccacctgccttgcctcccaaagtgctgggatcacaggcatgatccaccatgcccagcctaaaattaaaaatttaaagtattagtagaagctcaagaaatttaggttcatatttttatgaataaacatgaatagcaatgttaataacaatcttagccccaaggctgtagaggtatttaacttccagtctaatttctagcatgatatcttcttatacagttaggcagatttttttgcaacacactagcacagtaatgatctctaggacacacagtgagaccacagagttcatttacatttacaagtatatttggaaaaagaacatagttcttcatagtaggaacattaagctagtttttagttaactgtcttaaatattctattgtgacttgtgtatttttcattaacatcaattattgcaagatattccataatattaacttcacttcaagtaggtcacaaagcaaattactgatcaaagacaactgatgggaactctgcaattagaaactttggccaatcaaacaaggtgttgattccaattgcttccaataatcacttagctgggatgcctaccaaaaaaattttaaaaacaaccaatttaaaaaaaaaaaacaccgattttcttttttattattaccatagaattattaccatgtatttatttatttaaattcccaagagaagtttctttccttacttggggagtgtgcagataggtggtttggatcgaatgatttccttgttgacaagctctttctccaagtcacctccagccaaacaccaaaggtaatacacttcttcaatagatctttctgccaggtaatcattatttatatctattaaaagcaaatttaaggaatcattgtattatattttctacttttattaaacgtcaacaggcagtaatagctgccattctaaaaaaaataaactctgaagaacagacttccagttcctagttctgattgtagggagcctgaaatttgctactccatcctaacaacaaataaaaagttgaacagactgaaaaatcaacaattcttggatctgtaagagaggtgaggacataggacaaacttctgtccccaggactggagacagagaggagaataaagggagctatggcattctggaacagacattcatgagcagtgcctcaggaaccagtgccaagtttggaaaacctaaactgtaattgataaattactggaggctcagtgtggacaagtctgagagttaaaaactccagagggaaccagtcaaaagggatagccccacacttttgtgagtctggagactgacaaggttctcacagtaaatattggaggaaaatgcccttatgtttccagcagtggcagaggaaatgtaaccattctgaaatacaatgagcactgttcttaacaaggtctgtcttcaggataaaccggttagtcagaggctaactcacttagataatatcagagcctaactgacctggagaggggaaataccaaaatgcagccagctctagccttctatgtggtggttaaggtatggggaacagaagcattctgtagtcagtcctacaatttaggtctcaatctttaagtgagccagtcactctagacaaagtgtttccttgcccttaaggggtggctagaacgagttggagcttgatatttcccctctcctactggaggtatgccatgactggcagattctgattcaatttttgtaataatttgaatgctcccgactgaaaataatatactactaaaagtggcttatataataaagacatttattcatctctgttaataaaatcataggtacaggaggggcctatgcttatcaaaattctagaccattttctgcattcagaagagaagaaagtggtgaacctatgctgcagtacctttcttgacaagaaaatttgttttttccctataagtagcccttatgtccagcactttcatttagatcccattagccaactctagttcacaagcttactgcccatagcaagggaaactagaaaaaaacatctggaattttcaccctttataatgaatacatagtattggaaattttacactctatattggaaaaggaataaggggagaaaatagcacatggggaggcaaccaacacaaattgttccttccctcatatctcaaggcaacggctggctgccttttctgaagtcttccttgatgtcccagacagaaatacagaattaggtgctcctgctatgctgccattgtgctatattcatattgaccttcatttataacagtgattgtataattaaatgtctgtctgccttcccatttggcatgaatgttacttaaagatacagtatgtgacacataccaggaactcaataaatgtttaattgaatgaatgtttagtaaccattttctgctatgacttaagtcataacaacttttcagaataaaggtaactggtgtcactaaaccttacattccaagagtcgtaatcttcacacaagaattaaaagtctaaaagctgatattctcttcaatatgcagaatataatgatatataattcttatcaataatattatttttagagatcatttataaataaattatatagaatatcagtaacttaaatagaaaggataaactgttagctcaaatgtgtgtgtttatgtgtattctagccactccttaagggcaagaaagcacttgtttaaaggctagaggcacaggctcacttaaagattcagaactaatcacaggattgactacagaatgcttctgttaactttaaccaccacacagaaggctagagctggctgcaatttgctatttcccctcaccagttcagttaggctctgatattatccaaggaagttaggctctgactaactatatatatatatttgtgcgtgtgtgcatgtactttgttttttgttgttgttgttgttttttgtagagacaggatatctctacgttgaccaggctggtctcaaatggctggcctcaagtgatcctccctctttgacctcccaaagtgctgggattacaggcatgagccactgcacccagccagtcagttatattttaatcacttccagaattgtctcttaattcccatgatcccaccaatatatattgttgataagttcaaaactgaaagtaggacaaggaaacttctttaaaaacaaggctcatattattctctatgctttaatttatcattacctttacacaactgactgatatcctcaggcagagttaaatcagcacatctcagagaagatgaaaacagactggcaggtttggtaaagggggtatataaaggtgatacctcactgaatactttgtccttcattaattgatctggggttggccttgagaacatttaaaatacagagcatgaatgaaagtcataaaaaatttcctagaataatggcatacattcaagagaatggataaaagtcttaaatacctcattagcacagaaaataatacagctctcttttgcagagtctagatgcatacttttatattataatcaaataactgtgagtaaatactgaattttttttacttatgttgtactttacctcatgatgtatcaaaaatatcattccataaaagcttctgcattgtttacttttaccctgactagcattcacctgctttactgaatatcttaaataattaaataatatttatgcaaactattataataataccatttggcttttcttcctgtcctttaatgtggtacattgacacaaaactatttctctctaacatgtcttgataaagttgtttttctaaaggcaaatttgtatacattattttcaaacattacatagtaaaggaatttagggatagctgtatgactagtagtgacatcatcaagtcaaagtcaattaatgaaacttctaagaaatccttttttattgtcaacaattgttagtttatcacaccactgatccaagttcattgctataatacatattgacaacaaacttttattctcatttcactgatgttattattgggtctaggaatacctacattccatagtttagttaatattctatttaaaagcttgaaaatgaactagtaacttctttagtgtatgtcagttttctgaccgtagtttaactttaattactttttcattaattcacaaaaaatgaaagcttacatcattcacagttatgatactgatgtcaattatatactactccatatgtacattatctttaatccattatattaaaacaagaaaaaaaccaattgcttatgcgtaaaggatctcaatgtaatcccaatctctaaataatatcaacctcttagaaggatggaaggtaaggcacttattcaaaagatctatcacagtttcaggaagctcctggtaaataaagagagaaaataattaattaaaatgatcaattttagaaatatactttattcaaatgtttgctaatctagaagtttttgatgtttttaaagtttttatttgtactttatacaaatttagtcactgtgaaaaagcaaatacttaaagagaaataagcattgctttaaaatagcttccaactggatcccaagtgtgtaaaataaattttcattcacagattgctatggtttgaatgtgttccctccaaagtttaggcttcatgaactttgaaacttaatggccaatgtgatggtattaagaggtgaggcctttaagaagtaattaggtcataagggctcttcccctggtgaatggcattaagaggcttataaaggtgagacctcacatagcaattgcctagcttgcccttctgccttgtaaggacagtgtttctctctcagaagactgcagccctcaccagacgaccaaacgtactggtgcctttaacttggacttcctagtttcaataactgtggaaaaataaatttttgtctttataagttacccaatatcaggtattttgttatagcagcacaaatggactaagacccagattaatgacaaacctttataatgtccaaacaaccatgctcttcagccagaactattaaagtgtcatctacacaatctataaaacagaaaaactatatgaataaatgctatttttctaatctgtccaacaaaccagaaaataaactgatcaaaaatgttttaatggagtaatgcaattttgaaacttaaaatactgaaaactttatcattttgttaaatttctttacatgttttgataaaaatgaaaagcttcagataaatactaattgaataactgacactgaaagataccagcttaaatagtttgataaaggagcaattcctttacaaggaaggtaaagatactctagctctctctgtctctctctaaatatacacatgcagacacacatagctgacccttgaacaacatgggtttaaactacacaggtccacttatatgtggattgtttccaaccaaacatgggttgaaaatacagtatttgtggatgcgaaatctgcatgtatgtaggaccgacttttcatacacatgggttctgtggggctgactgtggaacttgagtacacatggattttggtacatgtgagggtgctagaaccaatcctcttcaagaactgactgtatgtaaacagcgctttttaagaaggctttgtagttttgttttgttttttcatgattacaagactaacttatttttattgtacataatttggaaaatgtacttacatttatttgggaatttaaagtaaaaagtttaggttacagaccacatttaagaatctccaaggcttcttaatagctgtagtatcaatctttgtaattaaatgtggtaaatctggtaaaacttttgcaaatttatttataattcattattatttaatgtttactaatactttcctgtacatattcttatttgtaaatgtttttaacttggatactaatctgtcactcttttgcataaagtgttctatcactgtttttctctccttaattaccaaacatgcttaattaattccactccaaagtagattacataaatttttattaatttgaattatacatgtttggatccacatacatgaaaattcatatgagccttttataaggaaaaatcaatattcttcttgagttgttatttgtacatgattcatcaaatagaaagatagcccaaaagttaagatacattgtctgaaggtaaactgctacagaaatacaattttatattctcattttgatttcacaagttaatttacttggctagataataaagctgagattatttccatctaggttaaaattcctcagagaataaagaaatttctgctgtaatattttagaagggacctcatatgctgttctgctgatcattaccactgatcattagcaacttgagtaaagggaggatatttcagtgtactcactatttcaaaagaacacatcctcaatgtgcatgattactaatagtaagttatatttatatttgaaagataagcaattgtacgacacttacccaaagtaagcaaaaattttagtctttcagaaatatccaagctctgaaataattttcttccctaaataaaatgagaaaagaaatttctattaatatttacatgttttttctaggaaggcatttttctccccttatagctgaaactgattttatcaggcatctttatttatctccaaaagttttaatggatttttaaagtcagctccactaaagaaaaattactggtgaaataacattttagaaagtgttgcataatagttatcatttaaacattttatacatctaagggtcattacattctagtttgatgtaagcattgttcacttttgagatccacacatacctggatatctagatgtattccaggccatatggagtcttactttattgagaccaagatgcctcctgggtaagactgattatactctttcgcctaccgagctaattcttacttaaatatcatgattcggttagtctgtttctccattaaaaaaacttcataacactccttcctcttaccacaataacttcagacagccatccttcatgctcctacagcacctggtatattttaagatgcacacattatattttaattatttccttactagtctgcctcaggaggctccttagtataaggtctggagtcaaacacttataccttcagcatttatgagttgagcaatgattgtgtgccaaattggactcttccaccatcaaatagttatataaatttggcaaactacttaataccacctgaagtttcacttttctcatctgtaaaattaaaatattaactgtacatataccacaggttatggtgagggttatgtaatgcagaatatgcttcattaatgttggctatcattatatttctcttatcataaacaaattaagcttatatgatcatttaaataaacttagaaggaaaaggcttaagattacctggtgtttatagaaaaaagagatgctttgatttttttttaatagagaagaaaaaatgttcttaaacacttaccaaatcagaactacaggtagagttcattgaaaaaaagctgctattcttctcaatcttacattactgtcatatcaatcttctaaaaacgtagttttcatttcaatatcttgttaaacttttaatggtactccatatatcttatataacttaatataaacatcttaactttgtaaaaatatacacattatagagatatcaaaataatatatatctggtaacatttacattcacacttagtaaaagtatgtttccagagatgccaaaaaatatgtgaaattatcaaacatgattaagtcaaattaagccttttctcctcatatgtaattaatttgtacagcaaaaacatactattattaactttcctctccaaaagattattccaataaatgcacaatttccttttattatattaatatttctttatacataccacacaaagctcaaataaaatgattccaagagaccatacatctgatttggggccagaaggcaatggttttttacttggcatgtgatcagtggttttgaaaattccctgtgcaattacctcaggggccaagtacgagggatacctgtaatgatacattaaaataatgaaaaattacaacagggaaagaagcgatagtacatttttacaatcaatgtggtaagatctatgtaaaagtctcatgcaattaaattaacaactgttgctagaaagcattctaaactaaccatcataatacagaactttaatgtcaaggaatcaagagaaaatatacacaagtctgaaatagttttaaaaccttcatgtctccctccagcattagctcctttatttgcttctctctgtgtttttaacacagtcctctaggcttccaagtgtttttccttccttcttattgcctatcttcccttaacgctgaattaatatttaaagtgcattttatcttttaaaaaagtatttatttttagtagtaagaatgttaatgctataaaaaagatacaaattgaaaagtaaaactcctatctctacacccctgtcatccatacatatttatgtatatataactttgtccacccatcacctctgccccacatggtggaatactatacatattgctatataccttttttccacttaaagtgtattttagagattgttctttaaaaacacaagtatagagtttcctcattctttttgaaaactcccaataatttcattgatgtacttaatttgatgaaacaaaaacattttggaacttccattcttttgctattaccaataatgagatgaatatattatgactattacatatcccacaagtatatgcatataaatgacagatatattcttagaagtggcattccaagatcgtaaggtatgtgcattttaaattttgatttaccacaccaagttgccctttggggaggttgtatcaatttatattgtcataagtaatacatgagggtgcctatttcctcacaacttcactgacataaaacgttttttgaaaaccggtttagcaaatattgaataaatgcaaaacactgcctattaaatatgaataaggcataaagaagaaagcttcaatgaacacccatgtaccaagaagcagtttaagtgaagaacataaaattatcaccaaaagtccctttgtgcttctccctgattgtatctccacccctgttcctccagagaagacacctggaatttttgtgtttgtcattctcttccatttcctgatggttttaccatgtttgtatccctaaaaaatgtactgtttagtcaagcatatttctgaactttataacactggaattaggatgactgtattcttttgctctttcaatcaagattatctatattgttggatgaagctatatccattaaattcttatttctattatatgaacataacattatttatacattcaaatggcaatggcatttaggctgtttcctgctttttattattaacattatgaacaacgttgcacagaatgccatgtatggtatacatctgcaaaaggttcccaaggttaacaacctagacccaaatttctaagccataggatatgtgcactttctacttcattacacaatgccaaatgtttttcaaaacgagttataccaatctatacacttgccagcagtgaatgactgttcctattgttttacttcttcaccaacacttgatatttgacagactttttaatgtttaacaatctggtatataaaatctattgtggttttactttgcatttccttgaaaattaatgacattgaggcatatgttcatatgtttattagtcatttgggtttattattgtgtgatatgcccattcaagactttcgcttatttctctagttgttttggggtccccaagaccactctcatgtttagaaattcactagaaggacttacaagacttagcaaataagtgtactcacagctaagatttattacagtgacatagtaagggcatagctggatcacaagggacaaagatagagagggagtctccaggaacctatatacaggcttccttatgctctctccctcctatcagggatcacacagaatacattcttcttccagcaacaaaaatatagcaccacgtatgtgatgtatctttcattttcttttctttcttttttttttaacttctttccaatcttgaagaacaaatgttatgtgatgtttctggccagagaagctcattgaaaatccaaggattttatttgggacttgtcacacaggcactctctgcctggcatgtacaaaaattcaagaactcaagaaggaaagcaagtgttcagcataaaccactttggttgtttacaagcacagtaaactagcctcagcagttaggcatccatggggacatttctgcaacccaagtttcaaggcaacagccaagggcaaacattgctagcaggacttagtttctaaggatagcagtcttaggcttcctatgataatcttttactgcacagttgttctttaactccagatactaatgtcttcttcagtaattatgacttgaaatattttctaccactctgtggttttgtcttttctttctctttacggtatctgtttatgaatgagaagttcttatctttcagttgaattaaacttttttccttatacttaatgattttgtcaaaataatctgttaattttctcaaaatttcagtttagccttttatatttaagtttcttgattcatctagaattcatttttcatatgatgtcagacaaggtacaacttattttcctacataaataagcaattgagccctgttccctttattgaaacctctttctccccaagtagtgccagccgtatactaaatcaaatctccacacatacataggtttgtttcttggctccctcaactgttcatttggtcaatttgcctaagagtatactattacactattttaaataaaatatttttatataaaatatattttattaaataattactgaaaattgttaagagctctcaaaacatacataccttttagtttctctttgggaaaatgcaggctctttgtaggtgtttgttcttctctacatacattttaaaactatcttgccaagtatcttctctttcacatactgaatttttattgaaaatagataagatataaagacaggttgtagagaactaacatctttacaatactaaccctaacaatctataaacatgatatctccatatttatttaggtcttctataatgtctctcaaaaagatttatattttttccataaaggaacatatcacgggattttgtggtgtcactttgtcaggtggaaacctctgtggccagtggtgcctttgcctgagttttgctgggacccactgggcccgttccatccacttggactggcaggctgtgctcagctcgtgctactggcctggatgccacgcggccaagggagagccaggcatggcgtggcaaggggtgtatgagtgagtgtggggtctggccactgtgcacagccaggcacactggctgtggcatggcaagcaggtccaggtgctggcataggcactggcttcctgcaaggctgtggttggaccaggtgcgttgcaagcagcttccatggctggcaccagggaacatggttgtgcccggaaacttggagatgccaggaactgcagagccccaaagagagtgtcacagccctggctcagaaagttcctaggtctgggctccccaaagggctgcagctcctctctccttctgtcttctttccttgccacccgcaatgtggcaagcaaggggttgtttcagccctgtttgttatagctgttttagctctgacatttggcaggtcccaaattcttgtcctgcatccaagaagaataaggtacatggacaagtgaagggtgagcaaggtgaagagatttattgagctatagaacacctaaagagacccacagtgggtagttcctctccactggcagggtgtcccaaggagtgtccaacactcagctgagaggagaccctagggtggatagcttttcccctcaggtggggtgtccctatgagcattcagccctcagcagagagaagaccctggggtgggtagctcctctctacagctggccatccatcatctgctcaagtctggctgagtccagggtttttatggtcctcagagggaagaagtgcacgtccattggtccatgggcggccatgggtgggcccagaaaaagcaccacaagttcccactcaggtccacgggacctgcagcccatctcccatgcttcaggccctcctgggcttgaaggcagggcttcaccagggacctgcccccttctacccaggaacctgtctgactcctgtcactcttcatggtgcccaggctattcgtgccacggagcgcctgcccgccagcactgagctgccctcagccccccttcagactccctcccttgcttgttggtgtccgaagtccacagggagtcaaggcagcagggggctggagtgtcagtgctgcctcgagtgtgcacacacccagccggggtccaacagcacctgggcttgaccccaacatcgctccaagatcagagtgtgtacagggagccgggagaggccaggcagtgggagtagacatttccgagcctacagctgcacctgggagagcagggctcctgcctgcttccggcccccaagagcacagggaggcctgggtctgcagcaccaacttaggcagctgcaactgtgcccgggaacgtggggctcctgcctgctcctggcccccataggctccgtgaagtgacagccccagcagcacctcctccacactgcagccggcatcatggtagtggccatcccagacaggccgccactgccatcaatacctgatttgattctataaagtacctattttgcctgttctatatcttataaaagctatacatggtatgatgctatacatgtttgttttatatactatatatttcacatacaaaaatttaacctcccatctcaattagaaaaaaaagaactacatacctgagggcacttgcgtatctttttataaaccctctacaactaccaatgagacttaaatagaggatatactcagtatagttttgctttaaaaaaaaaattcctataaaaaatacccattaggatggccttacaaacaacaatttaagaagcaggtagtaaataagaattagacataggagcaattgctaaatttgaatcccagtgcctagaaataaaaggaataagaaccgttttagaagagacatggagtgaaattttgccatacttattacatatgtgcatgccctttcgtcatttattgtcagatttagtcatgagcaccacaatctagattttaaaaccagttagattaaattatgtcctcttacaatgataagtataatcaaaatgtatttaaatatatgtatcatctatgtaatatatattaagtaggcattcaaatattatttctatttttcttcctaccttttctacagctacctcctcacactatcattgctagtacttcttatttacattcaaaatacaagtcaattaagtcagggaatgtgacttaaattcaaatgggtaaatttgttttttaactcctttttcattttaatagaatgatgatggtgataccagtatcttcttatgatttgctcatgtatttctctcatatacaaattcgtattgtgttattttaccctaagatgatactgctcttccaaatgaatgtgtgatatctctagaaacagctgaagtctagtggaagcagcactagactagatgttataatacctgtgttctaatttcagttctaccacatattctatatgtgatttgggtttcttcatctgtaaaactggaatattactgcctacgtcacaaagctgttataaatattagtgaatatatagacattaaataaaaataaaaaatttaatacaaatgcaatggtatacttttatcatcaccacaatacatccagaagtcagttttcatcttttttcctgatttccagcacatctaacccaaaaataataataatgaaaaatcaagcaaaactacaggtaaattgttatatcaaaaacttctgacaggacagagataaactttgtttcaaatattttagtttcccttttaatcacaggaaaattattaaaaaataataagctctagaattgttatttaatgtagttcatcttttttcaacaactttctcttctgtagcatagcattttaacactcaaagacaattaccagaactttgctgtgagtatgactgatgaggtaaataaagtggctttcatcatctgtttgatgttttaataaggtattaagctactggccaactgaaatgaatgcccaatttccaactctttacagtattttgaaacagatggtaacattttactttgttgttccttaatatttgtcttttgaatcaactgcaagcttcttctggtgtaaatattttctttcatgccttagctgtttgatcactttatttttcctggctaatgtttcacattttgctctttgatattttctggtaagaccctttgggtctaagacttcaaagcaagccagaccaaagggtaacacaagaccaattctatccaagcattttaaattcaagtgtagctcttacttgatatgctttaagaaaaatcacctcctttcttcgattcatcactgaaacctaaagtacctttaaataaaaatcaaaaacttaaagtaatttttaggtttttggatttctttcttacacaaattgatttagacaaaagaagcagcagcaatcacttgtactacagctacttaaaagtcacctcgaaaggcatttatcatacatgacaaaggagctagagcctcactaaaaacttatattcaactataagttgaataaaaaacccctttcatattcgaaagggcttttttgaacaaataagaaattgtagactgtctttgcaaaataccattttcatgcttatgaaacaagaattggtttttgcctgtaagttttcaatacacaaaactgtaagactacgaatttatgtaccttaataagcagtccatcaaaacagaaaattctcccactaaacaatgagcttcttgaggacagaaagctatcttatttatttttgtaaaaccaacaggcataagagaaattgctcaataaatgtttcctcactgaataaagtttaagattattatctatgtcttaataataagacacagtcataaacttaaaaaatttagttaagaaacctgtaatttgagttataaagaaaaaagggcaagttatatatgaggctggctttaaaaaaaaaatcaaattaagtttttgagtaacattctgtttgaaaaacacactccatgactccatatcacaattctcagtaacggtgtgatagaactgattttaggaagcccaaagaggaaaacacaaatggatactatcaaaaacagtcacattacaattgaaaaaatatgattaatgtctctaggttagataataatactgcatcaagtttagtttccttgttttgacaactgttctgaggtcatgtaaaaaaacaaagtccttcttttagaaaatacaaactgaagtacttacaggttaaagtgctattatgtaattaattactcttaagtgattataaaaaacaatcattatacacatacacacatatatgctcggagaaaaaacagagaaaaagcaaatgtagtgaaatgttaacatttggagaaactgatgaagggtagagaggaattctttatactatttttgtaactattttatctaaaacaatctcaacttaatcttcagaaaagaaaataataatgaaaatgtctaaaagcaaccacacaaatataacacagaaatccgtatcaaaaacatctacttgaatatgcatgaaacaaccttccatttcttttgtggagggcaacatacatctgcaattccataacagaagtgattaaataaacctttctgaacttaaacatagactttcaggtatggaatttatctctatctctaatatccacaatgactcaacttgaatcttaatatatatcttagagaaaagggaattaaacataaaacattaaattgaaaataatgtgagagtgatgtttttcagtctcttgatgcacacacattatcattagttgagaatctagtcatccttcttgccttaagttgatttgattctgaatgaaatacagataattaggaaatattataatgtaaagaatgtcaatactgttagcttctctgccaattcaatgaatgatgaacatcaacgaggatgctgggaaaaactcattgtctactcattttaaaagtatatggaaaattgagatgcattaattttaaaaaagctgtttgcatatcaaaaaggaatatcaaatataattaacaaaatatacatgttatcaaagattacaaagttaaaaagaaactcaaaatagaggaaaacatatccttaccctattgggaaatcaacatcatcaccatgagctgtcatgtgataaagtccaaatttagccaatttaatatgtccctatgataataaagaaaaaaaacactatcaaataatttattataattggcaacatataatttatattataaaattatcattatacattttataactaaagaaaccattatataacaatattttatcaaaatgccactgtagattttaaaaaatcataattttataaaaaactatctgccaatagtctgctttatactcattaaatatgtatatatgcatatgtacacatatatatctcaaaatgacaaatgacatttttctttaatatttttgctgttacattgtctagttatttcacaaaacaaaaaggcaaaaacattctcatctgtcttgaaaccttggttagaatgttttgtggtaattttcacagagcaaatttttttccatggagttgaaagtccatttatagttataatttaactgtgaaataggaaaacttaacttgaaaagatcagttcaaaaatcatcaagattttggtgaatctgctagattttcaataactttttatattgtttgagaacaaaaataactatcataagtataaggctcttaataaatgataaatataattttacatattttaagtttttcccttttaatctataaggctttaaaatattaagttgatcttaaaattggtttgtcttctcaagaacattatttccaagcattataaaatatttatatttaaaaacagcttaaattgataaggtaatgattctttactgccataaatctgaaactaatgagtacaattttctatttttgtgtttgtgtgtttgttttttagagacagggtctcacactgtcatccaggctggagtgcattggtgtgattatagctcactgcagcctcaaactcctgggctcaagcaatgttctcatctcagcctcccaagtattgatttgggaaaagaaccagagaacaaggataatcctaacacagcaaataatgcccatgaaaaaatttcctccaagttgtttttatgtattttatgaaaaggaatcaaattacaattattcctgaaaatatataaccttactatccataattctctttgaagggtttacaagcttcttcttaatgccccataagatttccagtagagaaacagcacttcaatagtaaaaggaggtaggcatgaacagttggtaaataaggagataaatagaagaggaaagaaggcagaagaaaaatagagaaaacacaatgcagttggtttatatgaataacattctagcaaaaagagccattttcttaaaaatgaaaataaattaagaggaggagtatactgggacgccacaaggctttagaaataagagtaaaataaaaaaaccataaagttagaaaatgggtcttgtgggaaaaataatccatgtgaaagatatacagattaaataatttaaggattatttaatccttaaattcaaaaaccacagttacatcactttcatatagacttttcattatgaatattcttaaaacatattctgattctattgttcctctgactgagtagccctgatcccagttgcttccaatttcaaatgatatataaatatttattacatgatttaacaattacctttcggtccaacaggatattatgaggagacaatgccctgtgtactataccatgtttgttcatatactgcaagccctgaagaacctcaaatgctatacacaaaaccgttgaacagctacaaagaaaacaaaaagtcaaagatcaattacaaagcaaataaataacttgttttaacaagtgaaatgtgacctagtgaaaatattcaaaaagttatatttttattgctcctcttttattctgagaaaatagaatctatatattttctaaaatatctacctctacatattttaggttttctgattataacagaattaatctgacaaagatcctacagtttcctaaaggctactgtaatagcagtatttggttcttccacgaaagggctttaattttggtggtgagtgcaactaacctatagcaggtttggcttcgccaaattatcaggttaagtttcaagtatatggcagaactaagtcactaaaaactattttgctcaatacaaaatacctaagcccccgaaaaaagtagtaacaatatattttatggtatacaaacactagcttattttccatattcaacctataaagcaatctctggtcatttatgatttagcaaacttttctctttaattcttatcctatcctctacaagccatccttcacacagatatcctccagtttccttctccttttccctccttgtctctctcaccaaccatctccctaattttttttccaatttgcaagtctactcatgcaaattatcaggaaacaggtactgtatttgggtaaatactgctacttagcagtagtaagtaggatttggaacatgttttaatttttattattacactttataaagtatggattgttcatttgcagacattggtgcctgcattaaaatattttcttgtcaacattccttttctttttgaaaagttcaaatctcagagcataagacaaatgtaatactcacatacaattaacctagctttattaattatcctctaatgttttaatcaaaaattgttcacataggaaatttccccatacctacaatattaacattttcctttctatccattttttttaaatttttctaaaattaaattagtgtttgcagatagccactaaacataatttttaaaaccaatagtagagataatatggaataataaaaaatattcaatccacaaacaggcagaataaaaggaaaaaagaacagaacaaatagaaaatgactaatagattaagtacaaatggtctcaattcaccaattaaaacataaggattgtcagatttgataagaatttaaactcagctatactcagtctatgagaaacgcactaaataaaagacataggttaaaagttaaaaaatggactaacagattgccatgggcttgggtggggggtaggtggactacaaaagagtatgagaaagttttgtggcatgagggaactgttctatccttgattttgatgatggttacataattttgtttatcaaactcattaaactttacataaaacagggtaaatgttaaggtatgtaaattataccttaataatcctgactttaaaaaatactagattgaataaaatttttacaaaaataattgttgcaacctgattctctctccgaaattaaaaccaaaagaaataaccagagataaaagctaaaatttgcctctatgatcctagtttgactttccagagggaatcagcaggttttgttttcaattcttctggtggttagatttttacttacttactaactcttcactatgcaagaggatataattgacgtattttcacaactttcctatttttcttcctcaagtcctttttattacattgttttacattaacaaattttattttacattatcaaataatcatcagcaggtagttttcaattctggtggtagacttttacttaatataactaactcttcattctgcaagaggatacagttgtcatattttcacaacttccccaattttcttcccaaacttcttatctgtattcattatattgtttttacattatcaaacagtaagtgggataaaggaaacctacactcctttctggaaggtgaaacaaataagtaaatagataatgtgacatgtagtgattaaatgaagaaaaaaaaatgaagtagggaagacagataatgtggtcagggaagtcctcactgaggtgacacttatgtagaaatctaaaagaagtaaaaaagacaggtaggtctctggaaaatgtatgattcgggcagaggccacagcaagcaagtcctgaactggtataaagtcagcagctcacaaaagtgtattcagtgcgtgcagtagaatgagcaaagattaaagtgacaggagataagctcagagagatagctatgagtcagaagacgtaaggccctttaggccactttaagacctttgggcttttactctgagaaagatgggaagtgattggcacattgccatatgataataatgattaacacatatttactgtagaactaagcacagaaagaaatagaaacctaggccacttaaaccctagctgtcaagagaaaatgtctcagtcatcaagatttaacggataccataattttataactctatttatgaagattatcatcagctactataatttttatatctcatactatttttaaatttcttttttgtttagctataagacatcttgagaaattgtttcatacagagagcatgagtagaatattttcatgcacggcgcatctgaaaatatcttattcttgcctttaaacttggaaagaattactccattgtcttatagcattctttattaatggcgagaaggctagtatcagtctgtttccaactttgttgcagacatcctgtcactcttccctgggaagttttgaggattatttttactttatccctagagttataatatttcagcccaatatgtctaatgtgggcatatttgtgccagtcatcattaagcatgtactttcaatctgaagactcacatgttccattaacacagaaatattcacaaggaaaatttgatttgctacatctttcactgttttctctctctttttctctaagttggaactcttagtagacagatgataactggaactatttttttaatttaatttttttgaggatatagcaggtatatatatctatgaggtacatgagttttgatacaggcacaaaatgagtaataatcacaccatgtaaaatggggtgtccccccgaagtatttatcctttgtgttataaagaattcaattgtactttcagttattttaagatgtacaattattattgactacagtcatcccgttgtattaactttctgttttaagagcataatctttagtcctatctattatataacttaattccaggagagagagagatccagagatccaaagagagagagagagagcaagagggaaagagacagagagagagtgagagaaatccaaaccattaatttccagcatttctattatgtcctctagttgttccttgtcgatagatactgttctttggttatggatacatcattcctttgagtatctctgagaatagttagaagtcttttaattctgggaaaagagtattatcttcatttcctctatggtgagtactccctctccaccccatctccaggctctgtttttctcgaactatttttttacctcaaatattacctctggtaatccgatccctggttgtcatattttgaagtaaaggaataagctgatattccccataatgtgtgtaaaaaagaagcaatgagggttactatttataaagaatgctatttaaattgactgtaaaatattcctttttatcaaataatttctcccatattaaagtgccatatcactgagtcttaaacaaatagggaatgtgtgaaacaagcataatttgggataaacagagttttcataaacatcttcaaaaaataaactaactgtataaatggcaatattccaaacttaaaaaaaattatttgtaacttatcaatagttatagaggcaaagattttatgtaaaagcacaattacattgataaatatgtgcacatgaaagaaaacaaagtcttccccttaaaaaaaaagagaaacattccctgagattagcaaaatgtaaacctagttttatgaactcatttggctctacaagtcaattttagagtagcttctcttgttcttgtctgtttctcacacaactcacaaaaaactgatgccatattcagctatgacactagaggacctcagctgcatactacttcaatatagatgtctttctcatgaaattaaagccaaacctttaaagtgattttcccattgaacaagttctgaaactactgaacacatagactgcattttctactctctatactgtgcttttgctaattgtgagctattagacattagacttgcatgtcaaaaagcacattcatgttaaaaatgagctgatgaacatgcataccaaaataatttttaaaaattcaaacataaatgacataccgtttcttagctattacttgagagtacatgtcaattacaatctgatttgcttttctgtcctttcatattctcagaatttgattttttaatttgttttaaaatgtaaggtataaagaggaacaaaaaatgctattttataccatgagaagaacaaatcagtatttgcagaattttatgtacttactagctttttaagttatattctttaatactaccaataacttgggtcatgaaattttttaagtagctaatgcaacagcaaagtaaaactatcatatgtctagtagtagttaacatgttacagtttaattgaacatggacactaaaagaagatttaggattaagagaattagattcacacagttatataaaaaagatactgacaggggacaatgggactttatcctacacaattcccaagtgagaatcttgttaaatagacaaacccgtcagtaaccaagaaaatgtaaaattatactttaaatcaaaaaatattctactccttttgacatttttcagtaattattgttacttcagggcctgggtggctagcgtttactttgtcatcattgtcctgaacaactgaacataagaatccctagtgattataaatacagataagaccaaaaggtagctttcaaaataatataattgataactcccaataaagcaagattacatttgaggacatttttacttatattaaaacatatcaattgagtggctatttgtttgttactgaatttttgggcccacaattaccaagaagaagaattgatctgcactacaaacaagcctatagtatacttagaaggacagatttacaaactgataattataatataagcaattaactaagcagataagaattattcatcattttcctttgtcttcaaagaaaaataaaacataaaaatttacttataacattggtgagaccaaaagagacctacaaaagtcataaatcttgggaaagtaagcttaaaatctaaaagagaaaaacactatcaccaccaccaccatcaccaaaaaagatgttgatagtttctaggtatgagtcaacttggttgtatttggattttcaacatggctcaataaattttcaaatctattaggttggtataatcccaagtatatttttttatccctttccagatatatttcaaaggcaatttactgtcttcatgattaaatcgtccataaatcatctctagttgttggttaaaacatactgaggccaagatcatggatttaattcttaagcagaatggaagacttcgtatgttcacagccacaggttttcatctaaccccagccaatactcccaaatacagatagtctgtcacaatgagacactgcacaacctatatttacttaaaacatccaaatttttaactactacctcctatacttctctgttcctcattcctgaggacccactctttaagctcatcaagaccttggggtccctgttctctaagcctcctctgttaccccagccaagtggcccctttttgacatcattctttattctgacagatatggtttgccatttcaataattttttgcaaagatccttaatgggttctcattcaatggctctcccttgtggtagaattgaactccctttcttgatttccgacagtacacagttgagggtttctagattttatggtaattatttctatataagcttgtctttcccactgtatcttgagtatggactagcttattcaactatgactccgtatatctatcagtgtctgtaatgtgcatgttcaataagcatgtattaaaaataggtgttaaaatacatatataaaataatatcacacaatggtacaagggggaaagataattaaattctctaccactaatagaataacacctcaagatagaatgtataatcttttagttagtcaagaaaacacaagatgctcaagttcacccaatggctatccacaaaaaaaattcatttgctgaaaatacaactcttctagtcttttatttactgaaagaaacaggaataaatcaggatatactgggtaacaggataatcttgttaatatctgtctaaaactgtaaattagactaaattgttgagagagattactactggcctcaaaccatcagctcttttaggtatctgcaacatttccaagaagagatgttactcaaattgcaagaaataggggccaggaaagagaatgagaggtcaaggttgctgagatagatttggaaatcattcatgtataagtgataactaaaaccacacatgctatttcctcagatccatgatccatgatatttctaagggccactccacaagccaaaacacccatagtgtcagctaaccaagggaggaaacacatttctgcattctatgagttcaagatgttctttcaccttataaaacctgatcactcccacagaaattttccttttggtctaaaacattccttacttggtatcagcctgaattaaaatgttaagagagaggaaatacagatgaaatatattaatggttagctactgtgtaatttaagaaatggagaggaaaaataaaatgcttactaatgattaatgttcagataatattacaagtgaataattctgtgctatcttcaaagaaactttcctttataacttgaacacaaaagagctcagctagtatataacttttaaagactcattagtttataattccagaatttggggagggtgtttccaatgatgagctagtgtctttgaggcttttaatttgacacttatcacttactaaattttgatgttttgtaaaaaaataccacaatatttaacagagcaaaaaggatgaaaaatacaacagtttctggaattgaaaaaggaaataacacatttcagtactgggcacacatgttttagcctgaaaggacacaactatccatgctaaatttaagaatgtatttgcctcagattcagatgttttgaaatggaaattgcattgataaactgctacctaaagattgttttatagtaagtctaaaaaaagtaatcagtccatctgactttcagttgtgagactaggcatattttacaatttagctttaactccaaaataatcaaaatagaaccctgtaagtctggaatgtgtctaattctcaacaggagacaataaattgggaaattaactttccaacttgaatactagataacttttcttctcagcagaaaattaacttggtaaaatcaaatacatatggaaaacatagtctagcggtttgaggttcagacataaagccaggaggctctgtcactgatttgttatgcttagacagtgttccaacttcaccctgcctccatttgcaaatttataaagtaaaaaatgtaacaccaaacagaagctaaatggagatcaatgagctatcggccctgcacagaatcttaatcatcttaaaagcaaaacaaaataaacaaaaagtccaagtctccctcaaaaatcccagggtttttctgaaactatacaatatattttgttatatcatatgtatatatcctataaattaacaaaaattgcaagttgagttctccaactattctcctgacataactgaatcagaagaaccgttttctaacttctctgtgagaataaaatcaccatttgatacacaggtctggaggatctcaagattggctgcatatttctgccccatcaatgttttcttctcctaagcattttttcctatccttgcacagaaacttcaaaacctcttttgtcatcatagtcactaattctggctgtgcaaacacactaggtaataagtccaactccccataccctggcagcatttgggatgttggaagactgcaacttttctctaagacagaacttatcatggcatatagtgggttaaatctgtaccctgcatcattccaaagttgttttttaaattaaaattaatgtatatattgccatgtgaaaaaaagagaaacaaatttctattactgttcagaattttgatttgagaccaattcacatttttaagtggactaatattttagatgactaatttatcaccctacccatctcaaataatgaatgggagagggcctgaataatatggattgcttattacagcatctgcaagacagcatattgtaaacaaaagtttgtcaaactgaaatgttcagttaaataagtattggtctgtcttaagtaacttatgaccagtatgattgctgaaaaaaccctatttaccacgtcccttgtatttgtcagcagttggggtgatacagtgattatatttagatcagaaaatccaaaaatagccaaattttattcttaactacttctactagactccataagcttcctatgattcataaataggaaggcagacaaagcaaaataatactttaatagccaaagctttgtctccaaattttaatgtagaactctgagttctgcttacctatataaataaatacttttccctaaaccagatcaccttgaattagttagttctgtctatttcacctaaccttgaactagactttcagttctcaatactatgatataaggaagatcataccaattacagcaagcttcacaaaaaagagtaagaaaaagctcttatccatataatcccataatgacccaggaatactgtgtaaaaattggagaatagttatcttttaccaattcacaaaaaatataatattaataaatatggattcttaattttaggttctcctgtgtgtgttgttttcttgtgcaatatctgcaatcacttatttcaaccagaatctataagatggtagctaatttagctcaaatactttaaaactgttcttaacagtggtggctcacacctgtaatcccagcactttgggaggccaaggcaggaggatcacctgaggtcaggagttccagaccagactaaccaacatggcaaaaccccatctctactaaaaatacaaaaattagccatgtgtggtggtgggagcctgtaatcccagctacttgggaggctgaggcaggagaattgcttgaacccaggaggcagaggttgcagtgagctgagatcgcgccactgcactccaatctgggcgatagagcaagactttgtcccaaaaaaaaaaaaaaacaaaacaaaaaaacaactgttcttaagttgtataagtcagtatctcatattgttctacaaagagcacattgatttctaggtttcccaccaatggaagaattttaagaacctttcatcaaaagcaatggtacagaatcaccttaagggctcattaatatagatactgctgggttctactccctgcaattctgatatagtatctaagatgagtcccaagaatttatatttctaataagttcccaggtgataatgatgatgaaccacactttgagaaccgctgtcgtagaaggcgaatataaatgaacctgtttcactttcaggtatacaggaaggtatagtatagaacaaagataataggttttagatttaaacagaacaaagtttaaacccctgggctatctttttctaattgtcatctaacctctaagtatctttcttaatctttaaaatgaagtaataataaccgccagtacagctatgtggtaaagtttaaatataacatgcttatagagcctggtataaagtaggtactcaaatattggtttctttccgtgctacatacgtttcttaatgtgtgtatagcccccatcatcctttctcttccaagaataagttcatagaaagaactcatcaacttaatttcttttgacgctgatgacaatttttttttcaactaagaaaatatctaggcttactcagctccaaagtcattgtttatttaatttttttttttttttttttttgagacagagtcttgctctgtcgcccaggctggagtgcagaggtgcgatcttggctcactgcaagctccgtctcccaggttcatgccattctcctgcctcagcctctcgagtggctgggactacaggcgcatgccaccacacccagctaattttttttttgtatttttagtagagatggggtttcaccgtgttagccaggatggtctcaatctcctgacctcgtgatctgcccacgtcggcctcccacagtgctgggattacaagcaagagtcacctcgcctggcctctttaacttttaactacagttaagggtattttgcatatagcaaagatgtaatagaatataagcaaagcaaaccaatcgcgtgggtaagtacagggtaaaagtttaaaatttaaatcccaattatgggttcacttaactgaatagtctagtaggtcccattgaataacctggtatttctacctacctacagtaacagttaaaataatagcaatgataaagataaccataccacaaccactactataagtatagccctttaataggtctatccaccttttgtaatatacagatttttaagtcacaaactttgtgactaaattaaagactgggtctggataaatggatgaaaattcaacccttggctttacaattgtaactataacaacaaaatgtaaaaggaatacaacttaagatgaagttcctcttgaaaagatctgatattaactgggatatctaaatcttagacataataaatttttatacaaatcatatgagatatatgcctcacagcaatgactttgaaacaacaaaataaaactttttttcctgacctcttttctaaagaaaatgaactttgtttataggggcagcaagtagaattgaaatctaacagaaaatcttttctgcatttgaaataatatttttagagtatgtatcttttgtttatttgctggttagcttgtctgaaaggaggcccccaaaaagatttgtgcacatcctcacccctggcacctctgaatgttaccttatttggaaaaagggtgttttcatttgagaaaatcatcctggattatccaggtaggctcaaaattcaatgtcgagcgttcttataaaagggagacacatagacgagaagacacacaaagaaggtgatgtgaagacaggggcaaagattgaagtgatgtggccacaagccaaagaagccaaggaatgccaacaggcaccagaaactggaaaaggaacagaaggatttttattgaaagcctccaaagggggtgtgaccctgccaacacagtaagttttctgaattctggcctccagagctgagagagaataaacgtctgttattttaagctacctaatttgttgcagtagccatagaaaactaataaaatgttccaactttccatcacatgtttggtctttcgaaatagcccccatcctgaagctagaggctttcaagtgtcacctcatcagaatactcagctatggcttaaagaagccatcatgaataacaagtcaatcctattactcaggaaattccaagggtttttgaagctctgggccaggaacttgggacaaagaacaatacattattgtttatattagggaaatgcaaatgaaaactacagtgagatactacttcatacccactaggatgtctacaatcaaaagatgaaaaataacaaatgttggtaaggatgtgaggtaaatggaacctttgtgcattgctagtgggatagtaagtggtagggctatctttggaaatggcttgtcaaagaggtaaacatagaattaccatttgacctaaaatttccattccaatatgaactaaaagcaggtattcaatcaaatacatatgaatgttcatggcaaaattagtcataacagccaaaaggtagaaacaatccaaatgtccatcaacccataaatgaataaacaaactatggtaaagacatacagtagaaaattagcaatacaaataaatgaagtactaatacatgctataacatggacgaaccttaaaaacattatgctaagtgaaagaagctaagcacaaaaagtcatatactgtataattccatttatatgaaaaggtcagggtaggtaaattcatacaggaagtaagtggattagtggtttccaggggtggggagagagaaggcgagggactgctcattcttttttggagtgatgaaaatgttctagaattagacaatggtgatggctgtacaatcttgtgaagtggctctttaagagccactgaattttccctttcataaccatgaatttttaacaggtgaattacatctcaattttaagaattcaaaatcagctgagcatggtagcacaggcctgtaatctcagtgctgtgggaggccaaggtgagaggatcacttgagcccaggaattcaagacaagcctgggcaacacagcaagagcccatctataccaaaaagctttaaagtatgtaggtgtggtggtgtgtgcctgtagtcccagctacttgggagggtgaggcaggattgcttgagcccaggagttagaggttgcagtgagctatgatcatacctggatgacagagcaggatcctgtcacacatacacacaaaaaaagaattcaaaatcaaagcaatttacatattcattaaagaagaaaaatcatatcatagtctcaatagagattcaaaaacacatttaacaacattaaatacttctgattttaaaaacccttagccaattagaaatataagagtacctaactcaatctgataaaaggcatatataaaaaccttacagctaagaccgtatataatggtgaaatacttaacatttttccctgagataaaaaactaggaaatattgaccattcaatatttgtattcagcattgtagtggaggtcctatctagtgaaataggtcaagaacaagaaatataagccataaaggttaaaaaagaagttgtaaacatttctattcaacaatgatatggttgtttatgtagaaaatcctaaggaatccaccaaaaaactatttcaactaataagtaaatataatgtagcaaagttacagagaaagtgtcaatataaaaaattcacatatttctatatattagcagcaaacaattggaaaataaaactaaattttacctacaatcatatcaaaaacataagctacttaggaaaaaatttttaaaaagtaaagcaagaactctacatcataaactataaaacactgttgagagatactaaggaagacttaaaaatttggagagaaataacatgttaatctagtggaagactcaatatttttaagatatcagttctttccaaattgatccatacatgcaacgcaacctcaatcaagatgccaacagaaattttagaaattgagaaacttactataaaatttatataaaaatacaaagaaccaaaaatagctaaagcaatcttgaaacagaagaacaaaattggaaaatctatatttactgacttgaagatttactataaagctataatcatcaagatgttatgatgctggcataggaacagaaaaatagagcaatgaaataatacaaaaagctcagacacagatctatacttatatggccttttaattttcaataatggcaccaaaggaatgcaatcaaaaatgaaaattcttttaaacgatcagaggtaaggcaactggatatcagtatgggaaaaagtaacctcaacactatatacaaatattaaattgagatgaatcatagagccaacataaaatcgaaaactataatgattctagaataaaatatgggaatatcttcatgacttcggagtaggcaaaggtttctcaaacaggatataaaaagcagtaaccacagaagaaaaatttgacacattagacttgatcacaaactgtaacttttaagctgggtgcagtagcacacacttgtagtcccagctatttgggaggctgaggcaggaggactgcctgaacccagaagttcgagaccagcctgggtaacacagtgagagcctatctctaaatacaataataataataacttctgctcatcaaaatatatctttaaaaaataggcaagcctggccaggcgcagtgtggctcacgcctataatcccagcactctgggaggctgaggtgggttgatcacctgaggtcaagagttcgagaccaacctggccaaccaacatgatgaaaccacatatctactaaaaacaaaaattggccggccgtggtggagggcccctgtaatcccagctactcaggaggctgaggtagaagaaacacttgaacccaggaggcggtgcagttccaggcacactccagcctgggcaagagtgagactccattataaaataaataaaataaaataaataaataaaataaaatggcaagccaaagaggcagaaaatatttgcaaaaaaatctaacaatatgtatgtagaatatagagaatacacaaagaatgcctacaaatcaataatgagaaacaatccacttaaaatgacaaaaaattgaacaaatacatatgtgatgatatgaatacctaataagcacatgaaaaatactcaatatcctttgaatatcatgggaatgcaaagtaaatctataacgaaatactactttataccttgtacaaatggctaaaagtaaaagactaaaagcatcaactcctggaaaggatgtggagaaattatatattgttggtgaaaatatgtaaaaggtataacattttggaaaaaggtctaatggtgtttctataaaatattagtcatacacatgattaatatcctataacacaacaattctgctcaaagtatttcctcatgaaaaatgaaaacagaaggccacaaaaaaaagacttaacagggcatttatatcagctttagtcataatagccaaaaccctgaaaatagccaagaagttcaacaagagaaaattgaaaaacaaatatatttataaaacacaatacaactcagcaacaaaaacaaatgaactatgatacatgaaaccacatggatgaccctcagaaattatgctgaatgaaggaagaagtcttacacaaaacagtatatactgaatgactccaataatataaagtgctagaataaacaaaactaacccacgattaaaaaatcagaaaagtagttgcttggaaactgcaggaggggaggtgcagagatttactgggaagggacatgaggaaaatttctcagataatggtggtaatctagtcttaatgcatttagtttataaaagtgtatacatttgtaaaaacacatcaaatgtaaacttaaaaagtttgtgtacttcaccaaatgtaaatttaacctaaaactaaaacataaacacatattgaaatgtagttagttgtatacatgctaaactatttaggaatgaagtgtcctcatatcagcaattactttgaaatacatcaaaataataaagatgggttaaatttagctacaattaaatgttaaaatagttaaagttagttttaattaaaatgttaattagaaaatctaggtatattgcataattatttcaattttactatttgcattttttcataaaataatagccaagaaaaagtaaataaggtaatatgaaggcattttcagatgaccaaaatctgtgagaatttgtaagtatctgacttgatctaaaaaagtacaaaactaaatgaagtttttcaggcagaaaggacaggatatcaaacttgaatcaaaacaaagaaataaagagttcatgggctgggcgcggcacctcatgcctgtaatcctagcatttcgggaggccgaggcaggtggattgcctgaactcaggagttagagaccagtccaagcaacatggcgaaaccccatctctactaaaaatacaaaaaattagccaggcctggtggtgcgtgcctgtaatcccagctattcgggaggctgaggcacaagaattgcttgaacccaggaggcagaggttgcagtgagcccagatcgtgccactgcactccatcctgggcaacagagtgaaactctgtctcaaaaaaaaaaaaaaaaaaaaaaaaaagagttcatgaaatggcaaatacataattaaatggaaaagaattttttcttcatttctcaaagtctttaaagaaactttaatgccaaaaatagtacagatacatggtgaaatgtataatatatgtaaaagtaaatataaaatgtataacaaaactacccaaaagatgagaggagtaaatagaagtatgtcattataagattcctatcttatatgtgaatgggtataatcaactcataaaacactataaattttaaggatgcataatgtaaactctattgcaataacccaaaaaataaaatatagctaagaagaaaagataaaagacaaaataaaatgaaacaacaaaaaaaacctctgagtctcttgtagcctaattccaagtgcttatttagttgtaatccttctaccctcacactttattatttattaactcagtagtttctgctcttcagataattcccaacaggaaattagactagttaatttaatggatatagaccttttctataccttttatggatatagacaataccacaaaataaaattcaaaatgttcctttgaagtcagggcaactcctaattactaatctcctacctgagtcaatttactgaagtttcctcgctaactgaaggaactgattgaatacagaaaatatagtcagtaaatgaaccttgtaaaaattcatcactgaggttacacacagatgattttttaaaatttttttaattttaatttttgtgcatatacaatagatacaaatatttatgtggtacatgatatattctgataaaggcatacaatgtgtaataatcatatcaggataaatgggttatccattacctcaagcatttatcctttattggtattagaaacaatccaattatactatttcagtaattttaagatgtacaataaattattgttgactatagtcacaatgttgtgctattaaataccagatcttattcattctaattatgtttttgtactgattgactacccctatttcatccccacagccccactaccctttccagcctctggtaaccatcctctctatctccatgagttccaataaacaggtgagaacatgtaaagtttgtctttctgtccctggcttatatcatttaacaaaatgaccttcagtttattctatgtggttgcaaatgacaggctctaattctttcttatggctgaatagtactccattgtgtatatgtaccatattttctttacccattcatctgttaatggacagttaggttgcttccaaatcttggctattgtgaacagtgctgcaacaaatatgggagtgaagatacctttttgatatactgatttcctttcttttgggtatatacctagcagtgggactgctggatcatatgatagccttatttttagttttgttgaggaacctccaaactgttctccatagcagttatacgaatttacattccaccaatagcgtaaaagggtttccttttctccacacccttgccaacatttattcttgtctgtcttttggattaaagccattttaactggagtgagatgatatcttagtgtagttttgatttgcatttctctgatgataaatgatgttcagccccttttcataagcctgtgtgccatgtgtatgtcttcttgtgagaagtgtctactcaaatcttttgcccatttttattggaatattagattttttcctataaagttatttgagctccttatataatctagttattagccccttgtcagacagtttacaaatatttattcccaatctgtgagtgtctcttcactttttaaattgtttcctttgctgtgcagaagctttttaacttgatgtgatgccatttgtccagttctgttttggttgcctatgcttgtggggtattacacaggaaatctttgcccagactgatgtcctagtagagagttttcatcaatgtctccttgtagtagtttcatagcttgaggtcagatttaagtctttaatccattttgatttgaatttttgtttatgttgagagacagaggtctagtttcattcttctgcatacagaaatccagtttcacagcaccatttactgaaaagactttcctgtcctcaatttatgctcttgacgcctttggtaaaaatgaattcattgtaaatgtaaggatttgtttctggtttctatattgtgttccatcagcatatgtgtctatttttatgcaaataccaagctgttttcgttgctctgtagtataatttgaagtcagtaaatttgaatcctccagtttcattctttttgctcatgacagctgttgctattctggatcttttgtggttccatataagttttaggattgttttttctatttctgtaaagaatgtcattggtattttgatagagaatgcattgaatctgtagattgctttgggtagtatgaacattttaacaatattgattagtcccatccataaacatgaaatatatttccatttttgtatcctctttatttcatcagtgttttatagttttcattgtagagatctttcacttcatgattaattcctaggtattttattttatttgtagctattataaatggaattattttcttgatttctttttcagcttgtttgctgttggcatatagaaatgttactgatttttatcttttgattttgtatcatgcaactttactgaattcatttatcacttctaatcatttttttttttggtgtagtctttagttttctccaaatataagatcatattatctgttaacaaggataattcaactttttcctttccaatttgcatgcccttgatttctttctcttatctaattgttctagctaggacttctggtactatgttgaataacagtagtgaaagtgggtatccttgccatgttccagatcttagtaaaaaggctttcagtttttcccccttcagtataatgctattaatagctgtgggcctgtcatacatggcttttattatgttgcttatatccctagtttgttaagggtttttcaccatgaagggttgtggaattttatcaaaggctttttcagcatgaattgaaaggatcatatggtttttgtccttcattctgttgatattatgcatcatgttaattgatttgcgtatgttgaaccatccttgcatccctgggataaagctcacttgatcatgacgaatgatctttctaatgtattgtttgctagtattctgtgggggagttttgcatcaatgattttcagggatattggcctgtagttttctttctttgatgtgtctttttctggtttgggtatcagggtaatattggcctcgtagaatgagcttagaagaattccttcctcctttatttttcagaacagtttgagtacaattggcactaacttttctggaaaagtttggcggaattcagctataaagtcctctagcccagggcatttctttgctgggagactttttattacagcttccatctcattactggttataggtctgttcaggttttggatttttttcatggttcaatcttggtaggttgcatgtgtctagcaatttatccatttcttctagattttccaatttattggcatagagttgttcatagaagtctctaatgatcctttgagtttctatggtttcagttgtgatgtctcctttctcatctctgattttattagttgagtcttctcttttttttcttagtctatctaaaggtttgtaaatcttctttatcttttttaacaaaacaaacttttcatttcactaatattttctattatttcatttgtttcaatttcatttatttctgctgtgatctttattattttttttcttctactaattttgggattggtttgctcttgcttttctagtttttgaataagcatcattatattctttgattttttttaactttattgatgtagatgattatagctgttaacttcccttttaatactgctttggctgtattccacaggttttggtatattgtgttttcattatccattccattattgtttcaagaaatttttcaatttccttcttcatttctttattgaccccctttattagtctgttctcacattgctacaaataccaagactgggtaatttataaagaaaataagttagattgattcacaattctgcatggctggaaaggcctcaggaaacatacaatcttggcagagggaatctcttcacagggcagcaggagacagaaacacatgacaagaaatgtagatggcctctaggagctgacagcagcactcagtcacagtaatcaagaaaacagatacctcagtcctaaaattaattgcgaggaactaaattctgccaacaacctttatcagcttagagaagaattcttccccagagccacaagaaaagaaattgagagttcatttcctctaaccatatcattttatttttaaaaaacatttctaggaatatcataaagaaattcatatttgcatcatactttcaccaaaattcatttgtttgagaaataaaattgtagcacatgattaaaaaaaaagataatagggaaatattcaaactccatgactaacctaaaagtataattcattcattcaatagtccatttgccacatatttactaaatggaaacttttatacttacaactttaggagacaataaataaattacagtatgtatgtcaaaaacgttaactagagaagataaacaattccttccttaattctataactgtagactaacaattataagcctgaagggggaaagatatcttactactagagggttacagtataatataggcatttggaggaggaaaatataatttttgctttggttgagaagaagagtacgaagggaaacagtaagatgtattacttgaagaagtgctgtacattgcactaaagattggagataacagggttgagcaaaaagacatttcagtttttatggtaaatttcaaaattttggcattcactctcctcaatgtgtattaggaataattaaaactaattgtacaatttaggcacattggaaataataagagagttagagagtaatatttagagaagcagtagtagtaattggagttatttaatgagagaattagattgaagtcagatcctatgctaataagatgccttttcctctgggggaaaaaaaaaaagaaatggagaacctccaagtgtttctgaacagagaatggactgatcttcaaaaatattaacatagcagaaaaagtgggaggactgaagtatggctgaagccaggaagaccagttagaacgttacaatgcaatagccaagctgtttgttagtgaagatttaaactaaagaatgtataagacagagatatgtgagaactattgccaagtttgtattaacaacacttggcaattagtaagatataaggtacaagagaggcagaaagcaaaagtttgttgcaagataacaagtctaaatgtagagcatctttcggtattattttccttctttaaacaaaacatgtaaaacaggaagagaattatagatcagttatataaatctctaattcacatgacttcactaccataatttcaaatgcattttgaaactacggtcctcaaaagtaaaaaagatatgaaagcctcaagatccattatcagtttatattataaaataagaatatctaacatctatttctgattactacaacctgtagctcattattcaactctggaccacattccagaatgtgtccaaattctttcgagtatctcattcagtgagtaggcaatgttttaacaggggaaaataaaactcactaatttgagtaagtcagatcatgttttccatcaggctagtaaacagctgcagacatagtctgcttcccatcaaagtcttcacgtataacttctgcaatactaatggtattctggtaaattttcaaaaccataaccctaaaaacgtgacaaactacattttgttaaaggaatatggctctactgcccaccctgcattcacctgcaaacttaacacaatgtagaaactctattacaagtgccaaaactctgctgaatatctgtccatgagctacatttgctgatactttcataggttaagcaaaagtacatgctctgaataattctaacacaaaagggaaatacttcccatacagcacctagacttaaaagaaaaacaatttcctcatgcctgctttgatagcagtgataaaggtatatctgttttttaaatattctctggaaagcatttcaaagaggagttgagatctaaatttctccacttctcagtctcttgaatcttgctttagggtagcattaggtagattaataggcactaaatgtgagatgacttcaaacaaatctaaatgctgtacttttttcttgaaacctaatcactataggaatttaatttgacaattttatattttcaaaaaataattttgatcatttaacttaaactgaagagaaatgctggcaagattgaactatggcacagataacataaaagccactggaaagacagcagctgtctcaaaattaattccttatattaaagcctgaatggactgtaaagaaaatgttgaatattttttttcctttaaaccaggttagccaactatccacacaaataacattagtctataaaatactaacttgataacacctcataaaacaaacttatgttctccttttataatataaattctcaaaagggttttacggccgttaatactaagagagaacgtttgattttctagtgagatctggagcttcacgataggcttaaattgtaattattcccatagtagtagcaaattactactatgacatttcagtacaatattgtttcattcaatattaaatcggtcatgaaaaaaagtcagcaaattgacacagactcttctctaaattcctagttttcattcccctgatccctgtcccaccaaagatttaaaatttaaaatttaaatttaaatttcttaccaaatatttaaaattttcttcaaaatatatatcaagtaagatatatgctttgaatgatgcttatgtttagaaaatcaactgcaaattacgaccagacaactggcagcttatggttttgcaacagttatagacaaaggaacaagtaaaaatcacaaatgtcaagttgcaaccccatctaaataggtttcctgtttacatcagcccttcttgcaggtgcaggtgcttacttttggtagtaaaggaaagaactaatttataaaccttaagaacatcttctcactttctataaacaggttataaaattgattaaaattgcagtacatcaactctacacatatacctgctctgttactggagactaatgtaatccaaatatgtggaaaagtcaaatagttctcagcaaaattaatttagatggatggatcagataacaacttggaactgaacctaaaaggatcattcctactaaaaggcagtaagtactgaatgttatattccaaaatgtacaaagaaaacactgacttttagtctattatcagaataatttaaaaatagtactttatttacacaaatgcttaaatacatctcaatggaaaaaatggaaagacctgttaaggctactatatgttctatttaaaagaaaaaagaaaatgtaactggcataaaagatcatgtaaattttgcatttaatcctactcatgttaatatacatcctcaaagaatgtgcttccatctacactattttatcctcatgaagacaaaagcaaaatcattgaagaaaccactgatgttcattgccacaagatttgtcgtctttcaaacaaagataaaaaatggtaagcacagaaatgcaaaacttttcatgagctaatgatttaatcatactggcaaagcaatattgattgtatccttatataatacaattcaaagttcaaaaacatttttaaaaaaggttgggggatggtggctcatgcctgtgcctgtaatcccaacacctgggaggctaaggcaagaagatcactcgggcctaggagttcaacaccagcctaggcaacataatgagacccctgtatatacaaaaaataaaaaaatagccatgtatggtgatgcacacctgtggtcccaggtactagggtggttgaggtggaaggatcgcttgagcccaggaggtcaaggctacagtaagcagcgatcacagtaagcgaggtcaaggctacagtaagcagcgatcacagtaagcagtgatcgcactactgcactccagcagcctgggtgacaaagcgagaacctgtctcaaaaaaacaaaaaggcaggaggggtgggggtggaatagagttgaggtaaaacaatgaaaacggaaatttatcttttgaatcaccaacttctttcgcctcagttcctttaccaagtaaaagaaggaccatatacaggcagagggggaaatgtggagataagagactaccatactgatgaccagaggactgctctctttgtggcttatggggtcctctggaacttcggggtgttctggaacttttgggagcacaagaccatggataacatcaattttcaggatgtatagcaattctgatcatagctatgtccataaagaccctatttcacctgtgggacttctggatattcccttaatactctaccccctattcttagtgtataatcctttcttttttctaccccaaatactttaaacaaatatgaataattttaagaattccagatatttttcagttagcattaatattgatttagcatgtcactcctgttttgtaggagtgttttttcaaaagtatttgtatggtctctaagacatttgtggtagtcagcctccaggatggcccccaatgagccatgactcatgaaattcacatgtgcattcttgagcaatcctctccaacacagaatacagttaatggctgacctgtgtaaactaacaggatattgcattgcaggaataacagtgtgtgtttgttgacactaggttaccaaagccactgtagcttccaccttgttttctttccttagattgttcactctgagagaagccaaccaccatgctttgagcatgtcaagaggcctgtggaaaggccctcaatgtagaaaagaattaagcctcttgtcaacaactagcaccttctttataagtaaaccatcttagaaacagatcacccaactccagaaaagcttttataacagatgactggaggtccagctgttatcttgactgaaatcttgtgagaccttgagctagaaccatctagttatgctattcctatgttctgatccaaaggaattatatgagttaataaatttttattgttgttttaagccacaaagtgttgaggtaacttgttaagcaataactaattcatactctttcttctaaaaaccaaaaaattaaaaaagtcagtggctcaaacatcttcattaacaacacaatactgtttctctatgagggattgagaactcaagccaagtgaataactcaacaaccctttcttaaaaaaaaaaaaaaaaaaaattaaggtatgcaatcccagaactctgggaggccgaggcaggcagactgcctgagctcaggagttcgcgaccagcctgggcaacacggtgcaaccctgtctgtactaaaatacaaaaaattagccaggcatggcggtgtatgcctgtagtcccagctactcaggaggctgagacaggagaatcacttgaacctgggaggtgaagcttgcagtgagctgagatcgtaccaccgcactccagccggggcgacaaagcgagactccgtctcaaaaaaaaaaattaaattaaggtataatttacataggtaaaatgcatatattatacattttcagtgcatatttcatttagttatgacacacatacaccatataggtaatatctgatcaagatacaaaaatgttcatccccttaaaaagttccctcaaggccattttgaatcagttcttgaattaccccttactctctaacagaataaagcactgtttttctatcaccgaagataaataccgataatcttctatgtctggcttcttttgctcagcgtaatatttataaggttaatccacatgttgtgggtaccagtagctctttctttttcattgttgattaacaggttgagcatccctaatctgaaaatctgcaatccaaaatgttccaaaatccaaaattttttgggcaacaatatgataccacaagtagaaaattccacacataagtatttagtgtaaactttgcttcatgcacaaaattatttaaagtattacataaaattacacccaggctatgtgtataagctatcattcaaacataaatgaagttcgtgtttacacttaagtcccatctacaacatagctcactatgtaaatgcaaatactccaaaatctgggaaaaacaaatcccaaatccgaaacacttctggtcccaaacattatggataaagaattatcaatctgtaccatgtttatgcattctcctgtccatggacatttgagttctacccagtttagagctataatgaagaatgtttctgggaatattctagtgcaaatctttttgcataggtggacatgtatttttctgttctcttggataaatacctagacagagctgggactagagtgaggcaaatgaagtactacagtacaaaatttaaggaggccttataactaggactggaattgctggatcataaaatagatgtttctattaataatttagccttttttatagcattgaaattttaaatgtagacttgccataggttcttctgtcaagaaatctaccatttaaacaaagagcaatagtaggttaacatattagtctataaaaatataacaaattatatttatgaagacaattgatcagccaggcgcggtggctcatgcctgtaatcccagcactttgagaggctgaggcgggcagatcatgaggtcaggagttcgagaccagcctggccaatatggtgaaaccccatctctactaaaaatacaaaaattacccaggcatggtgggcatgcctgtagtcccagctgctcaggaggctgagacagaagaatcacttgaacccgggaggcagaggttgcagtgagccgagatcatgccactgcactccagcctgggtgacagagcgagactctgtctcaaaaaaaaaaaagaaaaaaaaaaagacgattgatgtattatcagatatgatgcatattaaataaaacattaagttaagaataacttgtgctacaatgatctctcaatcagtaaaactccttgttttacagataaggaaaatgattaagagacttgtccaaggatgcctaactagttagggcatattgcatcacacatattgcattgtaaatgcatattttcatcatacatattgcattgtaaatctttacacaaatttaacccaggctcaactaaaatattttttcttacctaaagttgtgggcataattggttttcaattttaatgtcaactagcttttaaagaaaattgctttttagcagcaggagactgtaaatttgaactagtgagcaaggaataatatattattttatttatttatttatttagagatggagtttcactctgttgcccaggctggagtgcagtggcgtgatctcggctcactgcaatctccgcctcccgggttcacgccattctcctgcctcagcctcctgggtagctgggactacaggcgcctgccaccacgcctggttaattttttgtatttttagtagagacagggtttcaccatgttagccagatggtctcgatctcctgacctcgtgatccgcccaccttggcctcccaaagtgctgggattacaggcatgagccaccacacccggccggaataatatattcttttaaataaaaatcaaagattagtgacattacaaaaattataactataaaaacacatttactaaataaggttaaactatttctaaatacatataaaagttatttttcttacctatagtcagattagacttttctaaggaaggatgtaaggctatagtgtacaacaggggttcccaacccccccaccatggactagtcctggaccctgtacctaggactgcgcagcaagaggtgtgcagcaggcaagccagcaaagctccatctgtatttacagttgctccccatcgctacattaccacctgagctctctgcctcctgtcagatcagcagcagcactgattctcataggagcacgaaccctactgtgaaccatgcatgcgagtgatcagggttgcgggctccttataagaatctaacgcctgatcatctgaggtggagctgaggcagtgatgctagcgctggggagtggctgcatatacagattaacattaatagagaggtttgactgcacagagaccataataaatcaattacttgcagactcatcaaaaccctatcagtgagaggcaagtgacaattaagctgtatctggtggtaggcttttgagtggcaagtgagttgatgtacttcaagtgtacagctgcatctggtggcaggctttaagtcaaaatgcaacatttattttagtctgcacgtggcctgcctattattttatttacctcttccatctgcacctccttcccacactgcacacttgtcttggtcacagttttgataagcctacaagctaacccctagtcacaatgagtaaaaaccaaacatcactggagaccttctttaaaaagggggaaagaccccatgatgagacagcagaagactctaagactgccaacaaaaagaaagcttcatttaaaagaaaataccaacagtcctacttaaattataggttcattgtaacagatgattcacattctccaagtatgctttgtatgctatgtggcgaccagctatccaatgaagccataaaaccttcaaaactgctttgtcacatggagaccaagcagactgattaaaagacaagtcttcgcagtttttcaaaagaaaaaaacatgaacacgaagaactgaagtaattactgaaagccaccacttcatcaaacgtgttgacactaagagcatcattcttagcgactaactacatagctaaagctaagaagccctttactatcggtgaagatttgatcctgcctgctgctaaagacatctgtcatgaaattttaggagaggatgccgatcaaaaggtagcacgtgttcctctttcgactagcaccataactagacaaactgatgaaataacagaggatattgaggcacaattgctagaatcaatgagtcaccatggtacacaattcagactgatgagttgaccgatgttgacaacaatgcaacaatgcttgcttttgtgcaatatatttttcaggaggatatgcatgaggatatttatgtgcacttttgttgctaataaacaccaaagctgcagaactattcaagtctttgaatgattaaatatcagagaaactgaattggtcactttacatcggtatatgcagacacagcggccaccatgactggacggctttctggtttcacttctcaggtcaaaaaggttgcttctaaatgtgagtctatgcactgtgccatccatacagaaatgccggctacctgaaaaatgtcacctgaacttaacaacgttttgcaggatatgattaaaattatcaacctcattaaagtatatgcccttggctgggcgcggtggctgacacttgtaatcccagcactttgggaggctgaggtgcgtggatcatgaggtcaggagatcgagatcatcctggctaacacggtgaaaccctgtctctattaaaaataaaaaaattagcaaggcatggtggtgggcgcctgtagtcccagctactcaaaaggctgaggcaggagaatggcatgaacccgggaggaggagcttgcagtgagccaagatcacgccactgcactccagcctgggcgacagagcaagactccatctcaaaaaaaaaaaaaaaagtacatgcccttaactcatatctgttcatgcagctctgtgaggagatggacacagagcatacacgtcttctcttaaacacagaagtaggtggctttctaaaggtggatcactggccagagttttgagttatgagagctgttccagagatttcttttagaaaaatagtcaccactggcagcacatttcagtgacacagaataggtcacaaagcttgcttccttatgtgacatattcaacctgctcaacaaactcaatctgtcacttcaggagagaacaactctgttcaagttcgcagataaagtggctgcattcaaagccaaactggaattatgggggtggcaagtgaacactgggatttctgacatgtttcaaacattagcagagattttgaaagaggctgagccagggccttctttctcccaactggtgcagatcacctatctcagctttcaaaagagtttaagcattacttcccaaccacaaaggacccctgaatgggaaggaatagatccgcaacccatttgtgaataaaccaggtgaattgacttcatctgtgctagaagaggatcaactagacaatatcaaatctccatacattctagattaaagtcaagacagaatatcccaagattggcacaaaatcactccttttcagcctgcttccatttccaacatcctatctttgtgaagcagggttttctgcagtgacagcaaccaaaacgagattacagagcagaatgaacataagcaacagactttgggtgtcactgtctcccatcatccccacatagaaccttctagttgcaggaaagcaagctcagggatcccactgactctacattatggtgagttatataattacttcattatatattacaatataataaaaatagaaataaagtacacagtaaatgtaatgcgcttgtatcatcccaaaatcatccctccaccctccatccatggaaaacctgtcttccacaaaactagtccctggtgccaaaaagtttggggactgctggtatatacatgatatctgcatttttcattctagaggctacccaaaaccaaatcatttaaaggagcaataatagcacttttattcaatttatttgttttgcttctatcaaattactaccatttattaagataaatgcttttcttcccttgaaaaagatttttcatctagaatattgtggtaatggaaaattattaaccagtcagagtaacaatatttttcaaaactaggatggataattataaatctataaacactcgtggcaagatgttttattggtttaatacaacttgatttatacattaagaaagatttttgataattttaaggtcacttcgggaaatctgtgaagaagttcatttaatagtatatttctaataaaagtttagaccacatactttccttgccaagagagtaaatttattgagtctttgaaataattgcatttaaactgtatcattaaattctatccaagctatgattaatatttctccctactctttaatgtgacctttatttaacacagttcactgtgtccctaggaatacaagtatcctatttgaagttacaatgtgatcctttcaggaaaataatcttttttttttttgagatggagtcgcgctcttttgcccaggctggagtgcagtggcgcatcgcggctcaccacaacctccgccccgcgggttcaagcaattctcctgcctcagcatcctgggtagctgggattacaggcacgcaccaccatgcccactgtggtggctcaagcctgtaatcccaccactttgggagggtgaggcgggtggatcacaaggccaggagtttgagaccagcctggccaacatagtgaagccccactcttatactaaaaatacaggaaaataatcttttttttttttttgacatggagtctcgctctgtcacccaggcaggagtgcggtggtgcaatctcggctcaccgtaagctccgcctcctgggttcacgccattctcctttctcagcctcctgagtagctgggactacaggtgcccaccaccacgtccagctaattttttgtatttttagtagagacagggtttcaccgtgttagccaggatggtctcgatctcctgaccttgtgatccgcccgcctcggcctcccaaagtgctggcattacaggcgtgagccaccacgcctggccaggaaaataatcttaatctcagctagtgaaatgcttagtactaagaaggtttcaaattttcatatatccccttttgaagaattttttgtgaaatatttcagagaatgcctacctcacaaaagatgaacactggactatgttaatgttgaattcatatgtaatctgtaaattaaattttctcaagtgaaaatttgcacctacctttatcattaaacaagtaacaaaagaaaccaaacccctgcagtttaaacaaaatgcctttttgtttgccaagttctgcttttcatttaattgttctgatactatacagtacctcacaggtttcctttctcgaagcaagtcttccagactacgttcacaatgttcagccacgaccactagtcgttctgagaaaaacaaagcaaacccatgttatattttatcaatacaacatgttaaaaacaaaataatactctccactgatgatattaatatataacacccataacaatattttaaaagagcctttcaaactctatattaactacattattaccaagtatataggataataaacatctaataaaacaataactatttttttctcttgtatttttcttcctctagagtttttcttacatacgtcaggaaaaataggtggaaagactgtccttggggaaaaaaataactcacccttcttctgacacacattgaaagaaagaagtaaaagattagatgaatatataaagaattttgaaagaagggaaaaggagctaggtacagattgcttgacactctggttttaaacacagacctttgaaattgcattcagaaacttgaaaaaaagtagaaatgatctgaatcataactatagagaaagaaattcaacctagaattattgttaacccttgaacaacgcagggggttcttaaaggtgccaaccccctaaatggtcaaaaatcacctataacttttgactgtcccaaaacttaactactaatttgcctactcttgacttgaagccttattgacaacacataaacagaacagtatctacatttattttatggattcatgacatacctttttttcttattttttcctatatttctaggctacatggttcatctatgagttttttcaaattgtcaaaaatctccaaagaattttccaatataaattcattgggaaaaaaatgcatatttaagtggatgtgtgcagtccaaacccatgttgttcaagggtcaactgaacaacagttgagattaaatattataaaacagtggtagacatgatcaacattaatgatgtcatttttattttccaacagatcaactgatcaagatggcacagttctaagggccagcctatacttttttttgcctcatccattattccaagtcactaacatgatgcttgataatgaatctaagaggaataaaagaaaagtacaactggctttacaagcttttggggatttgacaaggttatttgaggagtttggttcaaaagaagttggagtgttgtcagtatctatgcaaaacagattctaagtaaaataaagaataagtttaacacaaaacacaaagactgagactagataaggtaaaggtgcaaagaaactgcgaataatgataactgtaaaatgaaggtttggtgaaaatgaaaaagtagccaaggtagaaaaaagagacagaagaagataggaaagaggaagttcagagtaagaaatctagtatataaaatagttcagtaatgattggattaaggcatggtcttgaatggggaagtagagatggacaattgtgttcaggcagacatgtcaagtgcaggagcaaagtattatcttggatcttatctaagtttactctgtctagtgaaatgggattatacagaatgatctgaaacacaaaaattaaaaatgctataagtgaatattatcattttcagataaaagattccaattgtagaggaaaaggaataaaatgaaatagcaaatgatgaagctagagagagaggtgagcaggaatatttaacaggaatttaaagaaaattaactttaaaagaacacttaatgagaaaaaaagaaaaagaaaaggaaaccatgcaataaaaggtcaagttacttacttaacaaagaaaagcgtatgcaaaggtaagctccaagcaatttagtacaacagtgaaattccagaagaaaaaagcaggcaacattatcagaaaaccaaaagaagaagctgcattcctttgcttttcatcttaccacgttttgtccattttccttacatttatctggctccctcccctcagtatcctctgtaaatctttacctcttctacccaaattgaaatgctaccagttcctccacctttgattctgggtcttttttactgttttctcatctattcccaaggctgaaaaactctgagattttattgcaagcccaaaactctcttctgaactgcaggcttctatagcctatattataggctttaatataaaagtcacctgaaactcaaccaaacttcaacttataatttactgttaaagtctgtcccctttaatactgtttcagtaaatgatatcactatccagtcaactgctctagctagcaactaaacagtaatctccccttctcaaatccaaataaacagagtcctgttatttttacttctcaaacatttctagaatctatatagtttgctccatctgccacaatctgggcccagccagcatcatctcattagataactacaacaatcttttaactgatcttctcacattaattcctatttctttccaacatattttcacactaaagcccaactgataaaatcataagaagtctgaatatgaaactccctctctagcttcatctatattattttatcttagtttaccaacttccatcacactgatcttccttctggcctcctgccttaggacacttacacatgggttcttattgcctgaaatgatctttcccacatagtggttaagagtatagactattttgtctgggatccaaatcccagttttgctactaattaactatgtgacctcagggaaattttctaacctctctatgccagattttttctgtaagatgaagagaagaatagccacctgcctcacagggttgttgtgaggttgaaatgagttaatatataataaaggcctagaatagtgtgtggcacataacaagcaatagctgattgttagcttttattattactcattattcagggctcagttaaatgtgacttcctcaagggacacttctctcatccccccaacatcgatttgctgtcctacaacatactctattctacattttaattttgttttgtagcacttgtttcaactctaataatttgtatgcattcttattttggtccagccagcatcatcagtaactccaccttatccatggttttactttctgcagtttccaaacattttaaatggaatattctagaaataaaaaattcctaagttttaaattgcatgccattctgagtagcacagtgaaatctctcaccagcaattaatatatgccaaaaagaagacgtggccgggcacggtagctcacgcctgtaatcccagcactttgggaggcaggcggatcacgaggtcaggagaccaccctggctaacacagtgaaaccttgtctctactaaaaatatgaaaaaaaaaaaaaaattagccaggcgtggtggcaggtgcctgtagtcccagctactcgatggctgaggcaggagaatggcatgaacccgggaggcagagcttgtagtgagccgagatcctgccactgcactccagcctgggcaacagagcaagactgtctcaaaaacaacaacaaaaaaaagaagacgaaaagtgcttccttcaagtgaaaaggtgaaagttctcgacttgataaggaaagaaaaaaaaccagttgttaagatacatggtaagaaattttctattcgtgaaattgtgaagaaaaaagaaaatcataccagttttgctctcacgcctcaaactacaaaattatgaccacattgcaagagaagtgtctagttaagatggaaaaggcattaaatttgtgagtagaagacataaacagaagaaacacgttctgactgataagaatcagattcggtacaatcctcagttttagacatccactgggggtgctgggggccttcttggaacatatcccctgaggaaaaggggggcctactgtgatatcttttttcctatcagataatatattttatgatggcaggaatgaggtgggtctcatcacaggtgcctagcagtgcatcagtagttgcacacaggtgcatcacagtagtacatcacaggagcctagtgcacacaggtgtactgcatcacaggtgtctagaatgtcacctacaacatataggcatgtaatataaagataactgttagatgaattaactttagcaaaggcatgatgtggccattagaaatgaagaatctcatatgaccacagtcactgaacagagccctgtcctgtgtagaaaattacatgcccacgttataaactcagtataactcagtagcactgactttcatgtaaaacaaaaacaaaataatttattaaaatgtgcatattccattaattaaccattttaaattggatattcataattcttcatatctataagagatttccaaagtatctggcacaactaaaatttttcaggtttctggaaaccccttcaaaacatcataaacaagtgtttgccaaagcttcaagattctatggaactattaagcatagttttaatactgctgagccataatcctcagcagaacatcaaagtttctcccagagataatggagtgtataccaaaacaatatttccaatatgaaccatttttttaaagaaatctttagagagtcttcattctgaaatctctggaccactgtttaaaaataacatgttataaaaacaatatagtttcacagaataaagcatttaggaatcataatgtgccaaatataaatcatcaatgtagtagcattatttataaaaaataatgtgatgctaagatgaactttaaagagtagaatatacaataattgtgaaatagtcttacttctaacaaagatttgaggaagcaaaagtatgatgtagcgtctctagcctgaactgtgtgttttaggtttgacagggcttggctgtgttcccacccaaatctcatcttgaattctcacgtgttgtgggagggacccagtgggaggtaattgaatcacaggggaggtctttcccatgctgttcttgtgataattaataagtctcatgagatctgatggttctataagggggagtttccttgcacaagttctctttttttggcctgctgctatccatgtaagacgtgacttgctcctccttgccttccaccatgaatgtgaggccccaccagccacgtggaactgtaagtccattaaacgtttttcctgtacaaattacctagttttgggtatgtctttatcagcagtgtgaaaacaggctaatacaaagttaacactaagaaactgaagagaacacacatttaagcaagaataaaggagttgaataaggagtagggggaagtaaaataaagttttttaaagtagtggtttttttgtttaaatttagagaaagaggtgaatcatgaatgtcttaaaataatataaagggttattacaatatatttactgcatcacttttgttattaacagtaaaaatcgagactagctcatcacctttaaaatatgatatttcaataagtgtttatacagttcaaaaccaacaaagaaaaacattatgcttaaagaatagtattggtaccagaacactgtgatggtcagttttatgagtcagcttagctagaatatagaatccagtcattcaatcaaatactaatctagatgttgctgtgaaattattttgtaaatgagtaaagtctataatcagtttactttaagggaaattatcctagataatcagggtaatcctgattcaatcagtttaatagcctttaagagcagaattgaaagccaagtacactggctcacacctataatcccagctacatgagaggctgagacgggaggatcactttaagccaggagttcaagaccagcttgggcaatatagtgagactcctgtctctgaaaaataaataaataaataataaataaatatgagcagaattgaagcttccatgaagaacaataaattccaactgtggatgacagcttgagcttctgcccaagagttcagcttgtccttcttgaagacctgcctcatggatttcaaacttgcctagcagcaccccacaatcatgcaaaccaattcccagcaattcttttttatatattcatataacttacataaataacttatataattatatatataatttgttctgtttctcttatgaaactaatacagattaaaatttatatgctagagatacagaataaattatcttgtagttccatataattctattattctctactttaatttcaaataaaataatttttattcttgatttcaccagcaatcattgaaagatttctggataatcaataccaaataaaaaaggatgcactaccatttaccatcttcactctgcttctaaacacagctgagatttcaagctcacaagaaaagataaaatttgttaacatagtattttcaggctttactggctttttttctcctaaagatatttttctcctattagaaaaaaaattctgaaactctaataaaatgtttgccattcctgagattaaaaacttcatcctgctgagttagcaagaaaatattatcatctttgattagtttcgaatgatctatagaaaacagtgaaagctagacttctgagctaacataacatgtgaaaacataatgttactaaaacagaccacatgtaacaagagtatgtgactccaagtaagaagtcaattgttactgacttaacaataacatgcagggtgggagggggcatgactaacaatagcaagatatctgcatagcaagaacagaataaaagaggaaaagtagaatcaaaatcaaaattctttgaggagacacaaatcaaagtcatgtggtattacaccattgaaaaatatgtgttcatattgagaaatactttcactaaggagactgttcatcagaaacttcaaatttttcaaagtagatgcaactgaaatgactagaatgttttggaacaaacagacttttacataagcaattactctaacggtaaattattccttatacacacaacttttcagaatgctaaacattgccaataaaaacaagataatcaaattccctagcctaatgacaatccatattttcatttcagacaactagacttagaatatataaactttacacatattcatgacctatgttaccctagcagagagggctgctgaaatacaggagtagcagggcaggtcagggaagcagagtaaacagcaatatagtggacagggctaacgggactaaccatgctgttgaactggcctcagagaacaacaatcagtagaacgattacagtttctaagcggatcagttcccacccgactttgataatcaaaaagaaggttcacagggaaaataaggaagaatactccccaaagagaatcatgctataacgcagttcctaattcggtgtttatagaggcccgtttaggtagaggaaggaaaagaaggagctttagaactattttgtcaattgagaaaaggaggcctaggaacagaggaaaaaaccccaaatacataaagtgaagctccaaagaggcttccagatacagtgggaataaacaaagggctcttggtggaaagagtgtggaaagacaggcctctgccaaatttacagatgttcaccacccatggttaatactcagcatctactgtactgtcaaccaaagaatggttttggaaataggataaacttacaactggaaattctttagaatctgtagctggattaagggtaagggctgttgaagtatacagggattgaaaatatctattaattgcttggtgatgtaaaaagctccaaatgatccccgtaatttttcaacatctaattaatgtcactaaagccaggtaacaaataaaaatctttggcaaaaaattattttttgaacaaaaattaactcactgaaagttattttctgggctttcagcaaatggctggagctatctatagtctactattagatatagttaccactagtcttcacagttctctttaagcaaattagaaaaagcacccctccccctagaataaattagagaatcagatttcagctcccacttactccattatccagaagcttttatgcagtgaggcaaaaccctacacagtggccctgactgtgggtctcctaattggtaaatatatgacatggtgcaacactaggtacaggtcaaatcaattttgaaaagtctagtacctgacattagaacttctcaagttagcctttaagtaaagaagataatctctccataccccttgatactctacaccagtgcttttaagcccttttttcttttttttccattaggaatcctttttgaaaatctgcgaaaaactatgcattttcattattcagcaaacacatgtgtacatatgtatatacacatacacaattttatatgtaatttgaaggggttcacagacctcccaaagcctactgaagctgcaattttaaacttaaaatttcatttccttagatgtttactatagactaaaaataatcttcaaagcccttcaactgactgaagagaccatctcttggccaaggggaccccagagtaaccttgaaaactgagttctcagccatgataggacttagggtcagacaacctcattataccccacccccttaaccatgattaggctttcttccctagggacttaacaaaaaccagccctttcaaaagattccacaactgatatcaaccaactacctgacactaccccttcttttttgcctgataagagaccatttgcctgataaccaaccatgaagtggttctggccagtctaccaagaataagcagtaagggttttcgtgtcctctgctccacctttgacatcagagggccaaaaactccaccctcggatcatgaccctcagatgatgctagcattgccattttttatatgtgggacccatgaaggggcttgaaggggaatgaagtttaatgcacatacacacggttctcctttcataaatattcataactcctcccacagcttactgaatatgtatatttggccactctgctcagtataaatttctgttccctttgcccctccctcaaagtatctgtttcaagcttctcacaaaaggctatgcttcccagcctgtcacagtggtcaccctgcaggctataacccttatgataaataaagctctcctttctaagtttatgaacctcttcattcttcagtgtacctccctcacacaaaaaaaggtgggggacaaaaagctacagagacttcccagttcagagattaacaccaaaaagaacaataaagcaaacccataacaacagacataagatcagatcagagatctcagatcctcataccaaataaatttctataccatagtctccatagttcatctagacaacagattgtacaaacattataaagctttaaattgatattttttccacgtttaagtatctagaaattaatttcttaataagctgcctcattataaaaataatttgaagcagttagatttacttctttgccctggcctataagaagtatacaaccaaatttatagtccaactaaaaaaatattaatattactaacctcaaatcttattctgtttcctttctccctgaagaaaatcagaatatgccatctcaaaatatcccactttgacataaggattttgagtgaaggcaattagctctcttctctctccatttctgtctaagcagaacataaatctccctctgtaaagatgaaaggaatttccatttgataaattccatttggaaattatcctctcctacactaggaagaggaaaatgactcttatctacataacaaacttactaagtaattcttatttaccatgcatttctgagtcactttctcaaatcccaaacccctcttcctttgtctaccctcttctctatactttatttccctttgtgaagatggtatataagcctcaattctaactacctccatgagttgcatttctttgtgaaatctgtgcctatagattaaatctgggtttgtttgtttttttctcctgttaaccagccttttatcagtttgattcctgggacctaccattaagcatcagagagtagagaaagttttttttccttttttacatcttcaccttgattatttttctttcatgtactatatataaaatactgtatgaatgtctgcatcttgtctcaaattatttttgaaaaaagtaagcttgtaattaatcaagagacataaatgtctttttaaattaagaataattaataatgatattaagactttgtttcctagaaatatgtcaacaataaaaggccaacatcttttgaaaatccattaatttttgagactaccagcatcatcaaaatgaatgaatgtaagcaaataaaacataacagacagaagagccattgctctgtggtctaaagtcctttatcccaccaaaaccttttatatatgagtttgattaatatatatatattttttattatttcttatctttagagacagggtctagctctgtcacccaggctggagtgcagtggcatgactgtcagaggcgtgtgaaccagagcaactccatcttgaataggggctgggtaaagtgaggctgagacctactgggctgcattcctaagaggttaaggcattcttagtcacaggatgagataggaggtcagcacaagatacaggtcataaagaccttgctgataaaacaggatgcagtgaagaagctagctaaaacccatcaaaaccaaaatggccactagaatgacctctggttgtcctcactgctacactcctaccagtttacaaattccaaggcaacgtcaggaagtgaccttatacggtctgaaaaggggacgcatgaataatccactcattgtttagcatataatcaaaaaataaccataaaaatggacaaccagcagcccttggggctactctggctatggagtagcctttcttttattccttcactttcctaacaaacttgttttcactttactctatggacttgccctgaattccttgccgcacaagatccaagaaccttctcttgggggtctggattgggaccctttcctgtaacatgatcataactcactgcagccccaaactccttgtcacaaatgatcctcctgcctcagcctcctgaatagctaggactacaggaacaagacaccatgcctggctaattttttttttttttttttttttttttttggtagagacagaatcttattacattgcccaagctggtctcaaactcctggcctcaagcaatcttcctgcctcagcatgccaaagtgctaggattataggcatgggccaccatgcttggccttgatattcttcaacgcaaaattaacattctcttctttgtacttccatagcatagcatagcacattgtacatcacctattataacaactattactgtattatttaatattatcatggttgtatttttctctactgtttctgaagctgacttgggacctggggtaatgagttactcatttttgtatatttggcatctagcagaaggagggccatagtatcagtcaagggttaccaaggtattataaccccagtgtacatgtttgtcaaagcagtggacaagaaagacaggttcctaaataaatcttcaactcatcagcacctttattacttttgcttcaaagctaggtttctatcagctctgacttcccaatttgttccctacagagagagacccttaaggcctcaacatggcaccacccatgctcttgcttgagggattaagccaaacatgacaggcatttactaatatttgcagaatcaatcaatcaaagtcaaccttgaacagtaaaagaagtctcaataaaataatgtatactttaacatgtctgtgtgtatatacctatatgtcaatatgaaaaaacaaatttttttttatcatctgctagacaattaactttttttaccactctctttcccaaatctctcacgaagcctcctgacaacatctaactatttacagcactaggtatgtggtagagctcaacagtatttatggtacggaatagctctgattagaattctgtcaatatttgcattattatacacttacagcaacatgtacaatctttcaaaaaataataaaatgtattagcagtccatttttccttaatttccttcgtgtgcccttggatgaattaattgtgaaccttgacttaattgctctgtggtttaattttcttatctgtaaaatgacaggactagttcctttcacacagtaatgttacaaggattaagttaattaaaatatgtaattaaaatatgtaaaacactaagaatattgccttatataaacgctcaataaattttaacgattaataattatcattacaaaaaaaatttctactcagtctataaaacacaaatattctcagagtaaatattttaagagaaataaaccagggaacttgaaagtacagtttagtctattttcagcaaaacagtaaagaaaacattgtttgcatttatcagggtttttaatattaggttgaaacacataaaattgccacttttatagggaaaaagttgaatatcaccaactacatagggtttactttcagatttttttacgtctacaaattattttatgttagaaaaattaaatacatttcactgaaatgcatttaaaatatttttaagaaatgcaaccttaccctgcaattaagcttccaaaaataattctgaaataattaaaaatattgccaccataagaatctttaagtggagaatgaaagaacctgattacactactaaaaacgcagtaaacatcttcctcaaacactgactttttaaccaatagggttcaacttttctaattcagttctctaaatgggctgctatataaaaagactaatggagtttaaaaaaaaaaatctactgactcccttttcatttgaagacagttgccaaaatcattactttcaatcataaaatatattgttagataattcttctaaagttcctaacattagaacttcatttccttcatatagataaagaaatatgtttaagaatagacggtttccctgaaaaagaaaattaaaaatcctgattctcagatctgagaaacattaatcattcaaatatagttgttaattcattcattcagctaacaaacacttattgagtgctctgaggtcacaagtaaaggtccttatcctcaagaactaagaatcctcagaggagaaaaattaaatagaaaataataaaatgtgataaaagctataaaagaacttaggaaaaagacttagctcagattgcagggaatggagcatagcataatccatgagagaaaattgcaaagtacaaaatcaaggatatgtgaatcaaaaaacctcaaagcaactcagcttggctggcatgaagggttaaattagtggaaacaacaagcaatacatcgaaagaggacagcacagactagatcaaggactagatgaaggattttgtatgcaatagcctagtaaagagtttgaattttacctggtagatttgcaagtaaatggggaagtgtacgagagagaggcagggtgggggaaaaggatgagagaaagaaggacatgtgtgcactggtactgatgatagctttatatatttagtggatatagtatttataacttagggtaacaaagtagagaacataaataggaaaaaaaagaaaataacttaccatgctttcccctagaaatatccacatactggcagagtctgggatgggtgatggttttaaggatttgaaagcgccctaaaattttgatggaatttggtgtgagaggaagtccattgcttccacaaacatcatgtggcagagccgaggcaaagaaggtaaaggctcccatttcagcgtccttcaggggaaacatttttggagtcctaggtcttctaagataatctggaaaaggagagaattttaggacagaccaaacattaagccagacagaccaaatcttaagcatgattaacatacaacttggaggaaaatgccaacctgaacacttcacagtaaaaatatcaaagtataagaaaattctaaaatatcagaggacaaaacaactcagcataaatttatattgcagctctaaatcaaactctaagattttcaatggcataaaaaagaaaagattattccattctcaatgacatttgacagtttaaagagtagaggaagtttgttactgcatcttcatattattaataaggctcttctctttttttttttttttttttttttttttgagacagtctcgcactgtcacccaggctggagtgcagtggtgtgatctccgcgcactgcaacctctgcctcccgggttcaagcaattctccttcctcagcctcccgagtagaggcacccacgaccacacccagttaactttttgtatttttagtagagatggggtttcactatgttggccaggctggtcttgaactcctgacctcgtgatccacccgcctcggcctctcaaagtgctgggattacaggcgtgagccaccacacccagccaataaggctcctctctttacctaaagattgaataacccacacaccactgacaaccttccttctcatacagtgaggtaggtcaggaaagaggaaatataggtaccaactagtaacgaataggggaccttattaatagtagtaaagcttaaactagattaaaagaaggctctataatattaaataaccaattttcatttttatgctagatattttacataatgtatgatctgctttaatccttttaataatcctgacagagctattggctccagtttagagatagttgttccatgtgtatagcatgaggcgtcctatttgcacttactccaaaataaatggtgccccaaagttgcgtaaagtagtagcctggagagtaggaaacttgctccatatcaatctgaatcacattaaggcaaccataacaacaaaaaaaagggtcttctgacacaaaaatcttttacccatggacctcactaagaagacattctactggtaaagccctgcatttttcccttctcagcttaatgataaatatgctggaattccaattcaataaatccactttgacaagaaaccttactgaaatcattaaaaataaaatattataaaacgtataaacccttaacaaggaagaaaagagaaacaggccatgaggtgatgaaagatttctagaaacttgtacaaaacaaaatatataaggaagagtgaagcagaaagaaataagctacaacctgtaatagtcaagaggtttgtttggtcccttcagattcagaggcttcagactcagagaaggcgggaacaatgttaaacagcagtcagagggtttgaaatcagaagggtgaagtgttgaataattagaagcgtcaattctgccaccagccccacaacattggcagttatttacactccatgaaaaaaagaaaaagataaggttcttccctaaagaagctgaacaaactgagaactacactagttgctatggacactggtgagaagagcaaactcctcacaattccggaatttgtaggaccccagctaagatttggctgttcacccagccatcctaaaacaaaatatatccgtcaataagcctgtccatatatgcaaagctcccaggaagccttagctcttaaataatgagttgtctgagaatcatcagatagttgaggaaagactacagtatcaagggcaaacaatgaaataaacctccaaaaatctggctttggaagcaactgaaataatttatgaaaaaataacacaaaaaccaactctaacaaacatagagagatttgaggagatattgcatccattacataaaacaagttatagaaaaacacattatacaaaagaataaagagaaatggccaatagatacatgagaagataaacaacctcatgaataatcaaggaattgcacattaaaaccacaaaaaatttttatctactggacagtcaaaaattaagaaatctgataacacataatgttagaaggatgtggaaaaataggatctctaatttgctgtaagtgggagtgtaaattagtaaaatcactagatatgttttacactatcttgctattatattcctacagaaactcctacacacacacacacacacacacacacacacacacacacacacacacagagtggacctgtgcaagaaagatcaaggcagtattattgctcctaatatccccaagctggagacaatttaaatgtccaatggtaggtaaatggttaaataaattgtgctttattcacctgtatacataatgaaaaataagcaaactatagccatatttaatagcatagatgaatcttagaaatataatattgagtgaaaaaagtaacataaaatattccagttttcataaaactcaaaaacaaaaaataaaacaaataattctggaatacttatatctattgtaagaatatattcaataagtaagggaatttaaaaaaaatactcagaatatgggttactaccaaattaaagtggggtaaggttagggaaaaattcataaaaagcttcaaaaatcttgagtaatagcctagtttttagctggtgaattaatgggtgttcatgttatcattatgcttggtaatttccatgctctgtatctatatttatctacatatgtgtgtgttaataccacatatttcataattaaaagaatttaaataaaataaattgattctcaacaaaagcaaaagagttcaacaggaaaaggaaagtcctttttacaaatggtgctggaaaaagatattcatataaaaaaataataacctcaacttctactgatacatccacaaaaatctaagatggaacataggcttaagcgtaaaaggtaaaactgttagtcttctaattgaaaacataagcgaatatctttacaaccttaggctaggcaaagatttcttagacacaatagaacaaagcactagccacaaaagacaattttgacaaagtagacttcatcaaaattaaaaacatctgcatatccaaaggcacccctgagaaaataaaaattcgagttaaagggaaatattatttacatctgtctgtatatacatatgacattatgtatatatatgaccttttaaaatcaaacatatgtgtgtctgtatataattgacctgtattcggagtctataaagaaataccacaattcaataataaaacaagccaatacataaataggtaaaagtcacaaacatattttcacacaaggcatgaaaataataagcacatgaaaaagttcttaatatcattaattgggggaaatgcaaatgaaaatcacaatgacaaacctttaacttctacaatggctaaaatttaaatgactggcagtaacaagtgttgagaatgtggaagtggagctttgctatattgctagtgggagcgtaaaatggcaaaagaattttggaaaatatttggaaaacttttctaaagttaaaaatatccctaacttatgactcagaaattccactctttaaccaagaaaaatgaaaacatttgtccataaaaaaaaacactgtatgagtatgttcataggaactgtactcttaatagctaaaaaccagaagcaatgcaaatgtcccataagtgaatcaattaacatatttgtaccatgaaattctatttaacaaaaatggaacaaacatgtcaaaacatggatatactcaaaaacataaagtttatgaaagaagcagacacaaaagagttcatactgtatgactccatttaaatgtaattccagaactatagttctaaactatagtattaataaaaaaatcagaagatagtactgtagatgggggagaggggttgaataagcagagaaacagaggaactttctgtagtggtagaaatattctctatctcgattgtggtggtagtggttttatggatgagtacatgcatcaaaactcattaaattggccacttaaaatcaatgtgttttaatatgtatcaaattttatctcacacaaaataaaacagcttatgagaagataaacactgctatacattttcaaagcatcaaacgtaactagaaaattgtaaacatttcagacagaaaaaactgattctgctatcaacaagttaaagtgagactggcattctcatcagcaataatgaaagtcagaagagagcctggtgcagtggcttgtgcctgtgatcccagatacttgagaggctgaggtgggaggatcacgtgaggtcaggagtttcagaccagactgagcaacacagtgagactccagctcaaaaaaaaggaaaaaaaaaaagttagaagacatggaaggattgagagttgaaggaaaatacttttgattctatatacagccaaattatcagtcataagagcaaattataatttacagctatacgaacattaaaaaataaaattacctttcacttgccttttgtgagcaagtttccttaggatatattccagggaaatagggggaagcccaataacagaagatgaggggctaagaaacaatgttatttacccaagaatgaatataagcccaggataggagcaatacaaaaggactagaatgcaatctgttcaaattaaacagaaagccattgggctttaaggggaaaatcttcaaacagaggaatggaagcttgcttctatgtgcatcatacaaagaatgagaagattcagtgaagaaagcacatccacctacctattccccaggagaaagcagaaaggcaattaagaaagtggggacggttaaaaactatgtattacatactccaaaatataaagcatgctcaactacagcatattttgcccttggcaggaaagaaataaaaacccatttgaccttgatatcataaataatctccttagtatggcacagggatcatgaagttaaaactctggggaaaaaaacatatcagagcatacagcttggacttgctctaagtaacaactataaagccataatactgtaaacattttattttttttattggtttttggcacgtgaataaagcgcaaatgttatagttaagaaatatattactaactttgacaatgtacaagtaaatgtccagctaagagaaagtgggcataaatgtagtttctgaagtgataaagaaaaaggtagaatcactacttttctcgttttaccaaacaaggagtcaaatatattttcaaaagttgatgtgaaaaaagtagtttacgtatattattttgaattataaagtaaccaatacaaaaactaaaaattatgattatgactcttccaaaattcagaggagattgtgaatggtgtgggctatttctagaagtcaacggaaaaagaattagcagttcaacttagggctatctcaagaagtcaacaaaaagaattaacagtttaacttattatttaacctacagacctaaaattagaaaaggttaaaagtggttatctttgaagaacagtactgagagtaggacaggtgagacagttgcactttattattcaatcctactacgctatactacttgattttttttttttttttttttttttttgagacagagtctcactctgtcatcaaggctggagtgcagtggcatgatctcggctcactgcatccttccacctcccgggttcaagcgattctgtgcctcagcctccagagtggctgggattacaggcgcccgccaccacgcccggctaatttttgtatttttagtagagacggggtttcaccatcctggccaggctggtcttgaactcctgacctcaggtgatccacccgcctcgacctcccaaagtgctaggactacaggcgtgagccaccgcgcccgaccattttattttcaatcagatgtctttatcatcacatagctgaaaataaaataaccaaataaaacacaatgatcgaaaaagataaaacactaattagcataatcagtgttctttttccactacctcttaaatggttgtacataaaaaggctcacacacaaaaatacacacacatacattcacttacacctcgtgagtggaagaaaactaccgggggaaaaaaaacgtagagatgagagattagatgagggaaacagcagtgcaagcagttgggcttgaaaattcattcattcaacaaatattttgaagcccctattttaagtcagttgtttttccagctggtgggcaaaggataatgaacaagtcagactctgtgccctcaaagaacttagagttttaaacgactcgaatggggaaagaaagtaaaaaatagggcaaaagacgccgattttatcatgaataaaatttcacatttcttcaacaggaaaatgatactaattcatttattttatatatacattctctcaagaggttatttttgtctcaaatagatagaaaccaggacagggatccttgaaaagcagccactgacaatcctcaagtaacttccttcctctgcttcactttctcctactgctcaagggggtgttacactttgacgactgactaaacctcgagggccagaaacaaaccaaagcaaaattctgcctccaaggtgagtaatggaggggcggattctagattctctaacctcctttagccttcctttgaggcagtgacagagcgattactaagcctacggttcccaaacgactcaggtgaacctgatttacaggaaaggcgggctgtagctagggatggagacagtacctatcagcaagcggctccacagctcggttctctatctattctgaagacatgcggggccactcactgctcctgatagtcctctacctcccacagaccccacccactacgacacggaaaactggattacccaaatacctgcctctgagtctggggacgcaggcaagcacaaagacaagggggatggagcttctacacagggccccagcgctgtcgctgtggctgctgctgccgctacggcttagtgcaccagacgctgcatttcaggtgctcctacaaaagaggccactcctggaacgccgggagctcagacgctgccctttgctcgcgagccaagtcagccaaggttaaccttcgcggaacccggcgaggagcgcaagcctggccttccccaaacacagatccgagcttttcaccctctaccctcccctcagcctggccttttcttccgccctcacagccaccgcgacccaacgctgaggaaagaccccgacttgtggtgtccttccccttgcccaaactggccacgaaaggacatatagcgagagagaaagaggtgcggggggacggggggggtcgattgaaaatactgggtgagggaatggaagacgaggagcgtggtatggcaggttaatgggactgagcacaggaagaggaagaaagaattgagggttgaatctgtagaacactcaggctttcagcaaggacacctcattgggtcctttctcactgctatagtacgcgggtggctggacctacatgcttcctgctgtggctgtctcggaacccgtggtcctccgcttcatgtgagtgacgtcgtggcgggtcactcactcggggatcgccgattgcgatcgtaggggtcttccttctctaacttgcctccaggagagaggacctggcctgcgctgctaat

SEQ ID NO: 1675 - DNA, 270192 bp, Homo sapiens; identical to SEQ ID NO: 1672

SEQ ID NO: 1676 - DNA, 101350 bp, Homo sapiens
tgctagccttgcgcggcgcgggagagcgcagtggcgccggcgggaaagggctgcggacctgcggcgccgcgttgtgcgttcgacgacgcggcaccggcttcgacgccctctgcccgctccagaagcaggtaaaggcggcgggtgggaggcagggaggcgggtccaaggtgagggccctggaggttaggggtcccggggctccgagccgaagcggagggcctgaagcagcggcgggcggcgcggcgaatgaacccccaagccctgaatgtggggcccggcgcgggccgcctccgatctgacccgcgggcccggctgcccggacggaagggaagtgaggcgtcggcgagaggcgggccctggcgctcagcccgaggccgggcgaaggcgggggccgcggccgcttccttggcctccgagtgcctggcgggcctccaggccccagacacacccctctcgaccccccgaggtttcctcccagatctgttcccgccgggacctgaccttgcgcccctccaggcgccttaggtgtttgccaggcggagccttctgggaacttcaggccaccttcctgagcacatagtcctagcagagccgtttatttactcagttcaagtccagacacacagccactcacacgttcggattttggagactgcggggagactttcccctccccggcatttgtgtgtctttggccctcgtcccgcctcccctgcccccatctgcaactttgtccctcaatgggacccttctagagcccctctctcatcgggactctctctaagccgtccgtttggaaattcatcctcaatagagtgagtcatcttagcgggggcacagtttatctctcatgcgcttttggttaaaatagttttttttttccctccgaaagagagctagagtaatagaatgtagatgacaggtcagtgtcagtgttggcttcaaaggctcttcctttcggcggcagtctttgtaactaggatctgatatttgtggcacggacaggtttgtacacattctcgccatgcagtggttgtaatgtctccatggcacagttctggcttgaaggcaggattggctgctttttctactcgacatctttgagccaatcagcaagggctgcttgcctggagactggttaactcagtaaaggtggccattggttgagctcctagaagaaaatcctggagatgaacctagcctctcagaaaacaatgactgatttgcagctgtattaaaaaaatgttttcttttaatcccaacatcagccttttcactccgtttttattacttccagtgtttttctttcaaacaccagctgtcttttgtaactcgttttaactctcatcctttaattttaactaaaagacgcgctttaggaaatgtaaacatcgtgtgttctgtgttttgataaacgtggttccatctgcctttctaacattgtttactgctaaaggtcagaaataaacagttttgagtttcgctgccaggaccttttattatttaagtgccgtgctaggatggggggtaggagcgaggggctgtagtggtggacatggtgggaagaataggaaataaatggctgctcttttgcaaggaggctacaatttagttaatgaaaaaagactaacctgtaaaacaataaagaataaagcagttgaaatcagcacgcagtacgtacgaatgccagtttgtgtacttgttgactttagttaatttgaaggggagatagaagtactgtatttcatagaaaaagtgggcttaagttatggtagaggcatgttttttccttcattaaagtatattaaagtaggcatagtatcttgtatgtacacagtagaagctaaatattatcactagttgcatgttttttttttagtatttattttaaatctaaatactgttacatagttgcatcttatttatttatttttttgagacaaggtctggccgtatcgccaaggctggagtgcagtggcactatctcagctcactgcaacgtctgcctcctgggctcaagccatcctcccacctcgtcccctagagtagctgggactagaggcgaaagccactacgcccggctaatttttgtattttttgtagagaggaggtttcgccatgttgcccaggctggtctcaaacccctgagctcaagcaatccaactgcctccgcctcccaaagtgctgggattacaggagtgaccaccacgcccgcccggccgttttaaaacgctgattattttccttttaaaatctcccttttcatcatgattagccatgattatgcatgttttttgatatgcaaagcagcaaccatttattagttaatgaatttcagaaaaatagctatctaccttctttgctttcctttcagctttttatatgcaaaatcatattgtaagtcttgggaagaatcagttgtctattaaatgcctttagaagtagtttatgttaggaatttaagaagagattgagcattttttatgtatgtatgtatgtatgtattttgagacagagcctcactctgtcgcccaggctggagtgcagtggcgctatcttgtctcagcctctggagtagctgggattacaggtgctcaacaccacacctggctaacttctgtatttttagtagggatgggtttttgtcatgttggtgaggctggtctgtaactcctggcctcaagtgatccgcccgctttggcctcccaaagtgctaggattacagacatgagccaccccgcctggccttagattgaacacttttttgatacctaccttgcctgataatgagtaagcatacatcaagccatgtatcattatcaacctcattgccctcgtcctcatagtaatgaagtggcttatgtgtatgtacacacacatgcacaccaggtgctgttttaagcactttgcatatgtgattgtatttaattcttacaactctgagatttgcactattcttacaggggaggagacagagactgagaagtattaagaaagttgctgaaagttacccgactagtgtgtgggagtgttatgtatgtatcaggtaggtttcagtcaaacttagatctttgtgacccaaaaccttattcttttttttttttctttttttaaagagacagggtctcactatgttgctcaggctgctctcgaactcctgagctcaagcagtcctcctgcctcagcctctcaaggcgctgagattacaggcgtgagccactgtgcctgcgccttgggaagagtattttactttcttacctatctcagcattgccctccagaaattattttattagaactgtacatctagattgtggttaatcaattctatctgagctctcatacttcatttattttttttgagatggagtctcactgtgttgcccaggctggagtgtgatggtgccatcttggctcactgcaacctctgcctcccaggttcaagcaattctcctgcctcagcctcccaagtagctaggattacaggtgcacacgatcacgcccggctaatgtttttattttgagtagtgatggggttacaccttgttggtcaggctggtcgtgaactcctgacctcaggtgatccacccaccttgccctcccaaagtgctgggattacaggcatgagccactgtgcccggccgcacatactttaaaaattaaaagaggctttaataaatttatgtggctaagtagctagattttttttttttttttttgagacagggtctccctctgttgtccaggttggagtgcagtggcatgattatagctcactgtagccttgaattcttgggctcaagggatcctcttgcaacagcctcccgagtagctgggagtataggcacataccgctgtgcctggctcatttttaaaatttttttgtagagacagggtctcgctgtgttgcttaggctggtcacaaacttgtgggctcaagcagtcttctcacttcaacctcccaagttgctgggaatatgggcccgagccatcacgcctggcctgtttttctaaacgtggattgtatgagcatatcctttgatcatgtattagctgcttttcttttcttttcttcttctttttttaaaatttaaattgagacggggtgttgccatattgcccaggctggcctcaaacttctgggctcaagcaatcctcccaccttggcctcctaaagccctagaattacaggtgtgagccaccaccctcagctggctgtttttcttaaaactttatgcaagccccagatttaaggttattagtgtctttattattattattattttgaggtagagtcttgctgtgttgcccaggctggagtgcagtggcataatcttggctcactgcaacctctgcctcccaggttcaagcgattctcctgcctcagcctcccgagtagctgggattacaggtgtccactgccatgttcggctaattttcatatttttatttcattttatttatttatttatttatttttgagatggagtctcgctcttgttgcccagtctggagtgccatggcatgatcccagctcactgcaacctccgcctcctgggttcaagtgattcttctgcctcagcctcccaagtagctgggattacagatgtgcaccaccacgcccagctaagttttgtatttttagtagagatggggtctcaccatgttggccaggctggtctcaaactcctaacctcaggtgatccgcccgcctcagcctcccaaagtgctgggattgcaggcttgagccactgtgtctggcgtattttatttttttttttgggtggagttttgctcttgttgcccaggttggagtgcagtggtgtgatctcggctcactgcaacctccgcctaccacattcaagtgattctcctgcctcagcctcccgagtagctgggattacaggcacctgccaccacgcttggctaattttagtatgtttagtagagatgggttttcgccatgttggccagggtggtctggaactcctgacctcgggtgatctgcctgcctcggcctcccaaagtgctggggttacaggtgtgaaccaccatgcctggccattagtgtctttttttcttgaaaatatttgcattaatttgctgctttatttattttttggttttatttatttatttatttttgttttgtttttactgctttattttttggttactttttttttttttttcttgagacggagtctcgctctgtcacctaggtgggagtgcagtggtgcgatcttggcttgctgcaatctccgcctcctgggttcaagcgattctcctgcctcagtctcctgagtagccgggactacaggtgcccaccaccacgcccggctaattttttgtatttttaatagagatggggtttcaccgtgttagccaggatagtctcgatctcctgacttcgtgatcctcctctctttaatatctcttgaatctgttccttttccctatcctcgctgctgccctcctactccatggttagtatcatgtctcacctgggttgttgcacgagcctcctaacagctcatccctgctttcagtcttccaatgcatttttcccactgtagctagagtaatctgtctaacacattactcctctgcttaaaacttttttgtgacttttcatggcctttaggataacttctgaacttcttttttttttttttttgagacttctgaacttcttcacttggctttcaggatcctcatgatttggatccttattgacacttggctgtcagtgtgctagccctattaagttccttgtatttctccctgaaggggtcagagttcttaaatctgcacttgagttcagaagcttctatctgtctggaatacctttcctagtttgttccttaccctcacttttgttttattaactcaggcttgtctttcaggtctcagcctaggtggtagctctaggagaaagccctcggatacttcaagtctgagttacatgggcctcctctttgtgtccttagcactccatgttcttttattacattgtgattgcttgcttatttgtcatctcaccacatagcggtaaatggactgtcttaaaaaatgatgtgatttgcatagagtgtattgaaagagaatgaaatagtaattttggggtttatctaatacagagaggaaagggacattatatttgatagatgaaagttttctaagccagagaaggcataccaggcccttttatagcctgaatgaaaaaatcctttgatgtctaatttttatcaatttggtttctctattttattagttaggactttttggtgttcaagtaacagaaatacagcttgaagtagcctgtaggggaaaaagttattggttcatatgaccatataataggcattgtatgaataaggatggccatgaagagctagggtgggaactttcccatagttgggacctttccgtacttatactctgtgcatactggctttattccttttactgaaaatatgtttcttcacatggtaaacctgtttcatggcagcacaggggtatcaactagaaccttgaccaaatctagtgtttgaagggatgaagtactatgcttagttcattctaggttgtgatatgctcacttacatggccagggatctgttagcaaaaagcagagcagaccttgagtaggggagaggacggagttctgggcagacataaagaatatccactttaattctttatcgttttattgatttatttatttttaattaaattaattaattaattaatttttttgagacggagttttgctcttgttgcccaggctggagtgcaatggtgtgatctcggcttactacaacctccacctcccgtgttcaagcgattctcctgtctcagcctcccgagtagctgggattacaggtgtgcatcaccacacctagctaattttttgtctttttagtagagacagggtttcaccatgttggccaggttggtcttgaactcctgacctcagatgatcctcctgcatcagcctcccaaagtgctgggattacaggtgtgagccaccgtgctggccaattttatttatttatttagagagattggtggggcggcaggggggggtctcactatgttgcctaggctggtctcgaactcctgagctcaagtgatcctcctgcttcagcctcccaaggtgctgggaccacatgtgaaccactatgcctggcctcatccactgtaattcttaaccacctttctgattatgaatttattttcattggtactttatttgtggtaaagagatgccctgtactatggacctgtgtattccaggtacgaaaatggtaagtccaacattttaaagaagttggccttttggcttatgctagcttataacaagtacttatttattgattgatttatttgagacagagtctcgctctgttgtccaggctggagtgcaatggtgtgatcttgactcactgcaacctctgcctcttgggttcaagtgattctcctgcctcagcctcctgagtagctgggactgtaagcgcgcaccaccacgcctggctaatttttgtatttttagtagagacggggttttgccatgttggtcaggctggtctcaaactcccgaccttgtgatccgcctgcctcggcctcccaaagtgctggggttacaggcgtgagccaccgcgcccggcaataacaagtatttattgagctcttgtttgctaaataaaacacttatctgcaagatgcttacagactagtagtctcaacaagtaaatacaaaggtgctaagatagatgtctagggtgcattgggagctgtggctaaatcatgctttgagatagtgggaaactttcctaaagaaaagtaaattgaaccaataaatatgggttgggtgtgatggggtagagatggagtcttgctctgttgcccaggctggagtgcagtggtgtgatctcggctcactgcaacctccgcctcccaggttcaagcgattctcctgcctcagcctcctgtactcaggaggattacaggtatgcaccaccacactcgctaagttttgtatttttagtagagatggggttttaccatgttgcccagactggtctcgaactcctgacctcctgatctgcccacctcagcctcccaaagtgttgggattacaagcgtgagccactgtgcccggctggggttagagggactttcaggcagagaatgtataaggcacagagctgtgaaatgggctaccttgtgtgggaaacaaataactaggtacaggtggattagagtggaagaagaggaggccaaaggtagataagggatcacgtcatagaagtccttgagtgctttatcacagagttggaacttgatcttgaaagctatagagagtcattgaaggaaatttaagctggacctctcaggtttgaagtgcccatggaatattcaagtggatatgtctgtcaaacaattaactatattggggtttgggagaaaattattgactggagtcacacaggcattgaagccatgggtttgaatggacctagaagaggtaaatcgaacaaaagattaggaacagaaccttagcgagcaatgacactgaaaaaagtgagcagaaggcagaaagtccatgacagagaccaagaagggccagacagaaaaaaaccagtaaatgctgcttgggatgggagggtggattgtattgggtcaaggagtcaacagaaaaaagttgaaacaacaaatataaactactttcattttaagaaactgaaaccgtataggaaataataggagttttgttagtctgatcattatcaattctgtgtgcacagagaaaataaaatttttagacagttcttccaatgcagggatttgaattttttagcatttttaaggtcaggtaggagcagatggaggcttttttggcagtgtttgggaggtaagaagtggttgaccgggggcatggatatgatacatgcgcagttactggggagtacaagtatctagtagagtattttgcacatagtttctggacctataaagatccagtaaagcatttttttttttcttgagatggagtctagatctgtcgacaggctggagtgcagtggcgtgatctcggctcactgcaacctctgcctcctgggttcaagcgattctcctgcctcagtctcctgagtagctgggactacaggcacacgccaccacacccagctaatttttgtatttttagtagagatggggtttcaccgtgttggccaggatggtgtcaatcccttgaccttgtgatccacctgcctcagcctcccagtgtgttgggattacaggtgtgagccaccgtgcccggcccatttttttcaggggacccagagttaattattgattatgtagttgtaattaaatttagttcatttctcaggatttctatttgtgattttcccttttttttttttttttgagacagtgtctcactttgttgctcaggctgaagtgcagtggcatgatctcggctcattgcagcctctgcctcccaggttcaagcaattctcttgcctcagtctcccaagtacctgggactacaggcatgtgccaccacacacagctaatttttgtattttttattagagatgaggttacactatgttggccaggctggtcttgaactcctgacctcaagtgatccacctgccttggcctcccaaagtgctgggattacaggtgtgagccaccgtgcctagccctggtctgtttttgagtctatctctcttgagtgaacattctctttctctgctaaatcaccttgtctcagtttttttctttgtagttaagctactcatagtttttttagttggggaaaaaagtacaacgtatttactatcttaaccacttttaagagtacagaacagtagtgttaactatgcacattgttgtgcagtttttttcatcttgccaaactgaaactctgtacccagtgaacccattttctccttcctagccattggcaaccacgattctactttctgtgtctagagtttgactacttgtagataccgcatataagtagaaacatgcagctttttgtcattgttattgctgtttttggggtgactggcttatttcacttagcataatgtcctcaagattcttccatgttgcagcatatgacctaatttcctttttttttttttttttttttgagacagggtcttgctctgtcacccaggctggagtgcagtggtgtgatcatggctcactgcagccttgacctccccagactcaagccatcctcccacctcagccttctgagtagctggaaccacaggtgtgcaccaccacacctagataatttttgtagacatgaggttttgccatgttgcccgggctgatcttgaactcctgggctcaagtgatcagttagttagccttggccttccaaaatgctgggattacatgcatgagctactgtgcctggcctccttttttttttttttaaggctgaataatattccattgtatgtatgtaccacatttttttttttatccattcacttgttgatggacatttaggttgcttccacctcttgactattgtgaataacgctgtgataaacatgcatgtgcaagtatctcttggagatcctgttattaattattttggatatgtaccctgaagtggaattgctggatcatatgataattctgtttttaattttttgaggaactgccataccctttgcttagtagctgagccattgtacgttcctaccagtagtacacaagggttccagtttctctacatcttcaccaacatttttattttttatttttttattttttgagacagagtctcactccgtcacccagggtggagtacagtggcatgatgttggctcactgtaacctctgcgtcccaggttcaagtgattctcctgtctcagcctcccgagtagctgagactacaggctaattcttgtagttttagtagagatggcgttttaccatgttggccaggctggtcttgaacccctgacctcaggtaatccacctgccttgacttcctaaagtgctgggattacaggcatgagccactgcacctggcctgttttttaactcatttgttgatagtggccatctcaataggtgtaaggtgatatctatctcattgtggttttaatttgtatttctctgattagtgataagtatcttttcatatacttgttggccatgtgtatatcttctttggagaaacatttgtgcaagtcctttgcccacttttaaattgggttatttggattttgtttgttgagttgtaggagttctttatgtattctagatattaccaacttatcagatgtatggtttgcaaatattttctctcattccgtaggttgccttattattctgttgattgtttcctttgtgacacagaattctttaagtttgatgtccattttgtctatttttgcttttgttgcctatgcctttggtgtcgtcttcaagaaatcattgccaaatccgatgtcatgaagctttctccccgttttcttctacgagttttaagtttaaggtcttagatttaggtctttagtccattttgagttaccttttgtattcaatgtaacataagattctagcttcattcttttgcatgtgggtacccagtttttcctatatcatttgttgaagagactctccttttcccattgtgtggccttggtacccttgttgaagatcatttgatcacatatgtgagtatttatttctgggctttctattccattccattagtcttatgtctatctttaagccctaccatactgtgttgattactgtagctctgtaatgtaaggtgttttgaaataggaagtatgaggcctccagttttgtttttctttctcaagtttgttttaactatttgggatccttctcataatttttatcctttaaaaaattcccaggctgggcacagtggctcacgcctgtaatctcagcactttgggagaccgaggcaggtggatcacttgaggtcaggggttcaagaccagcctggccaacatggtgaaacccctgtctctactaaaaatacaaaaattagccgggcatggtggcgggcgcctgtaatcctagctcctcgggaggctgaggcaggagaatcgcttgaacctgggaggcagatgttgcagtgagccgggatcgcgccactgcactccactgagtgacagagcgagactccatctcaaaaacaaacaaaaacaaaaaacaacaaaaaaattcccagccgggcacagtgactcatgcctgtaatgccagccctttgggaggccgaggcgggcacatcacttgaggtcaggagttcaagaccagcctggccaacatggtgaaactccgtttctacaaaaaaatgcaaaaattagctgggcttagttgttcttgcctgtaatcccagctactcggaggctgaggcaggagaatcacttgaacctgggaggtggagccaagattgcaccactgcacgaaagagtgagactgttttaaaaaaaaattccctttcatttttttcccttcctttcattttaaactcacttacagcgtggttgaatttttcttttttcttctcgacatgtaaggacagataacctatacataacctttgaaatatggagtgtgccctgctttataaaaacttggcatttttgaattacatgtttcatgttaagagttgatatttgaattaaaaaaggattttggccaggcacagttgcccattcctgtattcccagcactgtgggaggctgaggggagaggattgcttgaagccaggagttggagaccagtgtgggcagcaaagcgagaccctgtctctacaaaacaaaataaaagaagcaacaacaaaaaataagccaggtggaatggtgcatgcatgtggtcccagctttgggaagctgatgcaggagtattgcttgagcccaggagttcaaagctgtagtgttgtaccactgcactccagcctgggtggcagagtgagaccctgtctcttaaaaaaacaaaaaacaaacacaacccccaaaaactctttctttgctttgtagaggtattcttttagtggattaaatatggttttatcttttcaaacatcttagaagcaaactagtttgcttgaagcatggtacattttaaaaactttcattaggaaaatagagatatagaaaagtagtatgatacattgaaaccacaggtacccacctgcttgattcaacaattgttaccattttgccatatttgttttatctacatatataaatttcctgaaccatttaaaagtaaactaagaggggcaaataagtttttttcagttttcccttttaagtatcatatgattgtattataaatgtatgtattttggactttgacatttaaagatttagattgatatttgctcttttaaaagattatataagaagacgtatatcttcagatctcgccaaggaaaaggaggacattctccctatatagccataaaaccattatcatttctagcaaaattaccagtaattccctagtattatactactttttgatttttttttgagacagggtcttgctctgttgcccagactagagtacagcagcacattcatggcttactgcagccttgacctcccaggctcaagccattctcctgcctcagcctcctggagtggctgggggctacaggcacataccaccatgactggctaatttttgtattttttgtagagatgtggtcttgccatgttgcccaggctggtcttaaacttgtagtctcaagtgatcctcctgccttggcctcgcaaagtgctgggattacaggcatgtgacctgattccctgatacatgctacttatactatattcagatttcctgagttgttccaaaaatgtttttgattgctgtgtggtgtttttttttcttctttttttttttgagaggaagtcttgctctatcacccaggctggagtgcagtggcgtgatcttcgctcactgcaacctccttctcctgagttcatgcagttctcttgcctcagcctcctaaatagctgggattacaggtgtccgccaccatgcctggctaatttttgtatttttagtggagacggggtttcaccatgttggccaggctggtgttttttttttaaatgccagatttcagtcaagaactacccgttgcatttgggttgtaatcttgagtctttttaaatatataggtagaactgtctcttctacccatccacctccttctctactctgcctctccttccctactctgcctctccttccctgtggtattgacctgttaggtctgttgagacgattacattttgtattgctgcttgtttcctcatggtgtagtattacttcttcctctatcccctatatttatttcctgtaaactgggagttagatctaaaggtgtgagtagacttaggttaaacagttttggaagagtatctcatttagtaatgctgtgtacttcctactgtttctagttaagaggcatataatgtcaggtcccactattttgatgctgtatttgatcaccaagctaatgtggtgagaacctgatcatttcattataaagttatggttttctttttgcttctagcaagtagtaatctatagggtggtactttgacatcaggtaaattttttattttttatttttttgagacggagttttgctcttgttgcccaggctggagtgcaatggtgcgatctcggctcactgcaacctctgtctcttgggttcaggtgattctcctgcctcagcctcccgagtagctgggactacaggctctcgccaccacgcccagctaattatgtatttttagtagagacgaagtttcgccatattggccaggctggtcttgaactcctgacctcaggtgatcctcctgccttggcctcccaaagtgctgggattataggtgtgagccactgcccccggcctcaaatttctttttttaaaaaacatttttattttattttattttattttttgactttttggagacagagactcactctgtcacccaggctggagtgcagtggcacaatctcagctcactgcaacctctgcctcccgggttcaagcgattctcatgcgtcagcctcctgagtaagctgggactacaagcatttgccactatgcctggctaattttttttttcttttttgagatggagtctccttctgtcacccaagctggagtgcggtggcacaatctcagctcactgcaatctccgccttccgggttcaagtgattcttgtgcgtcagcctcctgagtaagctgagactacaggcgtgtgccactatgcctggctaattttttttttttttttttttttgatatggagtctcactttgtcgccaggctggagttcagtggcgtgatcttggctcactgcaaccttcgactccctggttcaagcaattctcctgcctcagcctcctgagtagctgggattataggcacgtgccaccatgcccagctaatttttgtatttttagtagagatggggtttcgccatgtttgccaggatggtcttgatctcctgacctcgtgatccacccacctcggcctcccaacgtgctgggattacaggcgtgagccaccgcgctcggcccacctggctaatttttgtaattttagtagagatgaggtttcatcacgttgccctggctggtctccaactcctgagctcaggcaatccctccctgtacccccccaggcctcccaaagtaataggactacactcgtgagctaccactcccggccccagataaatttctttcttttatttttgtgggacttttttttttttttgggacagagcctctctctgttgcccacgctggactgcaatggtgccatctcggctcactgcaatctctgcctcccaggtgattctcctgtctcagcctccctcctgagtagctgggattacaggtgtgcaccaccatgcccagctaatttttatttttagcagagacggggtctcaccatgttggccaggctggtctcaaactcctgacctcaagtaatccacccaccttggcctccaaagtgttgggattacaggtgtgagccaccgcacctggccaggtcaatttctttaccaacttttcacctaatgattttagcattcattgatgattcttgattagctatttaattattggttaaaaaatggtaattagttttgggttctgttgttccttatacatttagtagctagccaccttctataaagataaggtttctctcatcaactaaggctattttgttacctggaattagtgttctacttaaaggcagaatagatgcttagttactttcttttatacagactttttcagagtgcaatagtcacctccagtggcaataagtgcagtctttcttgtcttttctcttttgtcactttctttttggaatatcatatatattataaatattatagacatttttgactttgatttcttttgtgattatagtttgatgtgaatttgactttaatatataactttcctttcatagtaagaagacatgttggataacaagaagaggtgtagagtttgcatatatcaactgtggccttaatgagcatgttgacagcatcgatgctagacagacagtaagtgttattaaagttgtagagtatgaatattttacacataagatttttttttttttttaaattgagtcttgctgtatcacctaagctgaagtacagtggcgcaatcttgactcacttcagcctcaaactgctaggctcaagcgattctctcacctcagcctcccgagtagctgggactacaggtgcatgccaccacacccagctaatttttgtattttttggtagagatggtttttgtttttgttttgtttttttgaggtggagtttcattcttgttgcccaggctgtagtgcaatggcatgatctcagctcactgcaacctctgcttcccaggtttaagcgattctcctgcctcagcctcccaagtagctgggattacaggcgcatgccaccacatccagctaattttttatttttagtagagacaagttttctccatgttggtcaggctggtctcaaactcccaacctcaggtgatccgcccgcctcagcctcccaaagtactgggattacaggcgtgagccaccgagccctgcttgtttttgcttttttttgagatggagtgttgctctattgctcaggctggagtgcagtggcacgatcttggctcactgcaacttccgtctcctgggttcatgcaactcttctgcctcagcctcccaagtagctgggattacagatgtgtgccaccatgcccagctaatttttgtatttttagtagcgatggggtttcacatattggtcaggctagtctcttaacccttgacctcaagtgatccacccactttgacctcccaaagtgctggaattacaggcgtgagccaccgtgtctggcccagagatggcgttttgtcatgttgcccaggctggtctcaaactccttggctcaagtgatccgcctgcctcggcctcccaaagtgctgggacaacaggtgtgagccaccacgcctggcctacacaggtttctaagcttttacttatatatttgagggactaaaaaaacacctcatgagaaggaaaatataatcacagattttgttactagaattttcaaaagagctttcgtggtataagacatgttgactgaggaagcataaagaactgaattgtggtgttagtttttctatttaatgagtgttttcgtttctctgcttcttaaaggccagtcttggctgggcatggtgcctcacgcctgtaatcccagcactttgggaggctgtggcaggcagatcacttgaggccaggagtttgagaccagcctggctaacatggcaaaactccgtctccactaaaaatacaaaaattagtgggacatgttggcatgcacctataatcccagctacttgggaggctgagacatgagaattgcttgagcctgggaggcagaggctgcagtgagctgagctcttgccactgcactccagcctgggcgacagagtgagactctgtaaagaaaaaaaaaaaagtaaataaataaaaaataggccaatcttgcttcttcatattttacatattgttagccatccataaatatttgtgcacctgttttatgtgtggtactatgcatagtaccattttggcgtatatatcatgatccatgttctcaagaaacattattagttgtagatataaacacatatagatggaaattaataagtcagtaataccgactgactctaaattaagcaagactagtactgcaataagtagttaaggattatagacagtattgatgtattatacagaaatacacttggaattaaaggtatatatttttcagcaactggctttaacatttaacaacatgtctcagaggtctatccagtttttacacagcttttcttttatttatttatttttttgagatggagtctcactctgtcgcctaggctggagtgcagtggcgcgatcttagctcactgcaacctctgcctcccagttaaagtgattcttctgcctcagcctcctcagtagctgggactacaggtgcatgccaccatgcctggctaatttttgtatttttagtagagatggggtttcaccatattggccaggctggtctggaactcctgaccttatgattcgcctgcctcggcttcccaaagtgctggggttacaggcatgagccactgtgccaggcctacacatcttatttctatattccaccaacttttttttattactgcatagtattccaaaggatgagttctgccataatttatactgttttcctaagtgtttaggatgttataacagatagatacatatttctttttttgtttgtttgtttgagacagggttttgctttgttgcccaggctggagtgcagtgctttgattactgcctactgcagccttggcctctcaggcccaaacaatcctcctacctcagtctcctgagcagctgggactacaggcatgtaccaccaggcctagctaattttaaatttttcacagagatgtgttctccctatgttgcccgggcttgtattgaactcctgcgcttaagcaatcctcctcctttggcttcccaaagtgctggaattagaggtgtgagccatcatgcctgcccctgatagatatatttaaagatgattggttactttaatttggttacattttctataaaaagtattttttggccaggtgcggtggctcctgcctgtaatcccagtacttagagacactgaggcaggaggatcacttgaggtcaagagttcgaggccagcctggccatcatggtgaaactctgtctctactaaaagtacaaaaattagccaggcgtggtggtgcacacctgtggtcccagctattcgggaggctgaggtaggaaaatcacttgaacctgggaggcagaggtagcattgagctcagatcctgtcactgcactctagcttaggtgacagagggagactttgtgtcaaaaaaaacccaaaaatatcttttttttttttgagactgagtcttgctctgtcacccaggctgggcgcagtggcgccatctcggctcactgcaagctccgcctcctgggttcatgccattctcctgcctcagcctcccgagtagctgggactacaggctcccgccaccacgcctggctaattttttgtatttttagtagagacagggtttcaccatgttagccaggatggtctcaatctcctgaccttgtggtccgcccgccttgggctcccaaagtgctgggattacaggtgtgagccaccacacccggcccaaaaatatcttttttagtgacatacttttggtatctcatgagattttagcatctacctttttcttatcacagtagtattttgaaatcatcttgtaggtaacttaatccttgggaaagacattgatgatactggtttttggtagcttctctttctgaggaagttgtttgctgatcgtgtttgggaacatgctatgtttgggtcctgtaacttccctatatattacatatagagagattttttttgtttgtttcttttttgatggtcttaaggagctaaatatttggttcttagtatcagttttcttaggcctattatttctagttggtcgatattgaatattatgtagaatatatatgtgtgtgtgtgtgtgtgtatttttgtttttgtttttgagagagtcttgctctgttgcccatgctggagtgcagtggcgtaatctcagctcactgcaacctctgcctcctgggttcaagcaattctcctgagtagttgggactacaggtgtgtaccaccatgcctggctgttttttgtatttttagtggagacagggttttaccatgttgcccaggttgatcttgaactcccaacctcaagtgatctgcctgcctcggcctcccaaagtgctgggattacaggcgtgaaccactgtgtctggccagaatatcttttttttttttttttgagactgagtctcgctctgtcacccaggctagagtgcagtggcgcgatcttggctcactgcaacctctgcctcccggattcaagcgattctcctgcctcagccatctgagtagctggaattacaggcaccggccaccacactcgactaatttttgtatttttagtagaggtggggtttcactatgttgaccaggctagtcttgaacttctgacctcaagtgatccgtccacttcagcctcccaaagtgctaggattataggcgtgagccaccgcactcagccagaatatcttttttgattgttatagagatctgttattttctggatattgttccaccgaggtaaattattcaaacttaattgtccttgtcatatactacatataaaagatttatttataaaatgatatggagtgcagcacatttcctaaaattggaatgatacagagaagatgagcatggcctctgtgcaaggatatgacacgcagattcgtgaagtgttccatatttttagcttcagtataaaaactgtacagatatttgtatagctgataaggttctttttagagaaaatacttaaaaaaatgcagcttgtacctttttgaattggattttaaagcttctgatgttgaatatttctaaatgtgtgtgtgtgtgtgtgtgtgtgtgtgtgtgtgtatgtgtgtatttattattattattttttgagacagtcttgtgttgcccaggctggaatgcagtggcaggatttcagcctcctggtttcaagagattctcatgcttcagtgtcctgagtagccgggactacagtcatgtgccaccatggccggctactttttgtatctttagtagagacagggtttcaccatgttggccaggcaggtcttgaactcctggtctaggtgatgcacctgcctcggccacccaaagtgctgggattacagatgtgagccaccgtgtctagcccaatattcctaaatatttaatggtttttttaagtttcttgacttgcgtatggtggcatagcaaacttggaattaatatcctttttttttttttactttttttctttgagtcagggtctcgctttatcgcccaggctggagtacagtggcatgcttatggctcaactgcagccttgatttccttggctcaactgatcctctcaccttagcttcccaagtagctgggactacaggtgtgcaccattacgcccagcttattgttttgtatttttttgttgagacaggttttataatgtttccctggctggtcttagactcctggggtcaagcagttcgcccactgtggcctcccaaagtgctgggattacagggataagccacctacacttggcctcagaattagtatcaatagtaaagtttgggatttttaggatactgcattttgttttttttaagaaaatctgtaataaaattgtgtatcttgaaaaatgatatggtgctttttaatttttattttcatttttttagttgtttagagtggagtctcactctgttgcccaggctggaatgcagtggcgcgatctcaagcgattctccaacctcagcctcctgagtagttgggattacaagtgtgcaccaccacactcggctaatttttgtatttttggtagagatggggttttaccgtgctggccaggctggtcttgaactcctgacctcaagtgatcctcctgcctcggcctcccaaagtgctgggattataggcataagccactgtgcctgtcctgataatggtgctttttttgtattgatgatgtggttttcagtaggaaggttttgtattttttgtttatttatttatttagagataggctcttgctgtgttgcccaggatggtcttgaattcctgagctcaaatgatcctccttcctcggccttccaaaatgctgggattacaggtgtgagccactgtgcccaccctggatggtttttttttttttttgaagtgtttattggtatatctactttaatggcagtattttttttttcagtgtaggaaaaccacaggcaaataatgtcagtattgaccattgccataacactattagagatcatgtttgttcattctattactatttgtagatttcatgttaaccctgaattttaaaaaactgtttaagtgaacatatgtccttattaaaagaaaaacaaaaaattaaaattagctgagtgacatgtgcccatagcccttgctgcttgggaggttgaggcaggaggattgcttaagcatgggcagttgaggctgtggtgagctgagatcatgccactgcagctcagcctgggtgacagagggagactgtctcaaaaacaaaaacaaaaatctagagttgataagacctctgcttaccatgttggaatattatgatgataatcagtgagcaagtattgattagattttacatcaggttaaaattatataatagaggtagaagaatttgaaaaatgcatatattcatggtattgttaataattatttgttttgaggatgggagggggggatatatttgtttttacattgttcatttgagccagtccattcacatttctccataatatatcaaactttacttatgcattcttattttctatatccttttcaaatacaatctctgtttaggtcaggtatgtatatgaagatgctatacaaggttgtttaaactaatgtattaataaggaggctctcatgaaaaaaggaagatacgtaagattagatgataaaatagttaaacctgagcatcacttacagtagaatatgtgggattgagataaactggattataagtagaacaggtgattgggagatagtgtgagctgtatatatatatatatacacacacacatatatatgtatatatataattttttttttttgaggtggagtcttgctctgttgccaggctggagtgcagtggcaccatctcggtcactgcaaccactgtcttctaggttcaagcaattcccctgcctctgtctgggactacaggtacgtgccaccacgcccagctaattttttgtattttagtaaagacagggtttcaccatgttggccaggctggtctcgatctcctgatctagtgacctgcccgcctcggcctcccaaagtgctgggattacaggcgtgaaccaccgtgcctggcctatatatgtttttatacatcagaattttcttatttatttatttatttgttgagatggaatctcgcccggctggagtgcagtggcgtgatcttggctcactgcaagctccgcctcctgggttcacgccattctgctgcctcagcctcccacgtagctgggactacaggcgcctgccaccacgcctggctaatttttttttttttttgtattattagtagagatggggtttcactgttttagccaggatggtctcgatctcctgatctcgtgatccgcccacctcagcctcccaaagtgctgggattacaggcatgagccactgcgcctggcaagaattttctttaatacactaaacattatttggacactaaaactgcctatatgtttagatctttttacatacaaatagacacagtgaaaaaaagggaatggaagggatatatagcttgcaaactggaggaagtacagagggaagtccatgattcacctttaatttataataatgattttttcctgattatggaaaaaatgcatttcttacggattatgtggaaaatgcgaaagtagcatataaaaaatatattaaaaaaatcacctatgattctattatccagagatttcttttccagtctaatttaagtcagtcccttttgtgtgtctgggtagattatatttagttgagtgtcttgctttcatttctaacattctcttttaaaaaactacagtgaaggccgggcgaggtggctcacacctgaaatcccagcactttgggaggccgaggtgggcggattacctgaggtcaggagttcaagaccaatctgaccaacatggtaaaaccctgtctctactaaatatacaaaaattaatggggtgtggtgccgcatgcctgtaatcccagctactagggaggctgaggcaggaggattgcttgaacgcgggagctggaggttgtagtgagccaagattgtgccattgcactccagcctgggtgacagtgtgagactgtctcaaaaataaaaaacaaaaacaaaaaactacagttaaatattatccaaatcaggctgggcacagtggctcatgcctttaatcccagcattttgggaggctgagacgggtggattacctgaggtcaggagtttgagaccagcctggccaatgtggtgaaaccccatcgctactaaaaaatacaaaaataaggttgggtgctgtggctcacgcctgtaatcccagcactttgagaggccaaggtgggtggatcacctgagatcaggtgtttgagaccagcctgaccaacatggagaaaccccatctctactaaaaatacaaaattagccgggtgtggtggcgcatgcctgtaatcccagctattcgggaggctgagacaggagactcgcttgaatctgggaggcagaggttgcagtgagccaaggttgcgccattgcactctagcttgggcaacgagcgaaactccatctcaaaaaaaataacaaaataaattgggtgtggtagcgagcgcctgtagtcccagcaaactgggagactaaggcaggggaattgcttgaacccaagaggtggaggctgcagtgagccgagatggcgccactgcactccagcctgggcgacagagcgagaccctgtctcaaaaaaaaaaaaaaaaaaaaattattcaaaacatagtctttttaaatggctgtctaaatttccattatgtcaatctaaagaggtgttgtattcaataatctaacaatcctgggttcagcttaataatagaaacaacccaatttacaaataggcaaaagaatccaaacagacatttattcaaaaaagtatataaatgccaataagaacatgtaaagatggtcaacaacatttgtccttaggaaaatgcaaatcaaaaccacagctagataccactaggattatgtggaagagttagttccttgagcccaggacttcgagaccagcgtgtgcaacagagtgagactctgtctccaaaataaaaaacaaccaaaaagcctaagcaaacaaaccaacccaacacctcctggtgcttaaccacaggctgtattcttttttttttttttgagacagagtcttgctttgtcccccaggctggagtgcagtggctcaatctcggctgactgcaagctctgccgcccgggttcacgccattctcctgcctcagcctcccgagtagctgggactacaggcacctgccagcatgcccggctaattttttgtatttttagtagagacggggtttcaccgttttagccaggatggtctcgatctcctgacctcgtgatctgcctgcctcagcctcccaaagtgctgggattacaagtgtgagccaccgcacccggccgggctgtattcttacactgactgtatagaaagaggagatagagtaaacctaccccgtatacttcagcccacgccctgtgcctgttctgtattatgaagcggggttggggggcggtgcagacatagaaaaaggaaaaaacaaaaggaaaaaaagaaaaacaaacccaaaacaaaacaattgacagtaacagtgttggtgaggattagagaaatcagagcccttacacattgctggtggaagctgaaattggtgcagctgctttggaaaaccgtttggcagttcctcaaaaggttaaacatagagttaccgtatgaactagcaattccactcttagatatatacttgagagatatgaaaacatgtccacagcaaactcttatacaaatgttcatagcaacattattcaccatagccaaaaagtagaaacaacccaaatgtccatcacttgatgcatatgtacataaaatgtgttatatccgtaccatgcaatattttctagcagtatcggtgaagtaccaatacaggctacaacatggatgaacctggaaaacatgccaagcgaaaggagccagtcacaaaaggccatgttttagattatacaattctcttcatataaatgcctagaataggtaaacctatagagacaaaagtagattcgtggttgccaggggataggagagggaggaatgggaatggttactaatgggtggtggggtttcttcttgagttaatagaaatgttctggaattagtggtgatggttgtacaactctgaatatactggaaaccactgaattgtacacttttgaaatggtgaattttatggtttacatattatattttaataaagctggtataagtagaaatttgggagctcccacacttaaaaccaatccacgacgctacctttgatacagatggtagtggtgaaggtgatgattttaaatgtattttggatttattattcattcattcattcagacggggtctcactctgtcacccaggctggagttgcagtggtgtgatctctgctcactgcaacctccccctcctgggttctcctgcctcagcctcctgagtagctgggattacaggcatgcgccaccactcccaactaatttttgaacttttagtagagacggggtttcggcatgttgcccaggctggtcttgaacccctgacctcaggtaatccacctgccttggcctctcaaagtactgggattacaggcgtgagccaccgcacccagcttattttgaatttacaactggcaggatttgctgaatgatgaggtgtgacggaaagaataggcaaaaatgacttagtttttggcttcaacaagtagaaattgccattagctgagattgcaattactatagatagggcagggtggcagaggagaatcaggtcacttttagatatgcctggtttgagattttttttttttttcctccgagatggagtcttggttttttgtctagactggagtgcagtggcacaatctcagctcactgcaacctctgtctcccaggttcaagcaatcctcccggctcagcctggcaagtagctgggattacaggcatgcacctccacgcccagccaaattttgtgtgtgtatatatatatatataatttttttttttttttttgaggcagagtttctctctgttgccaggctggagtgcagtggcatgatcttggctcactgtaacctctgcctcccgggttcaagcgattctcctgcctcagcctcctgagtagctgggccaccatgcccagctaattttgtatttttggtagagacagggtttctccatattggtcaggctcatcttgaactcccgacctcaggtgatctgcccaccttggcctcccaaagtgctggggttacaggtgtgagccacagcgcctggctttttttttttttttttgagatggagtctcgctgtgtcgcccaggctagaatgcagtggtgcgatttcagctcactgccacctccgcctcctaggttcaagcgattctcctgcctcagcctcccgagtagctgggattacaggtgcccactaccacgcccagctaatttttatatttttagtagagacggggcttcactgtgttggccaggctggtcttgaacttctgaccttgtgatccacttgccttggcctcccaaagtgctgggattacaagcgtgagctaccacacccggccaatttatatttttagtagagatggggtttggccatgttgaccaggctggtcttgacctcaggcaatctgcccgcctcagcctcccaaagtgctgggattacaggcctgagtcactgcgcccagcctgagatgttttttagatacacaaagtagagatgttcagtgaatactttgatgtgggtctacagtcagagaagagttgctggctgaagatgtaaatttgttagcatgttgataggatttattttttattctttttcttaagagatggggtctcactctgtcactgaggctggagtgcagtggcacaatcatagctcagtgcagcctccaactcctagagtcaagtgatcctcctgcctaagcttccagagtcgctggaattacaggcacgccaccatgcctggctaatttttaaattttttgtagagggaaaagagggaaaagaacaggccctaggactgagctctggaacgctgtattgtttccaagttgagagatgtgaaaatctcgagagtggcagtgtcctctggagaagaaagccagttcttgggggagagattgatcagctgtttaagtgctgttgataggtctagaaagacaagaactgagaactgatcatttgatttaattttattttctagttgttggtataaagaaatataatctagctaagtgtgctgctcacacctgtaatcccagcactttgggaggctgaggcaggaggaatatttgaggccaggagtcttttttttgttttttgtttttttttgagacggagttttgcttttgtcacccaggctggagtgcaatggctcgatctcagctcactgcaacctctctgcctgctggattcgagcgatcctcctgcctcagctcccgagtagctgggattacaggcctgccaacatgcccggctaattttttttttttttttgctaatttttgtatttttattagagacagggttttgccatgttgtccaggtctggtctcgaatgccagaccaacctggattacaggtgtgaaccatcatgcctggacaagtccaggagtttgagaccagcctggacaacattgcgagacactgtctctacaaaaataagaaaaaatttaaaaaattatttatttatttttttgtttttgagacgaagtcttaccctgtcacccaggctggagtgcagtggcatgatgttggctcactgcaacctcctcctcctggcttcaattgattctcctgcctcagcctcccgagtacctgggattacaggtgtgcgccaccatgcccagctaatttttgtatttgtagtagagatgaggtttcaccgtgttggtcaggctggtttcgaatgcctgacctcaagtaatccacccgccttggcctcccaaagtgcaattgcaggcataagccaccgggcccgaccaaataaaaaatatttaaaaagaagaacataagaaaaagacttatggagagtatatttcttaattttcaagaaatttggattctaattatatatattatatagatttaaaaaaattatttatttatacttttgagacaaggttttgctttgttgctcatgctggaatgtagtggtgcgatcagagctcactgcagccttgacctcctgggctgaagtgatcctcccatctcagcctcctgagtagctgggaccacaggtgaacagcaccatgcctaagtttttaaaagattttttgtagagatgggggtctcactatggtgcccaggctggtttcgaactcctggactcaggtgatcctcccacctcagcctcctaaagtgctggcattataggtgtaagccatcgtgcctggtgtaattacattttttgctactgatttctagtataattccatgtgcacttgaaagtaaattgtgttttgtggctattgggttcaatgttctatagatatggagtcaagttatatttattgcacagatcaaatcttctgtgttcttactgtttcaccccttcctccttgcccctttctttcttcctcttatgtttctttccttttccccttcccctcctttaaaaaaaaaattttttttaaaggaggggaagcttcttgtgttaatggttacagagaggggagtttcatttgaattttacatacttttttcaaaattaaaaaattaggttttttttgaggctaagtctcactctgtcacctaggctggagagcagtggcttgatcttggctcactgcaacctctacctcctggattcaaacaatttttgtttctcagcctctggagtagctgagattacaggcatgtgccaccaaacccagctaattttttgtatttttagtagagactgggttttgccatgttgcgtaggctggtcttgaactctggcctcaaatgatctgcccaccttggcctcctgaagttttgggattacaggcacgagccaccttcccccactccacgtgcaccccgccccctccgcccaaaaaaaaggaatgttgtgtaagtggaataattcaatatagccttttaggactggcttttttttagatttttttattttttgagatggagtgtctctctgttgcccaggctgaatggctcgatctcggcttactgcaacctctgtctcctgggttctaagtgattctcccaagtagctgagattacaggcatgcgccacaatgcccagctaatttttgtatttttagtagaggcagggttttgccatgttggccaggctggtctcactatgctgcccaggatggtctcgaactcctgacctccggtgatccgccttccttggcctcccaaagtgctgggattacagaccggagccaccacgcccggctacgactggcttttactgagcataatactctggaatttcatccaggttgttgtatgcatcagtaatatgtttttattgctgactagtatttcatggaatggatgtaccatagtttttttaaccatttatctactggaggacatgagttgtttccagtttttggttattatgaataaagctgctgtaaacatttgtttacaggtttttagatgaatataatttttcagtcctgataaatgcccagaagtgcaattgctgagttgtatggtagttgtatatttagtttctttaagaaactgcagaatatttttcagagtgactgtaccattttacattcccatcagcaaccataagtgatgttgtttctttgaagtcttgccatcatttggtgttgtacctgttttttattttagtcaatttgataggtaagtaatatctcattatagtttttttttttttttgcaatggggtttcgctcttgttgcccgggctggagggcaatattgtgatctccgctcactgcagcctccgcctcccgggttcaagtgattctcctgcctcagcctcccgagtagctgggattacaggcatgcaccactacgcctggctaattttgtatttttactagaaacggggtttctccttgttggtcaggccggtctcgaattcctgacctcagttgatctgcccgccttggcctcccaaaatgctgggattacaggcatgagccaccgcacctgacctcattagagttttaattcgcacttacttaatggttagtgatgttgaacatctttttatgtacttatttgccacctgtatctcctctttcgtgtagtgttttttctccttttttgctgattttccaattgtttggtttttattttttgttttttttgtgtgtgtttttttgaaacagagtctctgtctgtcacctaggctggagtgcaatggcatgatcatagctcactgcaggctcaacctcccagctgcaaaggatccttccaccttaggctcctgagtaactgggattataggcacgtgccaccatgcctggctgattgttttctattttttcatagagacagggtctcactattttgtctaggctggtattgaactcctgggcttaagggattccccccctcttcagcccctgttgggctcccaaagtgctaggtttacaggcatgagccaccatgcctggcatactgttgagttttgataggttgttaatagattttagatattagtccttatcctgaatgtggtatgtaagtattttctcatagtctgtagcttgtcttttcatccttttagccaggtctttcatcaaacaaaagttttgatttgatgaactataatttatcagttttgcctttttttttttttttttttgagtcatagtcttgctctgtcacccaggctggagtgcactagtgccatcttgggtcactacagcctctgcctcctgggttcaaaccattctcttgcctcagcctcccaagtagctgggattacaggcacatgccaccacacctggccaatttttgtatttttagtagagacggggtttcgccatgttggccaggctggtcttgaactcttgagctcaagtgatctgcatgcctcagcctcccaaagtgctgggattacaggcatgagccactgcacccagccacgatcagtttttccttttatggcccatgcttttgtgtttttgcctagccttagcttctgaagattttctctctcttttttagttcccacaaggagagattttccccttttttcctgaaaattttatagctttatgtcttaaacatttaaatctgtggtccattgcgagttaatatttctgtaaatatttctgtaaatttccaagaatactaaagggtaagcatgagacttaggtcaaggtttattttttactgattgatgtccacttgttccagtatcatttgttgaaaaggtggtcttttctctattgaattgcttttgcaccatagtcaaaaatcagtcaggcacacttatgttgctgggttttctctcttgttcccagatctataatctgttatcaggtctgtatttctgtccctccactgatgctacatagttttgattagtgtagccatacagaaacccttgaaatcaggttgcgattcctcctgctttgttctttttcaaagctattttacctattttagttcctttgtcttatcaattttagaataattttatctatatctataaaaaaatcttgcttgggttctggtaggcattttcttaaacgtgtatatcaatttggggaagaattgacatatttactgtgttgtcttcccatctttgaacatttctttcacagttttcagcatattaagttttgtacttgttttcttagatttatacctatgtgctgaaatataggaagtcctcacataacatcatcaataggttctcggaaactgtgattttaagtgaaacgacatgtatcaggtccttgaacaacatactttcgttcaacgtcattctgttataatgttgatgaggaaaaaaattggttatgtattgtcttgcttaaagttgtagtttacagccaggcgtggtgagtcacgcctgtaatcccagtactttgggaggctgaggcaggccgatcacctgaggtcaggagttcgagaccagcctggtcaacatggtgaaaccccatctctactaaaaatacaaaaattagctgggtgtggtggcatgtgcctgtaaacccagctactcaggaggctgaggcaggagaattgcttgaacccaggaggtggaggttgcagtgagccaagatcacgccattgcactccagcctgggtgacagagcgagactcagtctcaaaaaaaaaaaaaaaaaaaaagtttataagatcctattgaggttaataagtgaggacttagtgtatttctctgtttttttttttttttgcaattgtgaagggtactgtttctttaatttcagtgtccatgtgttttttgctagtatgtataaatacagtttcttttatatgtttatcttgtatcttgcacccttgttaaactcactttcttgttggagattttatagattatttgggattttctgtaatacatagataaccatgttatctgcaaatagggacacttttatttcttcttccctaatctatatgcgttttattttctttttttctcttatttcatgagctagaacttccagcattattttgaataaaattggtgagagtagatatcttgcctttttcctgatgttaggaggaaagcgtttagtatttcattacaaatacaatgtcagctgtaggtttttgtaggtgcttttatcaggttgagaatatttttgttcctgtttttctggtagttaccatgaatggtgttgaattttgtcattattttctgcattgattgatacaattctttcacgcattaaaatggtggattatactgatttttgaatatggaactagccttgccttcctggaataaaccccatttcattatagtatacaatcctttttttttttttttttttttttgagacagggtcttactgttacccaggctggagcatagtggtgtgatcatggctcactgaagcctcgaccacctgggcctaagtgatcctttcacctcaccctgcccaccagtacctgggaccacaggtacgtaccactatgcttggctaattttaaatttttttgtagagttgaggtctcactgtgttgcccaggctggtcctgaactcctgggctcaagcgatcctcccaactcagcctcctaaagttctgggattataagtgtgaactactatgccccgccaaaattcaacaatatataaaaacagttatatccactgcactccagcctgggtgatagagcaagaccttgtgtcaaaaaaaaaaaaaaaaaaaaaaaaaattatatatatatatatatatatatatatatatatatatagctgaattttatttgctagtattttgttaaggatttttgtgtctgtagtcatgaggagtattggtctgtagtttttttgtactggctttgtctgcttttggtatcaggataatactagcatcataaaatggattggaagtgctttcttattttctggaagagattatgtaggattagtattattttttcctaaaaatgtttgttagaattttccattgaagctatttggccctggaaatttttttttttgagttttaaaattatgaattaaatttctttataaattatagtgattttatctttgtcttattggatgagttttgattctttgtggtttttgagacattggtccatttcatataaattgtcaaacttttgtgtgttcatagtttactttattagccttttgatatctgcaaggtctatagtaatatccctttttcattcctgatgttggtaatttctgtcttcttttttctttgtcagtcttgctagtctttcagttttatagatcatttgggtaaaccagcaatttatttcattgaattttctcattattttctgtttccaatgtttgttatctgctatttattatttccttttttttttttttttgagacagagtcttgctctgttgcccaggctggagtgcagtgacacaatctcagctcactgcagcctccacctactgggttcaaacgattctcttgtctcagcctcccaagtagctgggactactggcgtgcaccaccatgcccagctaatttttgtatttttagtagagacggggtttcaccgtattgggcagactggtctcgaactcctgacctcaggtgatccacccacctcagcctcccaaagtgctgggattacaggcatgagccaccgtgcccggcctgctctttttttttttaaagatggagtcttgcttttgtcacccaggctggaatgcaatggcgcagtttcagttcactgcaacctctgcctcctgggttcaaacgattctcctgcctcagtctccggagcagctaggattacaggcgcctgccaccatggccagctaatttttgtatttttagtagagaaagggtttcaccatgttggctaggctggtcttgaactcctgacctcaggtgatccacccgcctcagcctcccaaagtgctgggattacaggcatgagccaccatgcctggccccggcctactctttattattttcttctttctgctgggtttgagtttatttgcccttcgttttctgggttcttatggtgggggcttagattattcatttgagacttcttttctaatgtatgcatttagtgctatagattttcctgtaatcactgctttagccatgttctacaatttttttttgagacagagtcttgccgtgtcacccaggctggagtgcagtggctcgatcttagctcactgcaacctttgcttcccgggttgaagtgattctcctgcctcagcctcctgagtagctgggattataggtgtgtgccaccttgcgtggctaatttttgtatttgtattatttatttatttattattattatttatttatttatttacttttggagacagagttttgctcttgtcgcccaggctggagtgcaatggcactgtcttggctcactgtaacctctgcttcctgggttcaaacgattctcctgcttctgtttcttcagtgcgcgtgccagcgctcctggctaatttttgtattagtagagacggggtttcaccatgttggccaggctggtcttgaactcctgacctcaggcgatccacccacctcggcctcccaaagtgctgcaattacaggtgtgagccaccgcgcccagctaatttttgtacttttagtagagatggggttttaccatattgcccaggatggtcttgatctcctgagctcagagtggtctgcccacctcagcctcccagggtgctgggattacaatccaggtaggcgtgagccaccacacctggcctacaaattttgatatggtatattttcattggcattcaatttattatattttaaaaattttttcgagacttcatcattgacccatggattatttagatgtatattgcttggaaatttttatgttactgatttctagtttgattccattgtggttggaaaacatacctgtgtgatatcaattgttttaaatttgttgtggtttggttttagcttaggatatgatctatcttggtatgtgttctgttaatacttgaaaagagtgtgtattttgctgttgttgggtggagtgttctgtaagtgttgattagatccttaattattggtgttgttgagttctatatatttgctgatttactgtctagtttattctgtctgttgttgatagagtggtgttgaagtctccacctataattgtgaatttgtctatttctcctttcagttttagcttcacttattttgtagctctttttagtgcatatacatttagggttgctatatcttttttatttttatttatttatttatttttgagatggagtttcgctcttgttgcccaggctggagtgcaatggtgtgatctcagctcaatgcaacctctgcctcatgggttcaagcaattctgccttagcctctcgagtagctgggattacaggcatgcaccatcttgcctggctaattttgtatttttagtggagatggggtttctccatgttggtcaggctggtctcaaactcctgactttaggtgatctgcccacctcgacctcccaaaacgctgggattacaggtgtgagccaccgcgagtgcagtggcgtgatcttggctcactgcacctctgtctcctgggttcaagcgattctcctgccttagcctctcgagtagccgggactacaggttagttctttttgtatttttagtagagacagaattttgccattttggccaggttggtctcaaactcctcaccttaagtgatcctcctgcccattgtccaacgtgctgggattacagtcgcgagcccctgagtctggccagggttactatatctttttttttttgagatggagttttgctcttgttgcccaggctggagtgtaatggcgctatcttggctcactgcaacctctgcctcccaggttcaagcaattctgcttcagcctcctgagtagctgggattacaggcccatgccaccacgcctggctaatttttgtattttagtagagacagaatttcaccattgttggccaggcccgtctcaaactcctgacctcaggtgatccacccaccttggcctcccaaagtgctgggattacaggcgtgagccataacgcccagcccgctatatctttttgatggcctgatcctttatcattacacagtgcctttctttgtctgtgataattttctttgctctgaattctgcttatgtctgatattaatatataaatgtacttttatttaattgtaattaatttaaatttaaataggaacatatggctggtggctgccatattgacaatgcagttctggaaggtggagagagctatgatacaaatttaattaaaaggtaaattttataacacaatagaagatgataagggcaatggatagttagcaggaaaggggagattggggcagagggagcagggtatatgattttcagttggataatcaatagagaaatcattgaatgtgacacttgaacaaaaatttgaaggagtacaggagttagccgtgcagatatcttgaggaagagtatatcaagggctagcagagagatacgtcattgtaagaactttagttttttctctgagtgatatggagaacatataggggtttagatcagaccctttttacatcgtataaagctcagtctggctggtatattgaaaatagactatagggggacaaagttgcaaacagggagaacaggtaggaggttggaatatggttgaaagatgacaggtgtcagacccaatgattagagcagattttgggaaatatattagacatttagttttggatatgttaagtttgaaatgtttattagatatattcaagcagagaaaacaagtagactgcctgtagttctattccaggtatgagtccctgcccttgtggagcttacactttattggaatatgggtggtaaatacaatacgtatgtaaaacatatgctatgtaagaaaacaataagtcctatggagaaaattcaagtaggaaagtgggataaatggtgttggggctctgaggtcctgagaaggtaacatttgaataatgataagaaggtgataaggagatacttggagaaaagtggttcagtagagggaaccaaggtgtaaaggttcccaggggagaacattgctggtgtgtttgaagaagagtgaggagacttaagtgtggctaagggaaaggacagtacagaggtaaccagtgtccaggttatgggccattttaagggctctggcttttgtcctgagttagggagctagtggatagtttagtagaagaaaggcatgatccaccatgtggtttaattgagtcacgctggctttggtgctaaatagactgaagcggcaagggtggaaaccaagagataggagacttatagtaattcaggcaagaggctgtggtagctaagtctagggtggtggcagtgaggaatgatagtattctggatatgttttgagagtcgcactgacaaaattggcttaccagttggatgtgggatgagaggagtcaaggattattccaagattttggcccaagtcattggaaggatatagttgcactgagatgggaaagactgggaaaagcaggtttgaagggggtgatgaggagctgttttggacatgttaaatttataatgcctattggacatctgagtataggtgttcagtacgcattctaattatatttatgaagactttcgtgtttttaaaaatgaaaaaatgtattgaaatagtgtattcattgttctgaaatacatattgttaacatcttaatttttaacatgttcaatcctggcaaaacctgcatattttgaagagagagaaattgactactttttagctctgctgttagagttggtggtactttcttagagctaaataaagatgtcattccgattttagaaatggaaatatatatagtctgagtgtttttaattgctttctattttaggtctttttactgctggattgtgcaagatatttaaccctattttgtttgaattatgacttaaatgtcaaacatcttaactaagaaaagggaaacattttagttttggaagtcagaatgccaaggagaaggaaaaatcttgggggaaatccttttcggaagactgcaaaccctaaggaagttgtcgtatccagtgttgctagtcgtgaggagccaaccactactctaccttccatgggtgagacaaaagttgatcaggaagaactcttcaccagtatctcagagatattttctgatctggatcctgatgtagtgtatttgatgctttctgaatgtgatttcaaaggtgagaaaaagtttagtttgaaccctgtccatcttataagaagactttgtgtactatgccatgattaatagtaatatagaaaaatgtcttgtttctattttattcataatttattaatcatctgctgttggcaagttactaaggttggtatttgagttggtatttgggatatgaagaataaaacatattttctgctcttgagaaatgtgcagttctaggtgtaaggtatttgtatagatagcatattctgtctctttcatcttcactctagaacagactggcactgttgacacttcaggctacataatcctttattttgagtggctctcctatgcattgtaggtttagcagcgtccctggcctgtacacgctagatgccaatagctccttaccacccagttgtgacaataaaaaatgtctccatgtattgtcatttgtcccctgggaggcaaaattgtacctcgttgagaaccactctcctagaatgtaagctccataaagacagagtttttaaaaactttgttttactcctgtatcttcagcccgtaacatagcaactgactcataataggagctaagtaaatatctattaagcaactaggtaattataattatgcaaataagagctgattaagagttgaggctagcagaatagtataatttcaaaacattgactttggagtcaagaaacgtgggttggatttccagctctgccacttaatctccctgagtctcagttttctaatctgttaggtagaaatataacagtatgtgcttcataggacttttttttggtgaggattgagttttagttttttgtttttggtaaagtcttcagtatggtaggttattaataacttgtcatacattgtttagaagtatgtagacagaagggagtttatataagttggctagatgagtaaattaaatgttgatgcttagtattgttactagccatgattagtataaggtaaaattattctggatttgggaagttttggtaatgtgttataaacttccagtttcagtcatcgtgtggtctgcgagcatatcttgtccagttatgcatgtagaaaaccagttgtcagcagtgcatgatgctcagaaatgacagtatattgagttttgtaagttactttgacatttcctaattttgatatgtttaaaatgtaattgttgcatataaactaatacagcaatgaggaattacaagaaatccacatcatcctataccataacaaaaaaacttttttgttttccagaatcttctatagaccttgttcataagcatttgagatttgagtggtggaattttgttattatgcgtttttaacttaacataagcatttgtctatgttgctgtaatctgtatttttaatgggtttctaatctactgagttgtgctgtagtttatttaattatatctacgtttttcgtgaataattaatattgcagagaacatcttggtaaaaatatttttttctttcttttggcttttttttcttagttccaaaatcttattttcttgcgtcacagggtaagaactgctttggctcttggaagcatactgctgaattgcctaccaatgaggtgtgctgacttgtaattccaccaggcttgcataagtgtagtggtttcacttcagccttttcaacattgtgtggtagtgttttaagattttttgttttttgagacggagtttcgctcttgctgcccaggccggagtgcagtggcgccatcttggctcatggcaacctcagcctcccgagttaaagtgattctcctgcctcaggctctgaagtagctgggattacaggcgtccgccactgtgcctggctaatttttttttttgtatttttagtagagaatggggtttcatcatgttggccaggctggtctcgaactcctgacctcaggtgatccacacgcctcagcctcccaaaatgctaggattacaggcgtgagccactgcacccggcccatgttttaagattttaataggaataaaattgcatttttcctaatttgtgtttttttaataaagaggaatgttgaacatttttgtacatgtttgtttattcttgtattcttgtgtaaattgttcattcattgaaaaaaaatttttttataccatggttttaatttttcccagcaatctgtataaggactttttttaatgtgataagtacctatccattttgatctttaatttacttagtgtaatttttcattgtatagacattaagtttttagttgatcttttctggttttactgtcatgtagatttttttcatagaaatactccttacgtttgctttcttttttttcccccgtccctgcccacccccgccacctttttttttcttccatttttaggttttctgtcctttgtagtattgctatgatctcctaattggtctctgccaggcttgccccctccaatccctctttgtttttcttcttaagggaacttaattgggtgcttactaggtgccagttcttgtgcacagcactttttcatggattatctcatttaatcctcacagcaacctatgaggtaggtgcttttattatccccatattacaaatgagaaaatcgaggtttaggaaagttaacttgttgaaagtgtcatagccagcagtagagatttaaatgttggtgttctgactccagaccagagctgttacctactctgctgtgctgtttccagacttatctttcttaaaacagcaagacaaaacacaaaataaacaacccctccctccaaacttcagatgcttaaaaattcttattttgtttttttttttggtttccttttttttttgagatagggcctcactcagtcgcccaggctggagcgcagtaatcactttcactagaggctcactgtagcctcgacctcatgggctgaagtgattctcctacctcagcctcctatgtggctggtactatacgcacatgctaccacactggttaatttttgtagagacagggtttttccatgttgcccaggctggtctcgaactcctgggctcaagcgatctacctgcctcagcctcccaaaatgttaggattataggcatgagctgccacacctggccttaaaatttctaatggctccctatttgtgttataacagaacgagctcagcattggagtcagatataccagtcctggctctgtcactgactatctgtgtgacttgggtcaagttaatgtactttttaacttcatttcttcatctgtttgctaggaataatatacctcatggtagtatttgaggattcagtgaggtgatgtgtataaaacttctagctcaaatgctatgactggtagtttccttcaagttcccttcgaaaataaaattaatatttcttaacatgacatacaggactcctcccaatttcacccaatcgacctccttctagggagagccaagcctgggtttacccttttttctcttgtgtctggcaagttactttttaatcttcaagtcccagttcacatatcaccttatgtgagatcttttcttattctcctttgtgcttctatggcatttgtacattatcaaaagtgtgcattatttatttatttatttattgttgagagggagtctcgctctgtcaccaaggctggagtgcagtggcgcgatctctgctcactaccacctctgcctcccgggttcaagagattctcccacctcaggctcctgagtagctgggattacaggcatgcgccgccactatgcccagctaatttttatatttttagtagagatggggtttcgccacgttggctaggctggtctctaactcctgacctcaggtgatccacccgcctcagcctcccaaagtgctgggattacaggcatgagcaaccacgccaaaaagtgtgcattatttaatctgtattatattacagtgtaattgtctctaatataattgttttaaatctctattagattgcaaagttctttgagcatattaaagatttttttttacaaaatatttctgatatgcagtacatgctcaaatattctttgtagtaagtgaaattcatagcgtggatcatgtaaataagttagatttactaagagaatacataaaatacttaatatttaaaagtttgcatgcaataggtaagtatttgttaaacaacaggctttaggacttttataaataagcctaatatgtccaattacagatatttatgtatttactcaattcagcaaataatatttatttgatgatagtttattagcttggtttattactgttttcctgaaagaataggattgcatgtctccatcattcagactttttgctactacagactttggtatgttaataaaatattaattttttaaaaataacatgaatattgtacatttatattctgttcaatgcaaaatccaatataattttagctggattttaataaaattattaaatctgttttctctgtctatatttttgttgttgttattattcttgttgttgtacagttgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatggattcatttttggacatgcagctaactgaagacctggattccttaatacagaatgcttttgagaaattgaactcttctcctgatgaccaagtatactcatttttgccttcacaagatgttaatagttttaatgactcaagtgagtttataaatcctgattcaagtaatatgactcccattttttctacacaaaatatgaatttgaacggtgaaaatttagagaattctggttctactttaagtttaaacccattaccttcacattcagttttgaacgagtccaagtgttttataaaggataacacattggctttggaaagtaactacccggaagattctcttctcagtagttctttaaatgtagcaagtgactccatcgcaggttgtagcagtctcaatcaaaaacagaaagaacttttagaatctgagtgcgttgaggctcaattctctgaagctcctgtagatttggatgccagtgaacctcaggcttgtttaaaccttccagggcttgatttaccaggtacaggtggggatcagaaatctactcgggtctctgatgtgtttctaccttccgaagggttcaacttcaagccacacaaacatcctgaactgccaactaaggggaaggatgtgagttactgcccggtacttgctcctctcccattgctgttgcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggtatgaggtttgattgggtttttaaaaaatagtataatgtctgaatttgaacacaagtatgaataaataggcaaaatgctttgcttagtagagatctttagtaacccctaaaatgttttctttttactaaggtttcctaactttgtgtagctaataacactgttttctgtggaagtttattgaaaccgttcatcttggaatatctctttgaaagacagaagaaaaaattaaagacaatttcaaaattgtgagctattgatgtagtagtagaagagagctaatttgagtgggagaaagatgagttcagctttgatcacagagttaaagagatataattgatcttgatttcatggaatggaagacttaaatacattaattttactggtagttggaaattcaggattatagagtgttgttaaataatgcttttagaaatgtgtgatttgaaggaagagagtataggatgacaactggtagtcagagaacttcaagttttcagggacttttctgttccaaaatagagtaccatcagttatttgatctcatatatacacctttatcccttctgtagttaaggtaggctgtgagtgccttaatctgggagacaggagtcagtgttagaggcagctttgtaatggtttcagtggcactccttgaagagtattgttttcatagtccctctctatccctgcttaacctttaaattccagaagatttcacctaatctattttatatgctagttcttttttttttgagacggagtcttgctctgttgcccaggctggagtgcagtggcgcgatctcggctcactgcaagctccgcctcccaggttcatgccattcctgcctcagcctcccgagcagctgggactacaggcgcccaccaccacgcccagctacttttttgtatttttagtagagacggggtttcaccgtgttagccaggatggtctcgatttcctgacctcgtgatccacccgccccggcctcccaaagtgctgggattacaggcgtgagccaccgcgcctggcttgctagttctttttttttttttttcctttttccaaattttaaccattagccttctaacattatcagttgggtctctatttgatcctgggtgtatctagtctagtcttaatgaatatgcatagataactggagaatgtccttcataaacttatttttagttttttttttttgatatcttttctgtgtctgggtttctctgctagtaaatttccacatattctgctgatacacttataagcatatttttcagtagacatgtaggcttttctaactgacttaataacaacaacaacataaaacaatttaatattatagatgttactgtcagtcatggcagtgtgtttcatgaaagagattggactgaaaggtggtaccttagaaggcagttgagctgtgagacaagtttgaagaataggtttcaggggcctttagaatcagaggcagctacagtgtgggtaaagaaaaatgtgcttttcacaaggtagaaacttaatattttttgaatgaagagagagaaataacaggaagagtgttgagacatagaacctgcgttgtcttttttttttttttggagacagagtcttgctctgtcgcccaggctagagtgcagtggtgcgatctcggctcactgcaagctccgcctcccaggttcacgccattctcctgcctcggcctccggagtagcgggactacagccactgccaccgcgcctggttaattttttgtatttttagtagagatggggtttcaccgtgttagccgggatggtcttgatctcctgaccttgtgatccgcccgcctcggcctcccaaagtgctgggattacaggcgtgagccaccacgcccaacaatcctgcgttgtcttgaagagaatggtctagtattcaaaccaaaggaaaacgatgagtggaaaaagccttttgaatttattggaaagaaggtcataaatggatatctgagaaacaattttgttgtcctgtgaggacaaaagggtttaacaagctctgatgatggagttaaaggaaggagagaagttgggtagtagttgaaaggggtcccaaagtgtagttacaattttttttttttttttttgacagagtctgactctgtcacccaggctgttgtgcagtggtgtgatctcagcttactgcaacctccacctccccaggtttatgagattctccagcctcggtctcctgagtagctgggattacaggtatctgctgccacccccagctaatttttatatttttagtagagacagggtttcaccatgttggccaggctggtctcaaactttttttttttttttttaagagacagggtcttgctttgtcacccaggctggagtgcagtggcacgttcatagctcagtgttgccttgaattcctgggttcaagcaatcctcctgccttggcctcctgagtagctacgactacaggcatgggcccaccacacccggctcatttttaaattttttgtagagacagagtcttaccagcttgcccaggctcatctcaaactcctgggctcaagcagtcttcccacctcagcctcccaaagtgctgggactataggcatgagctaccatacccagcctagttagaatttttaaagatagctgagatatatacatgtttaacggtaaaaaaggaagtgtcagagaagggaaagctacaaagagaagaggataaacaggaattgggatcaaatgagcattcactagaatgtaagctccatgagtgcaagcttttgtgtctttttttgttcattgatgtatgctcagtgcttaaaacagtgcctggcacttaatagatgctacagaaagggacatatattttcagaaaaggataattaaaaatttgttaatcttctaaccattataaagattttatagttaaggataaaaggtctttgtaacattaaaaacaagtttctgaatattaatttacataaagcaaaatagacctgccttaggtcagattttttttggaattaaacttctgcttagagtatttttagtatgatttgtttgaatattacaatatgttcttttatttatctctttgtgtttaattttttttcttttttgagagagggtcttattctgactccagtgcagtggtgcaaccttggctcactgtaacctaaaccccctgggttcaagtgatcctctcaacttagcttcccaagcagctgggactataggtgcacactaccacacctgcctaatttttgtcttttttgtatagttgggttcttgctatgttgccgaggctgatttttactcttttattttatttatttatttttttgagatacagtcttgctctgtctcccaggctggagtacggtggcgcaatctcagctcactgcaacctctgcctcctgggttctagcaattctcatgcctcagcctccctagtagctgggactataggcgcatgccaccgtacctggctaatttttgtatgtttagtagagatgggatttcaccatgttggccaggctggccttgaactcctggcctcaagtgatccacaaaatgatagtacttgaataatttattttgtttatgactttggaaaaattaggagagaaaatttagaagaaaaggtaatgaaaattatttcatttatctttcacaggactttgcaagaggataatccaagtggagtcattcttagtactgatgattatttttatataaatggacagtaccagtttgatgtaaagtacttaggagaagcacatgaatggaaccagaatcgtggtaagaacagataatcagattctgggtaacgttatgagtaatacaaagaaaaaattcacttagtatttgtttgtgtgtttgtttttgttttttgagacagggtctcgctgtgttgcacaggctagagtgcagtggcatgatcttggctcactgcagccttgacttctgggttcaggtgatcctcccaccttagcctcccaagtagctgggaccacagatgtgccaccatgcctggctaatttttgtattttttgttgtccagcctggtcttgaactcctgggctcaagcaatctgcctctcttagcctcccaaagtgctgagtttgcagaagtgagccactgcgcccagttaaattggcttagtattttttttttttcgagatggagtctcactttgcgcccaggctgtagtacagtggtgcaatctgggttcactgcaacctctgcctcctgggttcaagtgattcttctgcctcagcttcctgagtagctgggattacaggtgcatgccaccgcacctggctaatttttgtattttttatagagacggggtttccccgtgttggccaggctggtctcgaactcctgaccttaggtggtccgcctgccttggcctcccaaagtgctgagattacaggtgtgagccaccgtgcgtggcctataactgtatagtatatataaaattttaactgtcattaacattaattcttatgttacatagtaagaggtgagtttatttcatagggtggttataaggattcaaagagttaatttttgtaaggtacttagaatattgtgtggcatatttaagttatcagtagggatcttttgagaagtaaatctaattttctgcttgggtctcagaatagctgtaaggaaattgcagttgtttcctatgtatctttttttttttttttgacacagtatctcgctctgttgccctggctgcagtgcagtggtgtgatctcggctcactgcaacctccgcctcccacgttcaagggattctcatcctcagcctcccagcctgagtagttgggactataggtgtgtgataccatgcctggctaatttttgtatttttagtagcgacggggttttgccacattggccagggccaggcttgtctcaaactcctggcctgaagtggtctgcctaactcggcctctgaaagtcctgggattacaggtttgagccaccatgcccagcctggttactgctttctaaaatggaatttgaaccaccagaaatggaatttgaccagttaaccactggttttccttagattggtttactcttttttttttgagacgaagtcttgctttgttgcccaggctggagcgcagtggcgtgatctcggctcagtgcaacctctgcctcccaggttcaagcgattctcctgcctcagcctccccctgagtagctgggattacaggcacgtgccaccatgcctggctaatttttgtatttttagtagagacgggatttcaccatgttggccaggctggtcttgaacacctgaccttgtgattcacctgcctcggcctcccaaagtgctgggattacaggcatgagccactacgcctggcaattggtttactttttatggaagatagtgtgagaataaaaacgactctctaaactgaatctgtggggacatcataggtaaaaatttagtttccttgctagtgtaactgtctattcagtgaagatagttttatcattaaatgtttatttgcatagtttgaattttctatggagaatcttgttaagatatagggactgtattttcctcagttttttttttttttggagacagagtcctgctctgttgccaggctggagtgcggtggcgtgatcttggctcactgcaatgtctgcctcccgggtttaagcgattctcctgcctcagcctcctgagtagctgggactacaggcatatgccaccatgcccagctagtttttgtatttttagtagagacagggtttcaccatgttggccaggatggtctcgatctcttaactttgtgatccacctatctcagcctcccgaagtgctgggattacagacatgagccaccacacctggccctcagtcttttatgataagtgtactgtaaaggtgattcttgggtttgccatcttcagacattgttaaatttttatatattcttttttgaactaaagattaagaattcaggaatctgaaaatgccaacataactaaaaccaaaggaggcagtatgatttggtgatgaagatcacccttggattcaccagttactagctatatgatcttgtgcaatttacttatactttccaaggcccagtgtcccctttgtaaaagggaataataatacttaactcccaggattgttgtgaaagttaaatgaaggtgaaaagtgttaacattggctgggcgcggtggctcatgcctgtaattccagcactttgggaggcttaggcagatggatcacctgaggtcaggagtttgagaccaccctggctaacatggcgttaccccatctctactaaaaatacaaaaattaaccgggcatggtggtgcacacctatagtcccagctacttgagaggctgaggcaggagaattgcttgaacctgggaggcggaggtttcagtgagtcaggatcccactactgcactccagcctgggtgacagagcaagactctgtctcaaaaaaaaaaaaagtgttagcatggttcagcatgcccttataacagcaacaataatatatgttaataggcggaattcattttaaaactgctttgttaagacaaaattcatgtgccatacaaatcatccatttaaattgtataattcagtagtttttagaacttaatattcagggctgtgcattcgttaatacactctatttaatttggctttgctgcaacttttagaacacgctaaattttagaacatttttatcatctcagaaagattctgtacctattagcagtcactcttcatttctttccagtctgtgttttgtccctatagataatttgcctattccagacatttcctacaacatgtggacttttgtgattggcttctttcacttagtataatgttttcaagcttcatccatgttgtagcatgtgtttcattcctttatatggatgagtaagattccactgggtggatatatcacattttattaatctattcatcagttaatagacatttgagttgttttcactttttggctattaagaacagtgctgctataaacaaacacacatgtctatgtctaacctttttaggaactgccatgctgttttccaaagcaatcatacctttttatgtttcctctaataatttatgagggtttcaacttttctacatcctcaccaacacttgttattgtccgtttttttgattattcctattctggtaggtgtgaagtggtatctcactgtggtttcaatttgcttttctctgatggctaatgatgtggaacatctttttgtgtgttttttggccatttgtatatcttctctggagaaatgtctattcatatttgctctgtcacttagactggagtgcagtggcacgatcttggctcattgcaacctccgcctcctgggttcaagtgattcttgtgcctcagcctcctgagtagctgggattacaggtgcaagccactacgcccggctaatttttgtatttttagtagagacggggtttcactgtgttggccaggatggtctcgaactcctaacctcaggtgatccgcccgcctcagtatcccaaagtgctgagatcataggtgtgaggtaccgtgcccagcctcctttgcccatttttaaattggttctttgtttcttcattagtgagttgttagagactgggcagaactttgaaaacttccaaataaattacttgtaagacttacttgttgtggtacatcattaatttcctgtatggtctaattcctttggaagaaaggtaagaaaatcccttgtgcaatggtgtattataatgttttctttatttcagatcattacattgtgtgtgtgtatatttgtccatttgtttttgttgtttgtttttaaactttatttttgaatattagatatatggaaaagttgcagagatactatggaaagcttctgtatacccttcactcatttatccttcatgttaacatctaatataacgaggatacatttgtcaaaactaagaaattggtttattattattaactaaactcaagactatagtttgattttaatttttctactcaaggtctttctctcttacttgacagtcttaatatgtggggtttttttgagacggagtcttactctgtcacccaggctggagtacaatggcgtggtctcagctcactgcaacctccgcataccgggttcaagtgattctgctgtctcagcctcccaagtagttgggactacaggtgcgtgccaccacacctggctaatttttgtatttttagtggagacggggtttcaatatgttggccaggttggtctcgaactcctgacctcatgatccgcctgacttggcctcccaaagtgctgggattacaggcatgagccaccgcgcccggccttgttttgtattttttaggcagagtcttactctgttgcccaggctggagtgcagtggcctgatcttggctcactgcaacatctgcctcctggtttcaagtgattctcttacctcagcctcctgagtagctgggactacaggtgggcaccaccacacccaaataatttttgtatttttagtagagatgggctttcaccatgttggccaggctggtcttgaactcctggcctcaagtggtctgcccgctttggcttcccaaagtgctgggattatgggcatgagccaccatgcccagccaacccatacttacttaatttttatgtcctcaaagggatatttagaagttgagcagtgagtaaaattagcacatcatgattttcaaattatgaaaagatcagattttttgaaaatcataatacttagtattgtttaaaaaatgatttttaattatgttatgtttttcagcaaaagaagcatttgagaagaagatatctcctataattatagataatacaaacctacaggcatgggaaatgaaaccatatgttgctttggttagtaccataagttgtcataagtttataacagtttgtatgcaattattggggaacattaattatgaaagtgaatctgaagcacttaagaatctcagaaccttggatagtctgtaaatgagctttcattggtgttcagcaaaatgaggaaattaggccatttagctgagtttttccataaagttaaagttttaaattctgaaattcaatttttgaactctaagattgttttgttttttggggtcttttatgaaaaggtagtggtactaaattataattttatttttttgtttgtacctatgttatatatatttatttccttttcctcatacttggcagaatcaaaatttgttggtcctttgtttttccctaaatttcttttgaaattttgctgttctgagaaattcagcattctgtaaactcagctattttctctgaatttgccagatttcttttaatgtttaagtcctttgcctttacctgacctatacctaatcctcttcttgcccttcttgctcttttttgctcacctttttttttttgttgttgagatggagttttgctcttgttgcccacgctggagggcagtggcgtgatctcggcttactgcaacctctgcctcctgggttcaatcgattctcctgcctcagaaactgagaaactgggattacaggtgcccgccaccacgcccagctaattgtttgtatttttagtatagacaggatttcaccatggtggccaggctggtcttgaactcctgacctcagttaatccaccaacctcggcctctcaaagtgttgggattacaggcgtgagccaccatgtccggccgaaaattctttatcttcctttcttaacatttttttaaagaacattctgtcattagcacatgtagaatttaaatattactgtgtagtattttcatcttgtggttatgccttcacttatttagtcagttctatattaatagccatgtagttatttgtatccttttgctgttacaaatactggaaaactggctatcctggcatatatctaatgtatgtattatataaataaatgctcttatataagtatttatcagtagctaaatttctaatagttaattgctgggttaaagtgattgtatattttgccattttaacacactcatcaagattagataatctttacgttttacatgctatatatttggaaacaataattttaatttcttggaaatacctattttaaaatgtttttgtctttgttgtatgtagtctcagaaacacaaatataaagtcctttttcgggaaccagacacatggtggaagtttaaaccaaaggaacttgcaaggtaaaacttggaggctacctaacatgctttttatgtaacgacagacagacaaggtccgtttagatttttccccttgtaaatgatgaatgaattgattagattgtaacttaatttctattgcttacggctttttgtccagttttatgaagagtttctttgtgtttctaaaattgagttaatttacggtaaaaattccccttgtattatatactcagtatcttactaccttttttgagttttatttattcgtttatttatttaaatatagagacagggtcttgccatgttacccaggctggtcttgaactcctggcctcaagcgatcctcctgcctctgcctcccaaagtgctgggaccacaggtgtgagccaccatgcccagcctgtactttattactttgaatcatatgttaatatctaaagctagaacagaccctaggatttggcacacctgaactatgtgctactgggaggggcgaattgtcgtagctgcttagtgatttagagcactggaaggtagtacggatatagagatggaaaaggtagcaaatatccagctgtccagatatctcactccatgcctgcctcccactatggctatacttttttctttattgagttgcttgacttgaataaaaatgttagtcaaggcatggatgtacagtttgttttgctttgtgttctatacttccatagagatagccctaacttcattttggttaggctattttttttttcttggcaatttcaactaactttagtactaaaggacaacctaattttagtatattcacagtgttgtgtgatcatcacccctatgtaatttcagaacttttccatttcctccaaagaagccctatgcctacaagcagttactctagttcccccctcctcttggcaaccactaatgtgtgttctgtatttatgggttttcctgttgcgtatactgcatataaatggaacatacaatatgtggctgtttgtgtctggcatcttttcacttagcttaatgtttttaaggctcatccatgttgtagcatgtgtcactacttccttttcatttccttttgatagattactgagtttggttttctgatatttcatttaggatttttgcatctttataaataaatgagattgacctacagtttttttattccttgacttgtcttgcctgacagggatatcatagttttaggatcatgaaattaattgggaagtatctcctcttttcttcttttctaggtttatctaagtttgaatgttagaatttactttaaaaattctttggatctgatgttttctttgtgagaatgtttagttggaatttttccgttatagcaacgtttccaaatttattaagactattaaagcaattatagtagtctcttactatttacacatctactgtgttagcagttaagttccctcctgcaatcttagtatgtttatattatcttccttcttttttctttgttattctcatcagagatcagattagccttttcagataaacaagtctcagctttatttgaactccatcgtaagttttctaatgtttaattaatttctgcttctcattattctacctttattgctttcaaaaatcaattttgctttttttattctcttgtgttttaaacttctctacttgaaggtttaggtcattttctaatatgacatttgatgttaaaatttccctatgtatgccaggtgtggtggctcctgcctgtgatcccagtactttgggaagctgaagcaggaggatttcttgagcccaggagtttgagactagtctgggcaacagagtgggaccctgactctacaaaaaataaaaaaattagctgggtatggtggcgttcgcctgtggtcccaggtactcggatgctgaggtggcaggattgctgtagcctgggaggtcgaggctgtgatgaactgtgattgtgccattgcactccagcctaggcaacagagcgagactctgtctcccaataaaataaaattttcatatgtattattttagctgctctcagaattttaatatataatactttatttttgtcttatttagttattttctagtttgcattatgattaatttcattctttaactcttgggttatgtcgtactgtgtttttaaatttctgaacagatgagtgttttgtcttttataaaaattggttttcaacttaactacagtaggtcaggttgtgtagtttgtatgattcactgacatttataagatttttttggcctagttaagtgttgattttttatacatttcatatttgcttgataagaatgtacatgattacaatgtgttaatatatccattaaatcatgcttattgttactcatatctcctgtatttgagagatgaatgttgaaatctccctttattatgttgaacttgtggtttctccttataattctgcctatgtttgctttacatatttggagggtagtttttgaaatgtatacaagcttaagatttttatatcaccctaattaattgaaccttttattattttctagtgattttcttttgtctttagtagtgatttttgttgtaaagtgtaatttgtctaatattgatagacctacatcagcttccttttagttagtatttgttacttcttttttcatacttttactttgaatatttttatgttcgatgtatctcttgtaagcatgatggctggattttttgaaatccactctgtccaccttgacttttaactgataaacttagttcttttatggttattttggttattcatataattgatcttgtttcttagaattattcatataattgatcttgtctcattctgtgctttttgtttatctcgccttttctgtgattgttcttctattatagaaaatgatgtagttggatttttttcctatcatgccttatttaaaatttttaaaattgtttccaaatttttgtattaaatttttttcttctctactaatttggaaattgtgcagactttaaatctaaagtcaaaccattttcttggctttcctcctcacgcatacgaagactttaaaacattttaattctgacacttgcctccctctcaatttacatgctctcattgtccagaatatacaggtagtgtttattttcacttattcatctagttattgctttctgcttcatttttttcttgcatcatatacctttcatctgggaattgccttctgcctgatgttcatctttgagaattttctttatagtaagggtctgcttggtgtcaaattctttttttaaaatctgcagatctttttattgccctcattcttgtaagatacttttgctggatatgtatattctatactgacagttattttctgttgttgaagataacacttcactcccttctgacttacattattattgttgttaagtcagctgtcattctaattgtttctttgtagataactagttttaaaatgattttttaaaatttctggttgcttttaatatcatctctttgtctttggtgaatgacaatttcagtactatgtttctagttatggatttcttatttttttatcttgtttggcatttgttggcttctgaaattaagggattggtgtttttcatcagttctggaaaattctcagcatttttctttacattgcttccgtcccatgcattctcttctctttccgggacttagattagatgtatactagaacttttggctctggctcctatgacccttaacctctctttcatattttctatctctttgcttctctgtgatctgaaaccagacaagatcgaggtaggtaaatatgaaagccagatttgcccaactggcaaatgcatatattatccctgggatccagtcacaaagccttgaattcaacccaagacaggaaagttgcaattgagatgttttcattaagaccaaacctttgaggggctaaagcataacatctggcctcctggcaggtataaacctagatgctgtgtgaaagtactccgagttgaaggcctcagaattctcatatattaagttcaaccaaatatgagcttataataaaaaacatttttgaaaaaggcactatgagtgaaaacacaaacaactaacttcatatttgaacatctagaaacttcaaatactagaattttttttctttgtttgaacttaagtgtataatttaagaaatccttaataaaatgaaaattagaatcaaattgtatatattgtggtcacaataaagcagctttgatattcgtatctattagaaatatattattgttttcctagacatatgttctgatttttaaaaacttaattatcaatattccttcaacccttttttcccctggaattttcaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactaggtaggttaaaatgccttatgtacaaaattcaatttgaaatataatttttaaaaggtataattttggagcttgtggaatcattgctgataaactttaaaaataaggtggacttggctgggtgtggtggctcacacctgtaatcccagcagtttgggaggccgaggcaggtggatcacctgaggtcaggagttcgagaccagcctgaccaacatggagaaacccgtctccactaaaagtacaaaattagcctggctggtggcgcatgcctgcaatctcagctgcttgggaggctgaggtaggagaattgcttgaaccctggaggcagaggttgcggtgagctgaggttgcggtgagccgagattgcgccattgcattccaccctgggcaacaagagcaaaactccatttcaaaaaataaataaataaataaggtggacttttgttatttttaaggatttacttatagtcttacctagggtgggatatatgtagttatcaagagaagtacaagttcatatgagagatgacatgacagttcttttattgtcctcagagttttgtgagtccgtgattatgctatgaattctcctgccagttttacttgacgctcgctgctaatccagtatttcccttatcttctcgctgttattattttgtatccactcaaatcacttcttaatttccttaagttttaatgaaaatactctttcaagctagtgttataaaaattattaacagtacacttttaccaagtaatacaagtcatggccttctgacaatttgcaatccaaggtagcactgattctgtttagcaacgaagacacataaacaattgaataaataaaaacagcattaactgacagacagagtaaagaagaaaccacaggtctgaattatccatatgttttgatggtaagggatagagagcttctgttaaaaaggagttgggaatggggaagagaaaatttataaatgcttttttgattgagaaacagtgttgcaaagtggttaagagcatggactcttgagctatatttcctgggttcaaaaagtcccaaagctttgtcatctctgacaagttacaaatctttctgtacttcagctcttcatttctaaaatgccagtaataacactctgctcataaaaatcttataaggattatgaattagtacatgcaagggacttaaagtagcatcatctaacacatagaaaactcagcgttaggtatgatttcacttaggaaggcatcctgcgagagttgggacttcgagcactcctgaagttaaaaaaaagaggaaatgcattgacaaatttaatcgagaaaaattaactaaagttgagagtataatgatttgcacaagtgctctgagtctgaaattaacattaagtatggctttaaaaaatcttaccaaatgacatttcaaatgaaagctctttttttctaatttctcttaatcgggcaaatagcgttggttggccctttgtgactttgtaaatgaagcttcctcggtatcagacctattttacatatgcttagctatgtaaaactaaggtcagaaagaagctagaaaagtggtgtcctctcctgggaacaaattcagagctttaactttaatgcataattaacacctaaactgaaaatctcatatgtactattcaattaaaaaaaaagtttgagtgcttcatatatgccaagcatcatgctaggtaatggggttacaacaatgtaatgtgttcatagggtattagagaaagatcagaattagcttttataattttaatgtaatttatttataaaattttcagaataactgttaagtgccctgtcaattaatgcttctttaaatcatagtattgatggcagcattaagagactttctcatgatactctttaaaataatcttacagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaagaagaaaagaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaaaagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccagcgatggccaaatctctgaccatagactgtctggaattggcattaccccctgaactggcttttcaacttaatgaattatttggtcctgttggtattgattcaggtaaggaaaaagtaaatgaccatgtgtgtgtctttgtgtgactagactacagagggttctattttgtattttttttttttctgagatggagtctcgctctgttgcccaggctggagtgcagtgcctcaatcttggctcactgcaacctctgcctcccaggttcaagtgattctcctgcctcagcctccagagtagctgggattataggcatgtgccaccgtacctggctagagagttctattttgattgtaaaattatattctatgttaactgaaatgcaaaagtaattttatgttgcctaacttcacatagtgccttatttttgacacatttctggaggactttaaaaaatacaataggaagaaatagagaatatttatatggagtttgtatttatcccatacatagtttgaacgttttctctggtatttacttcacacttaattgtacggatgaaccttttaaaatcctttggtgctactccagatacatttaagacaagattaattttttagaacatatttattgaaaagtcttgactaatagaaatgaataaagtaaacatatttagactcatggaaaggaataacttagatttactgtgaagctttgtataactgcagtagtcaagaagtgtgaagacagtaacatagcatataacataaatagaaatactctaagatttagtaaatagaagcataagttaggaattaatagtacaagttagttttgtgatgcataaggtggtttagtatgttttctgcaaatatataatgagtaatgattacattttcttccctcccccttcccccacaagggtctctaacagttgaagattgtgtggttcatatagatctgaatctggcgaaagtgattcatgagaaatggaaagaatctgtaatggttggtaggcttctttttataaagagctccttttttgtccattttgaacctttgaatttcagtgaaatctaccacataatattaaggagttctattgaattttggctttgagatggaagagttctattgaattttgactttgagagagaatgaacttgtaccatttaacagattactgtctttttttttctctcttttcagtagtttaagtatttccagacagccaaattatataattagcgatggagctcattgtaattgttgattttttttatatcttttttctattttagagacagtgtctagctctgttgccctggttgagtgcagtggcacaatcatagctcactgcagccttgaactactgggcacatgatcctcctgccttagcctccagagtaggtaggactatacaggtgcctgccaccacacctaggtaatttttttttttttgtagaggcaaggtctcactatgttgcccaggttggttttgaattcctggctttaagtgatcctcctgccttggcctcccaaagtgttgggattataggcatgagccactgtgcctgacctgttttttttttaagaaaataattataaacagtgagtttttcactcccagaattaaagacttcaatgctgattggttaaatttcaaagacagttcttaatttatttaaaaatttttttcagaccattcttcataacaagaaatttttttttttaaatgcagtatttttaccattctagaagtggaaaaaatatgtagctgtagtcatacttcataatttttattatctaactttattgttttacttagattgagtaagaatggtttacagttatacaaggagaaatgatttctagagaaaaataatataaccttgtatccttgtttactaatgcactccctgtttgccaatctcttgcctggcttttgtgtttaggagcgacaaagacaagaagaggtgtcttgtggcaagtttatgcaaggtaaagcacatgtttttatttctaatgtcttaatgttgaaatttggtgtgtgtgtttgaattttaactcattctaaattacttccacaaaatacggtacccacaaattttgatttgcaaataaaagttttatttatttatttatttatttttttatttagagatggagtcttgctctgtcgcccaggctagagtgcagtggtgccattttgccttactgcaacctctgcctcctgggttcaagcaattctcctgcctcagcctcccaagtagctgggactacaggtgcgcaccaccacacctggctaatttttgtatttttagtagagacggggtttcaccatattggtcaggctggtcttgaactcctgacctcaggtgatctgcccaccttggcctcccaaagtcctggggttacaggcatgagccactgcgcccagccagttctttaaaaatatttaatattttattgatatgaaataaaataaaacttaaagggggaaaaagcccctataatgtatattgaactttcatgagtgctgtggaacacctagggtatgctctcaaagcatttcctgttgaggttttgctctgcatgaaagaaaacttttggtttgagagcaacagagtgttcatgtgtttgatcaagaacatcattgaaatattacttggttattcaaagtttttattgatgtcagtattgttagaccacaaaacccagcctgctttttggtacatcctgccaacttgaaaatatttgattccagatgacttctcttagatagtgttgtcttcagtgactgttgcagggtggcagacctgttattaagcatcctccttttgtgcctgagttcctccacatgcctctgttgtccagtccacactgggaccaaggcaaggagtttcaccttgaagattcttaggatccactttggtccagacctgtgctcatgtcatagcctcaagagctacagctgatgtagggatagaggtgcccaaaggatggtgtgcaaatgccagtgtctattgtttcttcactctctaggacagcagaggaatgtatcagaatgtgttgatactcctctgagaagttgaaatgttacacattaaattctgttgttgtgaacttcctagaatgttcagttccttattttgaatatcatttgcccactctttattgtgtgccttcactgagttacaggtttgccaaagtaatcgatcttcttggtccttagaatgggtggccagagcagactgtagctgttatggttgctcacttccagctggctacaacttcctctatttaccagtgtcctgtatacatgtcactatgttttgggttgatatgatatgaaaaagagtgggaagcattgagtcagtttaaaattatacacagcctggccgggtgcggtggctcacgcctgtaatcccagcacgttgggaggccaaggcgggcggatcacctgaggtcaggagttcaagaccagcctggccaacatggtgaaacccccgtctctactaaaaatacaaaaactagccaggcatggtggcgggcgcctgtaatcccagctacttcggaggctgaggcaggagaattgcttgaacctgggaggcggaggttgcagtgagccgagactgcgccattgcactccagcctgggcgacagagcaagactccgtctcaaaaaaaaaaaaaaaaaaaattatacacagatcattactcttttaaaatattgctacattaacacatactatttcttacttgcgatgacgtgaagatgtattttacaatttcagagttgtgttatatttacaaactgaaaattaaaaaactgtttccttggtctctgaggtaaatataacagagtgaataatgtttaatttatacatttattgttgagagtatgacagtatttatactactttgtagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttggtatgaattaatataaatattaagctactgtctctgattctggtttattgtgtatgtttactttgtgattttttcaaagtattttctagtctagaatccatatttaacctgattgaatttaatgttaaaattgaaaaatattttaagtataatttgaagctggaggtttttgcttcagggaaattagttaatactcaactataagccatccatgttaagtttgtgttgttttagatttaactgtataggtgattgagctgcatctttctttttctttacctttttttttcttgatacatcgtcttggctctgttgcccacactagactacagtggcgtgatcacagctcatggaagccttgacctccagggctcaagtgatcctcccacctcagcctcctgagtaacagggactaccatgcctgggtatttttattttatttttggagatggagtctcgctctgttgcccaggctggagtacagtggtgtaatcttggctcactgcaacctccatctttcgggttcaaacgattctcctgcctcagcctcccaagaatcagggacaacagatgtgtgccaccatgcctggctaatttttagtaattttagtagagacagggtttcaccatgttggccaggctggtctcaaactcctgacctcaagtgagccacctgccttagcctcctaaagtgctgggattacatgcatgagccaccatgcccacgaatttttgaatttattatagagacagttttgccatgttgcccaggctggtctcgagttctggggtcagtgattcacctgccttgccctcccaaaatgctggaattaaaggcatgagccactgtgcctgaccggctgcatcttcttcttctttttttcttttttttaattttatttgtttgaaacagggtcttgctctgttgcccaggctggagtgcaatggtacaataaggctcactgcagcctcaacctcctgggtttaagtgagcctcctgtcttagactcccaagtaggtggaaccacaggcatgtgccaccatgcctggctacttttattttttgtagagatggggtcttgccatgttgcccaagctggtcttacactcctgggctcaagtgatcctcctgcctcagcttcccaaagtgctgggattatcaacatgaaccaccatgcccagccagctgcatctttttcagcttttaatatttacctctatttttttatttctataaaaacatgaaggaaatcttatttaaagataattatatatattagtaataagaaatgtctatcttactattaaagatgtctatctctgagaaaatatatatatatatttttttgagatggagtctcgctctgtcgcccaggctggagtgcagtggtgcgatcttggctcgctgcatgctccgtctcccgggttcatgccattctcctgcttcagcctcctgagtatctggaactacaggtgcctgccaccgcgcccggctaattttttgtattttttagtagagacggggtttcaccgtgttagccaggatggtcttgatctcctgaccttgtgatccacctgcctcggcctcccagagtgctgggattacaggcgtgagccgccattcctggccaaaacaaaatattttagagaaaaattttagaaacttatgagtttgaattaaaaaaattactcttccttttcaaatagaagcttcactttgaattttatttttggtctttatttcaaaatatctaaatatatgaagccatacttgcagtagatttcgtttggatttcgtcttactcttttctggaattctgaaaattagtattaaagaattccaggtcaaaagggaaaacatcttagaggttatttagtctaattctcaagggaaaagaataattcttagatggtgttcttaaaacattttaacactttcttattcgtttgactgcacaaaggagcacctttatatttggctgtaatacatccagttaaggcatagggattgctctaccttcatatttattttttaaatttatcttggttaactaaattagaaatatactgccattcccatctttgtatcctaacgcaatccaaggaataacctcttcagtagatcttaaaattttagtgtcctgtcaaatagcctcttcaattaatatatgtattaatttgaggcaatgaattttctttcttctttctgttttttttttttgagtctcgttctgtcacccaggctggagtgcagtggtgcgttcttggcacactgcaacctccacctcctgggttcgagtgattctcctgcctcagcttcccaagtagctgggattacaggcatgcgccaccatacccagctaatttttgtaattttagtagagacagggtttcaccatgttggccaggctggtcttgaactcctgacctcaagtgattcggcttcccaaagtgttgggattacaggcatgagccacagcacccagccagcaatggattttctttaaaaaaaaaataaataaataaaataaggaaactctaacacttaggcttaaatggtgtgatactttctattgaaatgccattttccactattaaaacttgtctttacagttctaccctccctttaatatcttgatgtaataggtgaacaaatgagcatcttttgacttcacaacttactccttttttttgctatcagtgatttttgcttgtttttctttttcttttcttttttttgagacacagtctggctttgttacaggctggagtgcggtggcaccatctcagctcactgcacctttgccttttgggctcaagccatcctcccacttcagcctcccaagtagctgggactacaggtgtgagtcacgatgccctgctagtttttattttgttttgttttgttttttttgagacagagtctcgctgtgttgcccaggctggagtgcagtggcacagtctcggctcactgcaacctccacttcccaggttcaagcgattctcctgcctcagcctcccaagtagcaggaattacaggtgtctgctaccacgccctgctaatttttgtatttttagaagagatggggtttcaccatgttggccaggctggtctcaaactcctgagctcaagcaattcacctgcctcggcctcccaaagtgctaggattataggtatgagctaccacacctggccttttcttgtttttctgtagattgggtaatataatagaagctggttggctttgtcccaaggatacccacctttaccttcacatgcagcctgagaaagataatttttttctttcttttttttctcgaatagagatgaggtcttgcagtgttgcccaggctggtctcgaactcctggcttcaagcagtccttctaccttggcctctcaaagtgctgggattgtaagtgtaaatgacactgcactcagccagataatttcctgatgctgtcctcactctttgtccccaaaggagaaatatactttgtatatattttttaaagcaaaaaatataactttagacataatatatgaatagaataattaattttaagatgattaaggttacaaggttttagttcattgatgaaacctcagaatttatagtttagaaactttgacccgatagattggtagaaaatctgatgattgaattttttagtaagtttagattacatgcatatcttaagtaaaatgtgaaatattttaatttatttttttttgaggctgggtttcactgtgttgcccatgctggaatgtgcagtggcgcaatctcctgggctcaagcaattctgtcacctcagcccctcaagtagctgggaccagaagcgcacatcaccacacctggccaaaaataaaatatatttttagtatagatggggttttgccatgttgcccaggctggtctcgaactcctgggctcaagcgatctgcccaccttggccttccaaagtgctaggattatagacatgagccactgcacccagccagaaatattttaaattcttcaggtagcttgtttccatcactcttgttgtatgttcagctttatcactcctttttagtcatattgttacctcttgtggttcctcttttattgctgtttggtgttataaatggcctaagtatggttaagctttaaaataaataacaattctagcattttcccagattattttgtttatttatttttgatatagggtatcactctgttgtccagcctggagtgcagtgacttcatctgagctcactctagccttgacctcctgggctcaagccatcctcccacctcagctgggactcttgccatcacacctggccagcttttaaaaaacaattttatgtagagatagggtcttgctgtgttgccaggttggtcttgaactcttgggttcaaggaatcctcctacctcagctattgtaatttttaaatttaggaattttcagtcattttattgcctttgaaactgtataggaagttatttttcagacatcagcatttttgtagcaaacaaaattattttgttatatcacaatgtttaagaatatttattatcatcttaggttagaattaaaatagcatatttttaggaaagttctttttgtctgacagtttagagcagatccaaatatgaaatgtgagtaataatataattcttatacagttattttggagtaaatatatttgtgaaaaactgaaaaaaaaaaattgtgaattccaagatttctgtcaatctgaatttgcagcttgtttgtacactgtagtttctgcccattgaggagaatatgttttgaggacgatgttcacagcatcacacagtgtcacttttatgaggacccatggggaaatttctctcaggtctcagtaccagaaaaagctgtacttctgagcaactggtttgtttttattttatggacactgagaatctttgttttcccctttgctttggccactaagagtctcagaactaaatttgtggcctacttgtagcaattgtacaggattttgtggcatgcatttatatactaatactgctagccttagcttatattttatctttattttctctgacttcatttatttttatcctgtttatgtgtgtgtatgtatatatatgcctctatatcttcatccttttaatgattcaatgtgttggatatgcatgtgtgacagtatgtgtatatatatttacatacagatgcccacacatacatgtatacatgtgattgtgtgtgtgtgtgtatatttataagcaacttcaaatactttgcaaaaaatgagatataaataaatagtgcaagagtactcgtattactaatttcagcctttaatccgtaaagaaagtctgtgattgcttttaaatcatcagtagttttgcaacaagttaaccatgcctttggtcagtgtttctagtattacacatttcatcttgaacatgatttttatgtttttgttttagaaaagggagacccttatgtttgaaaaagattgtgccactaaactaaaggagaagcagctctttaagatatttccagccattaaccaaaattttctggtggacattttcaaggaccacaagtgagtgctagaaggattgtctgtagtttctactctgatgtcactgaaagcatatgccatgtttatttttctgataacaaaaataatgtaagtctacagtagtctctcctaatctgtgggtattattccaagacccacagtgggtgcatgaaaccacgaatatagctaaaccctctatataccctctatatactatgtttttttcctataaataagaattgatttacaaattaggcacagtaaaaaattaacaactataactaacaataaaatagaacaattataacaatatattgtaatataagttatgtaaacatggtctctctctctgtgtctcaaaatacagttgtccttcagtatctgggagattggttacaggacagaaaatctttaccattattgtttctgagttttatgttttatttagggagtctgttatgtcctaatattataaaaatttttctttattattttaaatgtctacctttttatgtatgtggtatgaggtagagatttataaatgagctagagatttaacttgtctttccaaatgactaaccaaatgaatggatcatctttgcccacttatataaaacataaccagtaattctacatctccaaatatatattttaaggactttaattccattgagctatttgttagatcctgagttgccaccgtgttgttttaattattgtagtgttatgttaggtatatcaggaatgctctggtttgaaaaatacatacttttgatcatgtatttttcttaaattcttcacaagagcttgttttaaataggtactttttgagaatcttttgagaatctaatatagattttgatctttagtttattaatatatttcatatcaatcacaataatggatttctggaataaaacctactttactttcagattttttttttttcctttaatgcaggtaggaattgatttactaattcattggtatttttacaatagtaatgaaatggtgttggtctgtgatttttttttttctgttcctgggctatttttgtcagattttggtttcagtgttttatttggtgtcaggcttaataaaataaactggcagcccgccatttttccctctgctgtggaaagtttaaagaacttagtaccttgaaggttctgggcttgtaccttctcagagagagaatcttggtttattggtcaaagtctattttatgctgtcttatcatttattttttactgatatctttctcttaaaatttgttagtatattttcaactctggttagtttatttcctttcagtctttaataacatacatttaaggtatgaatttttctctatatgttttgattttgatacatattttaattttcattattttctaaatctcaaattttagtttgattttctgtttaccctggaatttctttctccttttttttgaaacagagtctcactttgtctcccaggctggagtgcagtggcaccatcgtggctcactgcagcctccgcctcccgggttcaagtgattctcctgcctcagcctcctaagtagcagggattacaggcgcacaccactacgcctggctaatttttgtatttttagtagagacaaggtttcactatgttggccaggctggtctcgaactcctgacctcagctgatccacccaccttggcctcccaaagtgctgggattacaggcgtgagccacctcccctggccaatttttaaggcatataaaaacatgagtgaattttatgtttagacttggaccccattcccaagatacctcattatgtatatacagatattccaaaatttggaaagatctgaaatctcagccacttctgattccaagtgtttcagatgaggagtagtcaacatatacttttttgtgtgtgtgtgtttgtgtgagacaggatcttgctgttgcccaggctggagtgcagtggcacgatcttggctcattgcagccttgacctcctaagctcaagtgatcctcccacctctgcctcccaagtagctgggactatagacacgtgccaccacgcctggctagtttttgtatattttttgtagagatggagtttcaccatgttgcccaggctggtcttgaactcctgagctcaagggattcttcccctattggcctcccaaagttctgggattacaggtgtgaaccaccgtgcccagcccagtctgtacttaagaatatttattctctgctgagtgtgcagagttctaaatatgtcacctaaatcaaatctttaaaagtagtattccaatccctaattttcttatttatttttgctacctaacttgctattttctgagagttttgtgttaaaatctcccagatgccagaggttgatgctagcatatggccactcctgttctatgagtacctagagcaagaggcctgaggtgaaatagctcagagttgtgcttccccaggcaaaggagggggctgggtgtgtccttctggggatggtcagtgattggtcagccagggccctcatgttaggtggctgattgcctccatttgtctgccaacggctggctgattctctcagctagcagtaggttcagcttcatcctggtaagaagggtaggtgagctcagttactacagtatgtgcttgaggtgtaatcttctagggctgtttgcctcaaacaacatcagggctggagactgacttccagcaggtgagtgattttaaggcctagaaaggatgtggataattgttggtagcatccagcccctaatactgatatcctttgtgttgagcatatctgaggcagcaagatgagaggggaagtggaactggtagttgcacatggcttcctttcaagggttgtctttaataaattgaagaatagcaaaataccacattattttggataattagtttaccaaatttctttcccttttgctttcttgcttctttctttctttctctctttcttccttcctcccttccttccttcctttctctctctctctctctctttctttcttttttattttattttattttattttttattattatactttaagttttagggtacatgtgcacaatgtgcaggttagttacatatgtatacatgtgacatgctggtgtgctgcacccactaacttgtcatctagcattaggtatatctcccaatgctatccctcccccctccccccaccccacaagagtccccagagtgtgatgttccccttcctgtgtccatgtgttcttattgttcaattcccacctatgagtgagaatatacggtgtttggttttttgttcttgcgatagtttactgagaatgatgatttccaatttcatccatgtccctacaaaggacatgaactcatcatttttgatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgggtcaaatggtattcctagttctagatccctgaggaatcgccacactgacttccacagtggttgaactagtttacagtctttctttctttcttttctttctttcacagagtttgctcttgttgttcaggctggagtgcagtggcaccatctcggctcactgcaacctctgcctcctgagttcaggcaattctcctgtctcagcctcccaagtagttgggattacaggcgcccgccaccatgcccggctaatttatttttgtatttttagtagagacagggtttcaccatgttggccaggctgatcttgaactcctgacctcaggtgatccacctgcctcggcctcccaaagtgttgggattacaggcgtgagccaccatgtctgcctagttaaccagatttcaaaaaatattcgtatatggtcagttcctcagtatctggccaatggaagaggtgagagacataaatagtgtgaaatactgagcagcatataatttttttgaatgattttctttagatattggaacgtgagtgtgtcagacatttgttgatttgtagaatttcattctacagataatatagtatcaccgtcaagatatgactgaataatgcagggatgagaggtagggtagtgcttaagtttttcttttctgtatccctgcttagaatttgactaaaatcccatggtaaaagtaaatgtagaatttgacacaataaaaatgtcagcttaaaggtctattgtctgtgtttgatgtttgaaggaaaccacatataaatccaacaaaggatttaagaagaataggtgataaaatgaaagaaagatttgttatggctaatctgcctggtataaaggattagaaattgaatctatctatctatctatctatctatctatctatctatctatctatctatcttttttttgagacaaagtcttgctctgtcgcccaggctggagtgcagtagcaccatctcagcccactgcaacctctgccttccgggttcaagcgattctcgtgcctctcagcctcccgagtagctgggattacaggcgcgcgtcaccacacccagctaatttttgggttttttgtagagacggggtttcaccatgttggccaggctagtctcttaactcctgacctcaagtgatccacccgcctcggccccccgaagtgctgggattacaggcgtgagctactgtgcctggctgaattaccaatatactatcttttggcattcattttttgaaaattagcttttgagaacctattatttgatagtttccttctgattattcttgatttttttttgagatacaccatgagcatttaatttcaaggttgaaaacttaaaagtaagccagtttttcatattcttgtaagatgtttgaagattgcttgtgttaatgtcccacacaacttattttcatttattgacattatgtttctacttaaattttctacagctattcattagaacacacagtgcaatttcttaactgtgttcttgaaggggaccctgtaaaaacagttgtagcccaagagtttgttcaccaaaatgagaatgtcacatctcatactggccagaagtctaaagagaaaaaggtatggagttactaattttttttctacaagggtagataattgcatataaaaatataattggttcattgagtataataatttaatgattatttctcaccattttgactagactggaaatttaaccaccaatggcatatttggcttataatatctgtgcactcaaaataatgaatttatagctgattttttccttcgtgtgcatgataaacaggcacttgaatttctgcaacttctgtatagtctgacacagtagagtatgtggtttaattgaatagcagtaatgtgatgggtcttgaatataaacatgtgggcagaaatatttagccttttgggaaagtgccaaattttttcccaaagtggctctaccattttatatttccactagaacagtatgagggttacaatttctccacatcttcactgacatatattattatttaacacccgtctttttattataaccattgtagtgagtgggaagttgtgttaagaataccgagaatttgttttaatcaggtatggtaagacgtgcagacatggaagtgtcgtgaaggaagtttatcatactcacagagttctggaaacaggaggtatggcttgctacccaagttcacatggggagccagcaggattggtcaggaggcagaaggagtaggggggaaatgtgggcaaaagcctgtattttggtttctatgggaaggaatgggtaaggcagggtaagcaggtttaggattggctagtttaaataatttcagcaggctctggggcatagggacttcccctggttgtctgatactcgggggcaggtggatagtgccctggagtgggagaactccattaaaggaggaagttggaggcatagtttctggactggttggtttccaaatgaaaggcgtgctcccagacaggtgtttgttatctctaggaattagctaaacctgagggggttgtgagaatggatggagatgagggggcaggaggagcagcctctctagtgtcatgaaggctgcaaaaattccagtggcagaatacagaaaataaaagacatggttaatacagaaatggtgtcttattgtggttttgatttgcatttccttgatgactattgatgttgagcatctttttatgtgctatttgtcatttgtacatctttggaagaatgtctgttcatatcctttgtctatttttaaattggattatttgtctttattgttgagttgtaagtgttctttatatattctagatacaagtccccagtcagacatgtgatttgcagatattctgtcctttccataggttgcctttcactctgttgtttctgttgtgacactgaagccttttaaatttgatgtagtctagtttgtctacttttgctatgttgcctgtgcttcattgccaaatccaatgtcatgaactttcctcctgtattttctgtaggagtcttatagtttcaggcctttcatttaggtctttaatccattttgagttaatttttgtatatgtagtgagatagaagttcaagttgattctttcgcatgtggatattcagttgtcttgtaccatttgttacaaagactattctttccccattgaattttcttggcactcttgttgaaaatgaattgaccatagttacaaggatttattgctggactcctaattctattccattgatctgtatgtctgtcctattgccagtaccacttgtcttgattactgcggcttcttgattactgtggctttgtagtaagttttgaaattgggaagtgtgagttttccaactatgttctatttatttatttattttaagagattttggctattctggtgcccttggatttccatgtgaattttaggattagtttgtgaatttctgcaaagaagccagctagaattttgatggggttcgtgttgaatatgtagaccaattaacaatattaagtctttcaattcatgaaatggagtatctttcagttatttaggtcttctttaatttccttcaacaatgcactatagttttcagagtataaattttacacatcttttgttaagtttatttctaaatacagtattttattctttttcatgctattgtaaatgtaaatggaattatttcttttgtttgttttgtttctttctggtctggaattatgtcctttttaaaagtttattttttgatattacttttaaattaaaaagagaaaagggtcttgctatgttgcccagactggtttcaactcctgggctcaagcagtcctcccgcctcagccttccaaagtgctagggttacaggcttgagccaccgcacctggcctggaattatgcattaattttatttttggattgtttattacaaatacatagacatgcagttgggttttttgtattaattttgtatcagcattaggcttttttttttttttttttgagacagagactcactctgtcgcccaggctggagtgcagtggcgcgatctcggctcactgcaacctgtgccctctgagttcaagtgattctcctgcctcagcctcccaggtagctgggattacaggtgcctgccaccactcccagctaattttttgtatttttagtagagacggggtttcactgtcttggccaagctggtcttgaactcctgaccttgtgatccacccaccttgacttcccaaagtgctgggattacaggcgtgagccactgcgccaggcctagcattaggcttttttttttttttacatttttttttcttttttttttttttgagacagggtctcactgtgttgctcaggctggagtgcagtggcaggatcacagctcaagcgatcctcccatctccccctcctgagtagctgggactacaggcatgaaccaccacacctggctaatttttgtattttttgtagagatagggttttggttgcctaggctggtcttgaacttctgggctcaagtgatccaccttggcctcccaaagtgctgggattacaggcgtgagccaccatgcccagccttatttttttattttattttactttacagaatcttatcatcctgcaatccttattaataagaccactcaggggtaaattaagtgctcccttttttctttgaatgtttcattgtcagttagttggtatttaggacttaggtaattttgattttcatatgatctgttagtgctaccactgatgcctctgcccacctggaaaacatgctgtcatggatagatagatgcagcatattataaaaatgcagagagtgtacacaagatgattatgagaccttatgggccaaattggcaatgaagttacttctccctcctgataatatgcaaggcactgtgagtcattatggtaatagggggtgataagaagatgtgcttgctcaaagtgggagatgattggaaatataatcagaaagagagtttttgtgagttatgtaaaccttggccaaaatgtaaactttaagttattctggaaattatttttgcacttattctctttttttttaaaattaatttattttttattgatcattcttgggtgtttctcacagagggggatttggcagggtcacaggacaatagtggagggaaggtcagcagataaacaagtgaacaaaggtctctggttttcctaggcagaggaccctgcggccttccgcagtgtttgtgtccctgggcacttgagattagggagtggtgatgactcttaacgagcatgctgccttcaagcatctgtttaacaaagcacatcttgcaccgcccttaatccatttaaccctgagtggacacagcacatgttgcagagagcacagggttgggggtaaggtcatagatcaacaggatcccaaggcagaagaatttttcttagtacagaacaaaatgaaaagtctcccatgtctacctcctactacacaaacacggcaaccatccgatttctcactcttttccccacctctccccactttctactccacaaaaccgccattgtcatcatggcccgttctcaatgagctgccgggcacacctcccagatggagtggtggccgggcagaggggctcctcacctcccagtaggggcagccgggcagaggcgcccctcacctcccggagggggcggctggcctggcggggggctgacccccccacctccctcctggacggggcggctggcctggcggtgggtgacccccacctccttcctggacggggtggctgccgggcggtgacgctcctcacttgtcagacggggcggcttccgggcggagggtctcctcacttctcagacggggcagccgggcagagacgctcctcacctcccagacggggtcgcggccgggtagaggcgctcctcacatcccagacggggcggcggggcagaggcgctccccacatctcagacgatgggcggccgggcagaggcgctcctcacttcctagatgggatggcggccgggaagaggcgctcctcacttcttagatgggatggcagccgggcagagacgctcctcactttccagactgggcagccaggcagaggggctcctcacgtcccagatgatgggcggccaggcagagacgctcctcacttcccagacggggtggcggccgggcagaggctgcaatctccggcactttgggaggccagggcaggcggctgggaggtggaggttgtagcgagccgagatcacgccactgcactccagcctgggcaacattgagcactgagtgaaccagactccatctgcaatcccggcacctcgggaggccgaggctggcggatcactcgcggttaggagctggagaccagcccggccaacacagcgaaaccccgtctccaccaaaaaaataggaaaaccagtcaggcgtggtggcgcgtgcctgcaatggcaggcactcggcaagctgaggcaggagaatcaggcagggaggttgcagtgagccgagatggcagcaggacagtccagcttcggctcggtatcagagggagaccgtggaaagagagggagagggagaccgtggggagagggagagggagaccatagggagagggggagggggagggagagggagagggagagggcagcgtgtaaccttggtaacttcacttcagcctctgcacttattctcttaaattatcatctgtagtttcaaaactcagaccaccaatgaacagttttttcaactgctctggttcctttggatcatggccctcctctctctggcggtggtggcgacggctggagttgggctgggggtgactgggtggtggttttacctccattttgagactgaactcgcctcttccaactcggagttcagtatccctaattgtattttgataattttagagaactcttcaacatctcccgagagtggttaaagaaagggtaaccttagcggcataaaaaagttaatgatagtcgataaatgcctgacttacaaggtagacgctggggagaatctatttcctgaggagagagatgaaaatatacgacagcccagttttcatgtgcgttttgtgaaggtgtaaggcatgagttttttttttaactttctgtgtgtgttacttattgtttaatatcttatagccaaagaaattaaaagagactgaagaaacaccaagtgaactgtctttccaggactttgagtacccagactatgatgactacagagcagaggctttccttcaccaacagaagaggatggagtgctacagcaaggccaaagaagcttatcggatagggaaaaaaaatgtcgccaccttttatgcccagcaggtaaagtggaaaactgattatatattttttgtcagttataataactaaatactcttgaagcagataagacacccatattgtgactagattaagttattctggggaatgtagtagttatgtaagtgacataaataaggtatcctaagaaatgtatggttctgagaatttcatctcctgctgttttgagcatttgaaatgctcagtttctgtggttgcttttgcatttactgcttatgtgaattacagtttattctgacagtccatatttctggcagcagaatattaatattggccatctgagagtgagattaaaggggttttgtgccttctgtcatgtttgaatttttggtaatatatcactttcatagtacaaaaataacattaattttttttgggaagtaaaatttctacctgggctcatttaacatgatattataaggaacttgctttatttatttatttatttttttaagataaggtcttgctctgttgcccaggctggagtatagtggtgcaatctccgctaactgcagccttgacctcccaggctcaggtgaacctcccacatcagcctcccaaatagctgggactacaggcacgtgccaccaggcccagctaatttttgtatggggtcttaccatgttgtccaggctggtcgtgaactcctgagctcaagcaatcctcccatctcagcctcccaaagtgctgggattacaagtgcaaggtactacttccggccaggaatctgcttaactttttatgtttgtgttgccatatgggttacttctttgtgattgagcagagaagagtatcaaactgctataggcctgtgagccctaacagtagtccttgggggatagcttctggggtaggtaactacaaaatgttgaaggtgaacgccaagatgagacccagcattatcaaaggatacacaaataataaaccagtgattccttcttgagatggtgtattagagttctctagagagacagaccagtaggatatatgaaagataatttattagggggaattggctctcacagtcatagaggtggagaagtcccataataggccagctgtaagctagagaaccaaagaattcgatagcatagcttaaagccaggagtgtagcgcagtcgaagttcaaagcctcagaaccagggatactgactgcagcccccagtccagggtcaaaggctcaagagccaccaagaggcagctggtgcaggttccacagtctaaaagctgaagaatgtggagtctgaattccaaaggcaggaggagaacatctgcctgtttgtcttagccagcctccagctgcccacatggttggtgcctgcccgcatggaggggaggtcttctttctgtccactgacatgcagggcaatcttctctggaaacaccctcacagagacacccagaaacaatgcttcaccagccatctaggtatccctcagtccagtcaaattgatacctaaaattaactgtcacatgtgaggatcgtgtttagttaagtttcccacttttacgacttttggttcagaaaatgttagaaagaatgactcagtagtttaaggactacattattaagtcactgaaatttacctaaattttggtgcattcttatatattaaactcattgcattatttaagattttaggtttattattccctttttcccccttccttttatttggggcactattaacttcctcatcacccaagtagcaaacagcaaaactgtcccttggtgatatgtttatgatttagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaaggtaggactgtggtaatcacaagttttcaatagaatatatgtctttgcttatattggtatagcttgcaaattcaggagagtctgaatatgcaggctgagaatatctgtgtaacatctgtaaatgtttatgttattcattcttcaagagaaccttcttgggaaaggatcctcattggtatgatgattaacattttcttcatttgtattcctgtgctgtatttattaacgggagggcatggtgtaatctgcgaatcctctctgtgacttataaatgagacctttcaggaatattacatatctttgtccaatagacatttattaaacttaattgatatttcttggatttcaatttttcagtagatgcttgataaaatacagaagtaaataaggtgataggattctcccactccagtagtttttttgtttgtttgtttctttttctgagacataatctcactctgttgcccaggctggagtgcagtggtgccatctcggttcactgcaacctctgtctcctgggttcaagccattctcgtgcctcagcctcccgagtagctgggattacaggcgggtgtcaccaagcctagctagtttttgtatttttagtggagacagggttttaccatgttggccaggctggtcttgaactcctggcctcaagcaatccacctgccttggcttcccaaagtgagctactgctcctagcctgaccccagttgtttttaaattgaattttggaaatcttgtagaaaatctagaaaacagtaaagattagaaaagagaaactttaagagccgtttaaattattatttaatccagagagaagaaaactcttcaagtatatagaagtgttatgaaagaatattctttctatagaggatgaattaatagtgttttactcaataaatatttgattatcttctgtattctaggcatcaaggataaggtggtgaaaaagacacacaatccttgtctttattggagtttattgtctagtggggtataccatctagtaggatagataacagtgaaaaaatagttacataagtaattagcattgtgataagaaaatacaagttgtggccgggtgcggtggctcatgcctgtaatcccagcacttcggaggccgaggtgggcggatcacctgaggtctggagttcgagaccagcctggccaacatggtgaaaccccgtctctactaaaaatacaaaaattagccaggcatggtggcatgcacctgtaatcccagccacttgggaggctgaggcagggagaattacttgaaccctggaggcggaggttgcagtgagccaagatcacgccactgccctccagcctgggtgacagagcgagactctttctcaaaaataaataaataaataaataaataaaataaaataaaataagaaaatacaagttgtatttaggataaattctaaaatccctacataatatctcttgcttacctctccagtctcaccctgtgtttttttctccttttctgtatatttaactacactgtcagtcttgacccccatactagttaggccccctgttaataacttctcacagtactcctacctctcacagtgtttataaaaagcttattgtataattggttattaaatacctgtctttttggccaagaattgagccagtgatgatcatgttttttcttcaacactcaaaaaagtttttgaataaatgactaaataatggtagttattactcttatttttttgacaaataagattgtttatattgaaagtatgcaatgtgatgatttgataaatgtacacattgtaaagtgattaccacaatgaagtactttagcacatacatcacctattgttaccattttgtgtgtgggggatgagaacacctatgacttactctcatagcaaatttcaagtatatgatatagtgctattaaatattattaccatgctacacattagctcagcagaatgtattctttttaagcttgtaccctttgaccagcatttcatttcctcctctctattctggcccctggcaactaccattctattatgtttctatgtgtttggctttttttttttttttttttttccccaggtaatgtttttatttttatttttttattttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccacgtctacttctttctacacagacacagcgaccatccgatttctcaatcttttcccccaccttttccccttttctattccacaaaaccgccattgtcatcatggcacgttctcaatgagctgttgggtacacctcccagacggggtggtggccgggcagaggggctcctcacttcccagaaggggcggccgggcagaggcgccccccacctcccggacggggcggctggccgggcagaggcgccccccacctccctcccggacatggcggctggccgggtgggggctgacccccccacctccctcccggacggggcggctggccgggcgggggctgaccccccacctccctcccagacggggcggctggccgggtgggggctgaccccccacctccctcccagacggggcggctggccctcacttcccagacggggtggctgccgggcggaggggcttctcacttctcagatggggcggctgctgggcggaggggctcctcacttctcagacggggcagccaggcagagacgctcctcacctcccagacggggtcgcggccaggcagaggcgctcctcacatcccagacggggcggcggggcagaggcgctccccacatttcagacgatgggcggccgggcagagacgctcctcacttcctagatgggatggcagccgggaagaggcgctcctcacttcccagactgggcagccaggcagaggggctcctcacatcccagacggggtggcggccgggcagaggctgcaatctccggcactttgggaggccagggcaggcggctgggaggtggaggttgtagcgagccgagatcacgccactgcattccagcctgggcaccaatgagcactgagtgaacgagactccgtctgcaatcccggcacctcgggaggccgaggctggcagatcactcgcggttaggagctggagagcagcctggccaatacagcgaaaccctgtctccaccaaaaaaataagaaaaccagtcacgcatggcggcgcgcgcctgcaatcgcaggcactgggcaggcggaggcaggagaatcaggcagggaggttgcagtgagccgagatggcagcagtacagtccagcttcggctcggcatcagagggagaccgtggaaagagagggagagggagactgtggggagagggagagggggagggggagggggagagggagttcggcttttttaggttccacatgtaagtgagatcatacaggatttgtctttctgtgtctggcttatttcacttagtataatgccctccagccacatctgtattgttgcaaatggcaggattttccccttttaaaaaatttttaattaaatttttatttttatttaaaagaaataggaggtctcagtgtgttgcttagactggtctcgaacttctgggctcaagtgatcctcccaccttggccttccaaagtgctgagattgcagatgtgagccaccatgcctggcctgagccactgtgcctggtcccctttttattgttgaataatattccattgtgtctatatcacatttttttatcaatttatccatcgatggacaattaggttgtttcacccagcctggatgacagagtgagactctctaagaaaaaaaaaattgaaaaatcgaaaaacagaaaaatgaaatggaaagtaatcagtattgttaaggatgtggataaattggagccctcatatattgctagtgtagccactgtgaaaaatttcactagttctttgaaaggttaaacatataattaaccgtatgacccagtaattctgcccctaactatgtacccaagagaaataaaaacacaatatgtctttacggaaacttgcatatgaatgtctgcaacagccaaaaggtggtggtaacctaaaagttcattaactgatgaatagagaaacaaaatgtggtaaatctatacaatgaaatttaatttagccatgtagagaaatggcggaccttgtaaacattattctttgtgaaagatgaaggcagataaaaagccatatgttgtatgatttcatttttaccaaatgttctgagtatgtaaatctagagagacaaaaatttgattagtggttgctgggactggaatggcaagaatatgagcagtgactgctatgaggcacagaatttctttgtgaaatgatggaatgttctggaattagtggtggtggttgcacaacatgatgaatatgctaaaaaccgcttaattgcatattttaaaatggttagttttatgttaattttatctcaattaaaaaaattgtaagaagagaaaaagaggccaggctcagtggctcatgcctgtaatcccagcactttgggaggccgaggctggcggatcacgaggtcaggagatcaagaccatcctggctaacacagtgaaaccccgtctctactaaaaatacaaaaaaaaattagctgggcatggtggcgggcacctgtagtcccagctacttgggaggctgaggcaggagaatggtgtgaaccagggaggcgaagcttgcaatgagccgagatcgagccactgcactccagcctgggtgacagagcgagactccatctcaaaaagaaaaaaaaaaaaaaaagaaagaaaagaaaaaagagctaagtaatttgcccaaggtaatacttggtcaagatccaagatgcagatcttttctggaagccaaggcccatctctagtgcatgctgccacctgtggtagtctgtagttactgtcagtcaccaccaggtggcagtattgttgaatagaaatgaatccagtggaagatttgtggctctgacctgcattgccttttgacataagattaaggagtgttaaaatcggagatgaattttttaaaaaagagagacatctggaccttatgtcccttctggttgaaatatacactgctacgtacgaatcatttttgcctccaaatcaaactaggagcagatcaaacctttagaactgactaccattttatagggatttacaggggacagaggaacatgttaaacaacaccatggggatacagtcagcaaaattcagattgtgaaaatctaggataggctgggtgtgatggctcatgcctgtaattccagcactttggaaggccgaggcagtcagatcacttgaggtcaggagtttgagaccagcctggccaacatggtgaaaccacgtctccactaataatatacaaaaatattagctgggcatgatgtctcaggcctgtaatcccagccactctggaaactgaggcagaagaatcgcttgaacccaggagtcagaggctgcagtgaaccgagatcatcccactgcacttcaacctgggcaacagagtgagactctgtctcagggggaaaaaaaaaaaagaggaagtctaggataaatgatccaatttttttcaataaattgtaaagaaaaacaccaggggaggggaaaccttgttacttaagaaatatatcaatcaaatagaatgtatagacttatttcaatcttgatgccaacaaattactgtaaaaacatatttttgagataattgggggaaattttggaaactaatgatattaagggacttttattaattttataagatatgatggtgccattgtagttatgctttttaaaggagtccttatcttttatgaggtatgtactgaaatatttgcagttgaagtatctggagtgtgctgaaaaatgagttaaacagtcctttctaaggcgttaaacagcaagaacagcctgtatttgggaaacgaaacatatacattacttcatgcaacaaacatcctttgaactcttacttgaggcatgtgaatcaactagagaatattttcagagcaataagtgaactattagcaggtgataatcgtataaatgactgacctaagtgataaggggagccatagtgaagagtgtgagttatgattagagatttagttgggctttttttgtaagtaaactttttctttttgagatgggagtctggctctgttgcccaggctggcagttggttgtgaccttggttcactgcaccctccacctcccaggtgcaacccatcctcctacctcagcttcccaagtagctgggactacaggtgcgcctcgccatgccctgctaatttttgtattttcagtagagatggggttttgccgtgttgcccaggctggtcttgaactcctgagctcaagtggtccaccttccttagcctcccaaagtgctgagattacaggcatgagccactgtccctggccaatgtaaaacttttatgcgtaatataacatatgtaaagaacagtgcccaaaattataggtatatagtgcaaaaactttgtaaaaagttcgtaaaaaggttttacactatatacctagaattttgtgcactgtgaatacctttgtgaagctagcactcagttgaattttgagcaacatattgcttgaagtaatggatgtggattagagatggagatcatagacaaggaattagaaatgcaagagcaacatattcttttaaaattccaggctgaatatcatcttggagatatgatacttgaaaaaccatttgtttgtattctattaggagtattaggacaatttaataagcagaccgtggaatgtttatattttgtgtgttttaaatttattaattcatctcattaatagtttttttgttgtttttgttattctgctacagcttttattagttttcaggatttatatccttgattttcacaaggtcatttccaaaatggaacttcagtattttaggaggctcagactcctttgatgttttaagaactatctatcaggaaaagtttgttaacaattgattatctttaatagtaagactgcaatccagctgtgactagtggatttgctaatagctattactggaagataatctataaactagttgctatcattatccctttttcctgatgagaaaataggcacaaaagaagctaagtaacttgtccatggtcacacagtcatttagtggcagagctatgattcagaacaaagcttgatggctttagaatatttaattaacagggttgttgtgaagattcttagttaataaatataagccacttaaagcagtacttgactccttttgtatagtaattgttaggtatcattaatggtattattgccattatcattatttcagggagaacttctggtagtgcacagaaatctcttcccccataaaggaagaagtcccaccaaatcttttgatggatagattacaatgaggctatgtgttttaaaacatacatcttaaaacattaatttgggggctttttgagatagcaaatctgtcttactattacagttttgagatggcaaaccccaaaatcctcatgaaaacaatttcatgtgcttgagtagctaaggtttacgttttctattgagaatgtaagataaatgaattttaactcccctgatttctgttgtaacagaatttaagcagaacggtgggaagccctatttgtctgtgattacggggagaggaaaccacagccagggaggagttgctcgcatcaaaccagctgtcattaagtacctcataagccatagcttcaggtgagtgtagatttctgttattaataatggcaactgcccatatagatctttatcagatatttctgtgagtatagatttctgttattgataatagcaatagccctaatatagctaggtaaataaacactaatagcgtactcagaacaatctgttaaaatagttaactaaatttaatcatctgatttcagccacagattcatgcttaaattatgatataactttccctgctggatttatgttgtctggtaaaccagaaataaggaaaaatgtgtttgttgccaataatcatctgataaaactttctatcataaatttaaagttctaaaagaaagtaaatatatttgtttctttgataatatgcaaaataattaggtaatatgtatcatactttaagatttgctattattcttttgaaaggaaatcagtatttgtggattttggatggaattgggtggcttctattgaaatatagttataatttaggtacgtttaaactttagcagaaatgttcagttaatatgaatttatttgtgttttcataagttaaatgccattaatgacctgtgttgacaaacatgaaatgttctttttcattaagtgataattatttaataacagaaaatgacaagaaagtcaaagatgaaatatctgttgatggatagatttcctgcagatgtgtatcattaactcctacccaccaatttcagtgtagcatatttattttatgccatgtaataagatgttatttggctacattatcgaaaatgatagcataagttatgagcataaaacaggtgacatcagggttatttttataaaaggagtagttagaccagaacattatgttgagattaattatctattttagagactagtcttcctttaaattctctccggatagagttgaaagcattgcatggccagattaatcagacttacctgatatatcagagatttcttcttggtgctttcatgatgcaccaaggactttattcttcctacagcatactctttttcataaaggtaaaattcaggcctcacaggttttgacaaatcttaagttatactaagtcaagagcaacctccagctttaagattgtatttgttttgaccgtagataaaaggaacacaaacctagatgttggtcttggatattgacttaataagggtcaatactttggtagtaaatattatattaagcgtaggtacttggaattgattacaaggtatattccttagctaatttgaaattttcatctttaaaataactcttttctcatttctgcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaaaaaaaaaaaagaaaaaaaagagaaaatattttggttataatcataagaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataatgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccaca

SEQ ID NO: 1677 - DNA, 568337 bp, Homo sapiens
ctgtatcaaggaaatggacattttattgaaaggaaaagaagggtgggtaattactaagtacagagcaatgtgtcgtggaacagcaagcttggggatggtgccattggagagtttgggatagcatgactggacatttgagggtttggagaaaatagtatttggtgtgtgaatagagaagaaaaggagggagaacattcccaaactgcctttcaaagatagtgagttggtagagttagtctttaatcccggaagaaggaagaaatttccttgtttgttatcttagccctagggcccagaaaatgagccaaaacaatgctaaatagtaactgtagattaaatagatttttaaggctagtctaggtacctaacgaccacttattacaccatgggagaacgaatctggaggtccaagttgtttcatttctaaagtttcagaataaacgttttcataaatgcagggatacctccacttattctgcattaactgccttcatttaaaaattacttattaataaatgcagtagcacaatctgccaatatgttttgggaaatatcacaaaaataattcatagagaacttacgcaacataatacaattatctctcaaaccctagcaagaaaatattttgagagaaccactaataatgtgaattactagttaatattactaacattactaattattagttaacattgattactaatattaactaataatatatgaaatatatatttcctctgctatggaaatatgctgtcatagtaattcttttaacaatgtatgtgcctattaggtacaaagaacagtcagtgttactatcttttactcatttgattaaaaacaaaatattacaaacaaaacaaacaaaaaactcaagaaacaaaaacacagagtcagatagttgggatgtttgaaacactgcaaacctcttttactgcatttgctctatataagtctaataaatacagaagtagttatgagcaaatagatttttattgcctgcaagctgttatactggagcaggagaatatggtatcttgacggaagcacacttgctaccccacacctggggattacttatagttgaaagaagaaatgttgagaatggaacaaagacacaaacccattggataatctagtctatatttgggtttggcaatcctttcatcccaggaatatacctgtagaccaattcaaagtactaagaaccaagattaaagattttatacacatcacaataatagcaaattaagtacaaaacgaacctggcacataaattataatttgtaaggtacacaccattttaacaaggatacgacagtgttggtgcagtggtccgaactgacttctcacaatgctgcattatgagaaatatgtatctcgctttacacagaaaacatcattttgatgtgattacagaaaaatgctcaaatcttctttaaaaaaaaaagttcatgttctgatcacaagcagagccaaggttcatttttaggtcaaactacacaaaagaggatgctcttctccaaaaaaacaaacaaacaaacaaacaaaaaaaggaaacaaaaaaaccccaaaatcttggcatttccccttttactctacattcaggcttactttttaaagaaatacaagcatttttatttggccaaaacaaacaatgaatgtaattacaaggacaaggttaaaaaaataaaaaacaatgtcgatcaaggtcttccttccttctgcaaagctgtgtgatatcagccttcttcttcttcgtcactgtctttcatagtaatgccctgaagtcctcctccttctgaaacagaggctgtggcctcctctactgttaaacgtctgtgcacagtatcataagtcttactgttcagtgttccttccaacacaccctgcaatcgaaagtccctgtaggttttctgaagaaagaagataaaatttgcttagctcacttagattatatgcgtgtacatagatatatactcagttggcatttcaaaaatgatcttggggaatccactgataggttcatgtggctgtccatgccaatcatcttcttggtgtatttctggggagtaaatggaatgacagactctggctattgcttcaaactacaattactatgactacatcaaaatgttgttactatcagatgacaaattcactttcccctcagaacattactaattgcacacaatttaccttttgaacaacctgtagcaaaaataaaatatgtacctgtgtaagtttttaataagaaattattagtttttttaattgagggggctttcctttaatactgaaaaatacattatattttataaaatgcattaattttgaggggtcagttgtgtggaggaagaagattaatcctattatcggtaaaagaagttcacattttcagcatttcagtgaattataaaatttatttacatgtaccactggataaaaatttgtgtacatctaaatgtctggatgaattttgcccttttcttttgaaattcccttgggatgtgaagtgccaaattctgacataaagcttccatagatgggacagcaaaacaagtatttacattttttcttaaaagaatacattaaaatttgctgtattatgtatcaaaaatagagtaccatgttattgtttgtacaatgattttcaagacaacaaaatccaacaatatttttctgtggcacttaaaatattaatctataatgtttcccttatgtttacattgattgattgattgactgattgattgactgattgagacaggtctcactctcttacccaggctggagtacagcggtgtgatcattgcttactgcagcctcgacctcccaggctgaagcaatcctgccaccttagcctcctgaggagctgggaccacaggtgtgtgctactgcgctcggctaacttttaaatttttttgtagagacaaggtcttgccatgtagcataggcttgtcttgaacccctggcctcaaatgatcctcacatctcagcctcccaaagtgccgggactacaggcctgagccactgtgcctggccatgtttacttttttcttttcttttttttgtttttattttgacatggagtatcactgtgtcatccaggctggagtgcagtggcacaatcttggctcacagcagccttcgcctccccagttcaagtgattctcccacctcagcctcccgagtagctgggattacaggcacatgccaccatgcccagctaatttttgtgtttttggggtttcactctatcggccagactgatctcaaactcctgaactcaggtgatccgcccaccccagcctcccaaagtgctggcattacaggcgtgagccacagcactcagccatgttcactttttaaagtgtaatcttcttcacatataattttctgcagctaaacatgactggtattttattactactgatttttaaagtaggagaaaaagttcagttagttaaatggggaaacaacaaatgaagatatttcattttgtgggatatgattttgtcataataagctcattctaagtcataagttattatgactaaggtagtactctcttacaccaaaactcactgtaatttgcatcagaaccagtgagataattctgaaaggtatgttttgtctagataatctggaaactgataaacatggcattattaccacaaagatttgtgtttattcctataactctcttgtaattaaacatgtcaaacataaagtattcacctacagatgatgcatctaatgtaaagtattattgttccactaacaattatatactgagtttttgagttcaactttcttattttattggaatgactttcctttgacttagcttaattaccagtaagttggccagagcagatttgaattgtggatctgcagtcctgaaggctttctaatttatatataattaagaccgctttcttattcaattagcaagcaataaccagttgggtgagatactaggcagctagccttgcaatctctttctctgtctttagaattcataaaatgttattgacacttggatgttccctgtggcttccacaaaggtttggttggctcttgcttaagacaagtgcctgccacagagttctgttcactttttctctcctagcaaaagaagcaggtgatttatgttaactgcatttaatgtcatgtggccactatggagaacacaaacacaaccattttgactatttgagggtttcacttttcccctcccccaaaaaatcattctaaggtaaaaactttgcaaataatttcagtctttaattttttgtgtaaccctttctgggatttgtttttttcttagtgtgcaacatgaatgaaccaattggtgtataagtgtctttgtttagggtaaagttggctattacataaattttgatggcatctaggtctccatgggcatagaagaatggcaatccctgtgagtagtaaggacaagactactaacagcaagtagtttgggtcctgggtagaatacactactctgctgaaccatgcaggccaagtctaagtgacctggatggaaggaaagtctggttatgggccttcacaattctctacatgtgttattcaacagcttcttaaattcactgggaaatgatcattataagcaaaaccatgtaagttctgaagaataatgaatctatgtatgaaattggctaaaagtctgtttatattcaaagtagaaaaaacaattagaacattaaattattaattcactttgagttttattgtgaaaataattatttctaattattaaatagagccctatgacttgattaaatgtatcagcccaagaacacattggctaagcctggagacttgcctgtgaaaagtaaaacatggaaaatcaacatattcatgaaaattaatttcatatttattggtcaaatattgatcattaggaagaatatattaaagaagatatactgacttacagtaaaatggaaatgtcactatataattaataaaattattgttcttttatgctaaaatattcactagtgagaatacttaagatctactctcttagcaaatttcaagtatacattaataagtcacactgtatatcttgagtatataaaaatttttacttttaaattatacctcaataaaatgaaaaaatttcactcttgcttaatctttaactataaagatgtgtggaaatgaggaataactttgaaagaaacaaatcatgggctaatgtggagattgttattctcaaaacaaagagcttaataatctatcagctaacaccaggaggctgaatatgtaacttctgaaatcttgaacacagtaggcattagcttgaaaatatggtttatcataaggataaacagctaattgtaatattaatcactgcataaagtacaactgttatgtatgtgtatatatatgcatattatatacatatgtatattttatatatatatatatatatatatatatatatatatatatatatatatatggcaaatacattatcctgactctcttttctgaagaacaaacttcatttgaaagctcttcaagtcacatttatagaaacaagaaacaatggagaactaagccaattatgaacctatcatattgtcctttcagtttctttgtaaaataaataacaccatataagaagtgttctggatcaaaattattttctccattgacatgtaatgtgtagctatagtattaaaattttgtgagtggctataattttacttgttatttatgagtaatcataattgctattattgtggcattttaggtctggttctactttccagtagatttgccaatttctgactttggaacagaactttcctatttgtgggcctaacaagatcaacaagcaggcataaaaataatttgtattctaattagactgtaggaaccaaaggaataaagaaaatattttaatgtggctagaaacatcttttaatgatgtaacacagtgggtctttgaaaactttagcatgttttcatgtattagaaccatctggaggacttgttaatctatagattactgggttccaccctcggaatttctgattcagtaggtctggggtggggcccaagaatttgtggttctaacaagttcccaggtgatgatgatagtggtaggtgaggaatgacactttgcaaactactgtgtatactcatatatacacacattatgtgtgtgggtacatacacacatatatactactaataaatggtactataatgaaagtaaaggtcttttgtttaaataaataggtgattctcaatagcttagagttatgttttctgccataaggtgaaatttctgtcccaattttaagaaaaggttaaacttggggtaaattttgtacttacattagaatttacaaagtgtgaaaaattatgcataatatattattttatagatcttactcactaaatatgacatgtaatttattagcttttctcttcaagagctaaagtcaaaatggccttgccgaacttatgtgatgtctatgtcagtagttttgggtggtctccaacactcaaactgattaccttttacatataagaggcatgcttccaaaaggatttgggcaatgacaatgtattactttcgtaccagcatataataaaataactgagactctccttattcttctggcaaatatagtacaaaagccctcacaatgatatatgatcctaataaatatgaagtaattgtattatgataaaacattcatatgcttaagaaaattaatgtaaaattattgtgaacctacttccttcaggtaactgtgctggggctttatgtatttaatctcaaactgtgagtatttgctagcaaattttttttattagtgcaaaaaagataaatttatattcatttattaatctaactaaacgtggaagtaaacagtagcacatcattgctaataagtgatactttttagttacatcaaatacagttttcttgtatgtcagtatcttgccattattccttatagcttagtgggcaattcatatctaaacacattttgtttaccttcacaatcttgatgagcgtcttcagctggtaaatatggagttggaggtctaatctatcagtcaaccacacgcaaatgactttcatggaactgctgtaccattgctagaagggagaattggggcacaggggaggagaacaaaaaaagaaaacaacctctgcagtattcatttaacagattcgataatgagggggtaataaaacactctgaaatgaccacagatcagcacttgaagtcaataatgctataatttcctgttaacagaattgtatgctttgctagaaaatctgttaagttgacctaggctgttctttaaatgaattaacgttacagtctttcagctgtaacatattcacggaaacagtgtttttgcactttgcagcctagtggcctgctttgtaatttgtaaataacaaaggatcctaaatacatgttataggactgaatggacagccaagcagcaggaaaaaagaggtaaattattttcaaaggaaaattttctattagcctgcatgttacataaaaatcaaaaagaagatgtgttatgctataagtcatgtagtcaatacctaaaattacattttaaagtagcgatggcaaaaaaaaaaaaaaaatctacaacttaaacagtaatcctcaatcacacctttatcaattaaatatttaccaagctcttttaaaaccatctaaaataaagatttattgagatcttaggaagaaacattatcaagattgaatttttgtaagaatcacaaaataggtgtcagttgatcaaattatgaatgaaaaggatgtgtttcattttgtatttttggagggtccataatttttctgtttattacaactctcttaagagaaaaactgaaattcttctttaatgcaattttctgctcctatatgtctgtcagtctagtaaaagaaaatattgttcctgttttcaaaaaaagacaatctgccattacaaataacatttttaagggacacagtgattcagagctaggtttagataacactctaagaataatgctactcattcagataaaagtgagaaatatcaatgtccactcagcatttagaaaatgacaaaagagttttgaaagacaggagattttgtgccttgcttgtatacacaaacataatgacagtccagatcacatatgtgtgtgcatacgttctaaagaatttaaacaccgaaaaaaaattagaaaaaaaattttctctacataataaaaccataaattcaacttctaaaataaattttcactgatccaagtctgaaattcatctggatttatatttattaacattgatccaatacaatttagtttaacaagaaatggtattttaagtataaattaaaaatgaattttacattttaccatgcttatttccattaatttgttagtataatgaacatatatgcatcaaatgagataagctaatttaaatggataactgatatactaaataatagcaatcaaatggataaataaaagcttcaagttttaaaaatgtgagatggaccatgattttttaaaaatatgttattcctgtatctaattttgctccttcctaatgagcactttcctaatattcaggacatgtaaaaatttcagcagttctataaaacaagacagtcatactccaaaatccttaaaaaagtaaacttccagtaaattcaatactttaactggcacgttaaatctcaaaatcttttatagatactttaatttccgacactaaattctatgctacttatttcaaataatttacagcttcaacttcttgatttctattttaatacaggcactcactcacaagtattggtgatattgaatatgagtacagtcaattgaggcccttctaccacaccacactctagataatttgaaagtgaaaatattgtcataatggatgtgactcttaaaaattacagttattttgcaagggatagtaaatatttctttcttgttgaaggagagaaactatatatattttacgaagcctaacataacatactggttactctgttagactgcacagttactgtaacttggtaagttgtataaatttgagggaaatgaaaaaactttcttaaaattactctatatgcatctttatgttcttgaaaatccttatataatttaaaattaacttcatttttccattatatataaaatggtacttataattaagtgataattgaaaagacatataatgtaacacagaaatcatttatatataacttatttaatacaatgccaaaataataattttagagaaaaataatcttagagaaaaagaatttgggaataaaatgatctaaagttaactgcaaaaacagaaaaagagaactattattaagtaaaatgtttaagctatttatcatcatcttactttgaaggacaataaattgttctatcagcaaaagcttctaagaaaaaaattattctatcaaataagaaaaaattattctatcaaataagaacgtatattttggctcctaagtcaaagcattttcaagacacacttcaaattaagcaaatgattaaggaaaagcagcaacttagctcagaatatttgctgccactaagaatagcctaacaacaacaaaaatcccattatgactgctttcttgtatacagtaaaatgcagacacacacacacacacacacacacacacgcacgcacacaccttaaacaaacaatgaaagccaccagacagaaacctctagcactttcttatttctagtgctgggattaatacgtcctccttttgagtactgaatatggtaggtcccattttctcacactgagaaaaaagtcaaagataggttctctccattccccaatcccctccaccaaaccaaaccaaacaaaaaattggaaaagggtgaatgtgcagtaaagtctccatgttagaaagtgccttttcactttggaaaagttaattttataaaacaacttggttgaccattcacttttctccacaggggatgaaaaggaaggggtgccgcagcttgcacagaaggtatgggaatggcattactgctttattctttgccttggtctacacaggaataaagcagtaagtgtatattttacaaattttttctacatcaatccatgacagcagcctaccactttagcaaaaatatgtttttttcttctttttgtggttcattcaactcctgtaagggcatgcgttactcactgcattttcttgagatatctcttttaaagcaaaaatagaagaaagggaaaggctagggttgactctgtgagacccctgtatttattcacacttattgtgcatgactgtagactggtaaatcatattagcagcccgcctccccatcaagctgctacttgctttccagccctgggaaggttcaacaaatcaacaggagcacggaaaacagaacatcagtctaatctagtgtttaaggtgaggttttcaaacccaatctaagaagatctttagagcaagcaacaagctgaagggctcagaaggtggtattgacaatgaaagagtgttgaaatattgagaagcgcagcacttgtgcatttttaataacaagagggtcaacaaggacacagctccctcagtgccaggagttgccactgactatggaaattgccacaccagggctataaacgcttgcagttcatcagctttcttaaacagttcatcagctttcttaaacaccctgaaccccctcagtggacctttagtcttgaattaacaaaccaaagcaatgaaagagggtgcagtctgaatggctggcattgatccccaactgtgtcagcactgctacaggccctgaaaaactctttccattgtcaatagaaattgacaaacctcatctcctaaatagtgcagctgagccgggcgggatccacgcagctgtaaagggctctgctcttggggccggggagcactaacaatagaacaagcatgagctctttgtcagtcccagactcggcaattttctaacaaggattaaagttgtttctccgcagagctggtgaaaagagatttagcaacataccgtgctttcttcatgcaagttaaagagaagtagttaaggaatttcattattctgttaactagtggaaatacaaaacaaatatattaaatatgcacaactctcctttttacctaatttataacattttgaggatgattcaattaaatataacacgtattgcctggaaacaagcacttcacctttattttggaagttttatttttaaaaagtccagctgcttgccacctggaatgaggtctcaatacatactaatgcacaatgcctttagaccctccaaggctgatattcctaaatctgaatcacaagaccacatagggtttatatatcacggctgcttcaagcaaatgatttttgtcagaatgcggcttctgatgatgatggcaaggtaaaaatagctgcttcgctagggcacaaatctgtgatatattttctacttaagtgtttagctttttattgattatgaattggtacaactagttgatgtatttttattcttctccagctatgcttgtctcaataggtgacaaagaaaaggaaagaaaaagaaccaacactttttagtgaattaagacctgaaatggctaagtttccagattatgtatttcttcatttatttcaaaagaatctgtatgtttggcaagagttgagtcattgtgttaaaatgaaataacgccaagaaaatctcaccttaggaaatatgtaccttttaaatataaagttaaatgaaagaacaaacaatatttgttaaatgaggaaggcttggataaatttgataaatataagccattcttcaggatcatttagtaaagagcaacaaaatatttagaaacattaatgcactacaatttcaccagtatatttctatttaatgcaactaaatttgtggctctgtttcactcatttcccatgtctaaacactaaaacgcaaatgttatattaatggtaaatttaatataataatgtcaaggtttttctaccctgttcaaggcaccccactgaaactatcatacctgggttccataaaaccagacccccaggcacaagcattttgcaagttctgagtgtgaatattttcctggcttggaataggagtaagggctatatttaaggacaagtgaaaccagcctattaggtttaaaaatacaggaagtgtttaacccaacctatgccaatcaacattcccagctcaatccagaggcactcatggtgggggaagagaagagacttgcatctggacatggcagccgtgggctggttgtcaacacaccagggaagaacacaaatgcagaccccgtgagggtgggcagtgctagccccatttatgctactatttgctggattgagtctgttacgcaccttctctatgcctcagctttctcatctgtaatatgtggggtagattatatgaatctatctttaaaatactaagatttgaatgctctatagaaatactgtgagtttaaatttgacttacaggaaaaggcatgatgagcttgtgattcttgtaaaaatgaatggaagagaaaaacccagttgtcattctgtttttatatgttgcttcaatacagctttattcttccagaataaagaaaaatcatctagagttccagaactttctattgtctgttattttttttttaacttattcatctggcctcttaatgtatagacataaaaatgaaacaataaagtatactgaggaatgagatttataaagaactgtgaattacagatactgtttttattagtattatttttatgaattctaattataaaggcatctgatatttattttatccttcataagaagttcaagtgattcagttaaaatttcatttaggccagtgcctgtaatcccagcactttgggaggcagaggtgggtggatcacttgaggccaggagttggagaccagcctggccaacatggtgaaacctcatctctactgaaaatacaaaaaattagttgggtgctgtgacgtgtgcctgtaatcccagctacttgggaagctgaggcatgagaatcacttgaacctgggaggtggaggttgcagtgagctgagatcacgccactgcactcctgcctggttgatacaaggagactctgtctcaaaaaacaaaacaaaacaaaaaaacaaacaaataattcatttaatgcttatgataactttgatgaagtgggtgtaattattcccattttgcatatctggaaaccgagtttacagaggcacaaaactgagtttagattaagcaatttacttattcaagtttatacaatgagtatgacttaagtggtagggtaaagatttatatcttatatttatactccagagtctgtgctcataactcctgtgttatttcacttctctatagaaggacatctggatttctgttttgtcaataacacctttgatgcttaagagtagttcggtgcttctagcagaagaaaactaggaaaagtgtcattagcatttgtggtccttactgacagtcactgcaacataggattatgcacaaatagagaaggtacctattaattatttccaaaaaagcccattcaattttttttgcaggttgaagcaatccacatttctaaaggttaaatgtatctgtaaatccaataacgtaatatacaatgtaaataaattctttgaagaatcacactccctattaggataaccagtcaaatggctattaggttatacatctcatatactctcttaagactcattttaaagtgctatataccataatgattaaaaacactggaaaatatttgttctactgtagtaaaacaatgtaatgtggaaagacgatccttggttcttccatagtagaactctatatatgtgactttcttcatcatcttttttttttttttttcaatcagaacagagaagcatgtgattcatgctgcttttttccatgttgaataaagtcatattcagggcaattttcattttttaactccatcaggcagtttgtaaattaagagtatcatgtctattaaggaatgaaaagtgtaaaaagtgctaacattgggaaggttggtataaaataggcacctaataaatgcttgttgaatgctgaaaaactttcctatctttggcattccatacttcatcttttaaaaaatacatgaatataataacagatatttccagatgaattagatcctcttcagttacataacacaataagttcgaaaacaggacaagttctgtaaattgggagctgcacaagctctttccagttcactactactttcaaaatacccttcattccaaaatgtcctcaaagagataaactacctctttcttcaaactacatgaaaaatatttaaaaaataatgttctttattatcaaataagcaagtgcctctgcaagtttattctgtggctcctttcctagcactaaaaagactagtaattggaaagtgaaaatttcagacaatcagttgttctgccctccctttcttagtgtccttgatgggatgcatactggtttgcctaatcttttgagtgaagtcaccagttaatggtttggctcattgataaatccagttataatggtgtatgtactagtttggggtgcaaacatcacctttatgaatgattcgtttaggcaatatgaaattttcatctggttgacttattttgaacatagtatataaaattctggtaaatattgctttttaaatccataatgtaggatttatataaaagtatattggactcttggaactgctattaaatggtacaacttagtcttgagatgaaactcatgcctgagaatgagctgttagcatgtctttctgcttcagtttccttataaaaatgggacacattccaaaatcttcttttaagagtgtcctaaggacgggagtagacagctacctttctgtctctgagtcacggtgcagtcccccaggaacctttttcagcaaactgacccacctgcagctctgccacatgctaggcttctctataccttcggtctctgggcatgcccattcctctgtgtggactttattcccaactacatctccctgtccagattcatgtcagcctttaagactcagctcaatcattcattatctctgcttcttagccaatactatctcttactaggtacaattaggggctcacctattttctcctcctagaactctatacaggtgtctataaaaatattgcacaatgtagttcatgtctccctcaatcagctgtgagtatacacaaggctttaactgaatcttacttgtattgctatctccagcccttagtagaatgtctggcacagagcatgcattcaattttcatgaaaagactgcatgcatttaaatatttataaatataaatttatatatatatatatcatatctataatagcagacaggcagcttttcaatagacaaaggacagatgaataccagagccagattcactgttgacttgaatcacatatttccttaacagaaaaataattaaatacacgttaaagctgtagaaatcattgaaaagtaaacagttgcatttggccaaaaaaatttaagacaggactcaaatggggcttaaaatgtgacagtctaattttattttaggtgatgaatgaaataaaagagaaagtactataaattgataaactttcatatctatgtacatatatgagaatacacacacacacacactcactcacaaagctatgctaacactatgagttcagatgttgatgtactcagccctccagaggctgtcccccaagcagggagctgcctctctagcatatgctcaggtctattggtacccactctgaggccatggggtgtattaggaggcatggctggatgtgctgcctgtgcattttcaccactaagtgacatgtcctgggtgcgttctacacttgttggcttcgttgagctgtttttaaagaaaggcagaaaaatattgttgctgtggaaatagtgagttctgtctgtagggatataagagcttgtttgggagctgatataagcctggcttttgagctaagaacccaggaagaacagagagcaagagtgtgctcttatctcacagtcacgtcatttgatgcaggtgctagaactggatacaaactttgtgttggctctaaacctttagcaagtttacagtcatccacttgaagcagagggagaaataaataaacaatttaatagattaattattagtatctattttgaaacagtattgactttcagttcaccagagtacttccatttaaaaaaaaatctgtggatagctattctgcagataaaaaagtaaaacattttatgtggaaataaaaatttttcaaaaatacccatttggtaagctcccttggggcaaggacttggtctatcttgtttaatactgtattcccagcctctagcaaagtgtgtggtctaaaaagtctttgataaatataggttcaattaataaataattaataagaggggtttcaactttctattctcactagattcctattgagtaattgtgacatagatagccatctctatgggcaaagccaagacctgaagttttaatctcaacatttcccaccattttttacacatagtaattgaatgagtttgttttctagatcttctaatgtaaaacaccaatgaaatggatattctacatgaataaacatgtacttttactgcctcaaaaataaatattctacatcattaaacttatacatttattgcctatctttttttgagatggagtctcgctctgtcacccaggctggagtgcagtgacacaatcttggctcactgcaacctccacctcccgggatcaagtgattctcctgcctcagcctcccgagtagctgggatacaggcatgtgccaccacacccggctactttttgtatttttaatagagatggagtttcaccatgttgaaagttcacatgttggccaggctggtctcaaactcctgacctcagattaatgcctatctttaagttatgtagccagtgagagaaaaagtcaacaaaaacaaatatagggaatatatggaactatagaggtcagtagagcaaaagtatgggaaagttatatattagaatgaataaatagaaggcttgaaagaatcttgttcagccacgttcaaatactgcatcctatccttgactctaaaccctaagcatgacagagaacactttgagaagtttcaaaggacagccacaaagatgattaaagggctagaaaaaaaggcctacaaagtgcagttaaacaaatagggattatttatcctggagtagacaagtatgacaggtaccttaataacagtcttcatatttaggagggattattccttagaggatgctggctacctgccttttgttctccaatgagagaaaaaagagaaatgggtttaaaaatcagcatgaagaatgtaggtgaggtacgggtgagaactattttttcccctccagtgaaatattttgtccatattaagacagcaaaatttagatgatgtgttatctagggctgtgctaagatcaagaaattcagggttctctcttacaggttaggtgtttatatgaaagcttaaaattattttatatatagtttcctgccaatgcattcaataatcacatgtaatgatagttctgctggttccttacacagattttttttcttggatttagccaacactggtgacctggctgccactgctgtgcccacttgtgaatggtctgaccttgcagaaggcgtgattcacagagggggagtacaaaaggccagcacagaaaatggctttaaagccaccataccatttgtttaagaagttaggatggaagagatggagggtagtagctatctgttctatgaaaacattgcagtgatcaactgatagaaatgctggtctcaggggaagcctggacatttccatgaacaaggcactagagaccagttgaaatgcaagcatgcaaagtcacaggctctacatatagaggtcagaatttctagaccatcttaaagatgaaagatacatgaaagcaatgctaaataactttcaaatgctcaacatgttccttataatcaattcaacagtctcttataaaattggtagagagaatattctaatttcttgagtgacttaagcctttgttactggctcaggtggatgaatgcaaatatacattatgcaattggtgtttagaaaaatttctccacgaaaatgaaagttgtgtcaccttccattcatcaaagacagttttaccattggtaagagagcttaggtgatcaacattttctttttcctattcaagcaaaatcctctggtcagtttgcatgtggaatttctttttttaattctgagcacaattaaaggtgagttaaggctctggtggaaatctaaagagcatcagcaaatctgagcactgctcagcttttgaattgcttttctacttctcagttcttttaaatagttttctatggcaggaacatttttcttaattagtcacagctaattagtgttctggcatagacaagtaatcagaaatgtcagagctgcaaggctacatctccctaatcctttgataataatttagcctcctgggagggccccaagctgcggtaagtagtgactgacaataaggcaaaattaggtgggcagcagaccattaggatagaaaaataaaaagcactaccaaatcctgctgagcaccatcaggcaactaactgcactgccagatgaggtgcctgtttaagcctctgttgttaattagctgattctaccagacctgccacatatgtccaggtgcctcatgcaaagatgtgtatttctgggaatgtgccaaatgacaattgtgttccacgatcacatttcaagaatctaagcaagaagcccacatatttcttgaacattcttttgaattatcaaagaaataagaccaacaagctattaatacactttctggttgagtttcttttaggcaattgggcatgcttatctcaagtttctcaggttttaattcaccaaagctctgattcaaatgagggcctttggcctctctgaaccacgtctggacttgccaaagctattttggcatacactatacatcaaaagttgatccttttataaattcttacacttacaaataataacttaacattacaatgaggattattaactcaaaggaaccagacagcggtaattcgagagcagaggttttaaagagaaacaaactttaaggaaaaaaaaaaaaaaaagctgaggagcagctctgtatggcatctactgaggcagagaagacaatatagaaacaggcttgactatgactatcttaaaagaggtcaaacaacttcagtgtgagtccaaataccataagtaaaccaaagcaggattatatacaatgaaacacaacaatgacaacagctggaaaacaatgtgttaaaagcagctaagtaacagattgctacaacatgtgagatgaataagacactgctgctatcatatatataaccaattagtcaaactttttatccacctttagtacacaatgaggtactgaggtacacaacacaacaatgtttataaataaattgcctcagctgggtatggtggctcatgcctgtaatcccagcattttgagaggctgaagtgggcagattgcccgagctcaggagctcgagaccaccctgggcaacgtggtgaaaccctgtctccactaaagtacaaaacattagccaggcatggtggcacgcacctgtagtcccagctacttgggaggctgaggaagaattgcttgagcccaggaggcagaggttacagtgagctgagattgcgccactgcactctagcttgggctacagagtgagactctgtctcagaaaaaaacaaacaaacaaacaaacaaataaataaataagtaacctcaaacagcctcaagtacctcactgtactcatatcatacatccctttctattgatggaaaaggaaaataatggctatgacatgggaataatattagtatttgagtgttgataggaaaatcatggttggacatactggtacaacagttaattatttatatttgagtacttttatataaaaataagaccaaagtgaaaataccctaatgggaatctatactaatttgtgaagaccatataacaactatacagttattaaaaagtgaaaaataattgaaaagaggaaaactgctattttaaaactgacattcacatataagaaagcatcccatttttctttttgagacagggtcttgctctgtcacctaggctgtagtacagtgtgtggtcatagctcactctagcctcaaactcctggacttggatgatcctctcgccttagcctccgaagtagctaggactacaggaacatactatcatgctaggctaattttttttttttttttttgtagagacaaggtcttgcaatgttgctcaggctgttcttgaactcctagatgtaagtgatcattctcacgttgacctcttgaagtgttgggattataggcatgagccatcctgcccagctagaattcttctataatatcgtagaattataagacatgcaagaaggcaaagatggtcttccatctcagtgggttccagcctgcattcctagtaaacaggctgattacatacacaaagaaactggctcaaataatatgactgaaaaagtacattatcagctctaaatacatacaaagaagtgtattgtgaaagttctatttaatggtcacttttatccatgttttgttgatttcaactgtgtattgtgaaagttctatttaatggtcactcttatataaccaagtgtattgtgaaagttctgtttaatggtcacccttatccatgttttgttgatttcaactgtgtatcgtgaaagttctatttaatggtcactcttatccatgttttgttgatttcaactattcttaggaaatcaacattgtaataaacagtctttaaatacattaagaatagcagtgttaatcttaccaagaatgagtaaattctcacttcaaaaagtttgggcattgatgtgaagcactagctcaaaagttccgggcaggccgggcatggtggctcatgtctgtaatctcagcactttgggaggtggaggcagacagatcttctgaggttaggagtttcagactcgtctggccaacgtggggaaaccctgtttctactaaaaatacaaaaaccagccaggtgtagtgctgcacacctgttgtcccagctactctgcagctgaggcaagagaatcatttgaacctggaagtggaggttgcagtgagccgagattccaccattgcactccagccttggtgacaagagtgaaactccatccaaaaaaaataaagttctgggcatttccccctttcttaaaatttgggagtccagaggcaaacaagagcatgtaagtgcaaaatcagtttcattttgagaagcacattcacttataatattttcattattttctttttatcttacattaatagtctactgaatccatttatatagtataggtcaattttactcaaaatgtttaatttagagtttcttcactggaaagtaagcattcttttcacagaaagtcctgggaaattaagcctttataaaacgctgtttggatgaatataactgattaactatcatttaaagaattactttaaatattacaagacatcataacattaaaaaaatcttgtggagatgaaactcctccacaattaaacatttaatcaatttataacaaagagcatgtttaatctgcatgatttaccaattaaacattgtaccctgatgtgtcttcagcaacatgagagctaaaatgagatagtttccaagggattcaaggtgggcagtgcccaataaatgcacaatggtttagagagttaggtaggtttagtgtctatcttgaaaaataagatgcgcttcagtcaactctcaactgcctccacatttcaacattcttggaccttagaaaatgacaagagaagtgctgttgtggtcattactacagatgtcagttttgacttctgaaaaatcacccctttccagcccagagagccaaagctctgaagaaatgtaccaggatctctgctgacacatggacacctgtggcttgtgctacatgttctgaaacctgagagagtgagcagccactctgcctgggaagaaacatcacagtaggcattaaaaatggaattgaagaattagaaaatctttgtcatactttttatattgggatcaggttgaagatggttttgatttgataaaaattttaaaaagactgctcacaatgatgccttatgtgttaaaaaaaaaaaaaaaaaaggacattggtgtaagagagagaacctcaaagcagaaaaactttcttttggtatattcatgatctttcctactacaggataacttctttcagtttttcttacccaacaagtcacttttttaaaattggaaaagtaaatgtaatatctagattataaacttagcatgtgcctcagtggtcacgtgagaggcagagatatcctctgtttaaaacatcctggtcagctggaaacactgagtctgaatacagaatatacatattgcaactttttaaaaaaatttgggtttcagaaccacagtgatagatatacacaatgtcatatggcatagctacttttgtagatagattttcttttctattaatctactgcacatgctactgcttctttggtgggacaccttgttttcacatggctatcacaaaataacttagaaattactatactgaagtacaagaccctttatgcaatcagtccagtaatttcggtcatcattgctaacattaaaactaaaaaaaaaattggtttaaaatctggaagagtttcagaaatcatctggagttccagaccaacatctttagtttacacgtactaagtaaactgagtcttacacagatggcataactttttcaaactcacccagatatttaatggcagagctgtggttggaactcaagtttctgcattctcagaccagagctcttcccataacactactttatcatttcaaattttgttaagtcagaggtaaggtagagagagcatagactttgaaacttgagaaatacgatttcaaagtttgactcaacaatccacaagtcacttatcttctctgagtgggagatgttttaacctaaaaatagggataaaatgggattgacgggatctagcctaggagcttggaaatgatataggtgaagcacctagaacatttcctggaacaaggaggtggccaggaaatggtagtggtgaaaactacagctattattttgataggttgaaaagatgaaggatgtaccttaaacaaacttagttttccctgttaacatcatggacctgccataacttatttatacttttaaaaagttatttctgttttaagcaaaaagtgttttgtaaatgtgactacttatgaggtgaatataatgccttcacatttgtcctaatgttagcttttgtgaccctcaaaggatacttttaattttaatatttcaagatttgatgtaaaaaaattaaagattatcctatttatgacctttaaggtaatgcagattttatttatttcctctctcatactttgacattaatgacttattattggagatgggaatgatagcagcagtgcagaataccccagaagcagattttatacggtaaatggctgtgtaggttgtacactgaaaactcttgaagatatcaatctcattccaaaaacaatgggcacgaatctaggccaatgtcatgtttttggtcttaagcaatagcagcttatttaaaccaaatcctggggtatttcatcacaaaaatcaggaacaatcaaggtgtttaaatgatcaaaaagttatagaggtcagggatactgtgagtagttagttactacactcagggaaagttccacaaactttttaacacagctgcatcacctgcaaagattatttagtattacatgctttccaaaaatgttgggggcagggtgaatatgttttgcagactaattgttttatataaaaatagtgttatatgtggcatttccaaaactaagtgaatttcttgaagagtttaagccctcatgttgcatgacccagaaactgtagcccttgttttctaatctgggttggttaaaaccactaagttttaattcagtataatgtgtgtgtaaccatgttttcacttgcatctgaagttaacaagatccatttacttacttatataggaaatactctaattggaatagcaaaagttcgtcatgatgcctgaatgaaatttttctcttcaatcttttatctgtaataggctaaggttgctaacagtatttatagggtcattattttcaactgttttttgacacctaacaatattattttaggctccagccaagtggatttccaataattacataatgtctctcagtaatgatctgttgcttaagatacacattctactttgcctttcaacacgtacttgataacctctcattttctaactgtaattgaggcaaattcagtcttggctgattaggggcttttagtatcccctcatacatgttattcctgatgacaaatcaatagaattagggtctatttttatttttaaataaagtaataaaaatgtgcaatttaaaaatattagaatgtttaaggacactacaattattttacaaataacaagtccagtgttctaccggggatattcaaaatacaaaaccttcacaaccaaaacagaatggttgcttattaagggttacttttagacccatagccatgtcagatgcttaggcattgaatgaaagtatatataaccaaggcaattaaactagtgttatattttaatgttggcctccttagagccactttagttccctctgtctgttatcattgccacatagaaagtcttccaaagaacttcagtgaatgaagaggagttggaagtagagaataacttcaaggagaaaaaacttctacctttataatgaactgatggcaagaatggattgcagtaaataggtcaccgagtcaaaaaactgaagatgttcagaaagttcacccattccccttgacaaatctatctatgatggtctacttatagaatggctttaacttttcaacatagaagacgtgctttagctattctaagaagaaacataatgggaataacatcaactcaatttccctcttctgttcaacagttttgaaaatcaccacattagcagaaaaagtaaaagagaacttggaaatgaaacatatgcttgtaaattcagagcaataccaaatggaagcagaagttgctaatatggtttcagtattttgtaaaagagccagctggatggatgataatttttctacccctgcagggcatcaaagcttttagaaaatcatttttttcacacatattaacacttagcttattaaaacaggcaatactttttattgtatgatagcctgagtaaagggtagaaacataaagcatgaaagataaaattcattttgaccacccaaactgacagtgaacactgacacgagagaccacggcagagaggatgacgtagcaggaccttctgcaactgccacagctgaagtgtcaccatgaagcccgtgaattgctgttacgaaaacatttgccgtaacttgcataattaagtgaaactgccagaaaagcatttctaaaatgcagagaagatgtacataaataaataagcttcaaagcaaatattacatttaggaatctgtattgtggtgaattatgcaaagttatgtcacaagcaaagtatcatttcctttgaactgactgtaaaataattacaaatgaatgacaatattgttatttaaattgactgctctgttagtctcctttacagatactgaataaatgaaacatgacgatcacagtatacaaaaccacagtcctcatttttaggcattgtcatgcctaaatgaagaccttagtgctgataaaactgtaatactgcatattttagcacatatcagtactttaaatcaagataaaaatgttcaacagtagagtggcagatatttggctttactgcagcttatttgtttgtttaacagtagaatatcatattgacttaaaacatcttatagtagggaccacatccattagaacatgattctgtttatggaatgctgcaaaaggcaagtgaaaagatgctgaacaccatggtaaaattattattatctggctttttataactaacctcaggtttttgagactcattctaatggtgacaatttttatatagaaaaggaagctaattaaggcctccagcagtcaaaagaagtataaaaattatcaactatattagctgcaaatgaacaggaattggaaatggggaataacttcaaggagaaaaaacttctacctttataatgaactgatggcaagaatggatttcagtaaataggtcaccaagacaaaaaactgaagatattcagaaggcaccccgccatccccccggcccacacaccaacaaatatacctttgatggtctatatctagaatggcttcaactttttatttttttatttagtcatttttttgagagaaagtctcactctttcacccaggctggagtgcagtggagcaatctttgctcactgcaacctctgccttcccggctcaagcgattcttgtgctgcagcctctcgagtagctgggattacaggcatctaccactacacccagctatgtcttttattttttcttgtatttttagtagagacggggtttcgccatgttggccaggctagtcttgaactcctgacctcaactgatccaccggtctcagcctcccaaagttctgggattacaggcatgagccactatgcctggccagcttcaactttttagtatagaagatacaggatcacaaaaaggagactatgctttgcaaacataccatcaaaattcaacttttctctttgcagtttatctatggtgtcagcataccttgcaagggaagctacttacatcaaataacttttctatatacatttcctcattgaccttttctcgaagaatatcttggttttgccgaacaaacataatataggtgtctgccagatccattcctggtttctgttgtgaaggaaaagcagggggaacaaaataatatcaggtctcaattgtgaaattattatttaatcataccctgaaaaataattttgaaaattacagtcataacaaggagcttaaaactaaaccaaaagtgagcatcttcaatacattccataattaaagcaaataaaagtttattactgatgttcacaacttgagatcaaattgaaaatacagagttgtagatccgtagatatcttttttttttttttgttaaatggctatcttgaaaggccagtatgtcaagcagtataaatgaataaatttttccaaaaattttccatgtgtaattataatttcccagttgcaaatacaatttactttgcatcatctctggctggcttatcaataatatttaaaaatgcgctgagtgccatggctcatgcctgcaatcccagcactttgaaaggctgaggcaggtggatcgcttgggcccaggagttcaagaccagcctggtcaacatgatgaaacctcatctctacaaaaaataaaaaaaaatagctgggagtggtgttgtgagcctgtagccccagctagccaggagggtgaggcaggagaattgcttgagcatgggtggttgaggttgcagtgagctgtcatcatgccactgtactccagcctgggcaacagagccagaccctgtctcaaacaaacaaatgaaacaaaataaaaccaaaccaaaaaatgttagctttccttagggtgcctccctcaactactatgggcgttcaaggaatacaaactaaattttttattaagctgagtaaaatattttgaagaagatattggggaaaatatttactatattacaaaatgaaatgtaaaatatcttgtggattatccattgcttctactcaatatttaacaacattatctgaataatttattttcttttagaaatgtggcaagagtatcaatgaactagtttcctatgtacagccgaagatgtggattaaatacctttccaaagttatttaacatttggtgtcttctaatagtagaggaggtaatacaatttctccttgctatagatgctgcaaagtcagtactagtaagggatagatgcctgcatggctgttaaagacttttttctaattgatttatgtttagctctttcttgaacttcatatagctggactagataatgaaagcacttacttgtgtcatctacacctgggcttggttcctaatctgtattgagttgttgattagagtatgacattaataagaacaaaatgataactatctatcactaggtagatctgctaccaatttgataggtagatctattaaattagatagatccatcgacctaatgataggtaggtagaactgatgcccaaataagccagttagccttgcatcatttcgtattcacagaaagcatttataacctttgtcagcagactcatttgcaaaagtaaatactataagaaaattaggttaaagaggatatgggtcatttaactattaccattgctggaaaaaacaactcaaggtaaacatgtgagtgatgctaggacagtagtcacatcttctccctaaatgaaagagagttcttgccatttttttttggagggggcatattttatataacataataaaattgaccatctcttaaccaatatatagtataggcagtgagcatgtcttacttattccatttataaaaattaatgattttttgttacaaagttatttctgtgcagtaagaattactgcaatctcttactgttcttatatttagtctaaaggtaaatatataccacataaattcaaggatcctttcaacatgaccctgatacaacaacattagctgtaacttgaaataactatataaatgtctttactggtctctccttcagtagcattcatacacaatgttggctatctattttcaacctaatggaggcaatttatcaaattcattccttcactatttcaataattctcatgagcaatgtttgaaagtttaaacaattacaaggataaacaataaaaaagctagactgttttcttctttgggtctagcaagattatacattggctcttccagtgaagaggcagggtaatttgtacaaagattactactattaatacttgaaggaaactaactcctaagatacatatttctctctgtgcctctcaaactttgtcaaaacactgacaatgagaacattcaaaaaacctgctgctgcagaacgaaagtgacatgagaacaattttcaatacacaatagcaagttaactcagtatctgagtttcaggcaagtatccagaaacaggatgctgtaatgtacaaaataccaaggtagttgggtacagcccagttgaactgggagttgaagaacagacaaatgggacgcttgtctttactactatttctccccaccccaaccccatttttgtttccatcttttaaaggccactgcttagacattcagttcagtcagtcactagacctatcagtctcagtggaaactaagttatggccaggaagactgaataatgactttaaacatttaccatagacactacggtaatttcttttctgtttccttgatcacttataagattagactatcatgaaacactgtccaggaagagtttattttccaccacctgaaactaacactttacagtttaagcctgaaagaaaacgaaatgcttttcctattggcagatccaagggatataatactgaaatttctaagttgagacagttccacaactttctaaggaaataaaaatctctggctgaggatacacttgattgttgtaaaaaatcaagtgtttcctttttttaaaaaaattgcattttcttcccttttggcaaattaagatccacttgcctaaaaaacaaacccagaattcttacattcttcactggaattatttcttcctttatcattgagctgtttacctattcttgaaattgtgacatatgggaatttcacacctagtgaatacattttcatgtagcttgtggcatgagtgtataatcattaaaagaatatacacaagtaagagtaactgcaacagctggtgacatttaccaattagaattgtagttctttaaaacactttatctttcatttggtgtatgaagggtaattatctctgataaattgctgaaaaagatgtaattttccttttaaacagtttctacatacagtacaaatgtgtttggatagaagacattatcgctggttcaatgctcccatgtgctaagactctgttttattatggtggtaaaatttacacaccgaaagtcactgcatctaatttgaatcattattaagtgttataagaatatgaagtttagtgaaaataataactaagtatgctagtacatttttgtggggttttttttggtgtgtacatgaagacaatgcatatgattgcattgtaaagacaaactataactacacattctgatacaaatgcatgactaccaattatatcaaaaaagtggccggttaaacttcaacagctgtggattcagattagtttttattaagaatattgtattctagagagctatatttagaaatctcttctaaattggtaatcatagttttcttaatatgagaaaaataacaaaaaccatatagtaagtactctatgtattaaatgccatttcggagtaaattatttttttcatactcccatttaaacctccaggatccttagttcactacacactaactcttccatcttgtttattaagatggtaatctctaaatgaaaatagtagttcctaaattacttttaatctcattcagaaaataatagaatctgtctagcaaagttatagtgaaacaacacaaaaatctaaaaaattcccccatgagcacaaagggatcaagaactatgggaggaaatgaagtattttaaggtgagttcctctgacactgtataagtaatcaaatacatcagtgagtgaacgaatttaagaaagggtgcagactccagcacttttttcccaagcgttaatcactagttaacctagtaagatgaacacgctgtttaaagagaaaaaaattccttgttaattatatgctgcaaacgctcttgcttcctgctgctacacctaatcccacaggtgcaagtcttcgctttccctattcatgggtagatgggtgcaacactgcagtcatttttcacggcaacagatttagacacagaagaagctgcttaaccttccactgaaggttagcaatacactacacaaacactgtcatggtgcctatttaacaaggagacaaatttttaaatatactattccagcctcaaagcttaactagaagctacagtgtaattgacttaatttgaaagtgcacttctcataacctagaaaagcttgccttgaagaaacaatcaagagtggaagtgtaatatcctgcgttatgattatctgcttgctttgtaaatgaaatacctgtgtctggccattcattaccatttgagaaaaaaggatcatgtaagatataagacaataaataacatgtcttcgaaatttgaaattgtagtaggagcaatttatatctcaattctggcatttaagattcagtaaaaatttataattgatcatagaacatagttctacaaacatgtaatttatctcaggtattgttaaaaacaatatttttctttcactatttaatatatctttaatgctctggcatttatcaatttctgtatttttatatttgaataaaaatctcctgaaatttttcaaaagcatttgaagtagtttaaataagttatatgttctcacataaaaaaggttttttcatatattcatgattatgttgtaaaaaactaaatacagtttgccaagtttttacaaagtagattatattgtattcccacagaaaaccagatggaaatacacagagattacagagccttctaattacatttatgccaacttaaatatttaataaatatgatgggaagagaaacagttgataaagagggggctggatgcagtgacttatgtctatattcccagggctttgggaggctgaggtgggaggattgcttgaggccaggggtttgagaccatcctgggcaacatggcaagaccctgcctgtataaaaaagtaaaaaattagccaggcatggtggtgcatccctgtagtcccagctgcttaggagtctgaggtgggaggctgcggtgaactatgatcacactactgccctctagcctgggtgacaaagtgaaactctgtctctaaaaataatttaaaaaggggcagagaggaagaaatttaaacaacgaacaagtcacaaatatatgcattttaaaaatagatttttaaaaaccatgaatgaaaaaaaatctcattgttattccagactgggcgtggtgattcatgcctgtaatcccagcactttgggaggctgaggtgggcagatcacgaagtcaggagataagagaccatcctggctaacacggtgtgttactaaacatcgtctctactaaaaatacaaaaaattagctgggcatggtggcgggtgcctgtagtcccagctacttgggaggctgaggcaggacaacagcatgaacccaggaggcagagcttgcagtgagccaagattgcgccactgcactccagcctgggtgacagagcgagactccgtctcaaaaaaaaaaaaaaaaaaaaaaaaaaaaaaattccaaactattatttcaagaatgaagcagccagttaacttttttttttgttaaatttagcggtattcaaaattctattaattattatatgtttaggtagttttgactccaaactgggagtagacaattctgaattaaaaataatgacactcacatccttttgaaaacagcttttagatttagagcatgtaacatgtgttttaagtaggtacatttgattcaatcccacatttctaaggggctgttccattactgcagagttcttgtcctggatcagggtcctctgtctgttacttgagtatagttggtaaaaggcagaatcctaccttaatgctatgaaggtatctgatatcagaatctattataattaatgctactaaaacttaggtagtcatattacttttattcttaacagtcacatgaatgtttcacactatttcttctaagtagttacataatttatacatttataggtctagaaacagttatgtagcattagtatgttacattttattatatcaatggggaaaatcctttcaaagagaagtttcttttaaatattaaaataaatactgaatgatagtttaagatattagcctgaactactcaaggggacaaggtaattttcaattgagatctatgggtttacaatgccttccccatttgggactatgaggatcaagtatcttgctatttctgatctacggttagatcactaacatcccagagtttagaggaatagctgctaatacagtagcaccaaacacaaaatgtgctaatgtgtacactacctatgagctttatactattatattcataagtagcaatcataatgatgatggttttaaatctctcagttcactagcctttccctcatctacagttgtgtcaattagaaaatactacatgaggacttgaagaagtaaaattaaaatgctgcattatttcatttttagcttttaaagtttagatggactgggatgggtttactcagctcaatttggaatgattcagattttggcttaagtgacgactcagggtgctagaattccagtgtctggaggcagctcatggatttatcttacataagagagaaaagccagacagacaaaacacaaaggaataaagaagcaaaacattcatctggaaagcacaacacacaacctcctccactcctagacgagtgaggctcttaatctggtcctggtgtgcatccctctctctaggtgaatatgcccctgtgggcaagagctccattccccgagttctgtctggctctcatgctgatgtaaagctccgagtattcaggtgtggttatctaagtagtaaacaacatgagaagcaaggaagcaaaagaaggaagagggaaaacactaatgtcactgaactgactgattataccctaaaagccaccagtgtgtactattctaaaagggaacataaatgaaaaaataaaaagctaatattgttcactctgtggaaggcaactggtttttcttttggtaactggtcacgttcttaagtagtgagcaggaactagggagtaatgcatgggagccggaagcatcattccaggtagaaacaataacaatttattgcaacagtgctttacaattcaaagcacattcacgttaatgtgctcatcgaattctgaattctcataatgagggaggcagcacagggattataggttggtgcagaagtgattgtgttttttgccattaaaagtaatggcaatacttttaaatactattatcctcactgcatgggtgggaaaatggaagcccacagatcaaacagctagataggagcaaggtggaaaatgaacggagatcctcgaccccatatcaagtctgtgcagtacagaggtgggtaagaaccaccttttggggattttgaaatgagaaatctttagcaagtatcataaagatgagagaatatttgagagaattcctaatgaagataagagaaagattagccatctcctttatcttaggacaaaccaccaagatcaggcatcagtacgattaagccaatgaagagagacagtttcttcttccttcctcattgttttggtcttttcttggccacagtaatctttatcgtatcctccaagtctcttcagctgtttcaccttagtgtctagcatagagttggtatgcagcgtgtgtgataatgttaataagaccattttaaatagggattttaaaaatcaacatacatccttaaaccccaaaatgtcctgtttaactagaatgacaatagaataaaattccagaatcagagttggaaagaacctttaatgtcatcttgtcctatttcccacataatgcagaaatcttcagtaccacacctggcaaacagtggtgcagcttttactatgtcacctttgtaaataacttttttttaaagttttgtcttacactgatttcagttctgctcccacttgtttttagtcattgttcctagtcctatcttcttgactgatacaggctcaggctgttcctttttccaaacaggagccctttacatattgatcagggctaccttatctcttagattttttttccctctttctaggaacagtcagatttctttttttttccttcataagccactatttccagatcccattaactagcctggctgctttctataggaggaagtaaagtaaaaagaaaatgttgccttgaaagaattcagatgtgacttgttcacaatcatacagatgcgatcaatatggtataagtgaaatgattatttcctacaatgtagatactagattttattgtaatcaataataataataatgtatgataatagctagcatttattgtgcactaattccattctaggaactgtgaaaactgcttaacatattcacaataagcctataagaggtgtaattacatctccattttacagaagaagaaactggtgcctaaggtcacactgataatagatgaagtgatggagcaaggattcaaccgccagcagttcggttcctcagcctgtaagtaacccccctgttatgcagcctccatagatctatatacctgattttttcaaaaagtactccatattattgtcaaacatgatcttttatacaactttttacatacatttgctatcagctacatcttacccaccttacgggtgagcaaaactttttttttgggggggaggggttagtataataatttaaacctgcagaatttttggttcttagtattcctatccgcaaagctaatatgaacattttcatcctcgtcctgcatctaatttctgtcagatctgagttcccttctaagttactattgaacaggacagactcacctagtccaggtcttgctttttctttctcactcttttttcaaatgtctgttgtctttgccaccatgagcattccaaggttctatgatggggccataaactgtataactgccacagaactcctccccaagatagggttgtctagccaagagcaatctatcaaactatactgaaggacacagttcatcatctagatcagaaagatatcaaggagaatcctaccaacttctttgtgaagaggcacgtgcctggaatttatttctgttcaggactacactgaagcatttttctcctaagtatgatttttttttcattcataaagtgtcatgagaagtatatgttacaaagatacaaaagactatgtttattatatttaaatggtttgatttgggtcattttctgttaactcatacatcttcaactgtgctataattataaggaatatctgacaagtatgttctaggaacatgaattcctccttttctgcataggaatgccacttaacttcagttgtaattttcacgttatagaatcaatttatttattgctttaaaaacattccagccaggcatggtggcatatgcctgtaatcccaggactttgggatgccgaggcaggcggatcacctgaagtcaggagtttcagacagcctggccaacatggtgaaaccccatctctattaaaaatacaaaaaattagccaggtgtggttgcacatgcctgttttcccggctacttcggaagctgaggcacgagaatcacttgaacccgggaggttggaggttgcagtgagccaagatcaggccactgcactccagcctggggcacagagtgaggctgtcttattaaaaaaaaaaaaaaaattccgacaagtgacggtattataagaaggtattgccttcttatccagaaaattttttctagctctttatcttctcatcatcttccaggtggaatttttgggctctgttgtctcatagagagaactggacaagaactcacatggtgacagaacattacagttaaaagaactaatgcagttatgtagcttattcactcattttatagatgactagactggggccacttaagtaatgcccaaggtcatacagtttcaagggcacatagccagataaaatgaattaacagtaaggtattattaagtccttggccagtgcttttttcttttaataaacattttattttagaaaaattttagatttacagaaacactgtggaaatattagtttcatataacccacacccaatttcccctattattatcatcttacattagtatggtacatttcctacaattaatgaacatatattgacacaatattattaactgaagtgtgagctttattcagtttcccttcgtttttacccaatatcctttttctcttccatgatatcattcaggataccacgttacatttagtaatttggtctccttggactcctcttggttgtgtcactttctcctactttccttctttttgatgaccttgaaaattctgaggagtattctcagatattttgtagtgtatcacctattgagatatgtctgattttttttgatgattagactgcagttacaagatttttagaggaagaccatagaggtaaagtgccattttcatcacatcctgtcaaaggctgatattatcaatatgatttatcactgcagatgttgacctttgatcaactggctggggtaatatttctcaaatttctccattggaagtttattctccccatcttcctttgcttattgtactcttcggaaggaagttactatgtacatcccacacttaaggagtagggatatatgctccacctccctgagagggaagtatctatattaattatttggagttcttctgcatgggagagctgtcttttctccccattatgtacttcaatatttacttgtatcagtatggaccaatggatatttattttatgctttggattataatccaatattactttacatatttgctcgctcaaattactctagcttaggccactgggagctctttccatcatctgctgtgtctctttgaaacacagagtttccagttttgtgttttttgtgaacatctcctttctgttgctacaagatgctccacgttcatcttgtatatttttcagcaccagccatttctccaatgagccctggttcatttcattaaagattagagaacaaatttgagtgctatgtgggcttgttgctactggggcatcactgtttctaggctctctgagctaacagagcaagaaaatgtatgtgagcacattaacgcatgcatatacatatatctaaaaatactgttaaatgtaaccagctctatctgtactaagctaaagacaaattcacactgatatttccaactctaatccattacaggatcattctagtccccttcctttgcttgcctctaacctgactctaacggtgagaaacctggctcctaccaaccaccatccatttacttaattgttcaattccaatacacacgtatagtggcttcaaaattgttaaactgtggagaaaaactttatcaaccagagtacaatgcttatttataagttccatttccccttattcttacagactccactaatttccaaagttactcagatcagcactttcctcgctcctctttcagtgagtttatctcatacattcacaatagaattattttattatagtttcctttccatcctgggattctatgatcacttaattgatttttaaataattgaatatactcaagttcactctttttgctataaagtttggttttgacaaatgcacagtgtcatgtatctaccattacaatatcatacagaatagttgctgtgttccaaaaaatcccctgtatttgaacaattcagccctccctgaccttgaactcatggcaaccactaatctgtttatagtctttatagttttgccttttgtagaatgtgatataaatggaatcatacagtatgcagccttttcaaattggctacttttggcaatatgcatttaagattcatccatgtcttcatgtgagatgagagctcttttctttttgctgaatagaattacattgtatggacgtaccaatggttatttatacattgacgtactacaggacaattttggttgattccagtttgggtgattataaacaaagttgttatgaacatttgtgcatagattttggggtggacatatgtttcaaatcagttggataagtgcagagaactgtgattggtgggttacatagtaaggctatatttagctttaaaagaaactggcaaacagttttccaaagtagctgtagcattcctaccagcaatgaatgagagttcctgttgctctcttatcctcgtcaacattttgctgttgccagtttgtttttggattttggccattctaacaagtacatagtggtatcttcttttaatttgcattttcctaatgacaaatgatattgagcattttttcataagcttacttggtatctgcatatctttcttgttgcagtgcctgtttggatcttttgcccatttaaaaagtttggttgttttcatattgttgaatattaagggttcttagaacactttggatacaagtcctttatcagatatgtgttttgtaaatagttcttcccatttgtggcttttctttctcttaacaatgaataagagtatacttatcaatttttaagttcaatttatcaattttttttctttcatgaattatgtggggttgtatctaaaaactcatcaccaaatccaaggccatatatattttatcttatattttcttcttgaagttgtatagttctgcattgtatgtgggtctaggtctgttttcagttaatttttgtgaaaggtgagccagcgctctttttctcatgagactctcttaagagacagcttcagagaggcatacttgctggagtttgagtataaaaaagaataacggccaacaagaccttacagcttttaaagttaatattcacaggcatcaacaatagaagtgtaatgtccataactgaagaaggaattcatcactttgtaatctgccatggtcaaaccacatctatggtatagtatgttctgctccagggggcaacttgatttaatgctgacactgataagctagaattcctctaggttagtaactggcatgatgaagagtctggatatgattgccatagaagtgtgcataatgatatgtctgtttccctatgtcttttgtctttaatattgtgaaccatttgagggcaagaaatgtacgtctcatcatgtatgtccaggatctagcacttagtatgtgctaaataaatatttaagtagtgggtttagtgaataaattgagaatgtttaatctagaaaataagcgttcctcagacaacatatgcctgtgaatagccaccacacctcctgggaagaggaggcatgaaaattgtcattaaatatgcaaagagctatcatgcagaagagagattagaacgaggattaatgggtaaaattcacaaagatacagaatttcaactcataatacttaacagtaggctgccatatggtcatcctgtaaccactgaaataattaaacagcacccaagtgaatctttgtaagggatgttagagaggggttacttgcactgagaagggaagtaaatgaaccattttctgtctccttcaactctgaaattctatggagagaataaactagtatagggccaattaaaaacctcaaaatctctaagaacatgaataattttggtgtcacagtccatttgtaattcaaaatcaaacaaaaactatgtgtgttacaaagtccaatgtgatatatacaagattatttgtgccttcctttttaagatatcaaacataaaatctccccttaattctccctttcatgctgctgctttgtggggctctacatatgtgatttttttctacttatggtccagcactgattccttgattctaggtacaggacgaggagggtatgaagacttctttgggaaacatttgtaaaataaaaagtccagttccaaagaaaccccatgcaaaggtagaaaagtccagggccttctcatttaaaatactcatttataactacagcagcaataaagccagagacaaaatgtggtggtgcatcctaaaaataagagctatctacaactgatacataaagcttgccagcactcaaaactgctaccatttctaatggcaatgtagagatataatgttcttcaaatacaaagagagaatttatattccatctagtcttaaatcttaatttatttttcattgtgctctaattctaattctttgaaaattgacatatatgccaaaataaatgattaaacagaacaccttaggccttgatcatataggtgataatagaatttaaatcaaaaactaatttggtatgatgattagcttaaaaatgctgcacaacttgttggttatgtttaccatgtgaacgttctcattgtagctaagtcagtttcatgatttctgctcatggaatctaaattttggaacaaatttatgagttatttcccaagaattctatgaaacaacaaatgttaaaataagtaactactgatttatataacacttgtgtatttagaaaactaattctttaactggttcatctttatcattattctaccttctataagaaacccattacagctttcatagaaaggggaggaaaagcgagcagtttttctataaatagtgtgaggcatttttctaccccatcctagagtgctataacttccctctgcaactcaggtgatatgttcttatgatgaactgatctccttaagagtttctgagttacaacagaaaaagtcaacgaaataaccttgctatgtcttgttatgaaggttagtgcttgcttaaggaaaataaactactccctaagggaatggcactggtttaaagatttgaaataaacccatgatgaactgcaatttttttttaaagaattccatacagttttaaaaagcagataaaaaatacttactggaacatcaacatattttgcagctgctttcaccttaagtgtgaaagaaagagataatcatgagaattatttttttaactgccatataagtactatgacaacagttaaaagaccacagaagagaactcattcaaatacttacagtgaatgacagaatggatgaaaagaaagtgccttcatcataccttgacagcttagacaacacgccttccaacactgaaacaaactataatacagttatagtgagtatttagaatgttactatgcatacaaactaatagcaggacaaacaattcctgaatcaatttcttccatcgcacaaaaattcacaatgaatgaactgacagctgaggtcagactaacttgtgatgtttactctttcattctgaacatgaactctactgtccttttctttcccatggctggaaataatacacttttttttttttttttttttttaaaatgagatggaggcttgctctgtcacccaggctggagtgcagtggcgtgatcttggctcactgcaacctccacctcccgagttcaaactattctcctgcctcagcctcccgagtagctggaactacaggcgtccgccaccacacctggctaatttttgtatttttagtagagacggggttttaccatattggccaggctggtctcaaactcctgaccttgtgatccacccgccttggcctcccaaagtactgggattacaggtgtgagccaccgtgtctggccaataatacacaatttttaaaaaaataaaagataatgtgtcataggaatctagtcactatacatatgagaccactgaagccattcataaacaatcttaggtccatgagatttttccttaaaacatttttcaacttcaatgtggatgttaagaaacaatggcaggcaagcttaatcagattcctttctattttatattacttgccatccttcaactttttctacatctacacaggaggttgaatataaaagaacagataatgggccaggcagggtggctcatgcctgtaattccagcaccttgggaggccaaggtgggcggatcgcctgaggtcaggagttcgagaccagcctaaccaacatggagaaaccccgtctctactaaaagtacaaaatcagcagggcatggtggctcatatctgtaatcttagctactcgggaggctgaggcaggagaattgcctgggaggcagaggttgtggtgagctgagatcatgccattgctctccagcctgggtgacaagagcaaaactctgccttaaaaaagaaaaacaaaaacaaaaacaaaaaaccaaaaaacaaacaaacaaaaaaaatgaacagataatgaaagggaggtggtgtaacatatgagctcttgtaactatgacacaatggctgacattagttaacaagcatttaccaggcagttctaattggcacatataaggatcatccctgcttcccaaagcttacgtagcagttatggagagaaaacagatacacactgcagagtacaatggaaaagagcactggactcagaatgtatatcccaattccatcactcagtagaatgcaagctcagtttgaccaccttacttctcaggcttcctccatcagttaaatggactagggtgaggggggtaggatgtggaattcaaattagtctcaaaagtggtttacatttctaaaactttatatttctatgaaataaaaaaacacatacactataatacagtaaaaatgtgaagcattttactttatttagcatgaaaatcgatgaataagagatcttaagaatgacatactgccctacatctctcctccttagaactaaaataatatgaactattgacacattatagattcccaaagggaaaatgctgacaaggttttttcaataggaaaagggaaattaacgaagactggtttttgttcacatagcagcttcttcaacaaagtgataatagttctagggacacagcttattggtctctggtgaccagagaactcgctgtgagtgcataggagataatcttttctttatggctgatcaattactacaaaatagtttatgcaaaagaaacaaaaacttccctataggtttctccatcacatcatttgcgacatgatgtaagaacacagaaacaaaaccatgcagactgactgtgaactataagtgcatttttaaagaatgagaataacgtatgcttgggtagctatcctaaaggatgcctagggaaaaaaaatccacccacaaaattgcgaattgctcacatgtagaagttaatttagcactttcttcctgcctgttaggatttcttaccaatcatgactggctaactcaacttgatgtagtttgcaaggacccagaagatgaatactctagggttatgtcagaccagggaaagggaattccaaacttaatggccctctgtggaaaatgcctcatctcttgtaactcaaatcttggagcaagtgtgtactgggtgatctcatttgccacgaggacagcggcaattgctatggttactagacagcttgaaccatggaggctgtagcccagcacctgattcttggtgcttgctagtgagtctgtgcatacacacatgtgtgttgctgagggacaaagcaagatagaggcaggaagcctgttgatgaatttgctgagggacaaagcaagatagaggcaggaagcctgttgatgaatttgctgagggacaaagcaagatagaggcagggagcctgttgatgaatttacttcttggctcaagttgcagctctgccgctgtctggctacgagataaatgtcaagtcattttgcttctctctcttcattgtacttctcagtaaagtggggaaaaggacagctatcccgcccaccttacaagaatggtctgaagatcagtggaggtaatttatgtgaaagaactgtgaaaatggccaaacactaaagaaatgtaaagaattaatattatccatatgattagcaaaatcactatctgtgtctaaaaacctgaatacattaagtcacaagttaatgggggctgccttagaattacttagtgacaaagaggaatgagtttggtccttaagctaatgggtctaattcaattaaatctatggggcttctatggaggtagaatagagctgaggctttaagtcagaaaaccactgggattccgcctgtttcaaggttatttggcagacggcagaaggaggaaggctttaaacacaggtggtcttgatccaaagcccatgctctttacccatcatgctacagaactgtaagaattaagtgatacgccatatgcaatgtgcccagcatataaatactcaagggttcaggtgtggtggctcacacttgtaatcccagcactttgggaagccaaggcaggagtattgcttgagtctaggagttcaagaccagcctggacaacatagcaagatcctgtctctacaaaaaaaaattaaaaaaattggctgggcatggtggcgtgtgcctgtagcttctcaggaagctgaggtgggaggattgcttgtgcccaggagttcaaggctaaactgaacaatgattgtgccactgcactccatcctggatgacaaaggaagaccctgtctcaagttaaaaaaaaaaaaaaaaaaaaaaaaagaacttggccaggtgccgtggctcacggctgaaatcccagcactttgggaggctgaggtgggtggaacatgaggtcaggagatcgagaccatcctggctaacacagtgaaacctcatctctactaaaaatacaaaaaagttagctgggtgtggtggcaggtgcctatagtctcagctactcaggagactgaggcaggagaatggtgtgaacccaggaggcggagcttgcagtgagccgagattgcgccactgcactccagcctgggcaacagagtgagactccatctcaaaaaaaaaaaaagagcccaataagtgtcattttgttttaattattaatgagtacctaggataagacatacaaaaacacaacagtcttagatctttccctttgggaaatacaaactagtgggagagatagacatgaacataactgcacatgacacaaggcagaagtgttatgggcagtgtagacagtaagcagtatagctgaaaccagaagaaggaaataatgtctttgactacaggatatggggtcagcttcacttatgagttggcacaggagctgagccaaaggatagcagagatagagtggctaaaatgactctctgggaaggttgctggcaaatgcatttagggcagaattttctccatgtggcatctggcagcctgtttggctcatcttcttcagagcacgaagcagcattggcttatatacaagttagtcctaggtgtgaacctgtggtctgctgcattcatgtctcagcattctttgtctccatttcaaaagtagtggagagtctttcctcagcttcctccctatccctaaaggtccctggggaggctcaatacagctgggaatctaagtgcttacatggcagtgagcagcgacagcacctgtgggattaaccagctgaggtgtacagttcctacaggaaagttttctttgtaagatttttgttgaggcacacctagtagaagagctaccttaaaaatcaaactctattataaacatcaagattgactagtaacgatataccttccacctggcttttaattgcataaaacagcaagattccaaagaaacccagttaaatgttgggtttagttgctgcatctttaactgcttcctgtgaactttctctgtacagctcagggagtatataaacacttatgggtttgcctttgtgctgtctgttctcctgagggtgtcgggttggaatgaaacactgtaatctctttgttgccctgctctttattactgatgccattaactgggcttgtttgaaaaatatttaacacctaaagtctgcctgggtaattactgactttgtctcatgaaactcttggaagtgactggtagaaggaaacatgaagagtgcttcaaggcatgtgcatttacatttcttgttgattttgacagcatataagattcatatggaaggtagaaccataaactctaagtgacgggaggattccagctagggttcaaaacgaacagttcttgcatttttagctgtgacacttcatgaaataaacaaggaatatttgcatcatttacactgcacgttataaaatcttccacagaaaacacaaacatccctagtatggctgataatgaaaaactaagtgttttctgtgggggaggatgggatagctgttttgtttttttttttgttaagatcaggactaactagtattgttaaaaatctgcacatgtactccatgaatttagttaaaaaacttttaaaaattaaaaataaacttgttttagtaacatattcttaaaaaatgtgaacacagttccagaatatcatgaactaggagaaaataggttgtcttccctaaatcagaacgttaatatatgataataaaataatacgaggcggccaggtgtggtggctcacacctgtaatcccagcactttgggaggccgaggtgggtgaatcacgaggtcaggcatttgagaccagcctggccaacatagtgaaaccccatctctactaaaaaaaaaaaaaaattacccggccatggtggcgggcgcctgaaatcccagctactcaggaggctgaggcaggagaatcgcttgaacctgggagatggaggttgaagtgagtcgagattgcgccactgcactccagcccaggcaacagtgcaagactccatctcaaaaatacacacacacacacacacacacacacacacacacacatatatatacatacacacatacatatatatatatatacgtatatatatatatacgtatacatatatatatacacacatatatgtataataacacaatacaattgtctctttcccatcctctttctgtgaatccagctgcgaaactacttatttgaagctttattccaactgactcctaaaaggccttaccagatcctgcacgttataggaaggagggagtgtttgacagcaggtatttattcataacataccttgttctgcaaagtatctaggacaacttctaaaacagcacacttagaccagatgttggtgaattcaccacactgttttctctcactcttcctttcattgttcctccacaaataaagtgaactattttactttgcattctctctctgctaaaggctcctaatatcgtatgctattccttttgggcacatacttggattttaacagatgccttctgaatatatggccttgatccaaacaagtaaattgagtaagtttaatgcaattaatttcaccaggctaaattaacaagaaactttaattacataatctaggcagtcagatcagatttatcttctatctatcctattcttaagagaaatccaggggaaaatattctaagttatgagagagagaaagcgagagagagagagaatgtatatatacccgtatatctgtatcaatatagttgtgggaaaagtgtatattatttcctaaatcctttttttttggcaataattgagaatctaggaagttggatattacagaaatgatcttttaattcatacccagaagtgatggaggccctgttcagcagtgctttctgagagttgtcatttttttcactcttggctctgttaaccatattctaaaccttcccccagtttttttttttttttttttttttttaagacagtcttactttgtcacccaggctggagtgcaacggcgtgatctcagttcactgcaatctctgcctcctgagtgcaagtgttcttgtgcctcggcttcctgagtagctaggtttataggcatgtgcaaccatgcccagctaattttttttttttttttttttttttttttgcttaaaacaataaaagtttattatggtatagttctgtagttcagaagcctaacaaaggcttcactgggctaaaattcaagtgtcaatagggttgagttcctttctggaggctctaggggagaatttgttttcttcacttttctagcttcttgcctgcattcatggttcatggtctctatcctccatcttcaaagctggcaacatagcatctctctaaccctgcttttgccatctcatctttctctctgactcttttcttttgccatctccttccccttttaaataccttgtgattacattgggctcacctgaataattgttatctcacagggttttgccatgttggccaggctggtctcgaactcctgacctcaagtgatctgcctacctcgacctcccaacgtactgggattacaagtgtgagccactgcacccagccttggcattttcattgctatatataaggtatcccattttcatctacctgacttagagttgccccacctggttactctagctggactctacaagctggtctcacagaatgtatgcatggagggacccacaggctggctggtacaacccagatataaaagggacacaagaggactggaggtgaagctatcactctttccctccctggtcttgctgagttctgcatggtgttgtggagagatcataggcttagggaccacaggggccaaatcctggctctgctgacatctattgtgtggccttgggcctctgtttcctcatctgtgaacagggagactggactggtgactagtcctgccttgaaacatgaggccacccaggtagggccccaggcctcctttcccttcttaatcagactgacatcaatgctttgattggtgttatattttgcagtgctaatatacatttgagacattaatatattttataaacatttttaaagcatataaaaatgtatcttaaaactataaaaatgtttgaaaagtccctagtagatgacctcaggactcttccaaatccagcattccgtgcgccatgagtttctagagcctggagacaacagatgcaggccaccagcaggctccatgcagatatgtgcgtaggacttttgttctagattgagaaaaggctgtcagtttttaaaaaacccaatacccccactttttttgatgaggaaaataagtcatgtgaggacacccagctggtaacataagaaaatgggactagaatccaacttttctgatgatcccacacttcggttggtttaattttaatataaagtggcaataaatatgacatttcttgtaccctttccttggtaagatttaatgctcctattttttttcccttggtaaaaattattgaagtctttctggctagaagaatttttgtttccccccccccccccctttttttttttttgagtctcgctctgtcgcccaggctggagtgcagtggcgcaatctcggctcactgcaagctccgtctcccgggttcacgccattctcctgcctcagcctcccggtagctgggactacatgtgcccgccaccatgcccggctaattttttgtattttttagtagaaacggggtttcagcgtgttagccaggatggtctcgatctcctgacctcgtgatccgcctgcctcagcctcccaaagtgctgggattacaggcgtgagccactgcgcccagtcttcccctttcttttaaggttactttccctcttttccataggtgttccagttacagcaccttggcctgagaacagtggctgctgatacagtccttttttcaattgttgaaatcttataatcacatcaatattttgaccccatatccctcctctgagctccagacccaaatagttaatatcctccttgacatctcctccctcaggtgtctcaaaggcagctcaatctcaacatgtccaatactgacatcatggtctttctctccaaatctgtttctcttccaggacagcctgcatctaggaatgatactaacattcaggccataaacctaagagtactccttactatttcccttttcattgtacatctgaaatgtctttggattagttcaacagagaccaagtaacagcttctacactatcccctctccaatctgtttgctacaggcagtcagatgaatcttcttataatgcaaatctgattaattccctacccacactctccaacctttcagtgacttcccattgctcttgggataaagactttaagctccttagcacttcctacaagcttctgctcacttctgcagccttgtcttgctccaggccctggtttctgcagtttctcttacttaaatggtcctttcatctctcttctcctggttaactctttcattcttaggaactcagctcaagcttcacttgcttgggaaaacttttcctgtcctccctgactaaatgagttactcggtcacagattatcctacatgacacatttgtatggcttgcattttatgtttgttagtgtgtctcctccaagggttagcaaactccttgagggcagggaccctgctgttttgcttagcactgtatccctggcattgagcatactttctggcacagagctgcatcctgaaactctacattgcctcatggctgtgaatttcaatcctttttaaaaaatgaatattgccctttttcatttggggcagagtcacagtatataattttatgcaaagtactttatgttctaggttagagacaagaactggagtattgatgccagagcacattcctttagcattttccagatttactttcatctactggattatatgacaagcagtgtacaaagaataatagataaagaggattcagagacacacacataaccatgaagaaatggcagagaaagtgggcacagagggcattgggtaaggagagggctaaatttgcttaggaagatgtaagatgtcttctagaaaggagagcaaaccaagacttttctagttgaattatcagaagaaagcaaaaaagggctcttcaagtagggggcagaagtgaaaaggcacaagggtctggaaaaactatgaaaccaatagaactttggaatagctagagtttaagatgtgggggagagtgttatggggacaagagcaattatactgtgaagggacttgtaggtgatgctaaaaagtttttcttgtgggtcaacctttcacaaactatattctaaggaatattaattcctgcaagatattattaggaattccagaataaagggccccaggacaggttaagtgtaggaacactgcactctcaaacactacatcctgaactacaaggaatacagtgttccccaaatgggttagtaacctcatctcatgggacatcaacaaaactcaagtacaaggtgtcctgagacacaatttaggaaatgatggcacagggaataaggaatgcctacaacatatgaagcatcggcaataaatggtcaaatcggtattttggaaagatactctggcttcagggctgtattagtctgttcacacactgctatgaagaaacacccaagactcggtaatttataaaggcaagaagtttaattgacttatagttctgcattgctggggaggccttagcaaacttacaatcatggcggaaggcaaaggaaaagcaggcatcttcttcacagggcagcaggatggagtgagtgcaagcaggggaaatgccagatgcttataaaaccatcagatcttgtgagactcactcactatcatgagaataacatgggggaaaccacctccatgagccaattacctccacctgctcccacccttgacacatggggattatagggattataattcaagatgagattttgggtgggaacacagccaaaccatatcaagggtgaagtgggggaccatggtggagatcagtaaggcaagaatttaaatgaggaaatgatgagggcctgaagactatagtactgccagtgagaatggaatgaggcagaaaagggagtgtttaggagactgactcaaggccctgatgtcctcctgtgtgatgtgcttgagcagattctataaagacagggacactaggatgacgagattttacaatggggtgatcagtactgccaatggagacagcaaatgcaaaacaagaggcacctggggtggggtggaggtgatatgggtatttttagactctgaccttgtagagatgtacagaaagcaactggaaatacgggattttaggtgataaaaattagaggaacaataataacaatatcaactaatatttaacaatgcattggccactgttctaagactctatctgtattaacatacttactattcactaacactaataaatgctactattatattactcctactttataggagaggaaaactgagccacagaaagcttgtttaagtaacttgactaagatcagacagctagtggaggagttgaaatttgaacccaggtcagaagttgggcttttaattgctattctgcactgcctttcacatacagagctgggaatcacaagcatagagttaaagctggaagtggaaaagtcacagaaatttgtagaaaaagttcaatagaggaccaatgatggtggcccaagaagtaacagcatttagttgccagtggagagagaagggcacagagagggaaggccaagaccttttctaggcacataaaatgtgtatatagtagggagggacacatactgtttagtactgtgtgtgattgagaacttgggctcgttctcatgttatttgtggaaatatgtgaggtaagaagaggatctaaaggtagccttgaagaggagaggtaaaaagaagaaagtgcagtttatttttatccagatgtagcaaatatatttgtgaatatgcacagaacaattaaaatattgaaagaaatatctgggatacgagaaattcactgttattttcatctactttatgttgagttaattattatgatataaaaatgtctacgacatgactcttagaatttgacagtgtagtaacagttaatatagaaaccgcatattttaatttttatgggctggttgctctttacagatttcccagagacgtagaatcagttaagtgcattggattaaggatctgaagctcagaggtttggatcctgattctcactaattaattaggtgtttgatgctcatcagtttaataaaggactttgagaactatgttcctatcagtgactgaggataagactgcccatttcattagaggcagagtcacaatatataattttatgcaaactactttattctatgttcatttcataggttttataaggcttaaataaagtcacaaatgtacagttacagtggcagtttcacagtaggtacttcataactcttttaaaaaagtcatttcttccttggtaaaaacaagtgtgaacaaactgtcttataggctattttttttttaatatcctgaagtttaaaggtttacatgccagtctggatgaagattcaccagagcagtgtttctcaaagtctggctcatggttccctattgtaaaataaccatggtggctggttaaacatgcacattccttcccctcttcccaaacttaagactcagcatcactggagattggggtatggaaatctgcattttaacagttctcaggtaatttttttgtgtatgtgtgctaacatttaagaatcattgccttacaagatgttttagtttttcttaatgaaataaaaccacaatctatcctgcctgtggaccctggtatcacgcctgcccaaaggccctaacagctggcccacacaacatttctagctggggtgagtgatccagggcttttcctgctgaagtcaatcggtaaatagtggaaaaggtcactgtttttccaaaggtgcagataccaatgtaaggctacagggatcatgaagaatcagggaaacatgacaccatcaaaagaataaaataaagctgaccaataacaaataaggagactcaatctgtattcaaaaacctctcaacaaagaaatggcttcaaaagtgaattctaccaaacatttaaagaagtgaattccaccaaacatttaaagaagaattaatgccaattctctttaaacactaccaaaaaaaaccccaaaaaacagaagagggaacacttccaaacttattctatgaggccagcatcaccctgataccaaagccagacaaaagatactgccagaaaagaaaactataagccaagataaacatggatacaaaaatcttcaacaaaatactagcaaactgaattcaacagcacattaaaaaatcatacaccatcaccaaatgagattgatccctaggatccaaggatgtttgaatataagcaagtcagttgttatgacacaccacattaatagaatgaaggataaaaatcaccaagatcatctccatagatgcagaaaaacacttgacaaaactaagtaatgtttcatgataaaagcattcaaaatattaggaacagaatgaaattatctcgacataataaaggctatatgaaaagctcacagttgacatcatattcagtggtgaaaaaataacttttttctctaagatacagcatgagacaaggatgcccacacttaccacttctattcaacatagtactgggagtcctagccaaagtaagtagacaaataaaataaaataaaataaaataaataagtaaagaagaaaaagaaaagaaatacaaggcatgcaaatcaggaaagaacaagtaaaattatctctgtttgcagattacatgatcttaatatgtagaaaaccctaaagactctacaaaaaagaactgttagaataaacaaattcagtaaagttgcagaaaaaaaatcacagacaaactatcacaagatcagaaaaccaaacaccgcatgttctcacttgtaaatgggagttgaacgagaaaacatggacacagggaggagaacatcatatactggggcctgtcgggggctgtggggataggggagggctaacattaggagagatacctaatgtaggtgacgagctgatgggtgcaacaaccactatggcaggtgtatacctatgtagcaaaagtgcacattctgcacatgtatcccagaacttaaagtataattttaaaaagtcattcatatatctgtatactaacaatgcactatttggaaaggaagttcagaaaacaatctcatctacaatagcatcaaaaataatgcagtacttagaaatatacttaaccaagaaggcaaaaaatgtgtacactgaaaagtataaaacactgaagacattaaagcagacaacaaataaataaaaaaatcccatgttcatgaattacaataattattatagtcaaaatgtccatactacttaaagtgatctacatatttaatgcaatctctatcaaaatcctaatggcattttttttaaagtaacagaaaaagcaatccaatcctaaaattcatctggaaccacaaaaagcttcaaataaccaaaacaattccgagcaaaagaataaattggaggcaccacacttcctaatttcaaaatctattacaaagctaaaataatcaaaaaagtaaacaatgttaacttttttaagtaaactttttaatgtaaacaacgttactggcataaaagcagatgtataggccaatagaacaaaacagagagctcagaaataaacccacacacatacggtcaactgatctttgacaagagtgtcaagagaaaaggatggtttcttcaataaatagtgctgggaaaagtggatgtacacatacaaaagaataaaagaataaaagttgacccttatcttacaacataaacaaatggatcaacaaaaccatcaactaaacaccatcaagtaaaaatggattaaataacttaagacctcaaaccataaaacttctagaataaaacatagggaaaaagtttcttgacattggccgtagcaatgacttcttggctatgatacaaaaagcacaggcaacaaaatattttttaaaatgagattatatcaagtaaaacagcttttgcacagcaagggaaacaatcaacataatgaaaaggcaacctacaaaatgggaggaaatgtttacaaactatttgtctgataaggagttgacatctaaaactcaatagccaaaaaaaaaaaattaaaaattaaaaaaatgagcaaagcactacatctctaatgaacatgtataaatggccaacaggtatacgaaaaggagcttaacatcactaatctttggagaaatgcaaatcaaaatcacagtgagatattagctcacatctgtttggatggctattatcaacaacccaaaagataacaggtattagtgagaatgtgaagaaaatgcccactgttggtggatatgtaaattggtgtagccactatgggaaatagtgtgtagaatcctcaaaacatgaaaaatagaactaccatatgatttagcgatcccattaatgggtatatagccaaaggaattgaaattagtatatcagagagatatctgcactctcatttctttgcagcattcttctcaataggcaagacttggaagcaactttaatatccatgagacaggtgaatggataattaaaatgagttatgtgcatataatgaaatattattcagcctcaaaagaaggaaatcctgccacttgagacaaacagatgaacctggaatatattatgctctgtgaaataattcagacacagaagattaaatattacatagtaccaattatatgaggaatttaaaatagtcaaaataacagaagcagagggtaaaatgttggtttctcagggactgaggggagggagaaatggagagatatttgtcaaaagcagtctcagttatgcatgatgaataagtcctggagagctactgtacagcatagggcctatagaaaacaacactatttgctaagaggattgatcttatgtgactgttatcacacacagaaataattatttaagagggctggaggaaactttgggaggtgatggatacgtttatggtacagtttgaggtgatggttttatgattataaacttatatggttgtatacttacctacaaactcatcttgtatatattaagcatgtacaatttttctgtctgttaatatctcaataaaatggttttaaaaatatcataattatggagattaatttgcatcatctttttaaaaaacatcaattattgtcatctcttatagaagcttgagatgtttggttcaacctatcaagtaaacttattttatacttttcaaccaaagaattaaagataagtacgatttgacagcaggagaaattaggcatagaggaaaactataacctagtgctgatttctaaatataatatccagtattatacgaggctcttttaatcaaaattaaattaaaaatttaatttctcagcttcactagccacatttcaagtactccacaaccacatgtggctagtagccactggtggactgtgcaggttattttagaatatcttttccttacttagctcaaatacactatttttaaaattaacctgatgtatttgatatagaaaaatttaagtgtcttactttgccagaaatggatgcagagatgacatgcagccccatctgccttctctgtactcttccttcccactcccaaagcaaaacttgctggactttttccttgctgcctgataaaccttatatcatctatagctagcatgtaattgaatgatgccgattatgcaaacttctcacaaaaggcaacttccgcatgaggactatgttcacgggttggttatatctggataaaatttccctgaaggcctcacagagaagaaggtgcaaagttaactttatttcactgtagtgcgttgactgcgtggtgatgcaagctgctgtgctgggctcctcagagggtggaaatctcactgctcttcctcaaagaacttgattctccagtagttcaccccttccccccatggttttcctattatttttttctctatctatccacttgttggtgagtgtgtgaggtatctgtatctgtaggtatttggtgcagtggtaaaaatcaggagaacaaaaataagctggtgaggtggtgtgattctaacatcgtttttctttgtggttgttttccactctaagacatgccatgagataatttgaaaactacaaaaaaaatgaagatgaaatgaaaaatgaactatactcccattacccagagaaaagctctgttaacattctggtgtttatcctaacagtctttttcctataagatgcaaattcagatcatattttacacttttaaatattcagctgttttcacttaatactatattacgaaactcttcatttatcattaatagtctttgaaagtatcatttcttaatacagatgtcccataatttgctttaccttttccctcattagaaattaaggttgtttccaaatattggtaagacataatgtgacaagtaccaataatatatattttgtgcatctaagcagtatgacaaaatagaaaaaggtgaaaaggtattaatgtacttgatgtatttccaaactattttccagaaaggctgtaacaatttatactcccctatgtaggaaaggtgagtgtcttgcctcacctgaaactgaatgttactttaaaaacatgtatgctaatttgctagagaaaatagtatactattgtagcttactttgcattccttaaattattaatgaggattaacatttttcatgttcatggggcagctctattttttcttttctaaacaggatgtcttttgtctgtttattaaattgggggcggttttacctttgcttcttgtcatccttccagttgttttatgaagaagcctgatttggggctttttgatgaagccttgtgagagcatgggatatatctgcttataggaaagtgcctctaggaacatgaccattctctctgttcatcctcttaaactcctggtgctctcatgttctctcttcctttccttatcagcccccgatctcatatgctactcatgaccatctgttacaccttagagggaatctaaatcatctaatcactaaatgatgcgcccactgcttcatctctacttatacagtgaaagatcatcgctttcatcaaaggtattttgagcatcaaattggaaatcctgggaaactcctgggcgtggaggacctcagatgtcaccctgcagctttctctgtctctgagaacagatctagagccttagtgccatcgccactacagatgggctaaattcaaggactgatgactactcaaggctgctatggagttaaaataaatagcataagaacatgaatgtgacacaataaggttttactggaagaagagttagttttaaaatgacaacaattgtaggaaaagccaaaatttattatatacaaaaaaacaaaagctgttgacatagtgttcctaacctttttttgctcccaacttttctgaaaattctaattttttcctgccctaatcttttaaactacattttttctcaattagatatttaaaaacattaaaaaattctccattgacaatttttcactttgatttaaaaaggtgaataaataatacattacctttgaaactaacagtgaaatgatttcttttacactgttgtcgatcagatcatctatttttgaatggtactgttgctagatattaaaagataaaaactcattagttgacatggacacaaaacttttgtcatcagtcataaatgctctaaatctactagttatgacctatcagatttatttaaaatgatcatttagaacattaaaagaacaaaaccttgaaaatgatccacccagtcaacactttttacattgtggtttgaaaattttcccatgtgcactgttgagttaagcagctaatggggttattatttagatgaattgagttcttattcttattcaggcagaggaatgtgaaggatactttttgtcttctcctctataattaaggtggccatgtatttttctaaagggttggtttagctggagaagcaaaaagactagaaaaagatttaattaatactgcatttcatgtctgacaactctcattcataagttattttaaatgtgctctagaaataaaatgagctcccaattgttcactctaaaaggactttttgtcagcacagggagcagcagtttatacaattcttacaatatgctcgagcaagggcaaaattagaatttcatcaacaaaggtgaatagatggtaacaaattaataggccataaaaggtataatgaaacatcactcactccccatagttttattaccgcttcctcatgaaaaagatgcctttaaataaataccaaaaaaagatgtatttaaaatcaacctgaaagacttttttttttctttctttagagaatactagagggctccattcttaaattagcagaagctttggcttccaaggcttgtgaaggcacatccatttaaacagtaattcttcctttagaagcatttatctgacaactgattgtccccaatagccacttcacagaaaatgtgacttgtaaagactaaccctatcttgatggttcaaggcttcttggaacagctaacaaaatgcatagagtaaaagtactcaggtcaatataaacattagaccaacttcactgctggttgaatggtttcttaagatgtaagtttttgaaagctattttttttttttgtgctgaaaacatgtctcaaagtttccacacagtacaaaacatcaacttaggtctgctttggaatactcaggaatgacactccacccctctccccaagggttctgacagttacaagtggttatcataaacctgcataaataataaagaaaggaaggataattttggagtgtctgaattattttctttttctgtgtgagtctgagtgtgtgtgggtgtgaatataagtgcataatgatgagtgatctaaaattaaccacactgatgtgaatgtggaattttctgggcacatattgcacccactaaagcatgtctgtctcacttaaagcctttattgattcccaagtttgtgctccccagaggataaatggaattgaaacatagagagtggatttctattccagtagtgctgatatttttgctttcgagatagcttgaagagaaggaaaacgggagagaaaaggggagagaagacagaaaaacaggtagaagaaaaagagcctgaaaaagctggctggcagttaaacttctgatccagtctaaattattaataattttctgagccagacaggtccacacatgaacatatctgagaccagctgaacaattccagtgcactggctgatgggtagggtaatccctccacagacacacttacaaaaaaggccccccagctcctggctgaaagctgtgcagctgactgtgcgatggagaagcttatgcaaatgagctctgcctggctctcccactctgccactcttgtttcacgtccttcttgctccagatcagtgtattcagcaagaggaaattaaatgccacgtgatacacctctttaggggtagaagaggaaagagatacaggagttgggcttcaagcatctcacttccctcttacatggaaagtgctccaaagcatgcaggcattgaggcacccagacttccaggcaggttcctaaacatgccttatccccaatgtttttctctgttttcataacttccattttttgaattcaaagtgatcaaatgtcatcagaaagctattgtatataaaatacagagcttctacatgttaaacttttgggttgaattgattctggcaaatcttaaaatcaagggacgagccacaaaagaggtcattgatacccattttcttgaaaagcagtgaaagtcagtggacactaggaaccattaaattctcctataatacactcccgtagattgttgcttgctttgatacctgatctagccataagcagagacaaagagaaaaagaggaagagatggggagggagggagagaaaatgagaatgaatgaacaaaaacaaacacatacaatgttaaaaacaaaggaataaagaagtatacatctgaaatttaatacccaaggggtaaatccaaatagtgtgaggtttttagatttgcataatatgggattctgctattgtaaatgtatctggttagatatgacttacactaatattacaactgctgggaactttcagaatctgctctggctgtgcagttggtggaggtcgtataggcacatgagtgtgagagaaaagatggcccgagaattcccattttacatatatattctgcagacaataactcacatatgccatacataggtatacaaaattagctagaaaaagtcattcattaggggacccaggtaactttctttttcttcttctgtgttttttaatccttgctaaaaaatgtattaaataatgtatttcaggaaaatgacaaattaacataaaaggaagttgtagaatgaaggaacaaggatgaaaccagaaattgaaatatgtcaataaatgtaattaatgattatctgtaaaagtaatatttgtgtgtgcacgcatttaaaataaggcaagtcaaaaactgccaaaataacaatggttattgtgtgttcatctggggtgggtacaggagtgttcagtggatggttaaaacattctaagatcagtggtgtgcttaaactagttcataaaagcagctttttagaaattttcagataactttcaaagacaaacatgaacatgcaaaaagagatcacaggtaaaagtttatctgcatagacatttttaagttaaaattgataggttttttttcccatttagtataacagacaacatttttggtacattaatgtttccaacaataaaaacctataaaatttttatcagaggctgggcatggtggctcatgtctgtaatcccagcactttaggaagtcaaggtgggaggatcgcctgagcctgagttcaaggttgcagtgagctatgaatatgccactgcacttcagcatgggcaacagaaggagacaaaaaaagaaaaaatactgagaaaaggtaatgcttatacactgttggtgggaatgtaaattaattcagccactgtggaaagcagtttgaagatttctcaaagaacttaagacagagctaccatttgaatcagcaatcccattactgggtacatatccaaaggaacacagatcactaaaccaaacaaacgaaaacaaaaacaaaaacaaaaaccacttgaacttgtatgttcattgccatgctattcacagtagcaaagacatgaaatcaacctaggtgtccatcaatggtagaccagataaagaaaatatggtacatatacaccatggaatactagacagccataaaaaagtacaaaatcatatcctttgcagccacatggatgcagctggaggctataatcctaagtaaattaacacaggaacagaaaatcagatactgcatgttctcacttataagtgagaattaaacactgagaacacacggacataaacatgggaacaacagacactgtggactagtagaggggagagggagggagggagatgtggatggaaaaacgacctattgagtactatgctcaatacccaggtgtaacaaaactacacatgtacccccatatcgacaacaaaagttgaaatttaaaagaagaaaataaaattcttcgaatacttcaagttggattgataatcttagattctagggctttgttagatttcaattcattcttaagttaagtttctccacatctgccctcaaaggcaaactgtgcctgctttcccgcaggtgattctgaacttacattaagataaccattcaggaatccttacttcatgaagcccagggaaatcacaggtcagacacagtccaaaatcctggcctctctacaatcaggtgaacagcaccacttcacctgactgctgttacacaaagacactcatgaaatggctaatcagatgccagtgaattccagctttcttaaaagattttggaccttgtcttggggtatataatattttaaaggtactggattgttagttccagaaatggatgcattttaatttaactgagaacaaatttggcccaagtagggccccttgctcccccgaattgccatattaatgtgttttcaccttcatcctcaactaatgggaccatggaatgaagtggttctgagggctgatgaatgcctacagcccaggtagtcatctgcttttgtgcagttacggataatgaggattctaaacactgaggtggctttgtgatctcgacatctgtccctgagggactggcctgagactgctgactcatttcacacagctgtcacatgagcagatcattcacccactaatcactccattaaaccctattctgggcctcagtggaacatgtttgcatcatcatgtagcatgtaagaaaaacaggatcataatttagaagcacagaagggaatgcattgtgaggaaggagttgggaaagttttatcccagcgatgacaatataacacatttactagagattttggagaggtaatttctttataatttagaaaaaacattgctgctatgtttaactatgtagtatatatttttacatggttccaaattgtctaatgatctagtttttttcaacaactttgttgctttttataaatgaggtccgctggctcacctgtatatgtaatgtatatactaattttcaacaattccgaaacttatctcagcatatatacagagggaaggcctatgcaattatgtgggtatgtttactggagagaaaaagcgaagtataaaattcttttgcaatgaaattcttgtttaccactttttcagggttgctaatgggttttacacctgcacattctgaactatgttaattgtgtgaaagttgtggggaactaattgtctctggtgtgaatgtacaggtgcacacataatgaacagtagtagattactcttcaaaaccacccacctattaatgtaaagaatcatttgacaatgtaacaatgttcatcatttgtgtgtgtgtgtgcctgtttttccttttaagtactacagcaagttgtttcttacaggggaggatttttaaagcagtgacaacaaatctgttcatccactcagcaaacatttactaaagtgcctactgcatgtcaggtactgcagtgtatgttaaaataagaacaaacggataaacccagtatgaatggaagatgattccacaaaccagatgagaaaagaatgggtttatgaggaaacctaagataatattctcaggcagacaatcaaaggcttacatctggttattaaaaaaacatgaggaggtaaataggagccactggtatctaagctagctgcctacttattcagataattagatataataaatcatgttgtaagtgatcagagaatggtaattactgaacattctataacacatatcagttacctgatatatgtgtaaggttgtatgctatggtaatataaatacatttttttttctgctgaattgctcaaagaataaaattgtgtattcatgcataaatataaattatggccaaatagctaatgtctatacctggggcaataggtatagaattcacaagtagtaggccttcccatctattttcacagttaactaagcccctctgcttagatgagaattgtcagcccaggaagagtcaccctgagtttgattcccaattgtcaactgtaagacttgtaagatgtaacttacctacaggacacaaagacattctaactcacgacaaaaaaaaaagtatacactagtcaatcctttacgcataaaggttttctaaccttgtacctcagggattctggggtagtattttaggacgaactgttgtggaggagggcagaagtctcatgacacaggcctgcctcttccttacctctgatgatggtcacatcctaggccatgagtgggaggaaagactgtatcactggtgggcttgtacctcactgaaatccaccactgggttcatctgtatgaagtgactttgggtgtggcctcctggttcaagtttttaggggctatatgtcatctaaagctccaaacttgaaattcttttggtattaaaagtatactgtagataaatgcttgaaaaatgttaattatcactctgctcctatagttattcagatttcaatttaaaagaaggtgaattaatttggttttaaataattttatctttaaaattctaagaggagtttataaattctgcagactaacaggggagaaacatttccctcgtcattatttaaggtataagtatttagtgttttcatgaatctttggactattgctatgttattgtaagctgttagccttatatatgcgaacacagaagccaaaaatctgaaaataaatttatataattttaatttgaaaagatgaaaataaaaaatatacatttacaaaaataataactcaaatgaaatgtgcttttagaaaaaaaaatgagacttacccattgactaccaaactggatcatgccatgggtggaaaaaaaaagatgatgaaagagaacagaagggaagaataaagaaatgaagaaaaagtaattacaatgggaaaaaaaggcaacaaaatcaacttaaaacagataattgaagaaaaataaatcaattttcacccaatcaccactctcaacaaaaaatcatggggtaaaataaaattgtacttctgaatataaaaccaaacaaaatataaataaaatagaaagaataggatatttattgataagaactaggcctagatttttaagtctatttcaacctaaatttttaaaaatggaagctactgtgtaaataaactatttcacactttttcgtgtgtcttacttttatagatgcaaactctggatactctagatttgtataaacaaaacaggtagctttccagctttctcatttgcttgtaaaaagcaaggtttatgtaaatgacacaacacttcagctgttaaaagctatatctaaaattcatggccactaatgcaattttagaccatatttatatcaaaaaggagaaactgacatgagcaaaggataaagggcattctgttattatagtaaagatcaaacgtttggtgctagagaacttggtcttttcaatccaatcaagagaatgccttgtggaaagggcatttcccatgccaaggcaccctgtgctgcctttccccatgtggcacattctacatacctcttgtcctccatccagggcacagagtttggtgctttgctttttggcatcgactaatacattaaacatagtgcaaacggaagctggaatgcgcaagtcagttgttttgcttgccttttgtagcttgagttcaaatgcagttcttgttctagtttttaaaacatgaattcagagtaagaaattctgctatacagctcacctgttttgtaaaaagtgaaatcaacactacaagatgctaatttaaaacatgcaaataaggagtaagcagtgtggcagtgcttgggagctaaggggtgggatgcttttcttttcaagtgtctcaatgaaagatcagattgtcatatttttatattaagcctagcttcatgcagtcactcaggcagtattgccacccaaatgaagctttttgttatatctagagtaccacatttaatggaaaaaaaactcataatttcacttaattgtctgaattaattgtctgaatttccaagtagaaaaatcacacacttgtatgcatttaagcagaatatatcctctatgtgaggtcttaccaaattagaaaaaataagcacaaacctagaaaaccctaaaacatggtaatcaatgtacaacagacaatgtgtaattcttttatgtcacttacattctctttcaaaaacctaaaattgcaggcaggtttttgaaaggaactgcatcatgagcaatttggaattggttttgctgaagtatcctatgaaaatccacagaatcgagacatcaaaatcaaagatgatttttaaaaaacattaaactacctaatccagggccttgccttaaggggccactgaacattattctaaagacagattttttcttggtttcaagatttcagaaatatccaattggtctaaccagtgtttgaacacttttctaatatgtggctccatattgtccttgtatatataatgaacaaggacaatgggaaaaaaatgcttgaccaattaggatgcaaagctgattttttaaaactacgataaaatgaaagcacatttggaagaatatgaagcctcataacttatttccagttaagtgataaagaatgtaagcagatagttggaactcatctgatgtggacagaaaatagttagtaatcccagaacaactgatggtgctgatcctattttgagtttactatgccatttcacagcacacagacacagtacataatgcatacagaacataacagacctttttcatacgtctcaggagatattaccttgggaatttaaagcatagtattcccagagagataacaataagccctaaagaaaccattaatatggtatagatgttactgattaaggcaatagttgggagacctgaaaaaaagtatccagccaatttcatcaattacatgggtccccagaatttaatcaagataacctaatactcattaaatgttggaatagtggtgcataatgaaacctttgctgtgacaataatatattaggtacttgataaaaagtgatatttttgggtgctggcacattaagcagcaatttgaaaatacatgtctaccttttgacacaggcctctagcatatcactggccattagtttaagtctttgctctaagtggtgggcaaattcctgttctggccagtgcagatcaaagacaaacatttgcagtgcatcaagcttccaaaaaaggtcttctgatgttgctgagccattgctagaagaaaaaggaaaaatgaacatcatgaactccccgttaattaggtataccattaatacattgttttttcttttctgcatcaattgccatcagtgaaaaaaataccatataaagtctctaatgatccaatattttctttgttcagccttctaattgttcctctacaattcttaataaggcagggcaaggagaacaaaatagaaataaatatggtggtagggtttcatacaaagaggtaaaatggatatgtatactttactaaggaagttatattgtgtacataagaacaaacattgtaactgttctttaccaatctctaggataaagattcttgcaaatccccaaaattatgttttatgcaagaaaatccttatgttagtaaccagtacctttgccgttattcatgcatatgtgcctctgtcaccatggtggtttctgtctatctacacgtgtgtagaacatagggtccttgaatttctcaattacaggtaaagatgagacaggaactggaaataaaacgggctaggtagggaagcaatcttttattttcattttttgctttttctggcttattaaaacccaacttagtgcaaggtattgtctgacagagaaatgacattcagggtgctctgaagatggagaaaaacaatgcgtttcaggtccttatatctaactgtggagccaagatttgctaagcattcactattatggtaaaattactctacaggagtgctatcaccccatgtatgaagataacttatagaagagttacagtaacttatagaagttaccttctagaaggtaacttatagaagagtacatataatattttggcaaatggttattactttccattatgcaagtacataggctaatacagaaacaagtgttttgaaagtaaaatattcctacattaaaacatattgaaatttaaccataaaaagcataaaagcaaaagcaaaaaaaagctgctgtatgattcatttgttctcagctttcccacaattgcttcacatatactaacttaaaatttatatttctagtttacaaaagaaaattaaagaaataaactcatttattacaacagcacaggggaaaatacctatgtaacaaacctgcacattctgcacatgtatcccagaacttaaagtaaaattaaaaaaaaataaattgtttaaagcaccacattgtttcgctaaatatatctttatgagctagcttagaaaaaaaggcacctcttgctcttgactaatgaaaagcttattcctgccctccaccctggcctcagcgtcaaagctctatcacaaacctacactgcttttctcttctcattctgccagtaattcctcctgatctccttgtctagccaaaatgccctcagacttaagttctctagggaccaatcatagcaaagcactgaacactcccgtagcactttactcacttaaatctcttcaccgtaatattcagtgcctcaaatgcaccattaaataagagaactagacaacaccattctgatactacagtgaaagtgttgaaaaaaacactacctttatttctccttttgccatatatatcatacaattaagagaaaacaaacaaacaaaatctcccttcacatccacagtgtacagcttggtagattagaggaactgagttttaagaataactgaatacaattggcaaagaagcaaatctgcttcttataatatttttactttggagaaatgtaactatttggaatgtatatattctttaacaacacaatgacaaggaaaaacatcataaaaacaaaatctctaatggtaaaggcagaattctactaaaaatagattttctaataatacatggcaatcttcatagagaatatggttacatttttcttctgtttgattctatggtaagattcttgacaataaatgtgtttaattgggaatgtaattaagataacaagtgtttgttataattagatagatatatgaaaaaaatgtgagtaggctttctctggagttggtacatataacctgcaatttattcagagctttttcattttaaaattatttctaattggtggcctattcctaaaggtattattaacagattaaagaattcgaatgtgagtagtagactctgagataatttcctaaaaatgccagcaggaaacttaacttgctggcattcatttctagagaaaaaaaaacagaataaagatttatatacagatacatatgtcgatgagcaatccttgcatgatttatgcattggtaggcagggatgtatcttcaaaaccatggttgcttttatattcttcttatttaatcagcagttgtatttttaattctttatgttaaatataaatgtttctttttattaatgtttcaaacttcaaaaaacaaatggcaataacatcataacattatgagtaattctggacactctgacaaagaacctaatgttgataaccttggtaggtaaagataatggtgatcaacttgtaaaacacatttttaaatttccccagaatggtgaaagcacaatcactttacttacaaagccccaatttgtcattattcctgtcctgaaattaacatactttaaaaaagggccctcaataagggattcagagtttgtacaaatcccaaagttaataaaagattactaacaaaaaaataaatttcgcaggataatgcccatgatagtgttcttggctaaaatcaagcgttaaatagatgagaaattaggaagaaaaggagttaaattataaaacagtgtaaaaaagaacaaaaaaatcatacacttagaaaggttcattatagtttgtaggcaattttctgagcacacacagacaccactttacacactctaatgaccaaaagcatttgcctgtaagaaaaaaaattcacatgtaacataatatcctagtgagtattatgaatgcagttatgatgttaaacttggagaaatattgccaaattactttgcaagttattctctttcttggtcttttcctatttcttttcttgattgtgtgcatacctgactgggtgtggatttgcagttggtggtgggataggtagaaaagtagcaagttcttaaacacaacgttctatgacagcagaacaaattaatgataggagtgaggaatttgtagtcaaacgaacctgggttcaaattttgcctctgtcacttatttgctgtgagatattgggtaagtttggtttcttagtttctttatgacttagtttccttaactgtaaaatggggataatgatatgaggttgttataaagattaaatgagataaataacttggcactgtactggaaacagtaaaatctcaataaatggaagctatttttcttcctctcatgattattctttctagttgatttcatatgagatcttgggcaaagcaggtaactgcccgagttttcccatttgtaaactagtactattacttggttctgattgctgtgaggctcatagttttaaaaactataccattataaattataatgatgatgcctgatgatagtaataataacaaaaacaacaatgtagagtagtagtaattatcatttactgggtgcctaggatatgccaatagtactaataatttactgagagcctaggatatgcctcaatacagttttttttttttaaatcatcacaaaaacatctttcatttaggtgtcataattgttttagagttgaggaaaaaactcaggctaagaaggatttacaattaataagctaagatctaaattcagaactgatcaatttaaaagcccattcctgttcacttcagtggttcttagttgctgattctgcaataggcaagctcatcatgatgtgaagttaataaatatggtttttgatgatataaagactatttaaaaataccaagatgtaccaactatataataaaagaacaaaagaagaacttcctggttttggcaatgaaagggcctgcaatgatgcagtactgttttttaaaagttgagactaagataaaaatagaaaaatattatattcttgaaaccattcttccaaaggttttctacttgcacaagataagtcatctgggcagtaataaagctggagctaagaatcctcaaaatgctttgtatacataaggagaactctgattattttacttagggtacaatgtcaccaaatgatttacttagggtagaatgccaccaaattattcctgtcccacagattatatatgaactacattaaactagcgtgttttttctttttaattgacattattcatcacagatatgctaagcttagcttactagcttaaaaactcaaataaaaaaaaaaaaacagtattcctcaaccaacgatgacaaatgccatgcagtctaaacacatctgcgcagaacacagcccaggccatgcaccagctaacacaccaccaggaaataagtgaggaatacacacgtggactcatataaagaaggcatccacgaagcagtagaaatgttaggaatctgtggaagattaagaggcagacttggaacttttggaagagctacattgggaagactgttggcgatattcctgtaaagaaacaaacaacgtgggaagggaccaccataagcgataactacagatggccatgtgtgaagtcataaggtcagggttgaagaggcaggtgctctacggacactaggtaagatacctacttgacaggctgccatgtctcctgctcaaaacctctgtgaattgactgggcgatggaagactccatgagatccacatagcggacaaccaagggtacaaagatttcttgcaagtgtttgtgaaattttccattacacaaaagtgctgaaatagccaagcagaaacagtgtttgtcagagggataatatcagacatttggaaaatatgggccaaaaaaacacgttttctgagagagtctgacacagaagaactgataaaatgcagatgagagtagatcataccccccatattgaatatcatatcatggaaattgatcaaaaagtataattagccttctatatatggctgtcaaaacacaaatagattatatctctctaaaattctcctggcaggtggtatgtttttattttctaagaggtttaacacataggcacatgaccactcgctggaaattcaagggagctgccagctcccctgaaggtcctgacacatgtaaatacagcaattaagcagagttacaatctctgtgctatgctgtgtatcacagaggagctaaaccttctcaattctaagaggtaagcttgatgacttgtaaaagctattcttgttcactaggagggtgtctgtgggtttgggaatatctattttgattcatgaacattatagttatttgtggattttctttttagtcattcaattttgcatatctgtatttaaaaacagcacatgacctggattttttagttttccatttgtctttaataaatggtagtatggaacatcctacctaaagtagtgacagaaatcttagaatttgtgctacaaggctgctgggcaaggtatactcacctttttcaggcgatgaatgttttctatgcagatgatacaattttattaaaatataggtgagtatatgcctaagtttcaccattaaaaaatagagaatctatatgaaaacagtaatgctaagtaatatttaacaaagactttattttagatgacagtactatagattgtaaatatttctcaaagaacatgtcctaagccccattgtggccctcaaagtgaaaatgtgctgatttaaaaatatactctgtggtcaggaaaggtattcctgaagagacagaagaaccttccatggaagacttaaaggggaggtttccaggtagagggaacagctagcaaacaagttttgggaaggaataagcttgggtctttgcagaaagatgaaaggccagagtaactgcaatagactgagggagggggaggggcagcccatggcagggtctagatcctaggactgagtaaggagtgttgctcttagtgggtgtgatgggaagctttatgatgcttatgattatgcagaggagtgacatgatatgatctctctggctgctgtgtggaaatggagtaggtagccaggagtgaaaacagagaaaaaggttaatactcagttgtttactgcaatagactaggtaaaggatgataatggctttgactagggtgaagaggtagaagctggggaaaagttagtaatctcattcacttttatggatttgaatagctatatatgcttatagttactaaatctaattactagcaactccaatagcagtgtcttataaaatattcactatgacaacttcccacattatcttcttcagagcaaaaacatcccaaaagcctaatagtgttttagctcttgtcaaagtacatgatgtttatcactgtggcatgtatatgaagatggcttcgatatgttactttatgcgtttctgaaatttctctgaggctggacaactacaggcacataaattggtgtgggaagtaattctaaacacagaaggaaatataacagatttttttttctacctctaattgatatgggttagtattttttgtggttaaatactcttttcccagctcagctatatgctaaaacatttcccattaaattgtgaacaataatcatatttaatgataggtgtcttatttaggagactaatgttatcttaatgatgttttcattagcacactgaaagaagctttatttattcctggagattcaatcatcgagctagaaggtactatagctcaaataattcagttccttttatcaaatgccacctaaataagcatgctaaactttaaggataaaatattctcactcaaaccatctaattcactgtagtatgcaaattaaaaaatatactgatatctgaatttattgggtctctacttaagaactctcattctcttcttcctcctcctcatccctagcatatttggagtaccaagcactatgtgaagtcctatatgtgccttatctcatttaatcatcacagaaactctacgagggaggattttttttttctttttttttttttagagacggagtcttgctattgttgcccaggctggagtgcaatggcacgatcttggctcactgcaacctctgcctcctgggtttaagcgattctcctgcctcagcctcccgagtagctgggattataggcgcatgccaccatgcccagctaatttttgtatttttggtagagacagggtttctccatgttggtcgggctagtctcgaactcccgacctcaggtgatccacccgcctcggcttcccaaaatgctgggattacaggtgtgagctactgcgcctggctagaactatttttttaaacttatcaataaggtaactgaggcatagagagtttaagatacttgtttaagatcatttagtcattagtagaaccaggatttgatagaaaaactccttgttaacctctataaaactaccattcctcactctgacaaccaattagtcatcaagactggtgtattttatatccttaatatctttcagtaagttaccgtgctctcttcatcaccactgctgttgcaatagtccagccctctcatctcctgtcttgattaatgcaataataacctaactggtctttaggatcctaatatttcctctgccaatccatcttctcaaaatcataagcagaggggcttgctgaaatatgaaactaagaatgtcactcctaaagattataatcctttagtggatcattatgacaagcttgaaaagcctgagcatggtatgaaagctttccaagacctgtctacaagttacttctccagctcatttctgttgtcttacctttcatttcctgtgatacagtcataatgactttcacgattcaatatacacctgctcctcaaatcctttctagaaatgcttccttctgctgtccccttgcccaattactggcttctcttgtttactctctaccctggacaggtttccactgtggttcttgtcatacaagtggtcttctcctgctgacatatttcttgctgacatatttctcgctgcctacaaggatgtaaggttctcaaggcaggaactatgtctgtattctaagttccagaaaagtccctggctcagagcaagtaatcaaatgtttgttggatgaatgaatatttgaaggctaagattattacattattattgtattaaatggcacttataaaacctattgaggcctgtgtatacgcctcatactttgtataaaatatatagcattaaataatacagctataagttctatttttaacccatatgtacaagatcggactgctaaaaattctaatgaatataaaagttggttattttatgtttcttattttaatgaatgtggcaaagaaaggattttctctggtcagttatgaatcttgacagcaaatgattatatcctgcagaatttaaagaaaatgaagattacctatatttcctatgaactacaaaaaatcttaaattctagccaaaagtttgctcagaattcagcaaagagttattttttatttgaaaaaaattataaacccacacttgaaaattttagaaaattggcagtattatttcattggtaattagagagaaaggggaaggagggagtgggggagaaatgggggagacaaagagaaaatgatggaggggagagggagaggaggggtgggggagggactagaggagaaagaaagagaaatacacaaagagggggaaagaaaggaaagagaatatttggtttccaaagacaagctacagaaatacaccctacactacacttgtctatgtaaatgtatgctccttccttcgttgtccatatggcagcttgcattccactcctatcagacactgtcaaaaggccctcttaatatgtagcctgaggcatcagagtaagtgcttctatcttctccatatggtttaataaggataggttatgatttggggctgtcacctgtccaaatcaagcctttacaaagcacccattacaacagttcattgtaagaggcaagttcttaatgcggccacatccaagaacacttctgacaccatactcaagtatgagagagtgaaaagggctgctcagaatgagtctcaaaaagtgattaccgcctgaggggaaagccagcacctatttttcagataaaaaaataacttttttcccgaaaagattccatgtttccaaatatcaccttgttagaaaataatgaggcatcaatgacatcgagccctatggtacaattagaaatggcaaaaagaaaacaaatggcttaaatataagctaaactcaggatgcaatatgcccaattattttgaaaatccccgataataaattagtgttgattattttcatatgaaaaagcctctttcatttacaaaagtacttgtcataggcttttagtagtaagatttcaacagagaatttaaatttaaactatgatccaattaataacaattactgagacaataatcactgggtaaaataaagaataagcaaataaaagaattcatatattgtttttagggtaaaaatatgctgctgactcttgaacccatataatccaattttatagtgctcatcctcttccaattagctagctttagtggattactagaaagaatgatttttctcctcaaacttctcattaggcatttcagaaggaaatgggtaattcattagcagcaaaacaaacagacaatacaaatcacaataaaatcaacagactttgccataaaacaattatttaagagactaaaaattatatcaaccctgagcaatgcaagcacagtggactaagaaaattaataagtcgctctccatgttgacaaatgcatataatgaagacctccatcacagaaacagaaaatatgaatatgggcttcaggagaaaagccagcagaactgcagtctagaacagcattatgtaaaaggaaaacactcttctctctctctctctctctctctctcccgccgccctccccacccctcaccccttcctccctccctgagatttaggaatagcacccagccaagaatctggcacattaagtaggcactctataaatgtctgattattgaataaatatcaataaaaatctacctcctaagggaaactccaagaacatcccatttaagtagactaggaaacacactggattctattgtccttttaattaaaaatttgacaagtaattttatatttggtaatattaatgtatacattaactagtataataacccctaaaaccacacccagttcttccttttcccttggggcacttgctaatatatatttatacacctatacatctacctagggagagaaagtgacaagaagtgatagaacacagctgttaaaatgtttcttacttttttgggcaacacatccaaatttaaaactataatgaaaaaatttcatagaatggcacacataatttgagttatacttctacaatctactgcatcaagttatttgtgtatatatgtgcgtatcctccactagattttatgtttttcaaggggaggaatcatttcttatttatacatgtatttgcaaggagcctaggatttgtaaattgtaggcattaggcacttgtttcttgtgaaactaattcagaaaagcttaattaaccgaagcttataaggcaaagataagtaaagaagtcttatggtccagcagtcctcatgctgttttttaaatgaaattatgtaatattaaaggcaaatagaaaagtctgtaattttactcaagctatgcatagccttctaatctttgagttaatgtcccacaatacttgccccatcaatgggaatgattgagtacagctatatcatgatcgataactctctcaagggtgggtttcttttttttttttttttttttttttttttttttttttttttttttgagacggagtctcgctctgtcaccaagtctggagtgcagtggcgcgatctcggctcactgcaagctccgcctcccgggttcacgccattctcctgcctcagcctcccgagtagctgggactacaggcgcccgccactacgcccggctaactttttgtatttttagtagagacggggtttcaccgtggtctcgatctcctgacctcgtgatccgtccgcctccgcctcccaaagtgctgggattacaggcgtgagccaccgcgcccggccaagggtgggtttcttgatgcccatggttttcagaagttacaggtgttcctgtgatctgttacaagaaacacactggcattttagaataggtgattatctttaagccactaaaccctatgaaaatataaaaagcagattaaaatttttaaaaagtctacaagtaggaaagaaactagagcaggcagggcgcagtggctcacgcctgtaatcccagcactttgggaggccgaggcgggtggatcacttgaggtcaggagtttgagaccagctggaccaacatgcagaaactccatctctaccaaaaatacaaaaaattagctgggtgtggtggtgcatgcctgtaatcccagctacttgggaggctgaggcaggagaattgcttgaatctgggaggcggaggttgtggtcagccaagatcactccattgcactccagcctgggcaataagagcgaaactccatctcaaaaaacaaaacaaaaacaaaaacaaaacaaaactaaacaaaaaaagaaaaaaaagaaattagaacagtactgtggaattcaactgaggggaaaaaggtagtgactccttgcttttatatttcatttaccatactggtcagtaaaacaaattctgacacaccattttgaatccaatcaactctggggattagagttaaatacattctcacattttggcccttatttcatcatttgtaaagtgcatacttataaaactaatctggcatgcacagatttgctgcaatctagatgttataccctttctgcattgtccctggtttatgtatatccagatatatctataaacaccaattcgtgaatttcagatgaacagctcatttaagcacttgaaagagaataacacgcaggtgtcagccttccatatttcaaagcttgaagattaacctaatatacaatatggtgacctaacagtccttcatttgaaagaaatctgaaaaataatctctgatacagcctaagtgtgagaataacccagcaggatttccacctcttcatttcttaatgagttttttgataatgagaggtgactttgccagtcactctgggctctattatggctaatttgactccacttcactctccttgttaattattaacactagcctttttatcctcatgagaccacattccaatttttcctttttcgatttttatgagcccatctttacgaaggtgaaagtcttcgagaataggttttcacttagtgtagagcaggaacatttattattcgtttaggcagagatgctgtgacattgattatataagcacgggtgttctttgggatgactttaatgtgctagcaatgtgaaaaggctgttaattaaagaagcagcaccgtggtatttttcagttgggaaccagttcccaatagaatggtcatttgccacttgctagcatatccacagattaaaaggtgactagctccaagggtttgcgtttcagtagtgctgaaagaaatgatttgtgccatttgcagatggctttcatttgtcagaagtggtcacttgccttatctattattgacagaacaactatggaaatagtgtgcaagggtagaatctatttgtactagctttatagtcactcagtatcattgaaccatcgtgccaattacttcattatgaaaacatttatcttccctcaatttgaatacatctctctttcaaaagtgtttccttagataccatttaaactgattgcccattaaattacctctttagtaggggagtagattggggtagatgaaggcagggtagagagcgaagtgagagcttggtcttttttggccagaaatggaggctgactttgttttcatcatcagttttgctctgggagtcagtgagtgagtctgtgaggggtgggacattggggacagttgctaaaattgtggtgcagctggtgctcttcccttgaggaaaaccgcatttcatctccaagggttctccacatttcatctccaagggttctccaagctatgactttccctaatcatggctaactgtaaggaaaggcacacaccccagacagatgtttttttatttttttctccttaaaatagaaaccgaatttgctgtcttgaaccttccctcactaattagttcagtctctagaagtcttgtcacagatggttcctaacatacatgctgagaccacacatacctttatctgatcctttctgtactctttaaccaactcctttcctctgcccccgacaacacaatgcccttataaatatttcctcattaaaaaataaaagttcaaggactctcttgtcttccttaaaaagatgatattattttataaatgcccacagaatctgctttttatacaatgaaatgagactgaactggagacccagtactcaggctctgactcatctctgtccttaactccctgctgtcaagccccccgcccgagttcctgcctctaggcattaggtttccacagctagaaaatgaagagttttgtttaagatcccttccatactccaaaagataaaaaactatttttaaacatcgaagcatacaaattttaatctaaggaagataagaaaccaattaggacgactgaattattcatgaaccaccccccaactcagctataaagttttcaagccactaattaagtacaaattctaactaatgtctccattagtttgaaaggtcttagtaattttaaattttgggaaagcaaacataaatatgcaacattattagtaataaatcacaaactgtttaaaaatctaaatataattagcagcctattttgtgtaacgcacacacacacagactgatgccgatgtaagcaagcactgtttttcaacaaattaactcccttcctaatattggacattcagagctctctgtcctattacctttggctagttaaagttgtaattatttcgaatttagacaataactctaattgggtcaacatggtaaaaactgtaatgccatggccgcaatgtaagaatttctttttctttcaaggggtactaaaagaatagaagttcaatattttcccatagttttccaaaaggacaatttgggggcagctgcaggttgacattaaacatttgaattgaattcactaaataactcagtatctaaggaatgtaataaaacaaacacacaattattaacaatggtcttcagtatcaccaagggtgatattaacagctggaagaattatgttttatcagctactcagtggtattgattttggatggaaacttgtgagtttggggtaaaagtcactgcattttatttcagttccccagatcacaccacactctcagtaccaaaaggaaaatatgacactggggaacttttctgtttacctctctacatgggggagctgtttttctcagaaataattgaggttttctaaaatctgcaaatcaccataaaataaaagccaagacctagacttaccctcaaaactgagtgctcaaaagagattagtactaaatgcttctctgttttgactgagtacggtacaacaaaataacacaagatgatatgtagtcaatgtatagaaatagttaaatcaggagagaaatataaaacatatttaatatgtgaattaaatatttgtaaacatgattgaaaattacattttatagttagaattatgaaaattatgtagttttaatttattaccccacaaatttacacttgcattgaaaaacctcttcttaaaaataaatatgaaaaaatattaattcattggaattaatgatattccattcattgtagataagtaattcattgtagataagtaattccattcattgtagatgaatgaatattccattgtagatgaatggaatatcatcaaaaaatattaattcattgtagtagaagttctccaacaaaacttccaagaaatccacaacatattttgttttctctataaaataaattacaatattttgaataagttaaaatattcatcatcttacctaattgcttgatggtgaacattaataatgccttgttttttttattatacttaaagttttagggtacatgtgcacaatgtgcaggttagtaacatatgtatacacgtgccatgctgatgtgctgcacccattaactcgtcatttaacatcaggtatatctcctaatgctatccctcccccctctccccaccccataacaggccccagtgtgggatgttccccttcctgtgttcatgtgttctcattgttcaattcccacctatcagtgagaatatacggtgtttggtttttttgtccttgcaacagtttgctgagaatgatggtttccagcttcatccatgtccctacaaaggacatgaactcatcattttttaaggctgcatagtattccatggtgtatatgggccacatttcttaatccagtctatcattgttggacatttgggttggttccaagtctttgctattgtgaatagtgccgcaataaacatacgtgtgcatgtgtctttatagcagcatgatttctaattctttgggtatatacccagtaatgcgattgctgggtcaaatagtatttctagttctaggtccctgaggaatcaccacactgacttccacaatggttgaactagtttacagtcccgccaacagtggaaaggtgttcctatttctccacatcctctccagcacctgttgtttcttgactttttaatgattactattctaactggtgtgagatggtatctcattgtggttttgatttgcatttctctgatgaataatgcctcattttaaaataacccccaaaatacatctaagtatgtttgattcttgagttttcattcaaatagagaaaacagtgttaaaaaatatcttacatatggccgggcgcggtggctcatgcctgtaatcccagcactttgggaggccgaggtggggggatcaggaggtcaggagatcgagaccatccctggctagcacggtgaaacccagtctctactaaaaatacaaaaaaattagccaggtgtgtggtggcgggcgcctgtggaggcagagcttgcagtgagccgagatcgcgtcattgcactccagcctgggcaacagagtgagactgcatctcaaaacaaaacaaaacaaaacaaacaaacaaaagtctcaaaaacaaaaaacaaaaaaacaaaacaaaacaaaaataccttacttacttattctcatttaggggacttaatgcctaatatatatacttatttttggcagcaggtttactgttatacatttgtcttaagataatattaaaaacctgactgtaatttcatagcagaaaatgaatgatgacagaagattgggaaaggaagacagtcattccacgttggctagctggcaggaaggaaacaaactggaacttaaaaattggctgagggccaggtgcagtggctcacatgtgtaatcccagcactttgggaggctgagacaggtggatcacttgaggtcaggattttgagaccagtctggtgaacatggtggaaccccgtctctaccaaaaatataaaaattagctgggtgtggtggtgcacgcctgtaatcccagctacttgggaggctgaggcatgagaatcgcttgaacttcggaggccactggaagtgccactgggagtgtcactgcactccagcctgggcgatggaacaagctctgtctcaaacaaaacaaacaaaaaaccggcttaggataatttgcagaatgaatgattcgcatatggataattgcatgtggttttattaacaaccactgagagcaggccttatggttgaatctaaggtaggaattgtaagcttataatagcatctttggaaatgaaatgaaattggataggagaatgaataagactaacaaaatctacagtatttattgtgttatatgtgagttatcatcttatttaatgctcactgacaatgacactgttggtgctattattttccttcttttatagatatagcacctagagtttggagaggttaagctattgtcaaaggtcaagtagtaagtgacagagagacgtgaatctgtctagcaccaaagctcatgttgttaattactctaacatgatgcctcccttactagaacagaggtttttaacctggtgccctaaatttaggatgtccatggaaagtacaatattacaaatgatttcatgtctatgtgatttcccccccaccagttttatcacagactcaaagaggtgaacaaccaaaggaagttaagaaagactagactagagccatgaacaaaaccaataaagatttttctttaaacaaagacaactacaaaaacatgagtttaggtttacaaccagaaagatatagcagtggccttctgggatgagagcagcaaaaacatgtgcagttttaacatataaaacgttctaaataaagtataataaaaaaagttccaaatgtattaacagtgtgaagaagttccttggagagtcagagcagacttgggctgcaggaagacagggaagaaggaaggaaagcacctctcatttgggtctgggttattcaggtcacatggtgagcactgtgttcttctgagcaccacactccagaagaacactgagaaatggagtgaggtctattcagggtaaggtgatgagaatggcaatgggcacgaaaaccctatcgtgagacagagttgttttatataggaataaagagtagcagaagaaaatacatgacagaagacaactgttgcattgatcaaagagaatgggtcagaaccagaggttaggaggaggcagagttcatcttggtgcatcatgacaagaattttattcagtagggaattagtgactccatggtcacttcaagtgctgaaacaaaggttgtcagtggtaaccaaacttgagactaaatgaaacttaaaaaagcatcacaggaaaggcctaggaatccgtatgttaaaatcttgataaaaaacagtttgttttgtttgctggaagaccatctaccagaatgactgtaaaatttattattaaattgagaataaaagtatcaatagagagcttttacattctccttaatttctaaatgttgaatgagcaagtcataccacacagcaatatctccctatcatctgtacaaatgaaccaactctcaggccagcaatattaccgcaatggacttaagcaggagccttaacataacatgatttctacaataatgaattattaaggtctttcagagatgtaaatgttctcaagtactttagaaatgccagcctttgaagattttcagattcataaggtacaataaagttcataaagaagggtgcctaggttatcagacttcagtgaaggtaggaggatgcaaatgagaagaccttcagagcccactggagtgtgggagtctccccgggctcccttagtctctggcctgacataatcgggcaggctgagcaaacctaaatgttacccatgcgaactcttgtcaggccggtgtgagggcacagtaaaaatacattcacattcaacattctcccacccctccccatttcacatatgaaagaaaacgcaaatgctcactgtcatttcggaggaaattattaagcagttggaaaagaggaaaactatcccaggagtcttgcggttgagcctctagtgcagtgtccatatccactgtaaataaagcccaaaatttctctgcatgttcagccaataaatcaggccaccaggcaaatgcctacaaaaggataaaaacataaaggagaaaagtagattactttttagaaacatgcacaagtactgtgccagttgaaaatattttataacatgtcttagtttcacaaacaggtatgataaacaaaatataatagtttttaacctgagaaaaattttataggtacacattaaaatcatagatttggcactgaggaatgaaatagaaaatagaattaaaatgtacaaggacatttattcctttataaaagaaatacatgattagtttacaacatttagaacatatataaaacaaaaaagaaaaattatttgtatctcataatttaaacaagtctattctgaattttttggtgtatttacttccaatatttctttttttttctgtgaatagaaacattaaaacatttggtattacactttataagattttcctgtgatttcacttttaatataatagcataatcttctactataaggatatactgttatttttttttttttaccaattaccctattaaaatggctgttttcaattttttgctattctcaatgatagcgtagtaaatatttttacataaatatctttgaatatagcactgattatttctttaggataaacttctaataattactggattaatgggtatgcattttagagtcttcacacattgcaaattgctctttatgaaaagtgtttgctcacatccattctccattcagcagccagtcatcatttcatttattttttttgagacagggcctcactctgtcacttgggctggagtgcagtgggttgatctcagcttactgcgacctctgcctcccagcttcaagcaattctcatccctcagccacccaagtagctgggaccacagatgtatgccaccatgcccagctaatgtttttgtatttttaggagaaacggggttttgctatgttggccaggctggtctccaactcctggcctcaagtgatctgccggccttggcctctcagagtgctgagattactggtgtaagccacggcacctggcttcaaatatgaattggattataacaggaaaatacaaaccacaaaaaaggggattgcaaaattttgacacactattttcttaagaactttccatgtttataaaaatttcatgtttcacatttatagtaaatatggccttaaaataatagatataaaataataatcagtaactaaaaagattgccatgtaattaattagcagatggtaaaggctgacttaaggaagaacagtgtagtataaaataatagatttgagagttggggacattttaatgcctggctcaatgctgtgaccaatatatgaatgtgaaaactggttgggaatggtatgcatgatgaaaattgagcatactgttttttgcatatattacctttgaatattttttggttaaatatgtgataaaatgggtatatgacctaacgtaaaaacacacaaaaaagtatacatgatttcattacacagatcttgcgcctatcttttgtagctatagtggtgacaaaagaagaacctgagattctcagctctgagtagagcagcacagaaaaatgcagtcctgcaaagagacattttcaaaatctcacttccagttcacagccaatatctttgcaaaaggttaaaattaagaaaataacagtcatgttagttcaggttgtttcaggactctgagaaaaattcctaaaggtcttcttaaagttaacttggaagacagagccaggatgaggaatgaaataaaatggaatacactttttttttttcaaaacagcttcaggttggcaagattttgccatcaactggaaaatttcattgttttgcagaagtatatatttatatctcaagttgtactcctgatgatgctattcttaatgaatgtaagccaatctgtgatgaatgcctcttctcctaatgatggctaaataacgctttaagcaatcactgtctttgaaaaatgaaagcaacagttgcagttatcttgagaatacagggtcttgtctacaacctgtccccttctctttcttgccatcccaccctgggttggtaggaagatgaggggctgtataattccctccctagggtattacttcctgtggggtggctgagattcaacagcatcaaggtctccaccagggaggagaaaacctccctcagaaatgcatccatctacagggtactaaacagaagtcatgattatctgggttaaagttcttttggctttaatgctaagccactaattagtgtaaatgagatggcagaggcagaaggcaatgtttaatttgcttaagagggaaatataaaacaaaccttgattttaagtccttcagcttaaaaaacttactactggcagggtgcggtggctcacaagtgtaattccagcactttgggaggcagaggagggcagattacctgaggtcaggagctcgagaccagcctggccaacatggggaaaccccgtctctactaaaaatacaaaaattagctggcggtggtggtgtgcacctgtaaccccagctactcaggaggctgagataggagaatcgcttgaacccgggaggtgaaggttgcagtaagccaagatcgcgccactgcactccagcctgggtgacagagcgagacactgtcttaaaaaaaacaaaaaacaaaaacaaaaacaaaacttatacaggattaataatacaaataagcaatacaaatatgtggcaagctgacaatacttggaaagccttttttttttttttttgtagtaaatatagtttacaacagtggcaggtaaaaatgaaccctgaacctagaagcagagtactgagcttttgagcttagtgatgatacttgagtgataacggtcaaatcagttcactgggtggattctcatttatttatctgcaaataggcaataacaatacttgccctaacctctcccagtgttgctgtgaaaatcaaataaatataaaagtttattgctgtgcaaatgtaataattgactaccgcaatcagtaattacaaatatgtgttgactaccgcaatcagtaattacaaatatgtgttgaaattcatataaatcttatgtgagtttatgtgttttaaaaataatgtccaacacaaattaaatggtgtttatgtgccaagtactgttctaaaggttttataaacatcatcttacttagtcccccaaacaattatttcaggtagattgtacaattatccttactttataggttagcaaacagagattaaataacttgcccaaagtcatacagttggtagataacaaagcaatgattgaatctaagtcagctggagcctagagaccaagttcttacacatatagtgtcttcttaagggaggcatatggcacactgcctatcatctctctctctctccatccatccatccatccatccatctaccatcagcagatcagaccactgttagtatcttttgatttatggcttgatttctttatatcttttctactttttattaaaacctgaggcctttgattactttttttttttttttgaggtggactcttgctctgtcgcccaggctggagtgcagcggcacaatctcggctcactgcaacctctgcctcccaggttcaagtgattctaatgcctcagcctcccaagtatctgggattacaggtgcccaccaccatgcccagctaattttgtatttttagtagagatggggtttcgccatgttcgccaggctgaccttgaactcctgacttcaggtaatccacccgcctcagcctcccaaagtgctgggattacaggtgtgagccaccgcacctggccttattacttttgccctcaaaatataataaaaatttataacttaaaacaaaaaaggaggatggctgcctaaacgagcaaaaacagtgagtctgactttgaaatacattttgtgcctatttattccccaagacaagattagtttgcaattctgtactttgttgataatcctaaaggttctggagacaatccagtgtctatagtatcccctgcccctgccacacacatacacacatactcacatacacagcgacatgattctgagggccatattctaaaaatatttaagttctcttgagggacagacgaatgaacaggtgacacctattgtctaactaatcataagttttttacaacttccgtgattcactgataatcaggttcataaacatagatatagcaataaccaagtgagatgatgagctgaaaatgctccaaaacatgagaatgtaaagtattatcctcattcatatatattataaatcagtaaataatgaacaaacatttttggtagagcattcatgctcatgcaattggttttgacagtcactgctgaaatgggaattctacttctacacctgagctgtatgcaagctacttgatggtcatcctcttccaagatgagggacatttgttggtcagaggctaatataactttaaatttgaacccatcctaaaaaaagatttatctcactgactatccagatatcaacaatgtgtaattgaggtcatttcaactgctgagactattgtaatctagttggtcgacaggaaatcgattttgttcatggtcaattattttgcataaccacactttagtatattccttaggcatgcatgccagttggagaggaataagggtacacacaaacaaaaataaattaaaaaaatcaaataccctttctctttacattagaatccaaccagaagcataatttggttcagatactgatatttaggggaatgcacatatgcacaaatacgtgtgttcacactgaactctcactgtccaggctcttgttgaagcagcccagcaaatgaatcaaccatttgcagtgaactgagagctgtctgcattgcaaataccaaattactgccaaacaaccttcttgcccacggtggaatggatttggtggatgacatcgtatttaaaatattttaaggatcttaagtcaatattttgctgtaataataagcaaccaagtaacgacttgagtcgtgctcatatttttcatgatccctccctctcagcccttctactgatattctccgcactccatccatcccccttaggcagagtccttggagatataccagagtacaaggaaggaagagaatgacagaatggaaagggacatcaccaggtttgcattgtgatcaccacgctatgcatctacatccctgttgtgatgctgtggttcaaatctgtcagcagaactaaggcaggacaatcactcctgcaattctacttaaattgcaaaacagcaatgtggtttattggaaaatgtccaggtctggagcctggcctgagtcttcacccaatcactcactagctgtgcatctgtggtgagttgctcaactttcttgggtctgttttcttatcagcaaaatggtgtgtgtggaggggggcatactggtgagggactatggctttttcagcaggcatctgacacctcctagctctgtcaaagaaagtggcttttagatggagagttgtcagatcagtttgcctaaaatatctggtcagagatggtctggtcactgaaatgtggagacagccttaaagattttctggaaaggaacttaaactatctttctaaggagaaaacacaggaattctgcagaaaagcctgagaagagaggttgagaggccttcaaagagaagggaaaactgcctggtaaggtactgtcaaagatctgaaggacatgaaacctgcttaactgagaaattgttgaaggatagaaacaacctcttagccctgtaaagtaaactgccactgtggagagagggagaatgaaaataaaaggagctgacatgcgagccacttgaaggtctctttgaggcagatacattaacctccaccaagggagctgagccaggtgctctttcatggagcaaaggaactctagcttgaacatccagcaaaataagtatcagtgcagaatgcagtccaccaattcactctggaagtcagtctggaatcagaccaattcactccccaatattgttcagagaaaacgtgagattttctgttttgctttgttttttaaaggacaaaaaacaaccaaagacacaaaccaaatatcaacatcccttcagtcatgttttacttagatggccatcagtaactatgcaagcaattattaataatatacatacacaaaacaatataacaaaaattagcacattcaaagaaaaacagacattctgtaatttcaaagaaaggactaattggctttaaaatggactacaatcagagtagattgtattttaaattcacataaaagaggtatcctatgctaataaaatagtggaaatcattttactcacctctcttccctgagggtttccaagaatttggaagcattgcagagtagaacaattgccatagtgttacaaaacatctttaaaaaaggtcatcataatagtcctatatttcagtatatcgtatagtgatatttatgaataatgattatctctatttaataaagtcaactttattttgtggattagtaaataagatatacattttaattgtgtttggatacattatactttgacaagcattttagtgattgcaagaagtataattaacatttaatttttagtttttgtaaaatgtttgagaataaaagatatacctgttttgctgaaatatatactgcaattgaatatccaattattaatagattttttaattcaaaaatcctaacactctgacaataatgccttttaacaaaagacaaagacaaaacatacatatattttatcacataatcactttcattgtaacatagctgtgttaccagcctagaaaagaacctcctgggaattcatttcaaattattgaagcagctgtttcttcagtttaaaataaaatatccataacaagttcacacatgacagatgcaagctaaaaactagattccacagtgtgagctaaaagcagatgttttgaataatcatatttataaccagatatcatatttataaccagatacaataaatcttagttacctatagtaaggattcatgagcactcttttctatgaattggcttaaaatgtagttcctgtagtttcttagattttttagaactaggcttcattaaatacaaaaattctgtaaactcacatgtatttggtcatttttattcttgctcatttcatgtgcttcctcaagaataaaagcactgtcagggcactgacatttattatatttatttaatgctacacattctccccacccaactcaaagtcagaaaactctttcatttttgttaacaaactcatggctattagaaagagtgagaattttaagtctcagaatgagcagtttgcttggtgaaaagccactctagatctttagtgaatgttaatatgtaattagaactttaaaaaattataaacaatacaggtttgattaaaacttaattcaaaaaagtgaaaagttcaatgttgagagcgaaagcctagagttatcaaccatacgcttatgattgttttctactaaagttttgttttatagtatgtcacaaattttccccttccacgttaacttacatttctaaaccaaagcaatcatggcatagggggaaaagcacgtgatgcagcattgtaagacgggtttgtgttccgtctttgcctcttaccagttacacatttggactgaaggcagtgcaggctgattaattataggacttttctgtagcccttgctgttaactaaatgcactcagtgttaactaactgccctcaatgaaaggcaggcaaactatttatggaattatgagagaaatagagtgagatttctttcctttgttactgcagtcttgctattaccaacgagacagcaaatacagaaccaaaaaaaaaaaaaaaaaaagaaaagcccagtggaaattaccccttggtttgggaaataaaaatatcttcttgcagaatagctctgaaagttgccttagggtcactgcaagccctcttgtggtcattaactttcccccttcttcaataactgatgagctaatttctcatggcacagatcccatcagtgtttgttgtcaggaataaacatgaaattatacacacacacaattgctttgtaatatataggagttatgtttttagaaaattcacatatgttctcatgtgtgaatgtgcaatgggatgtacagtgatgcagtgaaacactgcttatcgttggtgcttattcgttaaatgttcagatatgtatcaagactatgggcaggccacttattcagtgtagccacaaccatggtgaagccttacatatagctttatactacagtgaaaacaggtcatcacctctgcatgatgctcttcattctgctgtaagacttctatgcagagctctgccagatgaagaatctcttccagctttctagcaggagatgcctggttcatggtctctatatgaaaaaaaatcataatcatgttaccttgaaaataaaaagccaaacatatttgaagacgtaatgatgagactagaatgttgaaatagaatgagaaataagaaatacaaatgaatacattatttagacaaaaaaaaaaaaacagttcaccagattgcaggaaatatttcacccacaaagcaatgacagggaactgcaagtgctttgccatttaatatataagaacaggtgcatcagcacattagatgctcaacttctgcaacaaacaagttataattctcctcaaggtcagcgacacaaagagagcagataccacagtcttttctttctctctgtattgtattatcagtacaataccattctcaccacatgattcattcctggcattagcaaaacccatgcttttttgttgctgtttaaattcccggcctgaaatgtctatagttcatgttgatcttaaattcaagaagtacaaagtcacctaaaacaactctgacagctagcaattgactgatttcctccctatttcccagccaccatcccaccccacctttccaactgagggggttgtgggggaggaaggcagaagtgttctttgaagctgaaggttctttctgcagtaagctgaactggtataaaaaggagagaccacaataagattaagtgcagttacctgaaattctgctacagagaaggcaaagtagttattttctaagattcaacaagctggcagaaattaaagaagccctgtgtaatgaaactgtttcaaaacaatgtaaagatcagttcccaataaggacattaaagataaatgttgtcggggattcataggctctttctctttgctcagcaaggaggttgtgaggaaagaaaatctaattttcagtaaaagagattcttctggggaacttaaagggcatttttttttcctacaatagttttcccttgatttacttcttcctaaaacctcagccttaaatttggaggagacactttcatttgctctgttctaacgtattccaaaggatgtacaatgatgcagtgaaacactgcttatgatcggtgctcattcattaaatattcattatatactcactgtagctcagacacagtgcaatgtactgatgtggggttcacatccctcaaccctcaagccatatacacttcctactatattcccctacagaatggaaagccattgctcctctgtgacaaggttcaaaaattacagtaattcttttgaaaaatcagtgtgaaacaccaaatagtcaagtgtgcctacaatgttgttggctgtaggaagtagaaggcagtatgagacacacttccaatctcaactcagaaccagaaaatctctactgaaaagatccatagacatgaatgatcaaatgtttcatctgtttcatgaacatttcaacatcctcaaagaagcatgaagtcaaggaggctcatgactttgcatgacaacctacttaatttgggggccgctctagctgttctaattttgtcaggaagagaaggcacctaggaaaagtttggaagcaacatgaggcaaacctattggtgatgcaggaaatgtgagggaggactgctgaaagcaggtctaggggagacatcgggggaaggtaagcctgaaacatggtcttagaaataacaaatgacctggggaagaggaggaggaatttttagagaagaaatactgtatgacacagatgaggtgcattttggaggaaggtggtaataacaaccattagaaatggtacagtttcaggcgggcagatcacctgaggtcaggagttcgaaaccagcctggccaacatggcgaaaccccatctctactaaaaatacaaaaattagctgggcccggtggtgggcacgtgtaatctcagctactcaggaggctgaggcaggagaatcgcttgaacctgggaggcagaggttgcagtgagccaatatcacaccattgcgctccagcctgggtgacagagggagactccatctcaaaaaaaaaaaaaaaagttacattttcttgagagccaattatgtgtcaggcacaagccagggcgcttcccacgtgttagcacacacattttcctaacagctttgttttttattcatgtaactcacagataaggaaacatgctcaaaaagataaatgcaacagctaaaaagcagtgaaggtgagacttgaacacgtgggctcttgtacttgcctggctggagtaagaatgtgctaagaatgatgggtgattatgggagactttaagtaagataataagtagactagatgactatatcctatgaataacttggggcaaatgtttcttagcagggcctcagaataaattaattttaggaaaatgtattttggtggttgcctccaacaaggattggtgaaagtgtctgatatggatcctgagggtctggtttagtagaacagtgaactatggaaagatgatagtaggaatagaaaagaagggaaagatgcacagacactccaaaggcagaatttgtgagccattgttgagtggctagaatttgcaggccagagaggagtatgactctgaggtttggagacctcatggctcagagaatgatgatgtatggttgataaagttaggtaatgggtcttcaatggaccatcccatatattttagcactaactacattgccacataagtgtgatttaaaataagttaaatattctaaactaaaaaaaattgtgcattgtaaaatctacaaacatgcagagttaggctatctgaatctttgcctgacaaactgctactctgcttcaagattctactttaatgctaccttaaaattggaccttctcagagttctgggtctgaatgagttgctcctttctctgagctcccctattacaggctcatgagtctgttgctaaactgtactagatcaaagtcagcaactgggtctcattcatatagttatcttgtgcaggctttggaccatggcaggtatttaatgaatgtttactgagaatgcagcagaataattatgggaggaaaagaatgttaaaaaattcaatcaatacccccaaatttttaattttgcatgcgattgcaaagagctcatctgtatctaatacatcaagggtggataagagagcatgctcacgataaaacgcagctgtagtctgagaacacttctcaaataactgacaaatgtttagttctgaaattcttaaagaaaaagctttcttcagaaacaaaaactttgtcagaaaatgtcttcaaaataacttttaagcctcaagagcatatcacttatctttcttaatttctccatttttagatgaagagtattaagtttgggagtcagagggttcttgaaccccttaaattatgtactaatttttgtatgtagaggcatttttggggtgggggagaaagaccgtatctttcatcagattctcaaagttgtctataaaccaaacagatgctaagaagcactgaaccagataatttctaaaattccttctggctgaggcaatctatgcctcccataaatattgcacttatatattgcattatattatttcaatggactcatatatgtgtataacatgtttttcataaagaaaaaggaaataaaatttatttatgtatcaaagattagaaatttatttctcctacatacttccgtgctagggactagcactatttgaatctttgcctaactctgcatgtttgcacattttacaatgcacaatattgtttcagtttagaatatttaacttattttaaatcactgaagtatataggagaaataaatcctgcatactcttctgaatcctcagaagcattctgcaaattagataatcatgatcctccatttccagagtcttggagaggttgaaggtgtctgaggttatacagtttgttgctggctgagatgacattaaaatcttacctctgatgtcatacagacagaaataatattacaatgacttgaattactataattctttttcattttcaactttctgaataaaaatcacacacaaatgcccccattccacatctttagccacaagtatggaataatagaaaggaatcacagaaccaacctcagaacttattatatgtgaatctttcaaaatcagctattacatgtgacactatcttaagtacaaactctgagagtaccctgtgttctagtgaaatttaaaaacattctaaaacatttattctttctagattaaatttattgaggatcaaaactttgtacttgaacataatagccactctaatactttaaatagatgcatttttatcaagtactctgtgtatcccgtctctggtttcacccatttggctaaggccaagaagtttaatgcattctacagtcataattctattagataacaaggttatcaatagccccattaaaaagccgaacattgggaatatttgagaattcttccttaaaatgtttgttttcactcattttgtaacatttccaaagcattacagatggctctacatccttcaagcttcacaccaaattgctgattgttgtaatacatttcaaacagtgacatttaaaacaaacatgccaaaagtagcaaagttgcttgatgaatttcaatgcattgttcttggctatgattcttctttgctctggaacacttttggttttctgtaacactccttggctcattgaaacaattcatttttaattatacctccatacatttaagaagagatcctactggggaaggggagggaggatggaaagatgtaaaaagacagctcgactgtttgctttggtagggtttcattctactccatggcttagaaaggggcatatctcctggcacactggactgggctgcctcccttgctgctattccctgtcaaagtccccgtgatggatgcacagtgatgctcatggtgaagcttataccaggatgtgggaagaagaccagtgagataccttcctttttatccgtatatgatatgtagtaatttgtcatgctttgaccttaactttaaaattttttaaattgatgaaaaagtatttgctaataaccctacatgatgatttatgtatatattatgtaacaattgtcacaaattaattttgatgagagattttaaatgtcctcacctccactcaccatgatcttaaatttaatgagctgattgtatctgtacttgcagctaaacaataaatagtgttgaagatggtgttagactgaaggactatggaaataattccattccaatactgccctatcttcttccctcctttgcatctaggccatgatgatcagctagggagcatgaaaaaataattcctgtatatgcattcatttcttctttggtttttaaactcctcagattccgtggccctgaatttgattcaacaaacattttattccatgtaaggtacttcgctagccactgaggggatacaatgattaaaaagatattatttctgccttcaaagaatttacatatatctctttctaaccagattataaggtagaatatggcaacctataatccatttctggtcaacataaagaagatctgttataaagtctgtaaagagagtgaattaaatgtaagcagtatgtaagaacagggttattagcttgcaagaaataggatcaaagatgcatcaataagaaggctttaaattgctgtgtatatcatatggagtttttcagaatgaaattattgtggtgggtatgtgttcgagtttagaaagctagcaacagtccaaagtggaagtctttcacctcttccccctcccattcagagaaaagcattcactcactcctctgcttcttccctctccagctaatgactatatatcagatggataatgaaaaagtcctgacgttcaggagatggctgaggtgagaaacacaaaaatcttcataagggactatagggataacttcagaaaatcagaaaagaggtgtggaaaaagggagaaaatgggaaaatatctactatctagtgaaacaagggaaaggaaggactatagtttggcaatagcagggatatgagcacaaggaagcagtcacctggggcactctctgaagtgaggcccaaacagcgaggctttaccttgagagcctgtaaagaacaaggacattacggccaaaggcacagcatctaatttcttctacgtggaaccccaaatgtcagccagtaacaaggactgtcagcctactcttgtggactgcttgctggcaaaacttatctaccattaggcccagctgaagaaatggtggaatggatccttccttttccctctccccactaaaggagatagtgattgatcccctagctgttccccctgcagaaatataaagcaacattacattacacactctcacacacatatacacaatgctttgggcacataaacaaattgttctaattacagagatcagaaaatactctatcttaggtaactcatcaatgttagatgccttctgttcatttataaaccataatcccctggccaggcacggtggctcatgcctgtaatcccagcactttgggaagctgaggtgggtggatcacttgatattaggagttcgaggccagcctggccaacatggtgaaaccccgtctctattaaaaaaaaaaaaaaaaaatagcctggcgtggtggcacacgcctgtaatcccagctacttgggaggctgaggcagaagaattgcttgaacctgggaggcagaggttgcagtgagccgagatcgcgccactgcaccccagtctgggtgacagagtgagactccgtctcaaaataaataaataaaaataaaaataaataaataaaccataagtccctttagtctaccttagctagccagggaatttctactggatccccagtctactctaatttgaatcttaactctgatatcaacatcctccctctttgcatagtacagactgatgactcagttggaaagtctaaatttttatctagattttctgacccttcctccagctctggccatagcaacctgtggtaagttacatggtgccaaagtctagggcaagtaggctccaggaggtcaatcctggccacatctcaatacttataggctttcttatttcaagataagagagtgggaaattaggtacttccttgcccattaaaaaaacaacccattcctgtccctgccatctgtctgccagtttttagaacttgtggctaggtgcacctaaggaacttttggactcagtaccctaaaggagatagtatacaactttgtaagaagactgcctcaaaatctgggggtgaggtggttcccaaaagccaacttactttttcagttctttagggtcaagtggcctataattgctccactatctgtgacatcgctaagatgtggcactgccaactaatgaaagaaaatgaggaatcattgactctctcctggtttatctgactgaaacccaaatgatattatggttccacaagtgttggactatgtactgctttcatcaatgaatggagtaccttcagtatagatctccatttcttggcttaagcatgcatcagaatcacctggaggacttgctaaaacacaaattgcttggcatcattccgaatttctgattcagtaggtcttggatgaatcccaagaatttgcatttctaacaagttgccaggtgatgctcatgatgctggtgtagggaatgcacttcgagaactaccagtagttacgaaaaacaaagttaaaaaacaaaggtgacctacgtaaactttgattatttcctcctttccctgaaatcaagctatacttttatataaacctcatttcaggtaaaaggtgactttttctgcagaatctgaactgattgccagataggatagtgtccacatttgggcaatcctatatataaatgaaaataattaatccaggatggtatagcctcccgataggtatttaaaatccacacaaatactaatgccacatttgtttgaaaacaataggtctgtggcctcctaattccatggcttcctttgggaccaactcatttaatgaccctgccatttaaagtaagagttgcagttaatattctcccggaattaaccatgctaataatatagtgctttggaataattgttctgtcatcacagtcacattaactactttacctagattatctttcgcatctgtaaattcattgtaagcctatggccagctgttgaacaaaggagaattggccactagagtatagaccaatgacagctgggctgaatccaaactgagcagtctccataagccaacagtaagtgctgacccatgactggtgagccataaaatgtcagatacatgtgaggtaaaagtcagtgactctgtaagactatcttggggtggaatattgaggcataatcttctctaaagatcttaaagagatgatagtgatggaattacagagaatagattactagaacccacaagcaaaaattagtatttggtttatcatttgtcacaggcttctattcttacatgatttatgaggcgggaaacacattcggcccaatttgagttttattaaagttgtcttttcattgagaccttggctctcccaaagtttatgaagtaagaaaagctctcacagggacgaatatatctacagcattgctggctgcaaagactgtgaaggcttgagggagaagaaagttttctatgctgtctacttactttgctctggatagctctggatataactgtgttataggattttaatgatagcataaaatttttccagtgttaattttgccagctaattgtgtaatagctttttttaaaaaaattatttttttggacagggtcttgctctgtcacccaggctggggtgcagtggcgtgatcatgtctcactgcagcctcgaacccccaggccccaggcccaagcaatcctcccacctcagcctcctaagtagctggaggagtgcaccaccacgcccaactaattaagtttctttttatacagacggggtctcactatgttgctcaggctcatctcgaattcctgagctcaagtgatccatctttatcaggctcccaaagtgctgggattacattcgtgagccaccatactcagccatacatttttttaaagattgatctttgctgggtgccatggttcatgcctgtaatccctgcacattgggaggctgaggtgggtggattgcttgggttcaggagttcaagaccagcctgggcaacgtggcgaaaccctatctctaccaaaaaaaaaaaaaaaaaaaaaaaaaattatccaggcatggtggtgtgtgcctgtggtcccaagctactcaggaagctgagggtggaggatcgtttgagcccacctgggaggcagaggctacggtgagctgtgattgcaccagtgcactccagcctaggtgacagagtgagaccctgtctcaaaaaagactgttctttagccatgtcatatacacaatatatgtgtatatacacatatacacattcagtagctgaaactgatgaatagtcccctccctggtgtgttgttctttatatatacattgtatccatttttttctaaatattattcaaattcagaaactgaaaatcaaatactgaatcacataaagtctatagcatctttagtatcatgcctattccttcctgttttttaagtgtacttacctaatacattctttccatgtcatttgttttattcataaaaggaggaccaacacgcctccactctcatttcctgcctgacccttgctttaactcttttttccatactcaaggagaatgtttgcctgtgaacaatggggatacaggcaaggcagagcacagcaaggcacaaagatgaagatggtctgttcagtgggcaatggcaggggacagggactccagagacttgccagctgcaaggcaattgaaggagaaggaaagagaagatatttggagacagtaaccacaatatgaaatataacatttgaaaagatttgcagccttgggtgatgagaaatgagtcaaaagatctcaatgtctgcatgtatgtctttgtttcctttgatacataatcaaggtcttctagggcatgctaagatttagagaaagtctcccaattggcaagtgtaaaagaccaggtttacagagtagggttgggcttagtgccactttgaatatttctacagctctaacatcacaaatttgccaatcactgtgaatgtgtgtgcatgcattgatgcctcatggatattttaaagggctcctctttgaaattaaaatataaatgtgtgtcttttaaaaagcttcaattaggccttttaatttattgcttgaaactatatggtcacttagctagggcctacaagtaatgaacccttcttaatttgccaaactatttcatctgtgcagtctttgggtacttataaaccctgttgataaatacagaggtagaaacctgtcagttttcatcactctagttttgtacaattggaaaagactttttcatacatgtaacctactcagattaacaaggtgccatgaaagccatgctgctatgtctcttggtgtacctgttggcacctgttagtaagtaaatgagaggtcaccagttagttgctttcaaattcagtctctggagattgacaaattctataaaattgcttgcgaaaggaagaagccttgttatttcaagactgcatttatctgtgaatcccattctatataaaagtaaaaaaacaacaagtacatgacacactgtcaagtgagctgagcaaactgacatccttctggataccttttagaaaacaggtgttgaacacttgtaatgagatttccatgcatcttcagaggaagtaggaaagattctagcaagagctgttcagagtgttacagatcatggccaaggaaataattccgaataaggaacaaactgaagaagacattacataaatgccgtgtgtgtgtgtgtgtgtgtgttttaactttttcttttttcttttcttttttagaagacacatatccaccagacagaagtattttgaagtatataatttttccagatcgtggggaatctgggatatatttaattaactatttctgaactgttatctaagtgttttatttatttctatgtagaaaatgaactaaaatgggggcacgctatgttttataagaaagttaaaaattttgttttaactcagatactagacaaacttggaaaatcatctaagaagtgagaaagtaaaaataaccattggggataattacaataaagagtactaaatttatagtggtattttcttcattgcatttagatctataatctctctggagaacaagtttctattacagaggaattgagttcatctgtatacattaaataagcccatctttcaaataacacttcccaaacactgtatcattttaccactgatttgtctcccatgtttgctatagatgaagtatgtcaggctctcatttatagatggatctgaccctatgcttgtagtcgtctgccggatcatgggctttggtgatggctttgtaacttgtcttagataacacttttttttttctaagttgacttagttattcagtatactttatttaaattttaaggtaaatttatcaagttctttaaaaaactagaattttgatggatactgcaatgaatttatacattaatttgagggaagaatttatatcttatattattaagtcatccctcctaggtcatggaatagctctatctctatctagattactttctatgacttgtgagtttcaaaattttcttcatagaggtctataaagtttcgcatgtttttatcaaagctaattcctggataccttacagtttggttgttactgtgaaagttatctcatttttgttaatattttttagctagtggattgatggagtggagcagtggttctcaatgtgtggcccatgaaccactgggaagaccacctaaaacctttcagggatctgcaagattaaaattactttcataaataatactaaatgtttttgccttttacatcctgttgacatttacactaatggtgcaaaagcaatagtacgtaaaaatcaccgttgccttagcatgaatcaaggctgtggttgcaaatcataattgtcactgtattctttaacaccatgcactcaagtaaaagaaaaagccagtatcatataaagctgtacttgatgaaacagtaaaaatattactttgattaaacctctgcccttgagtgtatgtgtatacctatacatatatatacacacatatatatatatatatatatttttttttttttgagacggagttttgctgttgttgcccaggctggagtacagtggcgcaatcacggctcactgcaacctctgcctcccaggttcaagcgatactcctgcttcagcctcccgagtagctgggactacagccatgcaccactatgcctggctaagtttgtatttttttagtagagatggggtttctccatgttggtcaggctggtctcgaactcctgacctcaggtgatccgcccaccttggcctcccaaagtgctgggattacaggcatgagccactgtacccggcagagtatacatttttaaatagtatgtgtgacaaaatgggaagtttgcctaaagaacttttgcatattgaagtacaatgaatgactgtctcaaggaaaagcatttgtgtgactatctgcatccagggcctctctcctccccacacttacagaatcatttttggtagaaaagagtactgacaatgtatagttattcagagttggctatttggcagacattttctgagaaaacaaatgaataaagtaaacatgtcactttaagaaaaacaaccagtgtttgttaccacaatgctattattagagtcttcaaggaaaattagaattttagaaaacttgtatctgttataaacttgatagcttctcaatactttaagatgtttctgatgagaagggtgatattaaaagtggtgatatttttgatataatacttgctaatatagggataactcacaaaaccaatattttccaaataatacgtgaagttgaaaaatcatgcacacacacagcttttttttaaaatatatatcacaaaactaagtttcaatttggtccctatccaggtgatcacacatactagatcagtatagctcaagcaatgagtttttacaaatcatacatgtattgctttataaactaaaaccttgaacaaatttataatttcctaaatattctaaagaaaaagacaacaggttactgtctttgttttaaagcaaacaatttgtatctaacaatttgtccctcatcaacaggtgacttagaagcagaaatggtcacagaggttttactttcaggccaagttctcattatccaagccacactgtccaaaaagctaaatggaaattctttaattacctgttcaattctttttagggtgaggattcagtttaagatacaaattactttttgccattgtcggtgcctatgggaacatgaaatttcaggtctattatttaggtgtcagaaacttcagttcatggggacacacaatactcaaaattcaaattaacttcctaaggagccacataaaacttttatcagagaaaactgttatatcatcttagaaatattagtaaaaattattcaccattaacaaaaatttgccacaaactgtgcagtttttttttttaataaacacgtggcctctagacacaaacattcttaagtagaacagattttatttattacttattgctatcgtgtacaatggagtgttaaattaaaacaccacccagatgacacacacatcctaatgatataaggactgccacagtacaacttctcctctcaaagacagtaggcagtctgggcctctgggaaagcatctctaccccattcaactgaggctctgaaaataagaacacaggggttaaacctgggaacctggcaactagaaggccaagaaaaatcctcacctcccaaagactttgcttattcattccatgctaccttttgttcagggcacctccacatttctaggttcaccataagcctaggtaccaagtctatgcaaaagatctcatgtccaggcaagtcctaaggcgcagtctccccttttatatcttaaatcacaatatgctatataattttcaggaaacagtaggaactgttatcaaatgtatgactgcgctcttgtctgtgagaaagtctttgaaccaaagaacaaattgattcttcttttaaaataatatctaatttgcatcaacaaggcacatgatttaaaaaacaattaggaaacatgatgcttcagtgttatctctgcatgccagaattacaagtaaaaaaaagatctcactattatttagctagtaggttagtgataaaattaaagcaaaggagaaaactacttgatttttaatagggtaagtcaaagatttcttaacacaaaagaggcaattcaatgaaatggtagcattttataaccccaagattaaaaacagctgctttctagaaatgtccagttttcaaaataactgtttctatgaaacatgcaaataattcccaagaaagaaagaagacatttagagggaagtcctttgttttatttaacccattatgaaatttaaaaatccttttattctgcaaatttgtgctgccagtggagaattggaagaattcccaatggaagagaactatgatgatggaagagaactatgagtcacaattaagcagcacactgaattacaaaaacaatcaaaacaggctagattactgggcattgttaatgtaactgccatctataacctctggcttctctgatccagcattagtgcttcccccacttcttcctgccgtgataagagcaagaaattatggcttaatttttccaatcctgttattttagtgttagtttttgccctaaattttaattatttagtaattggtttgaaagactttttgcaagccagcttgccagtttatggatgttctttctgctattatgtagcttgataaattcatttgtttatccaataaatatttactgagtaccaaatatgtgctgggcacatctcttggcactgtggataagaagttgttaaaatacaaaattgtctgtcctcctggaactaacattctaggacaataagtgggatgaatgcactatacattgtgttggattataataagcgctgtggaagaaaataaagcaggagagggggataaatcttctggactgggggtaagttttgcaaatttgaatcactttcaacacctgacatcgtgaggaatgtggggaaaaataaacaaaaagattttagcccagtgcaaatttaactagacaagctcgtcaagggcggggagtgtaagaagagatcaacagacagacagtgggctctgaacctcccacttactagctatgggactgtagacacactacataacctctcaggttcagttttctgagaagaagtaataataatgatactatttattgcaaagtattgtcttaagaagtaaattgagttgcctgtaatcccagcactttgggaggccgaggtgggtggatcacgaggtcaggggtttgagaccagcctggccagcatggtgaaaccccggctctactaaaaatacaaaaattatctgggaggcagaggttgcagtgggccaagatcgtgccactgcacaccagcctgggtgacgaagcaagacttcatcgggggcgggggtgggggtggggagggaaacaaagaagtaaattagttgatacatcacatataaaatgcttagaatagtgcctggtatataagcattttctctttttactaaataattatcattatttttggaaagagtggcttttattaatattaatctttggcttttgtgacgcagctgaggtgtttatcataaaatgtcattactttgaatcagtcttggaggcatggcagccagtgaaaagaatgtgaagagggctctggtgtctgagagatgcaagtatgaatctcatatctgctcagttttaatggcaacagcaggaccttgtgcaagttaacgctttttttcagaagtctcagtgaactctccataaaatacctattttgtagagctatttaagcaactaatgaagcagtataaatagaaagcctttgggacaggccaggcactgtggctcatgcttgtaatcccggcactttgggaggctgaggctggtggatcacctgaggtcaggagttcaagatcagcctggccaacatggtgaaaccccatctctaccaaaaatacaaaaaattagccaggcgtggtggcagatgcctgtaatcccagctacttgtaaagctgaggcaggagaaccacttgaactcgggaggcggaggttgcagtgagttgagattgtaccagtgcactccagcctgggcaacaaggcaagactctgttaaaataaaaaaaaaaaaaaaaaagaaaaaaagaaaagaaaacctctgggacacataggcagtcagtagatgacaaaatcatgatgaattttgggtacagctttactcttttctagagggtataaactgaggaaaattattggaatgctcaagagactacaagagactacagtgtcaaagtattatcaagccatctgagttctttagttctttcacatgtaattgatattttcattgttacccacttttaaaagcatcaccccaccaagaacatttacaaggtaaccctgctaggttaccttgctaccaaatgcaaataacatgatataactaatatatataatatattttttggagacagggtctccttctgtcacccacgctggattgcagtggcacaatcatggctcactgcagtcttaaactcctaagttcacgcagtcctcctgcctcagccttatgagtagctgggactacaggtatgcgctactatacttggctatttgaggcgtgtgtgtgtgtgtgtggagatggggtctcactatgtttcctaggctagtcttgaactcctgggttcaagtgatcctcctgcctcagcctcccaaagttctgggatcacaggcatgagccaccatgctctccctggaatataacaacatttctaaaaaacccctatcttctgttacttcagaacattcttaaatttagttttcccttcaatcaatttaaattacataaattacattgatttttctttgtgtttttttggttttttttttttttgagatggagttttgctcttgttgcctaggctggagcgcaatggcaccacctcggctcactgtaacttctgcctcccaggttcaagtgattctcctgcctcagccacccaagtagctgggattgcaggcatgcacccccactccaagctaattttgtatttttagtagagacagggtttcaccatgttggtcaggctggtcttgaactcctgacctcaagtgatccacccattttggctccccaaagtgctggaattacaggcgtgagccattgtgactggccgatttttctcttttctaaacaagcatttcattttaataaaagtatatttcctagagttgccgacctgtacagttgaccagtggtatggattgctaagtcactgtgaggagaagatttctgtttggttgaagcaaggtatatatgggacaagtcccttttgttctctcctctctttaaggagatcaggcaactctacacatggcctctgccccaggcttcaaaaaggggcactctgaccctttcatatctcccaggggaagaagcatagcttctggaggttaaggatcacctaagtccagccccagctggctgagttatttactccatggcagctggaaagccacgaacaaccctgaacttcttgtttgtaaactaggatgaaagctgtttctacaacaggaatgttgtaggggagaaaatgccttaagaggtttgaaaaagtttgctaaagagcatcggattgttgctattacaatgtgctgtcataagaggtgacaatcagtcccatatttttttctaattcatttttctctaaagtgcacttagcaatcattgtaggtgtgttctttctcctcttcgtggctctgagtgttttgttcctgtcactttctggggtcaaatattgaaaaaggtaggggaaaaaaaaaagaaagaaatagagcccttaatagaagacttcagttaaaaacaacccaagcaaacttgcttataacattgcatacaaaatttgaccaaaatgagaaaactaggattaggaagtttcatcacttgtctctcacttcattgttttcagatggaactaactaatctcctacctctctccaaagtccagagtgcctactttgtgtcagcagacacagtggtgggtgctgggaatacaacagtgaacaagtcagtaaggaccctgcctgcatggggctgaagagaagacagagaggagaaacacatcataacaggcacacgtagttaaatgaataattgtgataagggatgcaagaaaaaaataatagaacgttaaaaaattcagcgactcagcgaactctttcctagcaatttcctgatgggatttcataacccttgttcattcctgtgattaacaactttcaaagttaataactgcttactttttatttaatagcatttatgctttttattctgttattttcaagagtgataaaggaaaatggtcctcttttcttgttgtaagagcccttcaaatatctgtgacagcttccaagtaagattggtggatatgcttaaaacataatgcataccattcatatagcctcaggttttttgctttaaatttgtatcaaaaatattgctgaatttttagagatgaatggcctatactttacctacaaagtattagcaatcattctgacaaaatcaaagcattttcagaattcctaatcaaaatgatctaatagaagccctgagaaaaagagagctattcatcaatgacaaaacatcacactaccaacagcaatggaaacaacaaaattaaaaaggcaatgtacagaatgggagaaaatatttgcacaccatacatttgagaaagggttcatatccaaactatttaagtaactcctataacttaacagcagaaacccaaatagcccaacttaaaaatgaaaaaagaaactgaatagacattgctcaaaagacatacaaataaatggccaacacataaatgaaaaggtgctcaacatcactaatcttcagggaaatgcaaatcaaaaccacaatgagatatcatctcacacctgttgggacgactattatttaaaatgaacaaacaaacaaaacaagagatagcaagtactggcaaggatgtggagaaaaaagaactcttgtatactattggtagaaatgtaattaggtgcagccactatgaaaaatagtatggaggcttctgtaaaaataaaatatggaactccaaaggattcagcaatctcacttctgggtatacaaccaaaaaaattgaaatcaggatctcaaagagatatctgctctcccatgttcattgcagcattattcattgaaagcaacctaaatgttcattgagagatgaatggatgaagaaaatgcataatatacatacaatagaatattattcagccttaaaaaaacaaatttctggcttaatagtaaaataagccagtcacagtacataataacacatgataccacttatatgaggaatctaaaagagttaaactcatagaagcagagagtagaacagtcactgctaggggctgggagaagagaacatgaagcggtattattcacagggcacaaagtctaagttattcaagatatagaagttctagggacctattatacagcagaatgcctatagttagcaatatagtacactttaagaaattgcaaagagggtagctcttgtgttaaatatttttatcataaaatattaataataataaagagggcaggaggaaactttcgtaggtgatgaacaggtttatgctatagattgcaatgatcgtttcacagctatttacctccaaattcatcaagttgtgtacattaaatatgtacagcttgcctgtcaatcatgtctcaacaaagtgctttaaaaatatcacaccaccacatgagaaataatggcttgtgcatgcagaaatattaattacctgtttccttttctgctgggcctaaaacataagaaaagagaatttaggagaaaagcaaactctacccttgtcgttcatataatgtaaaaggccactttctaacttaagtttgatttggttcttagtctagtcctgaggataaaacataaatactttttttttcttttttaagaaaaaagtagggggagagggagatgatgaaaaacatggaagtttttctcacctaatgagcaagcattttgttgttgctattttttaaagaagactgctcagcattcctaccacagtgggttgctaggatccattttccagaatattcttccattagaccagagataagagagaagtgacttcagaaagggaaaaggtaggagagtttcccgctcactgtccattgggtactaccataggctcttgtctaacagagacttgtttttatgtgtacaataaaaaggttctttatccatttaaaatggattctatggctataaaatacaaagataaagtgcactgcatatatcttttctgtatccgtggacaagttaatagtcaaaaatattaactcagttgagagcaaaatgattcttacaggtttttttgggtagagtacataacatttacataaaacaatatggtgtttattcaagttccccacaacttttatctttgccagatctgaaaggctttaatatgtctattttaatatcatttcttccaatctgtgtcagaatactcaatgctcccaaaacatgaaaattatttgaatgagtatttaagactgaaacccaatgtgtttatcttccactttccccgaatgatcaaatgttcattgcttttgctttaacacaacatgatatcataattaatgaagttaaaatggtaactaaggaggtttcatgttgttactctcgtgatataatgttggttgttatggtgatgagatggcttttttgttaatcactcaggaggttggttatcgtatgcttgttagaaagcttgaccagatttggagagaagaaaggaataataacacaaacaattatcatcaatctttttccctacctgaattttggtaaaactatactaatatcaactgcttcataaatctatgattccttgagtaccattttatataaaaagttactaaaattttataaaggattatttacttttattttcaggtaagaaacttttattttcagataagtatttaacattaactgcattttttccctctattagttaatcctgcatgtattattatgaaagccagttttatgacaatttgagcaaaaaatgtgaggcctgttacttttaattacataaattaatgtgttgaataaaactgttgaataaaagctgattttgtgactttgccacaaattccaatctacttatttctaaacatttaaaaaattagtatccttaatgaataaagcctgaagaaagaaaaaaaaaaaaagcacagttctctcaagagatctaatctttcaaatgcatcagtacattgcaagcaattaaaaaccgaaggaagttctatgagtttatttcagccctcaataatcaacaagtttcttttttgagtgatactgcagaacagaaaataaaattacataatactacactgttactgatcaggaaagattttgctgcctatagtttaaatgttagacatacttaaagtactgccaaaaaatacaacccatgaaaacaccttttggttttttcaaaactcaaaataagaacaaaggacaacttaagcacgaatcctgggtctttcattcaagcagagtcccaggaggcatattaaagcaatgaataggaaaaagctcttcagttcaccagctgagattttaatgagacatttccctttgccatggcacaggattgttcaggaaaggaaaggacttctcatagaaaattcagttactaggcattgttggctctcactgccacttcgacaattgctcactgcactgaccttctattttggcatattctgtgagtctagtgtaattgatcaaggcagctttctcgagacattttctgaccactttcttcacctcttctgctggtatgggagtggcaatatctttcattaaaacctacagagagaggaagtggaagggtgaggggcagggttggggatagacagatggaagaaaaaagacagatgttgcataaaataaatactaaagacaaattacacaaattgtccttgatctgactattattagggagaggggtcctaggtaacctggggggatgtaatgggtctgcaatgcacttcccaactgagaatgtaatcctcccaccttagctcctcctaagcctaatttatgcatatcaaaacctcccctagaccaggtcaccattcagtgtgactgtcacttttcttccagggacccatgacaccattaaagcagctgtttcagataaagattacagttctcgggacaaataatagtttgttttgcacatccctaatttaaaagccttgagtcttttgagcaatatatttgagaacaataacaaaaattccattaagaataagcataatctttgagctctgaaaaaaaaaaaatcaagacctctaatctcactaaattttaatgattgtgatttgctgtgaataccacggcagtgtattcaaagagggagaaggagacctctttgccttagtgaaatgaatgcttatgaagtatcgaatgttaaaatacataaaaactttctatggttttaaaaaataactgattattctctgttgggctcctaaaatgtgtttttggacttttcctttaaaaatgttattactgggcaaggggaaaatgcaattacatccagaattcaaaatgtaatgtatttataaacactgttacattgactcataattttctttaaaaccttcataatgataaaactgctcacattaagttttgattacactattagtaaaactatctttctgcatatttaatgcatttattcttgctttactttcattcagattacaaaacatatggcagaatgttaatatagagaagacaatgctttcgtaagtgctctatttctatgtcttatattgaaaggaatattgaaagaatatgaaaacatccatttcatgctgtattatttcattctcttgtaagtcagcctcagcactaaggattttatcatccctgatttatttaatcatccaagtatcagtgacctttgacaacattttttaaaggctactctttgatgacattttaaatattttgttaggcaaggttttcttttttgaaaatagcaaactttatcattctctctctatcaaattcaattattctgacaaatatttagcactttaattagcactgcacattagactttgcagccagaaaaatccttttgtgcatagtaaaaaatatacatgcaccattaaatgtgattattactaaactttaagattaattttgtttcatatgcggaaccacgaacgttactattatacttcccatggcaacaaactttacataacaaaaatggctgttaaagttagaatgtatatgtctcccaggtaatatttcatattatctgggaaccagaaacttactttctggcaaagtacaggtaaagggctggcaaatgcaaaaagggagatgccaacctcgatttcctgctgcatcccatgttcttccgaggtatcataggtttcaagaattcacatgcatatttttgttttacttttcaatatcagtaagtaaagagaaataaaaatgaagaaatgacccttaacatttctgtctcaattcagcaggagatgtgatcagtgactataactggaataaaggtccctgttcatcctgccacctgtcaatggagggcaggagggcatcctgccatcactaagtcttccctactggggggcagaaaggaggctctgccatggaaaccaggacatggagaagctgtattaggtacccacgatgggatgttgttccaaaaaataaagcaatccttaaggatttttattcataataccttaatgaataggatgacatgaatactttgaaaaatctgagttatgtgcagctttcagtattataaaaattctaataaaacataattacaacaatcacatttctatcacacaatccacaacaatcagggataagacagggatataaaaataaaattaatctgtaatcctaagatctcattttaatcatcagttgtagtcctcatctcccaagttcttaaatcaatgaaatggagatgtaatatctggacaatgtcttctctctttgctttttaatagagatgctaataaacaatatagtatctaaaattaattcagcagaaaatggacaagatcaagtgttagaagtcaataaatcaggattacaataatcaaattatgagctacagatgaatctagaaattcattttaattctggtaagaaatgggagttggccacattatttaactgttagcatctaacaagtatatgaataaaattacagacagatgaaaaaatactgctctttgaaacttcagttgtcataaaaataggaatagagaatatattttccttaaaaaatgatttttttcacctggattaaaaatcttgtttgctggttattttgtgggggagaaacatttctataatatgtgaattcatttaaggtaacacatacactggaataattgaaagaaattctgagatgaatattgaatgaatgaaatgatatatttgtgaatggtaaatgataaacttgttggcatgaggactacgacaggtagaagtacaaataaagttggaggataataaaagacaactgtaaagtctgagaagcaaaaacaattattcttaactgaaaaaaaagtatttcatgagggaaataaagaggtaggaaaaatgattactaccaaaaagatgccataatatgaggataggatttcagtgtgaggcttcagaaaggcttcagggagaatgaagtgctgtagacagagtctgaatgtagtaagaaaaggtgagaaactcatgacttgtgatggaatcagtagagagcatagaataacggggtctgtctccctagttcaataactaaaatacacagcaactgagaaagcaaatagtatttataaagtaatgttcaaacataccctttcaagtaatgaaagtgtagcttttagagcaccttcaggtcgtccaaagggaaaacagtatctttaaaaacaaaagaaagaacaaaagagtcaaacatttaatacccaagactgctaaataattcctgcttgtattacttggcattaatgaagaaccatgaaacaaacagaaaatattatagcatgaactcatccagggaaattttaactattaaaagtttacctaaccctaggatttcaaagacttaaacaataaaagtataagctgtgatgaaaaaggttttaaacgttttgatgatacttgttttaaaagaatacagtaaataaaagaacctcaagggtcatgagtaaagcgataatatgcattctgcaataatttcttgtttaagaattgttattcaagttctaagagaaaatgaaataatttccctcatttcctcctgtggctacttgtggtttagggtggccacatataccacagcaagattccagctctttcctttgctgacatttgcctgtctaccatgatgtctaattttctacctccccatacaatacacataaaccctctgcagttcttttgaatacagtcatttgtcccaaatatttctagttctacatattcctactgcacaccaacaaatgaaggacaggtcatggggatgttctgaaatcagtgtcagacaaggctggattgtgagtgggctactcagaatttcatggctacctgatggtaacaggtttattgctctttaccagggggtcctgcttcaggtcaatttccacttaaacaatactgaacatcagggccatttcatctttttggagctccttgctttgctgaaccagattcagcaaagtgcctcctcccaggactgcagttcccacctcaggatcaagtgctacaggcagctgggctgtacttaggatggcaccttgctctgacttagaaatctgcaaactaataacttggaaagaagtttatgtatctccatgtcattttgcataaatcaggcacttggtggacatattttctcagatataataaaattatatttctcacaccataatttaaacatatttcccccaaaagcacatatgttaagtttaacttgttttatacaactattttttaatagaagagattgatttctcctttttaaaacaaaacagcagtttaatttatattaggattggattttatattcgtgaaactttcattagtctcacacagatgcaaataaatgttatataaatctagtcactcaagttttttttttaacagaatatcacatttatcattgtatttactgctaaaaatgtcctttcttaatcttgctgctacatactccgctactctccacccacacgcacaagaaagccataaccaatttattttgatagtttcttctgtgcagtggtgcttttaagagcattagcaaattagcaaagtacctttaatcattttgtatattataaaccttaatccacgtttaaataaaacacaaattgggttcttgtagtcccctccccctgcttaatcttttcagtgtatttgcataatccatccattgtcttccctattgtttatttccattaacctgtgggtgacacattttatgaatggaatgttactgatccccagattacatttagcatttcagggctctgaggtcccactgggtatgttctaaattagcattagctgcccatgatgtgtaaataattcaacacatttacggagtacaagtaatcctgaatcaataaagtacagaaaataactacatagaagcttaattaatctttacaaaacaagttttaaaagaagagaagcattttgttctgcctttcaggctaaatattttgggtttttaccactctggcagctctataacagcaaagcaaagtggaaaacattcaattatcaaataaaattcagccacattatatacctaacatgaataaactgaagtcaaccttattcccattttggcaaattaattgcacagataaataaaccagcacagatttatcttataattaagccctttttgttccctatttttaaatacagtattttttttttttaccaaagtgatatatacacatagtttaaagaggaaacttcttttatcttttttttttttaaatgaaagccagaaatcctttatgtcagttccagtttctgctttctacaaaaaaaaaaaaaaaaaaaaaaaaatgctgtcaacttttagctgattcttttggtatttaaactttatatccttcaattgtacattaatatttttacttcttgacttttcaattttaaatattatcctactaactttccactacggaagagaagtatgtagccttcatttgtttcaggaactgcacatatttaaaatatatggtttggttaagttttgacatatgcatatacttgtgactataatcaagttaactcatggcctgcaagtcttccccccagatcacaggcaactactcatttccttgctataattttgattagtttgtatgtctagaattttaagtaagaggaaatgtacagtatttacttttgtgggtctgatttctttcacttagcatagttatcttgatattcattcatgctgttgtatatatcaagagttcattcctttttattggtgggtagtattccattgcatggcatacactgtgtatctattccttgctgatggccatttggctttcatagtttggctactatgaataatgttggtatgagcaatcatataaaagtctgtgtggacacatgcttccatttctcttgggaaaatacctaggaatggaatggctgggtcatatgataaatgtttaaatttttaagaatctgccaagttattttccaaagtaggttgtagcattttatattcctaccaacagcatataagagttccagtttctccacaactgtgtcaacacttgttatgttcagtttttgttttgtttggaatttaactataccactaagtatgcagtggtatctaactatggtttcaaattgcaattccctgttgaataatgacgttgagcatctttccatatgcctttttgtataatattcctttggtgaagtatctgttaaaacaattttttaaattgggttaatattttataattaaactttaaaagttttatatattctgaataaaagtttactgtgggatgtgtgtcgtctaaatactttctcctattctgcgacttaactttttattctaacaatgtctttggaagatcgaaagttctcaattttgaggaagttcaatgtaacatttttttccatttatgaattatgattatgttttatttaagaatctttgcctaacccaaagacacagatttttcacccaagttttctaggtctacctattttgagttaacttttgtattatgggtgaggtatgaattgaggtcaatagtttgcatttgaatatccaatagttccggtagcatctgtcggaaaaaagtatactttgcaaattgcccttgaacattcactgaaaatcaacagaccatatatgtgtgtgagtctacttttggactttcagtagcatactatcttgattactgtagcattataaattttgaaatcagtgttaatgttcccacgttgtcctttttaaaagttatttttgctatggtaaattctttgcatttacatgtaaattctattatcaggttaatttctaaaaaacaatcatactgggattttgactgaaatagccttggatccataggtcaatttagagagaattgacaacaatattgagtcttctggcccatgagtacagtatctctccttctatttaggttttctttaatttttctcagcaatactttatactattcagtgtacatgttttacacatctttcatcaggttgatcccaaagtatttcatattttttattgttattgtaaatgatattatttaatttcaatttctgattgttgccagtatatagaaatatattaatatttatatatttatcacagggtgtggtggctcatgcctgtaatcccagtattttgggatgcccaggcaggaagatctcttgagcctaagaatttaagagtagccctgggcaacatagggagatcccatctctgtaaaagaaaatattatctgcgcatggtggcatgtgcctgtggtcccagctacttgggatgctgaggtgggaggatcgcttgagcctgggaagttgaggctgcagtgagcagtgatcacacctctgcactccagccctgagacagggcgacagagtaagaacctgtctcaaaaaaatcatctaggattctgcaacttaaatattggagtggaattttttagattcggtaagattttctactcagataatcatgttacttgcaaataaagatagttttgcttcttcctttccaatttggatgacttcaaaaaatttgtttttttcagaatcaatgcactacctagaccatttgtgacaattttgaacataagaagtgagagcagacatccttgcctttttattttaggtagaaaacattcagtcttttaccattaagtatgttagccgtaggtctaccatccatgcccttaactggttgtatataacatatggtaacaatagtccttctaatacatttggtttactaattctatattttgtgtcttctcagttttgcttggttggctttttaatcctcttcattgatcatattttactatttttctatatacttaaaattttttcaccagatgctggagatagttttgtcttgttgatgtctagatatttttgtattcctttaaatatgcttgatctctgtattcaggaatgctcttaaattacctggaaacagtttggcctatttgaatcttgattttaatccccattaggtgaatcagagttgtgttaatttttttcccatggctgaagcaaaacctaatgagtactctatagattatagtactctactgatacccatgagttggttttccactctgggtaatgaaaactagaactacccctggtcctgtgtgttagcattagagattccccccataagcctttcctgtggttctttgccagactttggatagtttcctcacatatatgaaatgatcaatacttaacaggagactccagggaatcatttgcaaatagctgtagctctctcctctcctttagacctctgacctgaaatctctggctaccttggcctccctggaattccagctctgcctcttcaagtcagagagtccactaggctctacctaggttcctcctttctggatcatggcctggaaatgctcttctggcagtaagcaggtgcaactaaagggcttacttcatttcttttccatttctcaggaatcactttcattgctttatgtttaatgtcttgaaaatattttttcccatttttggggcctttttaaattgttttgggtgggaggctaaatataatcccctgctgctccatcttggacataagtagctccctcttttttttttttttttttttttttttgaccacattcccccactataaacaaaattcctgtcccttccttacttctaatatagtaacatcattttgcaggggttagatctaaattcagtatctacattacattagttatgagaatgttctagacaactgagacacagtattttctatgattactttccatgccttgctcaatagtttgttcataattcatacttatatttgtttttgatgtcctctctttatacacttaatctaatacaattccaaattctagtaaaagtagtacaatctaattaatacaactccaagctctattccaagtgggcaaatatctcaacatgtcaaaatatgttttatcaatttaatctacgttgaagcattttctgacatgctccagtcagaactgattgctctctaaaatcaactgtcactttgagggtctcaattaaccatcactctagggacacctttctctctcccatgttgatttcttgtttcggggaattttttttttttttttttttttttttttgagacacagtgtcactccatcacctaggctggagtgcagtcaggcgatctcggctcactgcagcctctgcctcctaggttcaagcaattttcatgactcagcctcccaagtaaccgggactacaggagctcaccaccatgaccagctaattttgtatttttcgtagaaacagggttttaccatgttggccaggctggtctcaaactcctaacctcaagtatgtcacccacctcagtctcccaaaatgttgggattacaagtgtgagccactgcacccagccagtttcagggatcttagatcctctttgtttccccctggttttggtaaattctacagttcaccaaagggaatataaaaggaacattttttttagtgcatgtctaaaaatatcattattctaccatcactgttaatagaaactattgctggtatagaattctaggttggaaatgatagtttctcagaattatgaagttactgttttccagatatcagtattgctcctcacatcaaaatgaaagttgaagaaaaggatcttttaaagttttgttcactgtctgacacaaagtaggagctcaataaatatttgtagaataaatcaatgttgagaagtcattctaactcattgtataaaatctggtttctctttctggaagatcttaggattttttaatccttaagtttctgaaaattcatgaaatgtacttataaaaccatcagctctcatgagactcgctcatcatcatgagaacagcatgggggaaacctcccctaccatccaattacctccacccggtcccacccttgacaaacggggattattacaattcaaggtaagatttgggtggggacacagaaccaaatcatatcaggattgtatagtacatatttagagaaattatccaaagatgatgtgcgtataagagaaatagagaaacaaaactttaagagaggacaggaaactaaaacgatactaatacaaaatgaatacaataaatgacgtggacatccctgtccactactatgtagttgtagtttttgggtggtagtgtggggaattgaagtcccttggtgagtggctctgattagtctaactcaatatagcaatcccatgtccatgtcagtgactgattgaggcatcccgtgcacagaatttctctggccactggttttggttcaaaaccaggctcatgagatataaaaaatactttgctaggatcttctaaggaaactttttatgatcttaagagaagactatagaaaaatatagcttctacgacttcctttgaacactggcatgtatgaatgtgaggccaagaaattctgtaggcttaacggctaaggtgtgagataaagaaaaaaaaaataaaaaaattatgttatcttactactagtctggggatgaagctatcccatgaaagagaatagcaatgtgagaatcacaaagaaagagagctgtggctactgaataaagcttgtcttaaagcttgcctgctcgagacctgcaggcaagtgagcatgcaaatttatttattgtttaaaacagttggaggcaggatttctattgcttgcagttgaaatcattgatataataatggggacttattcagttactaatatagatatctaaaatgatggctgggtctcaacggtagcaaaaaagagggaaattacactgattttcattgaaagatacataaaatacatttaaaggattctatacaacctaggagacaacacttttttttgtttgtttttgtttttttgagacagagtgttgtcatccaagctggagtgcagtggtgtaatcagagctcactgtagcattgacttcccaggctcaagtgatcctcccacatcagcctctggagtagctgggaccacaggcacacaccaccacacccagataattttttagtttttcttttttgtagagatggggtctcgctacgttgcctaggctggtcttgaactcctgggctcaagcaaccttccctcctaaagtgctgggattataggtttgagctaccacacctggttaaggcaatgctttcaacaacagcaaatgcagaaacacatctctaaaactgcaaaataattttttatgtcttcattttgtttgtaaactcaaaatcatttcaggcagagaattcaatcttaactctgtaagttgaattcagctatgctatctacaacagtgtttcctaatgtaaatttactggcctttttgggcagaatatttctccactgtgggattgtctcatgtactgcacttttaaacccagcactaaatgactccctacccctggttatcatgacaatgaaaatcataccttattcacttactctaaggtactgctactagccccagttgaaaaatcactaatgtaggggaatagatttatagtatatactatgagattttctcctttcaatatcatttaaaaaaatcacagagtctaagacctttatattatcaggaaacataacaaaaaagaataataatgaggcaataacagatcaggaagaataagaagataaagaaacggagtctcagcatggtcatacagcattcatatggttaaataaaatatttttgtgaacatattcactaagtttattttttaaataagtgcaaattaagagcatattcactacgtttattttttaaataagtgcaaaataagagcatattcactaagtttattttttaaataagttccaaatcacatgcatgcaacatagcagacaggttataagacacaatacattatgtggtgacattttataggcctaataataagggagaaaaagaaaatatgttagcatatttctgtttttaattattaagttctgttgaactaactataaccaggagaaaagaaatattatcaaggtatttatcttttactctgtaaatgtttgaaatgtttcttagtattggtggccttttttttttttttttttttttttttgagacaaggtctcatgctgtcgtccaggctggagtgcagtggtgtgatcatagctcactgcagcctcgacctccccagaatcaggtgatcctcccacctctgcctcctgagcagctgagactacagacatgcaccaccatgtctggctggttaagttttgtattttttatagagatggggtttcaccattttgccctgtctggtcttgaactcctggtctcaagtgatcaaacccacatggcctcccaaagtgttgggattacaggcatgagactctgtgactggctgatagctaattttttgagcaaggaatggtgctaggtgctgtgacctgtgttctcagagaatgtaagtaaaaagataactaatgactttaaagccatgtgggttacaagtgacaagacaatactacagacaataaatgctcaaagacttcagaatactctctgctggaataactgagaaaggccccactgtggaggtgagacttgagggctccttacctggtaatacagagagcaggaggaacagtcaccagagctagggggaagagactatgcaagaatgagaaatgcaaaaggcaagtaagaggtgcagtggaacggatattgtagggggaatggctagcctaaatgaatacaggagactgaatgatacgctgagaagcagaccacagactgaagaatgtgaaccttaccctgcaggcaagggagggctactgatgatcttgagcgctagtagaatgatataataaacaatttttgggggaagtaagggttgagtaaagtatgaaaagaaatatttatattaataaaaaaatatatacctgaaatggcttatctgattttctaaaagggaagagagtctctcttttatctcctcaaatctttctttttcttccactgaaacagtcccaattccatcaggcctgaaaaaaaaatcagaatcaataattcatattgatcgaacatttacttttatatattttatacatatgtatatttaaaaatccaaggaaaagttcactgtatacatattaattgtgtttacagtggaaatttactggaaatatttgcagccatttgctttatattttgacccagaatgaatggaatggaattattctcttttagacagccttcaaggtaaaagattataataaatattttccagatctaccgaaaacaatgactagtccttgaaaatggcagtgaaaagtgttttatagtagtaccaaacatttgaccaactaagtgaaatcccctgaatgaaaatattattaaaaaataatgaacgtaaggtaaaatgtcttaactggttctcttccaaataataattcagctaacacagaactggagatttaattgtcataagaaacatagaaatttttgatacatgtagaagttcactgacctctttttgtttgcttaaatacagggcatatgaataaatattagaattaaaatatacagggaagagagcaagctatgtttcttttcaagatttttgtgtttaaatattcctgtgaaatcaatgtgagtttcatcagaattttacaaagtagctatgaagactgaaaataaatcttattttactaagattaggattaaaaatgtaaaatatatcaaataacagaaatttagaatttattctgtatcaatttaggtatccggttgtacggcaatcatctaaaattttgaacatataaatcttaactgtcttgttagtgcagagggaaaaaaagtatgaatctcatattcacttcaaaacctgtttatatattttaataacaaaataaaccttttgcacttgataattaacaagaatcatttcctacctaattagtttatttgttcatttagtttctgagacagttttgctcttgttgcccaggctgcagtgcaatggcacgatcttggctcagtgcaacctccgcctcctggattcaagcaattctcctgcctcagcctcctgagcagctgggattacaggcacctgtcactatgcttggctaatttttgtatttttagtagagatggggtttcaccatgttgttcaggctggtctggaactcctgacctcaagtgatctgcccgccttggcctcccaaagagctgggattacaggggtgagccaccgtgcccagcttagcttatttctctaaagattatattttaattcccaaagacttgtgcatttatcattccaatgtactaattttaatggttatatataaaataggtagaaacaggaattattgaaaacaaagaaaaataaatgcttaaaataactttcctaacaagatttttatttgttcctctctatatacatataatcatatgtatgtgtgtgtgtatatatgtttgatgcttgttaactagtcaattaggatgaaagcaattaattttaaacttatacctgaattatactgacataatgacctttcagtcaaatcaaagtatcatttaagtatgagattttttttccaatatagagtacataatttttacttcagagactcatgtgctgctggaatttatgctttgaaaacatttcttacaattttttattcctaaatagggaaacattacttaatttcatatgcaaaataatatatcgaccacatttattccatctgaatgcattttgaatgttaactatggaaaaattaatggccaaatattagtctctcaagtatttttaggaaggaggaaaagtctaacgcataaattacaaagcagtgcaccatgagctaatactaatattttatatttatttaataatggatttttcacatattactttagaatcaattcccattgagcgaatgttaatacaaaacacaaactgaaacctatgaataattatgcattgacaatgatcacaaaagctcaactgggaagttctatataaatcattaatttggaatttgggtattcagacaaaaactatacctaaattacattatcatgtagacaacaatgaaaactcataccataaagttatgggtgattatttcactgaatatccctaggcaaattgataaaaagagcaaataacttatcttcatcattctgctgatttgacataatcttttggcttagctacctggcagatgctatgtggttaaataggagtaaacttttctattttgttcaactgtcaaatgagattgtcatccacagtgatactgtaagttgtcctatcatattagatttcactgaggcccactgtctgcttgacagaatggagccagggggtcaggtgatgacaagtgagaaaggtaagtcaggggaagctcgcttgtgtcaaccttcgctaagaaaagaatgttatacagagtgaaggaccaccattttactgagtttatcactaaattaggtacaaatctgacagttaaataccacgtttagcaatttggacttgcctttacacatccttattttagaatatatacaagattaactactgaatattaggcataagaagcagccttctatatctaaattattggtaataaatggtaactttgcagtagtcaactctaaaggcaacagttcctcctacaataattcttcccgataagtgcaaatactttccgtgtcatcaacatcttgtcactgtaattattaaaacaaacataatgatgagcacttatagaattttaaatacgtgtctggtattttgtactggctatcttatatgcagaataacatataaagctcacaacaatcctgtctcctttccaaaagagaaggctgctgaggctcagggcagttaggttaattcccaaggtcacaccgctgggaaatgcaggagcctggacttgaacctaggtctcttgccctccaaagacgatgctcttacccttactctcttcctgctatattttgatagaaaataataacgagcaatagaaacccaatgaaaccatgaaagttatatttgaaaagcaataatggagtattttgaatacccttacattagacattttctatctgacttgtctaaggtggagacgttaaaaaccaatgacatttaaaatataatgcttaccattgaatcagcaagtcagttaaagaagaccgtaagaaaggaagtcctaaaccttgctctttcatacattctaaagtatgtttttacaaaagccttgagagaaatttaaaccagttatattttatgaatgtttgtttaatagactcagagtattcgagatttaaaaattatcatttatataagctcagtttataaattcattcctgccagctctaccttcaaaacacacccagaatgtgaccttccctcaccatatccaccactgatccactgatcccagccactatctgcttatccctgagtacgcaggcagcctcttggtctttctcctccagcgctttctttgtcagagaactggccacacactactccgagcctcttcaaccatcagtcattatgacagtattccttgactcaattcctgtaatggtggcacacaaggtaaaagccaaagcctttataatgatgtatgagccccgcttcccacaatctgaccttatctaccccctcacttgccctgctcccctccactcaagccatgctggcctcctaactagtcctcaaacacaggaagcaagctccaggctcaaggcctttgcaagtgctgctgcttctgcctgagagtgctttctctacatgtacacaaaatcatatatgcacacatgcacacctggcttgcttgctcactttcttctggtctctacttacatgactcagcattagtgaggttatctccaaccatcctacatgaaagtgtatttcccattcccatagacctttctattttttaataataatatttattaaataataatatttaataaaaatgttttattgatggccactgtacatatggctgccatctaacatgatatatttacctatttggttactgtttgcttcctttgtaatgtatctctagtgctagaacaccagatggcatattgttgatatttaatgcatatatgctgaggaaatgaatgagtaatatatgcaatataaaaatattacttaagatgataagaattcatgaattagtaatatgacaaattattattactgcttattagaattaacagggtataaattatttggaacatttttatttattttttatttttcagatggagtctccctctgtcacccaggctggagtgcagtggcacaatttcagctcactgcaaactccacctcctgggttcaagcgattctcctgcctcagcctcccaagtggctgggattacaggtgtgcaccaccacacctggctaattttgtatttttagtagagatgaggtttcaagttggccaggctggtctcgaactcctggcctcaggtgatccaccctcctcagcctcccaaagtgctgggattacaggaaagagccaccatgcccagcttggaacatttttattatatgatagttggtaaaacagaaaattttgtgaaaagcaaacagaagcaggaactgtagttaagtacactggtaaaaagatctctaaagttagtatgtattcacacttagcagaaaatctttagtgtttaattttattttaattaataataaaataatttactttaaatcttaagaatagaatttttctccttagatataaataaacataataatcctgctttgacattgataaagattctgttaaaatgtggttatttaaaattcgaacataaaagacaaattttctcatttgaatgttaagtgggacttaactctatgacgataattaaatattaaagtggttctgatgagaagaaagggtagtcttatgtatcaatatttaatattctcatttttttctggggcctgtagttattgaagttacatgatttcaataaaaatagggtgctctgtgaaaaaggcttaatatatgaaaaaattataaaacagattaaaatagatacacttcttttaattacagataaagtcaaaaaagttatgacataaaacttctatctggtcttaaacaataagcaagtgaacaccaagtgcagttgtgtgttaatttatttcaaaggttcttaaaaaacagaatttgtacaacagaaccttctgccactgaggcctgatcttaacgtctgcctgtgggtcacactctgttttcagagaagccatcacacacatgtacatccccctgcaagctgcatacacacgtgtgcacacaaacacagacaacactttttgaaaggcagattcatccaaaaaatagttgataaggcctctatatacatattttcttaaatttctccatgagctaagcaatcttgtaatttgtgctattcatcaatctggcagattactgcattctaaaacaaacgcaaaaactcttttatatacattgaacatcccgtcatgattatcaattcctcctgtaacaagtgtgacgtgagctctaaattgaaaaaggtatttttaaactaaaagtcaggaatgagaggagtaaacagcattactcatcctaatccattttctattatttcggatgatttctgtggtaaaacaaactaaaaatttagtttctataaaggtaaagaacaactacactatagggtaagaaatatctaagagaaaaagggtacaaaactgggctgtagaatcaggcatttgagcagaagagaaaatatcaatgaggaagactgcttaaatattcagatctgtgcaaacctagtgctttacttcccttgtttgaacagtttgtgttcacacattttatagatcccttttccagtataataaaaaatttcaggggtttgtaacaccaataaaaactaattttgacatgtttaatatccattcctttggagtacatttgagtaaagatgaattaatggctgtcaacattttccaaaacacattgtaaggaacaatgaccctcagggatgcccaaatattttgtaaacaatgcaaattacgcaacccttttggaggttcacagaacaatcacagcatatgaaggggtctgagaagcctgatagtaaagaaatctgtttaactttgtataaatagcacttccagaattatttagtcacatctgcccacattcctcctgaaaattcattatttagtgctgacgagcatccgttctattacttaatgaaaactataccatcttctagagttattttttcaatcacttttatcacctgcacagcttttagatatgtgagggataaatgtgtttataatccctaggctttataatctctaggactctgcacattgcctggtttacagtacttagcaagcttgtggattgaataaagacaccagggttaacactgtatagtgaagtgtggttaaattaataagacattaaattaaattaaatgctcccccaccccatctccaactcatcaggtaagtttgtcctggaaatctggtggtttgttgtaaaagattatttcacaagcaatgcatgagcaaatgacaaagttcatggtgcttttgagttacttataggcttcttttcacctgcttctgctacgaggaatgaggaatgcatgacatcttagcttcctctagggaaagtgagaaggggagagacacctagagggtggtatttctgaattgtcaattctgcctgcagcacagcaggtaaaagtcactttgcacttcgtgtatttcccaccaatatccatttgtgaacagaatggaaaggagaggatgtcacagcacgagaataagaaatgataaaagatgatgaggaagaaaacaataatcccttcttttttatttcctaacctataatacctcctattgtttgaatcaaatgatgtattacttggatggtcatatattacacactcagtgtccttttacttcccctctaattttaaatatccagaagaaattaattgtgtctttatatgatcattgagatataaaaaacagattttctatgaaaaaatattttaaaagatgaaattctgaaatatgttcttatctttttgcaaacactccccccttccttgtctggattttgcactgcattctaatttccttggatgtttattttaaaaagggtagataccactatggtgaaagcaatcatctgactctataaagatctaagatcatattacttcgtttttgtgttagggtgctggtgaataggccaaggaccaaaacataattgataactggcctctcctgggaccaaacaaacaaataagaaaactttcttggactaatccaaactgaaatcactgctgtatataattccagaattcaagagaaagaaataccaagagcaatttaaaataaaagtaaagagaattaaggttggtatagaggttctctgatataaatatcaccctctgccctataactaatatttttaaaaaacaacatatattgtaactaaaggacttcatatatatcatactatgagaagagaaatttgaaaaataaagaccaaaatgaaaatttcctataaatatgccaaccagaaataactgaaatactagtttgtaaatataattataatttatttctctaactctatagatgtattatacattctgattcataatttgattgttttaacgaactgtaagcttttaaaatataatttaaatattctaatttataatgaaataattatatttcaatatatggatgtgccataattaatccaattatccattatttagaaatgtaggcatttttcctccattttttgctatcatagatagtgcttcaataattaatcttatactatatatgtttaacccatatccaaatgttttcttaagaaaaattcccaaaggtatattgctaggttaaatgcacgatattttcaagtattcgatacatattgcaaagttggttttttagaaagcacttatcagcttacactctggcctgcagtgcatgaaattattaattttcctgcaacctcaccaactgtagtctttatcctttgttataatcattttcaattttatatactaaaaaggggatctattttaatatattaatttctatgatggaaaatgatgctatcttgctgattatgtagggcctttatcatgtgccataaaaataattgcagttgattaatttaaaaacatttaattttaaacttacttaagaaggtccataatatatcacctataaaatttgtaaacagatggcccaatgtcattcaattatttactcaatcaatatttatggaccacttggtcaggtcatgggacacaatgtaagcacaacagaaatggtttctgccccaatagagtttatagtgggaaaatgcatacaaaataaaaattagacaataagtatacaattacatttaagaagggcaaaagtataaacatctgatctagtttggagtgtcagagaaggattcagtttggaaatgatatttaacctgaaatgtgatgaatgagcagcagtcatttaggtgaaacctgaagcagaaggcagtttgaggagaggcccaggatgttcgccatagagatgtccaaataattttttaaatgcaaattttttcatgtgacttctgcttgcagtatggtggactaacttgatactccccaaatccttattcactacaaaacacctaaatactgcataagccacaacaattatatattaaatgttgtccagctcttactagaaagtaaaataattctcccaagggtgggagaacaaaacaaatgaacctgatgaaagcaaagaaggggcaaatatgaacaacatggctgtcttggtggtaaatatcaatactgagaaagctttacagctgcatccaagggaatggatcactgagccatagacctaatttggatgagctgctaagcctgagacacctgcataaaaatgggaccctagaatgggttatagtatcagtgaaaggatagtgcactccctaacatcaaggaaaaacaagaacaagtcctctttagagggaagcattcagagcccaggacttttaagaattcccacatattaatcttaagtataaatgtttattacaaaaaaatgctaattgcattaaaaaataataaacaagtgaccatggcaaaaatgtcggcagaaacaatagaaaattcagttatttgaaagataatatgaaataattataaaagatctaaggaaacaaaaaatggaatcaaaccaagaaaggaaaaagatattcagaagtaatcaagcagagctcaaaaagaatcaaacagaataacagaatttccaggactaaataatttgttaactgaaattaataaatcaataagtgagtgaaacagtagatgtcagagctgaagagagaactgaagaaatagagtaagggttggcaaactacggcctttcatctgcttttgtcaatataattttgttgggacaagccacactaattcatttctatattgtccatgactgcttctgcacagcaatggcggagttgtatagttgtaacagagactacatggtcaaaaatagttacaagattttgtatagttacaaagcccaaaatagttgtcatgtttactgtagagcccttcacaatagcagccaattcctcaactggaagacagaattgaaaacattacacaggatgcagctggaaaaatacgtagatagaatacattttagagacattaaaagatatagaagataaaatgcctagtacatgggtaattggagcttcagatgagaagaaaaagattgtagaagagacaatatttaaagagataatgctattccagaactgatgacaaatataaatctttatattccaatcagggtaaataaaaagaaatgcacacctatacaatatcatggcaggtagattagaaattcatatatgtcccaatcacaataaattaaaagaaatccatacaaagaaaccttacagtgtacttacaaaacacaaaagaacaaaagaatctttttttaaaaaaagcatccagaggaaaaagaggaatcatcctcaaaagactagcatttgtactgccaagagccttttttgttgttgttttgttttgttttttaagatggagtctcgctctgtcaccaggctggagtgtagtggcgccatctcggctcactgcaacctctgcctctcaggttccagtgattctcctgcctcagcctcccaagtagctgggacgacaggtgcgtggcaccatgcctggctaatttttgcatttttcagtagagagggggtttcaacatattggccaggctggtctcaaattgctgacctggtgatccacccgcctcggcctcccagagtgctgggattaaaggtgtgagccacctcgcctggcctgccaagagccttcttaatggcaacaaagaaaatcagaagaaaatgaatgtcttcaaagttctaagagaaaataaccatcaacctagcactgtacacctagcaaaactttctttgaaaaaataggatgaaacaaaagaaattcccaataacaattcacagtgtataagagtccatttataggaaagtccaaagaacattcttcagaaaaaaggaaaattgtttctaaatctaagcaaatacgaagtacaaaataagaaagataatattaatttataagcttaggaaaaaaggatataactaaaataccacagaatttaagtatgtaagccagaaagggggtgactggagggtaatattctaaggactctgaactacctaggaggagaaatttgttaattagcataagactttaaaatttcagcaacatgcctggtaaatctcaaatgtaattgttggaaaatataaactgttaagagaaaaaaaaagaattaaagaaaataacttcaatgaaacaaaaagtataccaataaaaagtttatagaacatgagccaaaaaagaaagcttaaaataaaatggtagaaatggatttacttttattaacatgtgatttacttttattaatatgtgatttacttttatcaattacatgataaatgtaaatggaccaaactaattaaaggacagaaatagtcatattgaaaaattaaatcaaaatctagtttgctatttataaaacactaaagtacaagaatatagaaaggctaacgatgtgaacatgcatcagataaacactcatcaaaagaaagctacattaataatcacctacatatcatgcaaaaatcattattagttatgatgatcatcaccaaatgatgataacaatgttcatctaccaggaatatctaacaatcttaagcttgaacacagaacagccttgggccaggcacagtggctcatacctgtcatcccagcaatttgggaggccaaggaggaagatcacttgagcccaggagtttgagaccaacctgtgtgacataatgagattttgtcccaacaaaaagcaactcctcaaaaaccagcttcaaaatatacaaagcaaaaatttacagaaatagagagcaaaaaccaccatgacagtggtaaatcaccactcacgttggtcataaccccacagatcaaacaggcaagaattagtaagactttagaagatcttaaccacacaaatcctgtttgcactgcctaaagaatacatatatttttttttaagtgacagaaaacatttataatatttgacacatatttggccacaaaggaaatctcaacaagtgataaagaattggtatcacacagatcacattctctgaacacaaaggaattaggtaagaaatcagttctcaagaaaataaccaaaaatcttcatattcttagatttttttttttttgaggtggagtctcgctctgttgcccaggctggagtgcaatggcatgatctcggctcactgcaagctccacctcccaggttcatgccattctcctgcctcaacctcccaagatattttaaaacgtacttataaataaccttgtgtcaataaattatgaaaagttaaaattacttagaatcaattttaattaaatagtacataagacatttctatatgtagtaaaaacagaatttagtgggggaagttacagccctaaactcttagaaaagaagaaaagctggcaagtagtgagttacacatctaacataagaagttaggaaagatgacataacctcactaaggagggtgggagaaaaagctgctttcctattcatctttggcaaacagtattttgactggaaactgaaaggttttgtagacaagtactatagcctagttggtgaattccaaaactgctttgcatgaagttcaggggttgaacaattttgtaaatggatggtggaagtaagatttctcactgttgaaaagataagttaaagataaggaagaaaagcatgctgaaatgaatgttgatgtcctagattccagttggagacgtcagtatgaactcatggtttagtacacatcatatatcacctagctctgtccaactgagagggcctggaagctatgatttttccagcagaaataaacacacatgtcacctagatcttggtttctaaataccattctctaaaaaacaaacaaacaaacaacaacaataacaaaaccagagctccttggagaactgattaattcttaggctagagtagggaaaataaaagatgagcttgcagcatgtcagattgccagaaactaagaaagtgctcaaaaaccaaatgagtggggcatatcaaagggagccagtataaaagagctttcaatagctacagcaggaacaatctgagcaacaaagtaatttagatattattagattgtaacccaaggtataaagcaactgcacatgaatctatacggatataaacaaatggttaaataaataaattggaaagaagagacatatattccttacagaagaattctgaataacgtatgcagatagttctccttctaggagttggggtttatttcctgtctcctcttcagtgtgttttattggacttagctattttcttcaaactagagtataaaaaaataaaaatgacatctttacagtagagaaatgtgacaaatactaccaggatgtcacgcggatattatgtactccctgatagaatgtgatgagaagggtatttcatctctttacaaaaactcataatctcaggctaatcatgaaaatgtcagacaaacccaaactgagagacatttgataaaacacttgactagtactcctcaaaactgtcaaggtcacaaaaaacagacaaaaaaatccctaagaaactgctacaatcatgacaattaagtgcaacttggtaccctgaattgaatcttggagcagaaaaaaggacattaatttaaaaaactggtgaaatctgaataaggactggtgttcagttaatactagtgtgccaacgttgatttcttagttttgacaaatgtatgacaataacattaagggaaacggaaatacgaaaactctatgcactcttttagtaacttttctgtaatctaaaattatcgtaaaataaaaagtatatctaaaaaagaaacaatagagttcaacaaagccaaaagttgctcctttgaaaagaccaataaacttgatggattaagagaaaaaaagagagagaaggtaaaaatgaacaatattagactgaggaagggaagaattgtagatcgagcaaaaaatacaaagaaaacaacttgaataacttaatatcaatacatttaataacttaaatgaaatctaccatttcccagaaaatcataacttgcccaaactgactcaagaataaatagaaagcctgagaatttctgtagctacaacataaactacaacagttaaaaatctttccacaaataaattcccaagcccagatggtttaaaacaggggtccccaatacccgggctgtggactggtaccaatccatggcctgtttggaactgggccatacagcaggaggtgagcggcaggcaagcgagtactgcctgacttccacctcctgtcagatcagtgtcggcattaggttctcacaggaacctgaaccctatcgtgaactgtgcatacaagttatgtgctgcttatgagaatctaagtaatgcctgatgatctgaggtggaacagtttcatcccaaaaccatccccatcctaccgttccaccccatccatgaaaaatttaccttctatgaaaccggtcgctggtgccaaaaaggttgaggaccactggtttaaaagatgagatactggtaaactacaaaaagccattcaagtcttatacagagcaagtgggaaagctccccagttcattttgtgtggctacagtaacctagatacccaatcctgataaaaccagtatgagaaagtaaaataacaagccaattttgtacgtcaacatagatctacaaatatcaaactgggacggcaatggtagtggtaaataacacctatgtacatatagagctttctttgattgtttctacatacaacattacatactgtttttgaaaaacttactgtgttaaaaatgataagaagatccaacttaagacccaaaaactttgtcctatacctaactattgacgagaagaaggctctaaaggtatgaagtttaagaaaagctatgtcaaggtgtaacccttgtttctgttcatggttaatgtgatatagtctaatatatactaaaaaatttcctttgccttgtctcttcctcagaccttcagcaggctgttttatttaatatctcacaaagatccaggagttgcacagtttgaatggaaggtgtggaaggaagacagaggaaattaattaggtggccttagcaactatttcccaaattgcagtctgtctacatacttatcctggatgacggggttctaggctcctgcttttcgctgtctttgccactcccctctggggccacagtgttttccagcaacatgggggtggtaggcggggaggtcccagaacttcagcacagcttttccccatgaccacggataggagatgaggtgaggcactgactcagtgctcttccagtctcattctcctgattgaaacctgtttgtggtatgttgtcataacaaaattcacctgagtactgcagtgtttcacagaacaatccccaaaagctcatttaactaatacactgcataaaaaaattactacatgctatttaagcaatatttcatcgtttaaaaagtacttacagaattttatttgacctatttaggaaccatattgagtaggtagcattaatgttattactcacaaggtacacatggagaagctgaggctcagacagattaaaaccatttgctcaaagttaagtagttcatcagtagaggagccagaacaggaatacagatgctctgattcctcactcagagatatttccaacacaccaagtctttcccttccccttttctttttctctggttttgtctgttttgttttgaaaggcacaattatcttgcttcagtattgaacttgaggttgggtgagtataaatattgctaggaaagtctgcttaaggtagatttagggttgttctacagtttttgataaaataaaaaaactcctccagtaatatttgaaatatactccccaatacccatcccttctgcctttgcacatttagcacatggcataaaacctgtcagatcaggtacattacctaaggataaccttgcttatgacctttcatctggttgctcacctgccccaaaagtgagtctctccatttacaacgtgtgtgtcatttatacttaatttctatatagtcacatatctaaaactagaattaagtgaacacttttgatgatcctacgtgatgcaattatctacgttgtttctcaaaaaatgcacactgtctctaaaattacagattggaagtttgaggcataatttctgaagtgacagtcaaggggaaatgttagcacctgtgaagacagaggtattatgatatgatgatttgactgatgcccattaaggttacttaacaactttgtgatataatctggaatccatagaaaattgagattattttatatataaaactacagtcatgttgtactcttgtgccctgtacttgaaagcaagcacatctgagctggcgtttgtcaggcatgcagcagctctaagacagccctagaaaactgtagaggagtcagtgaatacactgtatgccttacattaaattgggacataaaagccattttgtgttgctgcttcagtttctccaccctcagcctgacttacaaaaccaagacgtataaccacacatatcaacctagaactttgccctatgaagcattgtctctgaaagcctcttttctccttcctgtcagtcctcagcggcactatggctgaatgagtggttgtgttattcagagatgtgtgtggctatcatcctgcatgagtgggtctgtttctgtccttgactcactttttctttcttcctttctttttctctctcttcctcagtcttagtaccagccagaccttttctgtttaactctattcttttatttctgaaacactcagagtgctattcagagatgtatctgtacagaaagaacacacctagagagctcaacactgtgcaataggatgtgctccctgaaaaatttcaaatccagacagcactgttgtccttcacttcagtcaataacaaaaggaaatcttttctccttttgaatttatgacagaggtagttcaggtaatgagcaaaacgactctttgaatatgtgtcttgacagatgtaaaaatgatcataaaataagaccacggcaaacaatgtagaaaaaccagacttgacattgacagtatgtttaaacaaaagtctctataaatatcagatgctacagacatggataagagaagcacattctcacaaggagaggttgccaaaacctgaatattccattaacaaagaaattaggaatataattacatacacattgaaatatttctatttagcatgaggtacagtcctaactacatactttttacttttttcttcatctcacaatttacatcctcttgggttaaatggcaaagaaaaatatattagaatagtaagagtaatcaatactgatagtattttataatgatgtagtaccttcacattagtatttgccccttttatgtatgacaactctgagtttcagaaaggttaagtgatttgttgaacatgggtcagtttgcaaatttcagagccgggattcaagtgaagatcttttgcctctttctggtctttcactgtggcagcatagtatttctgaatgacatctgctggactgtaaacgtcacaggaaacgtcataactttcagcttatcttggattatttctatcctaaattgaggctcaaatttccctcaaccctatatttcttcctttctttttcttaagctatatgacacctcaatgctgaatcagagactgattcaaatttcgattctaaaagactaccagagatacctgaatgtgtacacagtttaaactttgggaaagtggatttcacatgcaatattaaagataatatatgcatgaacatataaacataccttgaattacacattacagagtatcgttataaagaaaacaatagttttacagaataaaagtaactatggcaaccagtagagtcaaatcaggctgcctcccaggcagcagcagtagctccttgttgcctcagtaactttccattataatgagtctcaaacacatatattttgggggcacattagctgaattttccaccttaggttcccaatttaattttacctttctgtgtggatgaataaaatattctgattatacagtttgctttgggtttgtttgtttcactgaaaccttctcatcctcttgcattttagaggtctgcctagtgctggaatgtctattttttgatatcccctagtcagaaggaattgagacagagtcaggagacgagacagttttagtaaaacagctcctatcaacagttagccaccctgactgacccctgtacccccccattttctaagtgcagagggttgagtgtgagatagtggggaaaaaactactaaaatcagcaacatcctcctaatttcaaatcaaggctgggctccaaaataaagtgaaaacctgaatagactgtgagacaaggatcaatcttattttattgtaggctgagaaatggcagcactggggacttcaacagatatttattgtgtacctacaaaatgtaacacactgttttaggtacgtggaggataataggtgaatgagaactgatttttgcctttaaaatatgatctagtggaacagaagcaggtgtgtgtctgtgtgtgtgtgtgtgtgcacgtacacacatctagcacataagtatatatgacaaaggtaatgagataagtacagacaaaaagttcttagtgtctgaatgagttaattgaagtcttctaagatgagttttgtgatatttgactttttaaaactggaaaaaagaaaaacatggagaataaacagattttttgcggtaaaattttgtggagacaagaatgggcagatggaagaggatggtaatgggaaaatgttgatgctatcacttggaacctatttttaatttaataatcaaaaatcacttaagctttttgaagaagagtgtggtaaaagttattctacaatttttttgactgattggtagaatactatagaaagaaaaaggtagtagagaggtaaattcacatacataggccagaaaaaaatgaaggccagaattaggataaacaatggaaatgtaaaaaagagaatgttaaggggcactatgggaagagaatattaatattcacaaattggggataggagggaaaagaaaaagatgaataaaaagttaacgggccattaatggaggagacattaacacaaataatgaagtcattcattcattcatcaaatatgtattgagcaagattaagagaaggggagtgatatggacagatttttatttattttttatttttatttttattttttaagacagagcctgttctgttacctaggctggagtgcagtggcatgatcttggctcactgcaacctctgcctcccgggttcaagcgattcttttacctcagcctcctgagtagctgggattacagacatgcaccaccacgcccagctaatttttatattttttaatagagatgaggtttcactcagttggccaggctggtctcaaactcctggcctcaggtgatccaccctccttggcctctcaaagtgctaagattacaggtgtaagccaccacacgcggcatgatatggacagatttttaaggccagagatagacaactgtggaggccaacattagggaatttttatggcatcttggtaaaacaagagtacttgttcctaaagtgtggattagggaagtggctaagaagagactctacataaaacccattttctatcttgttttatcagtgaaaattaattccacagaggaaaagcaatgatcattagttacacacagacctatcaacacatcctacccaggcacaggtatgcattacaataggaatcatagggatacttaaggctattcagacttactacgaggtggtatgtaagaactaaaaggcagtttctaatctcatattttttctctctctctctttcgagtggctttaccagcaaaaagaaacataaagtgtagcccacctaaatcaatagcatattgatgcacacttttttctctgtcgtttttttttttttccttgtaagaagtgtttgctatttacaatctgttactgggtgataatcgcaaagcacatttttctctcttttccatagtcaaccccatacatttcactttgtatttgcaagtaaaaatacctgttgccgtgcacatgagaggcacagaatgcaaagctgtaatggagcagggtagggtcaatgacagcaccattttctgaatgttccatcagttctgcaaggtagcagagatgtctgtgacagcctctcacaccataacgggcacagtactcatctaacacaaagacttggccagggctaaaccatccctgcaaaataaaaaaagaatagatatacatgttttttctttctatactacgatttgctttcctgaacgcacttttaggccttataagcagaagctgcatgaaagtatcttgacatttattttattagtggtatgtttcatgaagagctaatgtcatcaattttgaaactgatttgggacactggcaacctaatgctattctctttttactgtcacagcaaggcatgggtaacttgtgcctctccaatgtcattcaaaattagtcaaatttattcataggatctaaattatcacacacaaagagtgttactccaaaaatctcagtctctttatgaatcaattaaaaaaagacgacattatagatgaaatttcctgctcaggagaagttttataaagtgaactaaaagaaaatgtcattaagtttagcagcagtatacatgtactatttgggaacttaaatatctgggatattcttctcattctgtttgtcttcctatgaacaatataacagagttaatgctttatattagcagtttctgttcctcctgaaataagatgttagaatgtatgtgtgtgcatgcatgccacctgaacacagcaggcagttgatgcggctaaaactggaggacaggttaggtggagctggcttataaaatatcttgatgaattatatggatttataagatagtaaaagaaaagaagggagtatagagagttttaaaagggggcagggtaatcatgtaagagaaataaagaataatgagaaaaaggtgagaaggcaataaaggaaaggaggaagaaaagaaaaggagtaagagaagaaccatcaggtgtggtatttatatgctttccatgttgaagataaataagctaaagctcagggatgttaagtgaattgtccaagactacactgcaaatcagttgttgagccatgatttatattcacagtcatctgcctccaaaacactttctaggcaaatcacactcactcccctttaggtgcagtggaagaccttgtagcattctcctcagactccatattacactggcggtcaacaacaaaatcaaaacagcttttgataattgaataatgtctttgagtggaatccgagaggacactatcccttattgatgttcactctatgtgtttgtccatgaaaagatagaataggattttgagatgatatattttactctccatgtgattgtaaagtttgagttggatcaggtttaaattatacttaataaacaatctataaatgaattaatgaactgttagtgtcagcgtggcaataaattgtttcacttcttcctctctgaagtatccccattttgatttcagacaaaatgggggggcgcattttgtctgaaatcttaaacagaatgtaactttattgcatgaagtttcaggttgagcatcccaaatccaaaagtcccagacctgggaagctccaaaatccaaaatatttgagcatctgcatgatgcttttaaatcaagtttagcctaaagctgcctccttacatattttaagttcagcctaaaggtttctctatacattgtgaattataaactaaatggagttgtaaatacacagtagtctactactgtgccaataactgagttttggccaatcaaaggtggccaactgttcaaactgtgttcaaataaggcaaatgctgaactgtaatcaatctggctgtttctgtaccttacttctgttttctgtacgtcactttcctttttctgtctataaagctttttccaccacgtggctgcgccagagtctccgagcctactctggcttgggaggctgcctgattcaagaattcatgaattaaactctgttaaacttaattaggctaaggtttttcttttaacaaagctcaaaggaaattgattttggatttttggattaaggatgctcaccttgtacatataatgcaaatattccaaaatctgaagaaaattcaatatttgaaacagttctggtcccaagcattttggataagggatagtcaacctgtactatgctcagtgtccaagagattaaagtagtgatagaaataggcattttctggctgcaaaaatttcagatgaattgctattgacaatgtaaatgcttggaaaaacacataatttttaggttataaagtttagtccccatattctgaggtgtcaagcattccttttaaataaattatacttcatatcccaaatgttggctacaatttcaacacataccaggaaacagtttactcaatttaattcactcctttccttttgtcaaggaattcaagttatactttggatggctagatgaaaccaaaactttcctttgttatgtatagctcctgtcatattgttaattccactatttccttcccctgccacttaggttgtccttctaagaacaaaagagagaaatgtgaggtgtcaacatctggggaacagaacttcaaccttaaaatgtctgtacgtcctataacagaggttttaaaaaatctttatttaaagccttctattttcactgagcgttctttaaagtgactgatacaccacagtttagcatctatttgagtctattctcctgtctattgagtggcacagcagtggtcttcaagtgtataattttcaaattgggaagcaatcaactggaatcctttatccctcactctcactacccttattaaatgagtcaggaataaaatgctggtttataacaagtatttctcactttctaaaatcttttattccaacttataggggatctaaaatcttttattccaacttataggggactagatagacttgtactcaccaagcaagaataggaatcattcagtctgtgatccaaagtctgcctctggagtattctaaaaaggaaggcatgatcaagcttgcaggggtttgcagaaataaactcatccataccatgtttctgaaaacgatctgcatctgtaaattcaggaaagcatgtacagtatatttacttttcaggcttaatgatggacatacaagttgtgaagaatacaaaatgcgtgactcaagcagaagactaccttttatcacatgaaatatgatgccaagagttcagcatattaacataaattgcaaactttatgaagcctaagtaaaaacaacagcaaaaaatctacaaatcattcagaatgcagtaattccatctccattcaaagctatttctaatatccaacagaagaataatcttattttccaactctgagaaaagctgtattttaaatctccatttactgatggaattgactagaaaagaacgaagatctattcataaaaaacagcaatgatgcctaggagtctgctttccaaatggcaaactagggcagaattgaacacacatgcttcagctggatcacttccagtcttctttttgtatggagcttttaatgggaccatccttaatgtaaaaatggcaatgagcgctctcaagcttcaagtttaagagacaggaaaaagggagcatcatgtttgcgcaaatatgcagacaaagcttaacgtcccaaatggcacttcaatcaaaggcccaaatttattgttctttacagattgcatctttcaacgcctgtagaccctgcgggtttatcaaaaggcaagcttttatgattgctttcattaatggtatgttttgtcaaagtcttcaatgtgagttatttactaagtatagagagaaaaagccacacactaccccaaaggagtgctggggtgttattacattagctctgttagaaacgtagcgcatactgagcaagcaatcagttatcaagataaaagtggactcttctcacaatggtaaaactgaaactccattgttccctaaaattcacagatagatctctttctggtcatcataagaaaagcagagtcctaaatgtaagctaagtgtagtttgtaaaacctatgtagtacaatcttaaaattataaaggaaaagagacaaaagtttattgattaaacccaattatagagtcagactcataataaaactcaatattgatctgtggacatgatgctaacataatcagtcacatttagatatttagcccagatcttattgatccatgtcaagttcaactttcagccatatttgtagatggaagaactacataattcaagctgaagggtcttcagaatcacactaaaaaatgatacacaaactaatgtacatctcacatcaatgacagataggaaaaggtgaatatagcaagtaatcaatgaatggcagcttattgatgtgtagggtataaggttataatccgtggagaaagtatcatacttatacctttacatttaataattacctgaatgattaaatacattacatgtgataaattaactggatgaacacaaaacagcttttcctgaactaatatacaattgaacttcttttgcattttattcttctgagtcttttaatagaaagttaaatatatgataatgtaatgtgaaataatatcagatgaataggaggcagaatattaaaactgcaaatcacacattttataaaattggaagattcttttgtattttaaaagatgtatcttagaatattcatttttccatttatctcagcaaaaaaatcttttagtatcatttttatgaaactaaattactagttttataaaacatctgctaaattttataccttatttctttcaccagagaaggttacaacaggagttaaaaataatgcccattaatggttaatctgttgagaacaggatagtgataaatttcacaggaaaaagacctatctttttcctgtgaaaaaagtaaaaaaatctttcttttactataaagatttgtagaagcaattaaaaaatgggcatacaaactttaaataaaaaatgtttctgaaaaacgatctatagttcatttctataattaaatcatatttttgtaaatttataaagtacttttctcaggaaatacaattccaaactatatatctgctaaggtaacaagtctttccaaatgacacacatgaatggaaaattactttacaaacaattaccattggtgataaaaatgatattaatgatagcactttgagtcacaaatacagactctactcggaaaaaacagacaggcaaacaaacccattaaaatttttatttaagaaaatcaacaaccttcaatttctccaggattgtaattttatgaaagtgaaatgtgttcttagaaatcattctatttttaaaacacaggctgtgaagaccaaacatttttactttctttctacatcagatcagcaccatttagaacatttcatgcaaaactacattaccatgtggcagtatagtcttagtttccatgaatttatggaagaaataaataaaaaagtaacagtcttgacctccctgaatgaaatggggtggcgggaaggggggcgggaggggaggggagaggagaggagaggagaggagaggagaggagaggagaggagaggagagagagaagagagagagagagagagagagagagagagggagagagagaggtaggtagataggctgtgtttcaataaaacttcattttcaagaacaggcattcagtttcagtttgctggccctctggcccttgttttaaacaaaataatagcaatgtatacaagtgtttataacattactgaaaactgacgggcacaatggctcatgcctgtaatcccagcactttgggaggccgaggtgggtgaatcacctggggccaggagttcgagaccagcctgaccaacatggtgaaatcccgtctcttactaaaaaacacaaaaaattagctggacatggtggcaggcgcctgtaatcccagctacttgggaggccgaggcaggagaactgcttgaacccaggaggcgaaggttgcagtaagctgagattgcgccactgcactccagcctgggctacagagtgagactccattcccatcccacccgccacccccgaccccaccaaaaaaaaaaaaacaaaaaacaaaaaaccaaaaactgtaaagtgaaatgtaaggcaacaatagcatcaaagctaggaggagagaaacagatgtaatacggctgaaatgcttttttagtaataaaattgtgtgtatgtatatttaagctttacaacatgatgttaagggatacatatagacagtaaaatggttacaatacagatgcaaattagcaaatctgtcatctcacgtagctactttttttgtgacagggaagctaaaatctacttaacaaaaatcactaacagtacgattgtatggattctagttgtcatgttgtacattagatctctagacttgttcatcctacacatctgctagtttgtatcctttgacccacatctccccatttcctccctgccatctttcactttaaagttatctcatgaactaatgtgaaatagaaaatcagatatcattaagatattatctagtttcttatttttataaagatatattttcacatagctttctacaggtataacatacctatatgttactcttgagagacacagccatcatctatatcaaatgcaaaacatgctttttagtcaattaccaaatccaaggctttaaaattgggttatactggattatcttcaattaatgttactataacacaacattatggtgactagttttaaacagaaaattattcatggtgttactcagatttctctgataatggaaaattttagttcaatctgtcttctgaaacaatatgacaactatcaaaacaaaccaacaagctatgagcttaagcagtatactgcaaaactgtcataaattgtgatgattaacctatggactaactacagatgtgggattggtaattgaggatactggtggagtttctatggcaacagttggatgtatgctcgagcgtctttaggtggtactgtcaccaggtgtgataacagtagatggaatgaaacccaaattgagaaagattattattagctatagatttaagaagttatagaggctttatgtaagtcaagcctaaaaattaaattttttcattaggataatagctgttggaagttaagagaaaaggataagtaggctgacagtatcaacttaaataggtaatacagacttgaaaataggtggcatagaaaatgatgtgaggactatcagtgaggggctttttggtaggcactgaccgccacctgccccttaagtgcccaagaattcaaatcctaggaaaggcatctaagtcagagagaatgtgagattgaaaaaaatttgaaatacttcttttttgctattgtgaatagtgccacaataaacacacgtgtgcatgtgtctttatagcagcatgtgcacatgtaccctagaacttaaagtataataaaaatatatatattaaaaatacttcttttttctttgcaacaaattcttatggtactgcatttgttgctgctcctagtgttgtgagaaatcatggatgtaaaaggaaaagggaaagaaaaaggtaaaggggcactctggatgaaaaaaggaggccattttttagcattctgaggtcactctggtgtctgggagtgggactctagtatcaaaaggactaaaagggtgctgccagccaagactgctctctgcaaaacagagctgaactaagaagcaaatgactcttttgaaatataatacaatttactgtcctacatttaaaactggcctatgtttaggagttcacctgtagctgcatttaccactactcacatctgattatacatttcttataattcaaaactcccatacagcttgaaaatttataggaagttaaaagtggcacagcaaagtaggtgccacttctctttttataccatccatgtaggctttaataggaagagtttaatattttaaaattttacctagatcagcctgaatagtatgtccatgttttatgtatacatactttctgctgaaaagcaaaggagtttgttcacacctttattattgaccaaataactgcttagcttcttttggttaaattgattcaaaacctgatatatgaattaacacatcttgctttctgcagccaataacacgtaagtaatacttttgcatgatgacaattttgatcaacacagaaacctagaattacaaataagcaaagtaaaccaatattgaacatttattagaaataatatgttcaatgtaaaagaaagacaaatgctttccctatgaagtgtgaaatttaatatattagatcaatcatgaaaataagttcacaaaattaaatgttagtttatattttaatttaataatttaaaaatacttagcttaaaaataaacagatggcagcttttctggttcatttttgatattaatttattattggaagacaaatgctactattcatattgtattatgtgacacacacattgtattatgttacatatataactgagagacagtgaaaaccagggtgtgtgcactgcattttggttggagagaacaaagtacagtttaaccaaagaatgtccatcaatctggcaactctagcacgttacattttaagtgaaaaaattggttaccagcctcttccccaccccttcagctcactctcttcccttagaatttttatatatccagagagtcaaagaaaaaaagaagtggaatagatttgcttattagagaaatctataaatacatattagtaatgtcccaaaaagataaggttgtcttccagtaagttagattttataattttttttttatttttcctagttattgttatgcttagttttttaaaaaataagcttctgatttatacttcattctaaagcactgggtttgtgaaaaataaataaaaatacatacttcaaagaaaagatatagaagaaataaagtagcaactagtgcctccgataaaacatatccactgaatattttagatgtaattctacctatattttgcttcatcaattgggtgtttttttatgtagtgaaaataataccgcatgtataacttagcattttttccacttaacatatattgaccatttgttttgcacgttattacaacacattcgtggctattacccttgtgcctgtatgaatggtagatattaggttgtttctactttttttgttgcgatagacattttttgttttgtaatcaataaagctaacttaaatattctgggtttggctagaaagtaggggattgatcctgtaaacaagatcatgatattcctcaaacatagtatcattaaaaattttttaaaacatctaattttaaaaatcatgaaaatacttacctttaccagctacaggtcagcaaagaaatgagaaacaaagcatatttaaatgggttgggaactatatacttatacaactagacatttaattttttattttctcaatttctactcatgattttaaaagttgtttttctaaaagaccatcaggaaagaaaacaaaaattgattatgtaagtcaatggagggaggaaaatactatggatgaaactactctctggaggaactctggaggaattcatggcatttctctgatagttcagggtcactaccctcattctgatgaggtagaacattttctttcttcattctttttttttttttttttttttttgacggagtcttgctctgttgcccaggctggagtgcagtggtgcgaacgtggctcactgcaagctctgcctcccaggttcacgtcagcagaggtctgccctgatttaaaactttactagcagcctggaatacaagtcagttgttgttaacaaattgaaacagtttccctttttagttataacaagtaaattcagttctcatagcctgatcaattctgccttgacaataaattgatatcaaataacagaaaggttttgttagaaacagatgatagggctgggcgctgtggctcatgcctgtaatcccagcacttcgggagctgaggtgggcagataacctgaggtcaggagttcaagaccagcctggccaacgtggagaaaccccatctctattaaaaagacaaaaattaggcaggtgtggtagcatacacctgtaatcccagctacttgggaggctgaggcatgggaatcccatagcctgatcagtcctgccttgacaataaattgatatcgaataatagaaaggttttgttattatttgttacaggcaggtgcagtggctcatgcctgtaatcccagcactttggcaggccaaggctggcagatcacctgaggtcaggagtttgagactagcctggccaacatggagaaactctgtctctactaaaaatacaaaaattaggtgggtgtggtggcacacacctgtaatcccggctgctgagattacttgggaggctacttgggaggctgaggcacgagaatggcttgaacctgggaggcagaggttcagtgaggcgagatggcaccactgcacttcctctctctccagaggcagactctgtctaaaaaaattctgtattattcagccacagtcttaaagttctatgctagtggttcctacctgcttttcttgccattatgtgcaagcaacaatagccacgagctcaacacattcctcgggcattccttgcactcaggatgttaagaaaaaatatgggaacacaagtgaaggaggatggcgattaaaaaaaaatagttattaagtcactgtaattctgtggttctcaactgggggtgattcctcaccaaccgcaaccctaccctctgggacatttggcaatgtccagagatatttttggttgtctgacctgggaccaggtgggagactattgatacctagtgggtagaggacaggggtgctgtaaaacattacataacgcacaggaaaagttccttactccactccctgccccaaaacaaataattatctagcccaaaatgtcaatagtgttgaaattgagaaaccatgctttaacttacaaaaaattctgcttctggtcatgatggcataattgagaataaacttaacctcctacctgaattaagtattctaaaaaaatttacaaaaagtttattaaacgctgcacgttgggcaacgtgattcctgagggacgggaaacaaggtgagccttacagtcactccaggttactgccaggagaaactctatagcccatggcacaagcaacaggaacccaggaaaagcccagtggtctccctgagttcaaaagatggaactgacagttcagaagggtgatagtaactagagtttgtaggaaagagtactggagagaagagagctgcccagcaagagactctcaagatctacagaaggcctcccccaagaattcagctgactacccatcagctcatgcatgtgtagaaagggaaagaagcaatctaaaggattcgagaggacagtgccccaaactcacacagcctagaatagcactgcttttcagcagcaagaatataaaagctcataattcacaggttatcagttagagtattaagaaagatgttggtccagaaatggggaaaatgcatcctggactaaacactgcttggtcttccctaacaaaacttgaaagcaaagcttgagaggattgaattgtttccaagtaacttaactgtgtctcagaacaagcatttttatgaagaaaactataccaaggcacatcataatcaaattgctcaaaaacagtgttaaagagaaaaatctttaaagcagctagaggaaaaaaggacattatttatagaggaaaaaaccaaaatagcagcacatttctcattggaaaaacaaatgcaagctagaagaaagtggagcaacaccttaaagtactaaaagaaaaatatcttcaaaatgagggtaaaataaatactttttttcgtatataaagaagctaaaagtattcattaccagcagatctgcactacaagaaaagtcaaaggaggtcctccaagaagtgaaaatatctatattagatgatgaaaggcactggaaatggtaatgtacatgtacataacatgtacataatggacatgtacaaaatggacatgtacataacatttttctttcacttttaatttatttaaaagatattgactaaggcaataatcataatagcaatgtattgtgggatttaccacatatatagaagtaaaatatatgacaagaatagtgcaaaagccaagagaggagaaatagaagtttactattgtaaagtgtgcatactatacatgaagatatataataaatttaaagggtatactttaaattctaaagcaatcacaaagataacaaaacaattggactgaaataaaaaattccatttactaaagcaacaaagatgaaatacctagaaataaatctgacaaaagatgtgctagatctgttcactgaaaactacaaacatcccaaagagaaactaaagactacctaaacaaatgaagtgatacatggtattcacagattggaagactcaatattaagaagtcagttttccaaaattttccaaggactgacctatagattgaaggcattcccagtaaaatctccagcaaggaatgtcaagatgttttaaaaatttacattgtaccccatatatataaacaattatttgtcaattaaaagtgaataaacttattttaaaaattcatagagaaatgcaaaggacatagaatagccaaaatacttttgaataagagaaatcaatttggaggacttggactacctaactgtaagatttaccaagctacagtaatcaagacagtgtggtaataatattaagatagataaactgaccaaagaaaggatagcccagaaataaactcatatgtagttaattgatttttcacaaatatgcaagggcaattcagggtacgataatctcttcaactctttgtgttagaacaactggacatccatatgccatccagaaatactgatggatacctctcaccatatataaaaattaactgaaaatggttgtaaaatgtaaacgccaaaattgtaaaatttctagaagaaagcaaaggagaaaatgtttgcaatttgggttaggcaaagatcctttagttataacatcaaaagcacaactatgaaaaaaattgataaaatggacttcatcaaaattaagaatttctttttttttttttctgaaagtcactattaagagatgtgaaaagacaagccatagattaggagaaaatatttgcaaatcacgtatctgacaaacatcttgtatccagaacacacagggaaacttcattttattgtgctttgcagatgtgtttttcataaattgaaagttcgtggcaaccctgtgtcaagcaagtccatggtgtcacttttttaacaacacgtgctcatatcatgacgtgctcatatcatgactgtttcatgttatggtaattctcacagtatttccaactttttcattattagtagatctatcacggtcatctgtggaaagtgatctttgatattattgtaattgttttggggtgccacaaactacacccatataagatggtaaacttaataaatgttatatgtgttctgactgttccccatctctctcccttttcttgggcctccctatttcctgacacacaacaatattaaaattaggctaactaacaacctgaaatgatctctaagtgttcaaatgaatgaaagaatcccatctccctcactttaaattaaaagctacaaatgatcatgcttagtgagcaaggcatgtcaaaagccaagataggctgaaagcgaggccttttgcaccaagtagctaagttgtgaatgcaaaggaaaagttgttgcagtaaattaaagttgctactccagtgaacacacaaataataagaaagcaaaacagccttattgctgatatgaagaaagtttgaatggtctggatagatcaaaccagccacaatattcccttaaaccaaagcctaatccagagcaaggccctgcctttcttcgattctatgacagctgagagaggtgaagaagcctctgcaaactgtgaagccagcagaggtcagctcattagggttaaggaaaagaagccatctctattacataaaagtacaaggtgaaacagcaagggttgatgcagaaatggcaataagttatccaaaagatccagctaagatcattgatgaagttagctatgctaaataacagatttttagtgtagacaaaataatcttctattggaagaagatgccatccaggactttcgcagttagagagaagtcaatgcttggcttcaaagcttcagagtacaggctctcttgttagtggctaatgcagctggtgactttaagttgaagccaatgtttattaaccattttgaaaatcccagagcccttaaaaactatgctacatcaaccctgttctgtgctctataactgaaagaacaagcccagatgatggtgcatctgtttacagcatagtttactgaatattttaagtccactgctgaggcctgatgctagaacaaaagaatctgttggaagcattattgctcactgacatagcatctagttgctcaagagctctgctggagatgtacaaggagattaatgttgttttcatgcttgctaacccaacatccattctgcagcccacagatcaaggagtaatttcaactttcaagtcttattatttaagaaatacattttataaggctatagctgccatacatagtaattcctatgagacatctgggaaaagtaaattgaaaacctggaaaggattcatcattccaaatgccattaagaacatttgtgattcttgggcggaggtaaaaatatcaacatttacaggagtttggaggaagttgattccaaccctcagggataactttaagggattgaagacttgagtggaggaagtcactgcagatgtcatgaaaatagcaaaagaaccagaattaaaagtgcagcctgaagatgtgactgaattgctgcaatctcatgataaaacttgaacagataagaagttggttcctttgggtgaagcaaagaaagtgatttttgagatggaatctacttctggtgaagatgctgtgaacattgttgaaaggacaacaaatgatttaggatattacataaacttagttcgtaaagcagaggtaaagttttagaggattgactccaattttcaaagaagttctactttgggcaaaatgatagcaaacagcatcacatgctaccagaaaatctttcgtgaaagaatcagtcactgcagcaaacttcatccttgtcttattttaagaaattgccacatccacaccaaccttcaacaaccagcaacctgatcggtcagcagccatcaatgttgaggcaagaccctctaccagcaaaaatactataatcactgaagtctcaggtgattatttttagcaataaagaattttaaaattatgttttagacatgatgctagtgcatgcttaatacactacagtgtagtataaacataacttttttttttttttttttttttgagacagggtttcactctatcgcccaggctggagtgcagtggcgctatttcactgcaacctccacccctcgggttcaagcagttctcctacttcaagcctcccaagtgctgggactacagccacgtaccaccatgctcagctaattttgcattttttgtagatacagggtttcatcatgttgcccagtctggtctcgaactcctgaactgaagagatcccccccacctcgacctcccaaagtgctaggattacaggcttgagccactgcgccggccaaacataacttttatacacactgggaaaccaaagaatttgtgtgactcactttattgagatattcatcttattgcagtggtctggaactgaacccacaatatctcctaggtatgcctgtataaagacctctcaaaacccaataagaaaatagcctaattacaaattaggcaaggtatgtgcagagatacataaccaaagaataaatatggatagcaaaaaagcacatgaaaatagcatttctctatatgagcaatagtcaattagaaaatataataaaaaatataagatgcaatagcaaggaaagtatgaaaggcttagaaattagcttaaccaagaataaaaagagctctatggaaaattattaaaatgtaaaggactcagatttgaataaatgaaaggatatttcatagtcatggctgggacaactgaacattacacaggtatggatctggaggcattctatgtttccatctctggaggagtgaatagaaataaaatgtgcagtagaccaggtaacataagacagaagcccacttacatggtatgcagtaatcagaagaatgagattagatgtattcataaaaacatggataaattttaaaaacatagagatgaacaaaaacagtaagactgaatatgacaaagaatacaaaaccatttatgagattgacgctaaatgcacacatacaaaatgcaaatttgcaaaatgaaaaacacaggaaattcacattaaatgctgtagaactgtagcttataggggaagggacagagactggcctatggagaggtaagaaacaaatttataaaaacttggttttcaacaacaagaatcaaaactcggagggaaaaaaatagatcagctggatggaagaaaatggttttgggaagagatttgacttgagttaatgttgtgctgggggtgagcaatgaacagagctccagaggaaaaaagttctacccggggttgagggagtcttatactttgatgcccaatgcaggcacagtccagggataaatacccaatttggcacttgaagtaggaaagaagcagtggataagagctgtgctgcaagagaaacgcctgagtgagcacccctgtgcatagctggggaatacccaacaagttactatgtaccactgtggcaagaatctgatgaaaatgatgtaaggaattcataggtgtctggagttgatccaaggaggacacagactacatggacttcattgccaggtgccctggcaggtccatggtgacgagcagtgcataccagcacataagtaatgaaatcaatgacagaagtcatgcctaagcccatgtgaacagagaatagtcttaggctagatgttacattcaatgatatcacagttttatgcaatccctctgaaacttaatttactatggatcacatggaagaagagtagggggaagaatcttgaattaattgaattataatctgtgactcagttgttttgaattagcgagttaaagttttttggcaacattagaaattaaaatttaagatatgttcaattgtagaaaaataaagttacacttctgtacaccttagctctgatgaaacactcttatctgctgtgccatactctatgtgtattacccagagggtgagaggaaggcagcagcagcgagttaaattttcaaatacagtgaaaacatcagaatgtgctctttttattttattttaccttttaagatgacaatgctactaattttaaagaagaaattttaaatcaatgaaaaaatttataatattcctaaatagttttcactacatataaaagatatgccccaaaataattacgataatctatgagtatggtctgtggtttctaaaataaagaaataaaaagctcatggttcacatttaattatttgaactaaagtgcctttgtttaggatgcccagaaatgatactgaagggtatctaaaaagagaagagaatagttacttgatgcatgaaaagcagaagaaaataatgcatgtcaagatgttattccctttgagaagaatctcaagaataaaaagccacaagttgagctgaaagttaaagacaaatatttattacaggtaaaacaggataagctttgtaaaggagtacaacaagttaaaacacttggtttagtgattatcaaagctaggtttgaagatgttttgaccattattccataattattaagcatcagtcatttaaaattaaaaatttagttcttaacaacttaaggtagcattcaaaaagtgacatgtctttaaggtacaaggggaaaaaagttggctttatgacttattatttttatcaatctacaacaaaaaaatagacctattatccttctggggtattaagaacaattctagaaggtaatggttcatcattttggtattctgaaatcctatcaaagcaaatttgattttgcaatactttttccatatctataggagacttaagtcaaaaatcacaataaactaaattaaattttcctttgagaagttttggagaattttcttatgtgctcttgagatttctagaaataccctaatgcttgacaaatccatgattggaaaccacacgtaccatttactccagatttatgtgaaaaattagataagtgattatgtgactactaatatgaactattttcatttaattaggaatcaattaatgatgtaaactataatactgaatacatttgcctcaattttatatcttattaaggctattaattgataatcaaattattttttaacaaaacttacaaagctgagcatctgcatggagagttcctcctttaggattcagtttctgggtttgaattgcaggaactggtttatatgattgacctgtggccctatacatggcttgaacccataatattctgtcctgttcatcatcactggcaaagattacagtatctccttctttaacagcattaaagaacatacaaccaccctgaaggcctgtggaggaaacaaaaagacatcattaaaaatttataggattggcagattttcgtctcattcactaactgacctcatggaaaagaatggctttgatattagcagttaaatgttttaaagaatatttagtttaaaggatcaaatccacaatcaaagatttgaagaaaaacaataacaaaaagggttaagctcccatattacctcagaaataaaaaataacctagggaaacagtccatgacagagtatcattctacaagacatataaacacactccatggaaatgcatagcacaatctgatatttcatgccagagaaagaagttttatctgttggcatagttgccattctatacatgggaaaaatatataatgattaagacaaaaatgatatttcatattgcatgtattttatcttttataaaattctttcacataatattttgcattttaagtgaacaattagttaatatagtcataaatttctatttcttaatctctattcaccaatatttaatcattatgtttattaatgtctacatttcttgatcttagatattaatgtcattaatattcattcattcaattttttaaatatcaggtgtccaatactctttccagtattaatatgaagggagagagagaagtacaagcatgtattgttggggagaaaattagtagttataatataataattcatttgccatttctttgcctatttctgctataacttttgctttcccgcaaagaagtttctgaaaacattgtaatatctcacctaattattccattacagtgaattttacacatttcaatcctgcgctaaaataataacaaatatgatgaaatatggctaaaaatacaagccctccaaaagagataatttgaatctcataaagtcttgcccaggtatataagtgaaatatgcaccctattcatcgagaggggtttaaattgtagaacagacaaaggatatttataagaattccatgcatacatacatggcaggaaaagtgattcaattaagatttacctgggtggggatcggtataatccacagtatagccttcaagctgcattaattcttgtggttcagacttcttttctctataactgcacatagcaaaggtatattggctaacctgctcgagaaaaaaaaagtttacagattagtcacattaaatttaccaaatttaactttcgtttttttatcaaaatactcttttcccaattaaaaatataacataatttgcacataaattattaaattttagcatttttcaaaacctagctcagagattcaagcacctttcgtttgtcagcttgcatttgttgggtcttctatgcctatgatccagcattccccaagacaatgatttggtgctcaagcttctatattaatagaagcaccataaataagtattcatgttgatacgtttgggatcattagcctattaagaagataaatagccttctttcacttcatggtttcttacagcttttaatatgctaacgtaggctataaatctctaagagtaagattaggagtagtcctagatttacataaacatgggaccacattttcaagcatacttatatcaagacttttaacaaagtaaaaaaagatctcacgcctgtaatcccagcactttgggatgctgaggcgggcagatcacgaggtcaggaaatcgagaccatcgtgtctaacacggtgaaaccccatctctattaaaaatacaaaaaattagccaggcgtggtggcacacaccagtagtcccagcaactctggaggctgaggtagaagaattgcttgaacctgggaggctgaggttgtagtgagacgagatcgcgccattgcaccccagcctggacgacagagcgagactccatctcaaaaataaataaatgaataaataaataaattaattaattaattaaattaaattaaaataaatctcactaaaagttgagaatttagtggccacataatgaaaacctcaggcagggccaggatggagtaaattttgggcagccagtgacaacattgccaagatctggtctgcctcttaattcttcttgtcttttggaattggcctcatttccttgtgctaaagtcttactagaaccatagctgctctgaagtcacctccctgagtgtgtctgcttggatcacaaggccatatttgaacaaaatactgtaaatggggaatgtttcattagcccagtttgggtcaagagctcatgtatgcagcaaagacgtcagatgctacaacaggcaggctctttccaaagtcccccaacagagatagagggaggttctgttcccagcaggagaaaaggctgtttggtggatatacatctaaattgcaaaatatcctgcaacacagggtccatggaagatagtttggttagtgtattttttttctttttttcttttttgagacaggttctcacatcgtcacccaggctggaggacagtggcacgattatggctcattgcagcctccacctttggtgatccagtgatcctcccactcagcctcctgaatagctggaccacaggcacatctaccatgcccagccaatttttaaaaaatatttatagagaaaaggtctctgtctgttacctgggcttggttaatgttaattatttcctttttctgtttttaaacataaaatgaaactaaggaaacatagtacctttcaatagacagtgattacttcaataggaccccaaaataaactaattatgaaagacagagaaaatatgggctacattaaaatcaaggtattctcttcatttaaagggtatcatgaagaaagtaaaaaaggcaaagcaacagactaagagaagatgcatgcaaaacatatattcaatcaataactcacaccagaaatataaagaactataaatcaacagggaaaactcagaacacatgttggaaaaacgggcaaaagatgactactcttttttattttcacatccactctctgtacctgaggccaaaaagagaggtttgaggaagtgacaggtgtaagatgcagggatcaacattgtaacttttaaaaggagaaaatatattttctgttctgagaaaagaggagctcttttctctgctcctctctgctcttctacaaagtaaaaggcgcaggtcattgtgaaaattaccatgttagagactgctaagttgcatgacaaattgtggatttaaaactgaaaattaacacaaagataacatttcattagaaaaaatgctgattagataagcaaaaatgaaaatggttactagtacacagtgtgggtgacagaatgaaaactggtgtggactttctggaaggcaatctggcaacaggttctatgatatacttacgttttacgtacatcacagtacataggtacaaagatgtaacacatttttgccaagcgtggttatgtttaatcttttttttttttttttttgccaattttgatgagtgggaaatactttcactgttatttgagtttacaattcctatcacaataggactgagaattttccgttatattcgataaacatttgaagttttcttttctgtgagtttcctaatcaaatagtttgctgtttttctaatatatcatttcatcatttgtacccttctctataatcaattttgtcagaggtttattcacttttttaacgtgttaacatgactaggctatagtatccagttatttaatcaaacgctaatttaaatgtggctgggaaagtacttcgtagaaatggtgaacatctacaatcagttgactttaagtaaaggagattatcgtcgatatgtgggtgggtctcatataagcagctgaaggccctaagagcaaaaactaaggttttctgaaaaagaagacattttccctcagcttctgctgaggcagcaccagcttctgcaggagttccagcctgctggcctttctggagaactcttactgatacagtagcaaaaggctgactattttttatgcattcctttggtctagcaaggaacgtatctcaaggaaacaaatggagaagtactcaaagatgtatatgcattgtgttcactgcagtattgcatataagcggtttggttaaaatatattatggcatgactatataggataatactatgagacattaaaagagacgtgacagatttttttcttaacatgggaacctaagatataacatttctaagatataacataaagagcaatttaaaagcaaaaatgtagactgtgattctgtgggtaaacattatatatatatatgaattaaaatatatattaaaatatttacagtgattattacaggatggtgaaatgataggttattttattttatagtgttgagttttttaaaagaatatacattattttaaatcagaaaaaagaataaagttatttctattttgaagaataaaaacattaagccttaatgggagagattgaggccagtatcttgtgatacttgtggttcttgctacactaaattttccttgtgtctttcctcatcttacagacagtcaaatttactttttcccttgcatatgtctaaggtttacaaatgaaagtcagttgctcccataagggttttttttttttattttttggtaatcacttaaaggtttcagtttccttgtgttaaaaggtataattgtgtgggtgtttttgggggtaagggttaaggggttggaggtgggggtgttgagaggtaaacaataacggtccaactgtatttgttctaaaaagaagtcctttctcttactctagaaaaataacttagttcaaagttcccctattctttcataaagctattttacacagcattatcttaaaatattatgaaatatctccaacataaagaaaagtacaataatacactaacatgtatatattcatcattcggctttgttgaatggtaatttcttagagatacatatgctttaaagtgtcttttttaaaaaaggacagattcaattaatgcctatacatactcacccaagacaatttcctttctcttctcagagataaacaccatgatgacttttctgtttattatattatttccatgacgttttgaaatgtgtaccacatacaagaaaatcgataaacatcaagtactttttgcatgtttccaaacttcatatgaatatatcatacatattattctgcaactttcttccccaaaagttcaatgcttctgatgcttaaccatcttgatataaatattgttacttgaattgtcacactttaaccactatcctagtgatgtccttcactttttttcacttgtccttacaaacaatgccatgatggacattcttgtacgtcttgtcttcttgctcacatatgtgacagcttctctagtaccacttcaaggagtggaactgctaggttgttgggtgcacagatcttcatctttactgaatgttgcctagctgctttccaatttgtacatactatatatacctgtggtatatgagcactccagatataatattaatacatctttaccaagcttggtattttaaatctttttattttttgccaactttgatgggtgggaagtggtatttcactattatttgagtttacaattcttattaccaataggactaagaatattctcttctgtttattagtcacttgggggttttgtcttccttcctgatgaaataatttcctcatttttgaatgtatcatttagccattttataccattttccacaatcaattttgccagagatttattcacctttttaatgttttcgagaaatgttattgcattttgttaatcctctctgttgtttttcatttccttaatttctgccatctttcttatctcttcatttgggatatttatctctttatttatttatttatttattgagacagagtcttgctctgtagcccaggctggagtacagctgcacaatctcagctcactgcaacctccacctcctgggttcagtcaatactcctgcctcagcttcctgagtagctgggatcacaggtgtgcgctaccgtatctggctaactgtttctgtttttagtatagatgaggtttcaccatgttggccaggctggtcttcaagtcctgacttccagtaatccacctgccttggcctcccaaaatgctgggattatggcatgagtcaccacgcctggccttgattgtttttttaaactcatataattagcttattcatttttaattcatttttaatatatgcatttatgtttattctaagttcatattagcctcatctcacaagtagcatttttatgagttctgttccaaatatttttcatttttatgatttgttttttatgttggagctacttagaagtatgtttttaagtttggctttgtggttctatttttggtttttaaattaatttcattgttatcagaataattctgaatcttagtatttttgagacatgttctgcttaacacatgactagttttttaatcagtgttttgtttgcttaaaaagagtgcatgtcttgtaattattattcagtgattattcacgtccattaggtcaaatttactaattgtcaaatattctatatctgatattcttttctgatgtaaaagtattgagaaatgttaaaatttcccatcaagattatctctctgtggattcttcatgcaattctcttaaatgtctatatattttaaagaaataatctcatatatatacctgggattgttacttctttctcggactgttctgtctttctggtaacttgttctatttgtatttatgcagtgagtattttaaaaatctgatactgctttttgccttgaagtctatcttcttgtacagtcacaaaactatacaatctttcttttgtttagtatgcatctggtaaatttaaaaaaaaatctcttcagtctcaattattctgtgttatattttagatctctatgaacaacaactggggtttttaaagccctgaaaatctagtcttctaacaagatttattttaaagacaagctatatttgctgtacatgctgatatatttggatttatttctattatcttatcttgccctttgtatttgccatgcctctttttctttcattccctgtctctattaaacattaacaaaatctccctatttcctcaacagtatagaaactatatatttcttttctctcactgattccttaaatcttgtttttaagtctcctcctgaatccaggaaactttgagtgctttacttccattacccattcccatctgttaactcagtcctcattatattagttctaccttattttagtaatgtttagtatattagcatttagtaatagaaattcattattaaagtatatgatcttaacaagtcaatatttatttatatttgcccttgggtttactcattttcttgctgatgactgcttcttgactcgcactctgtcattctgtgttcaatttctttcttcctttaatttgaaaatatatccttttgaaatatctgaatatttgaaaatatgtctttaatttgttcttactcaggcgtaatggtttagttacttacatagtgttttagcccagcaatcctatcagtaattttgaagatattccattgtcagaaggcttatacatccatgtggaaaagacttatgaaagttcaactgcagttctcctcttgtaatttgcttttttttgagacatctcacttggtggcccaggttggaaggcagtggcacgaactcggctcactgcaacctcctcctcaagccattcttgtgcctcagcttcccaagtagctgggattacaggcatttgccaccaggcctggctaatttttgtatttttaatagagacgggggttcaccacgttggctaggctggtctcaaactcctgacctcaagtgatctgcccaccttggccttgcaaagtgctgagattacaggtgtgagccaccatactcagcctatttgcctcttctttatgattgttcttacatgttctcttaatctttgtcattttgcactttcatcatgaaatttctaggagttaaagagttatggttaatacttattgtatttcttatatctgataattcatgactatatcaatttaaaaatcttcccattatctgtttaaatgttgcctctgtcacatttttcctttatttaatgcctttattcaaatcctatcagaaataatcttgaagctttctttcctccatatcttttaatttctttatgtatatttttttcacctcttcattttgagttctaggcagcttcctcagattctaaccaatattccatcattaattacatgacaaattttctcttcagatgtgtctaacctattgcttaccctgtctatggaggttctaattttagtgactgtgttttgaagttttggaagttctatatgatccttttccaaatctgctggttcactttgcatactgttattttcttttttgttattgttttttattatatttttgaacctgcttataaatttcatcaccttaaataaaattattttataatttatgtatgtgagagctgtattgctgaaattcttagtggtgtaaatgatcaatttagttttgtaattttagattgtgagctaataataaacacagtgttatctctggatatcctacaaagcctagcttaagggctcaccttccaataaaaagcaatttttaaaaatgccagctgctccatggtcatcaccaatccaggattgctttttatgttaatttcctagcttaggtatttcccttatatttaataaaataaactgggactttgacattctttaagtacaagctaacagttaaaaattctgagggttaattttcctgcatattcagagcttcagctcaaacacaagattaattgcccaagggcagattttttttctagcccatcatttcacagagatctagttcttttaagttctttataagatctctgttccaaatacccactttaagaatacctcatggtacatcttctttctctgcatgagcaataaaatctcaagtgcctacctaacaacatcaacatccactaatttcaaactccagcactattgtagccacaatgtcaactcacaatcataaccattctaggtgtttgtggtctctaaagtttttcttttttttccttcacttgacctacgtatttaaaaacatgggcactatattttattcggcatttctaggtattggccaaaaaggaattcttaatattacctttaagactagccaaaactaccaatttaaatcttttgatcaatcctttaattttgctttatgaactttccaaatagcaagtctaacttttatatgtatgagaaaaactgtgtaagtccttttcactacatttcagaaaagaaaagaagaaactatgacgatggggttagggtatgcaagtaaacacactgtgtgaaatgtgtcttatgtatccttaagttataattattcaacaccaggggacctctacaaagtaatacttttatcatcaactattgaaataatagaaaatatattgggcagctaattcataagtttctcatcttcttctcttatttggaagaatcttaaaaacctgactaaaaaaagtcacctgacacatcaccacatgaacaatctggaacctgctgggagagagatgaagggcatgggaaggtctgccttccctgcctggctcacaaacatttccatcaatgactagctgcaatctatagctaccgctgtgtaaagtactccagacggaccatccagcaagactcacccactttaattcagttcttcacctgaactgccaagcagaaaaatatcacctttatgtttaaaattccatttctatatatttctcaatctaataaaaccctactcctttttccaagtttttaacaaatttgtcccctttaccattctaaccttgtttgtcatttttttgtttctgactcagtgtcttcataatacgtataaaatggcttccacagtgtgtggcacagagtcactgcttctgtattttggcacgaaatttatttcaattcagtaaatattctgccatatttgaaaatgtactatttttgaaagtataagccacatatttatcgtcttaaaaaaaaactaacagtttaacagcacacataactcaacttgtactcttaaatgtatcctcttccacttaccataacaaatgacatttgatttttaaatgtcatacactccactgaaaacactcaagaaacagtaaacatcccctcatgcaagtaggcaccccattatgttacggacacagatgtcagagccatggagaaaccaggcttaccctttcaggatacacagatagctatgatgtgaccatagttataagaaagccatcaaaataccaaggaaatttggaaacaaacaaaattaacaaagaatcaaaaacaataacttaggaaacaactaattagggagttattattcccattacaaagacactcttaccttcacaaaaatatctgacttatgtaagtggcaagatatttttatattttatatattagtacttggagaaaaaggtaaagcaaaaatattggaaggtattgtgaactgaaaactagtcaggaaaaagtggtgtttttggaattgtaatggaacataataaaatgtataatttaattctaaatctaggccaggcacagtggcttgtacctggaatcccagcactttgggaggctgaggtgagatgatcacttgaggctaggagttcaagactagcgtaggcaactaaacgagacccccatcttttaaaaactttaaaaatcagctaggcatgatggcatatgcctgtagtcccagctacttgggaggataaggtgggaggatcacttaagtccagggattcaaggtggcagtgagtcatgttggcaccactgcactctagtctgggtgacagagtgaactctgtctcaaaaacaaaacaaaaaaaacattattacatatgatagaattatagattttgattatgtagcaaggatttgaagatattacatttggaaatttaaaactatgatttttagaggattcaaaactcactaaatcataagtagttaaataaagaaccaagcttcactgaaaagaaaatgaaatattatactctaagtaattctctcacactagcattgagagacaaggtctgggcctttgagattgaggtctaaactccagctttcatggatgagggaagtaactttccaaggtcacccagataaaaagggtcaccttggccaggcatggtggtacatgcctgtaatcccagcactttgggaggccgaggcaggcagatcacgagatcaggagatcgagaccatcctggctaacaccgtagaaaatgtaccgtagagacggtagtgaaaccccatctctactaaaaatacaaaaaattagccaggcgtggtggcacacgcctgtagtcccagctactcgggaggctgaggcaggagaatcacttgaacctgggaggtagaggttgcagtgagctgagatcgcaccactgcactccagcctgggcaacaaggcaagactccgtctcaaaaaaaaaaaaaaaaaaaaaaaaggaaaaaaaaagtcaccttgagtctagaacacaactctctgtagttcaatggatattctttccaatatatcatattattttatacattctcattctgaaacttaaaaacaactgtattcccgaatagcaagccaattacctcttaatttctggcaaagttattatttcagatagcactgagtccatgatcaaaaatcactaaaggtgttggagaaagagaaaagtgaattgaatagcaaataattcaaggtagtacgcttttattctcttttctcaggtatgtgttcaataaatcaccatcatttgttttatagtaattgttaatatccttaacataaaattgtaatctttggaggtatttaataatttttctcttaaatttcactaactaggtctgaaattaatattgtcatccctttagttttttcattctgagaagctgactgttaacaggtccatttaacttatttataataagaactaatatattttgtcttgcttttttttcctctttatcttctattatttggtaattaaagttttcttagcatttaatttttatactataatagtttctttaaaagttttaaagacataacccatattttctctatttattgaaaaacaaaataattttttcactggctgtatataacatgaggactagaacctgttttattgttccattcattattttgacaaaatctagaggttaggattcacattttgtaataattacttaattatatttctataacctatctcaggaataatttttcatgtttaattgagccgccaaaatattttacaagaataaaataaaccatatgcgtttatttcattattattctaattcttctacatcttaagtttcacatgtctgagatcatactcatttatctctcaaatgtcaggaattctcctttaaatatgttcagcaatgtgaactgtatttttttctttttttgagctttttggttatagaaactttttattaagtccaattttatagatttttttaattgtagagaagcatgacagagtgaccaagattttcagccataacacttatttcataagaatatcttgctgggaaagcacaatagaaataagacttcaaggagaaaaaaactttttttttttttttttttgagacggggtctcgctctgtcgcccaggctggagtgcagtggcactatctcggctcactgtaacctctgcctcctgggttcaagcgattctcctgcctcagtctcaggagtagctgggattacaggcacgtgccaccacacctggctggctaatttttgtatttttagtagagatggggtttcgccatgctggccaggctggtcttgaactcctgaccttgtgatctgctcgcctcggcctcccaaaatgctgggattacaggtgtgagccactgtgcacggccaatacaattttcaatgattgcaagtagatataaaatcacaaaagtatttagattctattgaacacgttactgaatgatttagtggtttttatcttagaaactagtatctactgcaactatttaaactcatgatgaaagacttaggaggatgcacagttgtataaaattattttaagggacacattggcaaaatagtttaatactaatatgattgctctttcctatgttgtcttttacagagatatactcctttcttgatgtcttttgagatctgtggattagtcatactaaacaaaatagtaagttactgaatttagtttcttgtgtatttataacctctgtatctccccttatgttcttataagtacttttttcctccctctcattcattcatccgtgcacttattcattcaccaaatatttatcatgcatctacagtgaatttttccaggctttgggtacacaacagtgcctcagaattgggaaaaaaagccatctcatagagtgagaatggaggagataaatgaattgcaattaggaggtactgaaaataatttgggtgatgaattgttttgcaggaaaacaaagcagaggaaagagacattaaaagcattctattttcaatagtgtggtcagaaaggcctctctgaagacaaccatattaaggtatttcaactggaagtgaagggaagataaaccaggtttaacagatcaatctgctatgtcaaatgcaaattccactttcattttctcccctcaattacttacttatccttattctttcatacttatttttgacaaggctttagaaaaatcattttaagtcttatatatctcatttaatttttctgtaatataagaaaaacaataatagaccttacaggattttgagagaattggagagaactgatgtgggagtacctagcacaatgcatgcctgttacacagtggtctccccgtgaatctaattcagttgtcagggagccaccaccctcctctcactttattctttttgagtcttagaagaattgtttcatgttgggtacaggacacaggtgttactataacgcagtatagtcagcacctgattgacttggggattgaactctcttcaaaccacatgcttccacactgtgaatgagctgagggctgctgacactccatgtttctgacttctgtctcctggcctcacttggctttccccacccctacctttcttcccactctcagggcatgtttcttttatttttagagacaggatctcactctgtcacctaggctggagtgcagtggtgcgatgatagctcactgtaacctcgaattcctggtctcaagtgatcctcccacctcagcctcccaagtaactgggactacaggtgcatgccactgtgcccagttaattaaaaaataatacagacatggggtctcactacgttgttcagactggtctcaagctctcaaactcctggcctcaagcaatctcagtttctggagtagctgggattataggtatcatcaccatgcccagtccgttttcacaacttttatcagcaaagaaagaacacagtggctgtgttgatgaagatgtttggtggaagaatacgtaaatttataagaaactgagaaagtgaggaaaagtgctaatacacctaaatgtagttttagatactaaatttgtctatttctaatggacattatcttaattatacattataatgtcttttaaaaattattgctttcttaaaaaccaaatgttgattacttccaaaagctctttatataattaacatgttcatattgtcatgtgttaaagagtacagacttgatgtgtgtaacccacccaaaatgccaaaaatttacctgctatttaagagctagccttataaattagttgtcaaaagacatgtgaggtgaaatgcttacattaatgtgcatttttcttcacataacctgaagtacaacttgaagttgctgttttatgctataagtattgtatctctagctagctttaaatgagacaattattttttaaaaaatgctagagatataaaattttaagtaccaatttaacaagtctgaaggtacaacaacaaaaatcaagaagtcaaaaacttcaggtttagaggaatcactccatttctagaggcatggtcacttaaatggcaaagtattgaaacatttgcttttagcttttaacttcttaaatattttgtttaatatctaaaatatcatccaacagacctagactctgtcatagataattgggcctagagatataacaaagagtacagatggaagagtaataaaataccaacaactaacagagctgtcactgacaattaggaaatgtgagccatgagacaactgaaaaaggtgcaatctggcgtttcgaatacatcaactccagaagctgcaacctattaatgctatcttttgggctcactgattcctggttctgtttccataaaatgttgccatatttcatccttcttttagttcctttaatatcccaagagatcttacttttatccatcccctttgcaaggtaataataaatcacattcccaaggccagacctagaacaaacccacagggtaaattcaggtgttcctgaatagtactaacacctgtagctgctggtttactagccagttaccagttcacgggtaatctggagaaattgtactcagacctgtatcagttggcactaatagttaaaatatgctgctgaaagattagcagggtcaccctgctccctgtgctcccacttagaggcagtcttgcagcctctactctgcctcgtcaccacttgccagggaattagatagacaacaggtggtttgacctattctgatccggtatttgttttcatttacgagcctacttgtgtatttctgaacaaagcttatataatttactaaattgaaatcgaaaatcccttcagtggaagcacagcaatgagaaacattcaatatcttttacccaatccactcttaataactctgtaaagaatggatttgttgagaattgggagatatgaacagactttaatctggggacagaattaaatcaggtttcagcatcactgcttttgatagggcacctaagttgctgtagtaccacaaggtatctgcatctggtatacgaaacctcccattttgtcctcaattgccaacctgtgcaatacctgtctgtgtccacacatgttaagtgctaactatgggattctagagaccacagcattcaggtttgtatgtcgtattcctactgcagggatgttaacagctggcagcttagcaactgccaccatctaatttcagtgaagattaaggctttaaaaatccctagctggaaatgttcttggcagaggccaaaggtgctgctagagttatttaaaaaaaaaaaaaaaacaaacaaactacaccagagctgaatttaatcatgaaaaatgaataaatcttcaagatccagatagattggacaggaatatttattgttaactgtgttgtccaaatggtgtaaaaagagttagtattcggtgtacaaattagagaaagaaaagtcagtcttttcagaacaatgttgagaatgatttgcatatatttatttacttaacaaatacttagtttctactcatgtaccaggcagtgtttaaaattccacagataaagtagactaaaagaaagataagatccttcttttcatggagtatacattctagaaggagtaaagagataacaacaaaaataataataataaacatataaatgtaaaaaaaatttaattggatataaatgcccctaacaatatcaaacagaataatgtgacagagaatgagttgaggggtacttcaggtcgcctgggtggaaaaggcacattcgaaaaggcaacatttgaacggatatctaaatggacatgaaggaatgagccatgcatggggaaaataaaagctgtaggatgttcagaatttctataaagggacttagaggtggcctaacaatctaggtggaagaaaagtaagggacttaatccaaaggtgtatttacacaacaatcacatttaaaaataaccccagtttatatatttatttgaggtgcctttggtgggggtatctggtgacttgaaggtgctaaactcctactcttggcactctaattaatctgaggaaagagctgcagaagtcaagacgtggctcagtgacagaaaataactattcaaagaggaagcttgaggccagaatatttaggacctcctctaagacacggttatgagttattctaagtgcaaagggagtccctggaagaatttaagcagcaaattgtcataatgtgagttatgctttaaatagattatcccacaatgtgaagaacctattgttaagaacgagggaagtggaagcagagagaacagctaggatgctattgtaggaatccatgtgatgatggtggtttcaactagtatggtggtggagaagatggagatgactggatgtaaatggaatgctgtttttgctatggaacagcaatcttttctgccatgagggtaaggaaaaaagagggatcaaacatgacacctaggttttgatttaagtatgttcaaatataagtcaattttatattccttacagaagtttgggaagtaacctaaattaaaaggggaatattcatttatataacaaatatttacagattctccactatgtacagattcaggcacactacttgtgtagaaaattttatacacatacctgtagatataaagacatatatatgcatatgaatacttacaaatacacacatgcacacactcagagcgttttgaaatggagtcttgtagaacaattttcaaaaaaaattaagctcacaaaaatgtaaacttttgtggatttttagccagcaatttcatttctacaagaatactcccacatatatatgaagattaatatacaagaattatacatatattgatgatggcattgtttttttctcctccacaacaaaaaccacattcaaagtgtcattgtttgattaaaaaaacttaaatgttcaaagaaggaggattgttaaagtacataaacttataatatagaatccagttatttatttattcatttaagttttttttttttttttttttttttttttttctggagacagcgttttgctctgttacccaggctagagtgcagtggtgcaatcatggcctactgcagccttgaactcctggcctcaagtgattctcctgcttcagcctcccaacatgctaggattacaggtgggagccatggcacctagccttaggtagattcttatatgttgatatggcaacttctcatggatatatttttaaaggggaaacaaagcaactcacagaataaaaatatatgaaatgattccattaggaatgaatggatgtgtgtttcacataatgatgaattaaaggtgcctaactccttcaaacaagtttggaaggccacactattagcaatggctacttggcgacttttgcaaaggatagtagaataatgtggtagtgctggcaggagtgttgaaggggcctttcattttctaccataaaaattgcatggtttgatttttatcctacactgagtatgttctgggtttgtaaattttaatcccatttaaagcataaagctataaagtcattatgccatgattttcttgatttggcaacaatatctctgttcacttcactttatcttactgccattagcaaacatcagctagtgtcccaaactaaacctagaggatataacagaacttcatgttcttcaggtggtagtttcattctcaagtgagtgagaggagtctgctgtaatgggtccccatgtgtgctgaatatttcagaaatcaataggatgggcagccacttctttatgttgaaagcagatcttgatgacatcccactaacagagtgcctctcatacatctgcagcaggtatggatcactctgtggcatggctgactgtttacatcccgtgccaactcagctgatatgtaattaacattatgtcttgatagcctactgttgtttgcagaaacttcaagtcatgattctgacacatcaacaacaagcagtgaacactttgatacagggccaaaacaacacagacgtctactcagtttccaatgatgtcacacagtcagtggccttcatgagcacaggactcaaattataccatcactccctggccatttttccaatagagtaacactgttttgtacttcatgaaatgaatgatccatagtgattaatcacatatctgtttgtcttcagatgaactgtagttatgtgcatcaatgtaatcatagcagtatggcagaggaaagagaagtttgacagaactggatttgcttgactctacaacttactaaactgcataatcctgagtaagttccataacccctctgtattattttcttatctgtacaatgggtataataataatacctaccttcacgggcttattctgataagataaagtattacaaatgttttacataaatgcttgccacaaagtacttgcttaataagtattagatttaatataacaataattatgttaattggggagtgcttcagaattatttactacagaatatggaatacctgggacatacatttttgaataggcattagcaaaatatagaatgaagtaataattcatttgttcaaatctcaaatacagagtgttaaaggtaacagattattttataataatgaactacaatatattaaagtatcttaagtactttacaccaatgatatcttccaaatctaataataaaacactgagcaagcacaagaaaaataagtaacaaacatatacaagtttaattctggtagtatttcaagcatattcttcgaaatcactgttctttcaatttggcttgaaccaaaatttaccttcattaaaaaaagaggcctcttagaaagcattaaattctatttattattataactatattggcatcagaatataaacagagaccaaaatgatcttacttggaagccaaataaacactcaatattaacaactcatttattttcccaccttttgactccaatttaaatgtttacatgagagtctttgaaacgtcttttcacctcagtggctcctcgagtgttcactttgaacaatgactttgcagctggccaaaccttactctcaatcaatttttatgaggacaaattcttgagctgatggttggatttccagtgatatcactcataatacacactcacaagtggtgatgagattcacattatcaacagagcatcattctgccgatggcagcggcagacacagcaggggtatactgtcctccctgtgaaaacgattccttcacctttcaataatgcagcctgcaggtatggacctacaaactgtgtgtggatagaatcagagctgcctttaaaaatattaataaaaactacccagttcctcccaatgggtaattctcattgaatctccatacatatccatcttgattttgaagtgtgtgccctcaatttgccttcccattacgtttggaattgaatgtaagattcacttgtgtttaaaacttgtcagaatactcgcatggattctcagttcatttgggcatggaattctctgcatgaatgcatgtggatatatgcacatatatgtgtgcaaagtaaatacataatgcttaaacatgacttcaaattttaaaaagaaacctcaggtagaataaattcaaattcattatagtttggtggtactttcttaaatttaaattatgaaacatatgggtttgcctactttgaattaacttagatatcccttttaagatataaagcatatgtttgttactgagaaaacacttttagctccccaaagacatggttaatcttcccccaaaaacctaccaattaacagtctcaaagttttacaattccttcatttccaaactctcttatgagtaataatcaaagtatacatatttgccctataacttctgagtcttacaatcatatgctagaaaataagataaggggcaaaagattacttggaaccttacctggcaaaaagcatgaggtgatcatttgacctcttaagactgatctacaaaagcctaactttcatattcaaaaaatcagttaaaacaatcaaataaaaaaaaaccagcgactaatgcaaataacatactgaacatctgtggttattgggttacattcccacgttctttcatgcctatttccaccagttaagacctatgcttgctaagttagctgggtttgttcccaaactagtttatgctaacaacattagccattgaaatcatgtagttaaatgagattttacataaatgcataaaataactgaaaaagaagctgctgtttccatgaaaaatcagttgaatgctttagaaaaacttgataaagacaagtcactaacacaactttgtcaaattagatatgaatgaaatatatccataagatataaatgtgtccagaagtatctattaaaattgcttaggaaacacattttaattcatgcaccaatgtcagaaacgaaatgtggaaactgtagaagatggcttaaggtttttgaaaaatagatgacccacaaccccaaacaggtaacctttttcaaagcaaatgctagggctctatacaaacaaattaaatctgtgtgtgcacgtgtatgtatcttttattaaagttgaccaactattagttctaatcatgtaagaagaggttactttttagccaggaaaaaaaaaataggctggttgtttgccatgtagataaaactacttttcactgagttttcacacttttcatggagttaccaggctatcatgggacatcaataaagtaattttatccagcaattgatggatggctgtacgtactcactggaagacagcaaatgatcattttccttccttggcattttactatgtcattctgatctagtccagttaagcttgtttaatgtgtgccattggaatcaatgagatttttacagaatgttttgtgttaagaattccaagagtgatactcttttcatatattgggaacaaaatagcttggatttatcatggactggaatgactattacttagaagggtattctttaatataaatttaacttaattagtatgttctatgagcaaagttatccatgactacaaaagaagagtcagccaaactgcatgttctgataatatatgttcagaatccaatcgtaagcaaatacacaccagtcaagttgacttaaaaacatatttatgtgaacaggtgatttcttggcttatttgtactaaatgtggcatatttgcattaaatggcagcatatttgcattaaatatgccagttagtacaaatatatttatattaaaatcagtgattatatgtattatgctttatatataaaatatagaatgatgcagtggttctcaaggtatagtcttggaatcccagagatctccaatatcttttcagagggtctacgaggtcaaaactgtctttataagaatattcagaagttatttgtctttttcacactttttctcccattagtataaaggtgagttttccagaggttacattttatctgatattgcaaaaaattgaatgcagaagctgatgcaagaaaacagttaccttctattaagccagagggtaaagagtccaaaagcataaaacaatgccacttatttcactaaattgtttggcttggaaaacagttattttacataaaaactttagtgttagcatgtaatgaatgtactgcttttatttaaagtggcttaaacatattttaatttctaaaacagtaaattttgatagatataacccacataaacaaattttgagaactgctatcttagagtgattatttaacaggaaaaaatgactaacctgaactagaacaaagtaacgttttttccatcttttccaaaccttctgtccaagggcatacagatatctggaaagaaaaacaaaagccaaagaatacttcagatgaataatgttgtgcttccatgtaatcacatttcttccataggtatttatttttgagaccagcctgctaaaggcaaagtttagctcatttggaaagtgagacaacctgcagcttctgtgatacaaaatgagttagcttattctgggttctcgaaagggaattgatttatgtgacttatcaatttgtcagtccttaccacaaattgagcaaagtaggaattagaaaggataatcaaagaaccagtaggaattttattcttacatgcaattcttaggagagacaaaggctattaattgaggacatggttatcaatgcttcagttctcagatgactggagctgagtagtgcgccctgaggagcagccagctgcagagccaagaatccagggtgaagggtcactgtccagctgggtgaccccaaaatgtgcctgcaccaatctcagtctccatgtcctcacctatcaaacgaaaggatggatttgctgatttctaaggtctctgctagctccatcattatgggatttacctgacttatgaaagcatctcactgcaaatgttttaactataaaattctgatagtaacgaagatgccattgggtagttttacatagtttcaaccatggcttttcttcaactttgcattgaccttagtaagctgaattgaaatgattagccaatcatttgagaatattattcttactgaatatacaaatgatatactgaaatatcagggaggaaaaagaagaaattaaaaattagtgtgaccatgttgtggagagctattccaaaattatgccacaaaattataaacacactccctacaaaagtggaaaatattgctagaagtttaaaatatgacagaggcctaattttaagactaaagaaagatttttcaatattttataatcctttattctgaaatgaaggattaacagtgcagaggctgttcaaacgaaatttatatacaattctgagtgatttttttaaaggagcattatgattatttatttaggggcttaagatttttagactttcacaacttttaaaactaaaatcttaggctgaatctttaatttctgtcttattaaaataatcctattttgcaaaacataacaaacatactgtttgcccccctcccccctttagaaacagtgacatagggagttggctaaggtgtggggaattaatgcgcactcattcactactagtgggagtgtaacatcttgggagatgatcttcttgtaggataacatgtcaatacatcgaaatagtcatactctttcattcctgaatgtattaaggtaataaggaggtgcacataaaggtgtatgctgtagggatacatagaacagtgttgtttatattattggaaactgataacaaatgtccaacagcagtaaaattagtcaatacgtgctggcatatccacagagaaataccatgctgccaatgaaattatgtttttgataaaattaataacatagaaagtatcacattgtgtaatattacatgaaaagagtaggattcaaaactacacacatagttaatgatttggaacttgtaaaagaatatgtaaaaataattccaaaatattactaatagtatctttgagtggtagagttatggcagatttaagtttccttctttattccctgaaaattcacagaaattttcagaatccaggggggagaaaaaaacatggagttactaaaagtcaaaataaaaacaaagttcttgcattgtaaaacatcacccaaatggtccaaaccaattatatattttctttcagcacatcagctaactgaagtttttggtgaacttctattcagcatttatgataccgttaattcattccattatctgtgcttgtggatggaatgtgaattcatttaatgactggctgagacattactgctcttattcttacctgttcattgttttttctcaaggaccccttaaaaccctttgctccacctttgctctagcttctaatttcttctctgtggttctagtgacaggtatttagttgctctctttctgtctttctctgcaatttcctgttttgaaatgcacatatccaagctcttatttcagggttaacagcaatgacctcgggagctagatgctgtggacatgacaggtgccttttatgaaagtgaactagcaagatatgcaccaaatagctggcttggagccacagagagcatctggaatgacctttgcctggaaccacagcctgcttctcagctctttccaagtgtctcactttgcagactgttgggcaactgggtcatatacaagtgaaagtaaatagtgatacacaaaccatcaacaccacaagctactcagtgtcagtcttgctgacagtgaaggtcctgcataaagaataataatcagcattgcacatgtatatatatgtaactaacctgcacaatgtgcacatgtaccctaaaacttaaaagtataataaaaaaattaattaaaaaataataataattatatgtatttaagattaatatgctttctttcacctgacatttggtcaattttgttaatttctttattaaaaagtttaaaaatatatttggaaaaaaaacatgcaaaaaaagaataataatcagctgcaacatcatcaaaatgacagattaacaaaattggattaaaatatatggtttctttgaagacagaaagcagggggacagatggatacatacatgttgtattaggggttagtagaagatgttataaggaacagaataaaagagaatttgtgattggaaccaaggtaagcatttaaatgatgatttctgggattaggtatcaagtatccctatctagctgctatttcactggtatgaaagcagtttcttagcataagaaacacattgaaaaatgagtgaagagccagatgcagtggctcatgcctgtagtcccagaactgtgggaagtcaaggcaggaggattgcttgagaacaggagttcaaaatcagcttaggcaacatagccagactctgtctgtacaaaaataaaaataaaaattagctggatgcagtggtacacacttgtctttgctacttgggaggaggctgaggcaggataatcccttaagcttaggttttggaggctgcactgagctatgaccatgccactgcactccggcctgggtgacagagcaagatcctgtctcttagagtaaatacatgaagaaggaatgaagataaaaatgttcatcaatattatttaagaataaacactcaaaaacaatctaaaaatcaaaaattaaaaaataataattttgccattaaaagtgaggccagataaagaattactaatgatatgggaaaattcttataatgttaggttttaaaaaagcagtcatacaaattcatattatatgcatagagaaatatccggaaaaatgcaacaaaatgttaatcttatagttaatatctggcaagtgaaattaaagatgaatttcatattattctttatgcctttctataattccacaatgtctatattggccatgtcttccttttattgtttgagtagtttattggtatagtttacataaagtaaaattacctgtttcaggtatctaatttgataagtattgacacagtcatgtaaccaccaccacaatcaacttatagaacatttccacctccccaaaagttcccttatgccctttatgatcaatcccctccttacatccctagctctggcaacccctcatttgatttctgattttataatttttctttttccagaacaacatataattggaattattcagtatgtagcctttctgtctgacttctttcattgagtagaatgctttggtgattcatccatattgctgtacgtagttaatatcagaagcccactcctttcattgctaagcaatatattccattgtagggatttgcaagaatgtgtttattcactagttggtggacatttaagttgttttcacttctttggatatcataaataaagctattatgaacacttgtgtacaagtctttttgtgtaggcatgtcttcatttctcctgggtaaatacctaggagtgggattgtagggtcgtattgaaagtacatgtttaactttacaagaaactgccaaattgttttccaaactggctataccattttgagttaccatcagcaaatgtataaaggtacatcttacttttgtaatcagagaaggttaccattattaaatattagggggatgtagtcattatgactataaatatgtatttctggtacaaccaagttgaatatttagagaccaaagataaagtcctttatctcattatcttgagtacagtggagacatcctataagctttcatgcttaaatgggttttctagtttccaaggtcattctcaagttttggaatttagagtagtctaaattccttgtagatgggtaatctttttacctcagaagggctggaatgtggagggaatgaggaaaatggagcgaaaatctttttactgtttggtaactatcagataatccatttattagaaaacatctacaaaactaaaaaagcattttctcctaacccatcttatgcttggcattgctgttgaattactattctttgttgttgttgtttcttaatgttcagtgttgttatgattttttttatggtatctaaggccaaaatgatttctatttcagaaaaatatacaaaagttacatttaacctgatattatgctccactaggcaatagattttgttcattacatttacaggttccagtatctttaattacagaaacatgagttactctatatagaaagactgtatatatatctatagccaatttttaaagactttgcatataaaaatcaagttgacctcaaatagttagaaaatataacttgatctttaatgattaggaaggatcccatagcatctgagagtcactgttataaaaataaattataataactacataatgctgtaaaaggaaaatgcacagctgataaaattaaatgtaaccatttatttgacatataatggaaatggcattaatttaacagatcttcaatagctattaacttgtcttaaaaaatttgttttttatgttattatcatttgcattctggacaattggcattttactgcttcataaagtatgagtctaccaaataaacatatagaaaaatattatctaagaaatgcgtgtgtcaggctgaagagagagtacctcggctaggtgtactagagatttgctagcgggtctatgctgcagctgtattctccctcaatattttgtaacctgctgagtcattactaccttcctcatgattgtgtgattaactcaaagaagtttttttttaagggtatgtaaatgagacctgccaaataccagtcaaactgggaacacacatttaactgggttttatgtgacaatttatgatgttatccaataaaataagtatctatcacacagcatgagagaagcattttctaatgagtactgtgaatttttttcacgtgattttaaagaggaaagcagattttgtgtgtgtgtctgagggctttttaacattaatttccaccaacctacagaatttggttttaaatattttgttgtcatctttgtcaaattcttttagttaaatcagaaatatatggaaaaacaaaagaacacaaatatcatcagttttcatggccatgctacattctccagtactctattagcaaatggccctgggttggggcgggggagggaatccccaatcaaagttaaatttgatccaagaattatttgaatggggttaaaagaggtatcccattgtacatgacattttcacaagcacatatttccaaagctaatttaaatataacactttttctattgaactatttccaatgcatcacaatactcaggtaactagagtgttctggattattttaaaataactgcccagatactatttaaagtatttgttttcatgaacacatccaacttaaagcaaggtattaagcagttgttccctttgaacaacaacaacaacaacaattgcctgcttaactttaaaatcttttcttcttgcatgggattaggtaacaaagaaattagcagcactgaaacaaagctcagatttaacacacaagagtaaagccttgaagcatttagttctatcagtcagtataaacatagcaataatcataaagtattaatccctctcttgggttatttcaaacggagagcactatttgctccaaagaaacacacaactgattgctaggaaacaaagcacaaagacaactaaatatattccagtttcattcatctatgacttaaaaaaaaaatccagctatccttaggtcacactgtatcatcaaatatcagagatatgaagaaactaaactttcaaatttttgattatatatttaatatatgatgtagatgtgtagaatatattttatgctgtttgggaaaaaagttaagagaaaacatttttttaaatggtatttgcctaattgatttttttttaaaggaaatggccagtccttaagccaaaatagttactaccaacaaggcaaatagtatattttaaaaatcttctatatctgtagttatatataatcattagcatatctcagtacctacaatctttttggtgtaaacatgtcaacatgattcttaaaagagtcaactattaataaggtagctggaagataacaccacaattacttctaaaagctttcatttgcaaacaaaaatagtctttatgaaatccatcagaatgttccgtgacagcaggaacaaaaacttttctttagaaagatttcctgatcattaacatatgtattttagtaccaataaaatggttcttggcaatagatttattgagtaaaatgaagtttagtaaaaataaatttcaagcattaacgctgcaatgcttatacgacaaaactattttaaaatgcttgtctttacatagtacccggttgaatgtgtgtgttttttttttaagtagattcatatgtaatattctgatttcttttcttttaagccaaaaacatcagaagtaagtttaaccattaagccattttcctttaaatactatatattcttggctaacatttataatcacaaaagtcaatgacattttaagaactcattttctgattaaaaaattgagatttaactcatcttcatatcacaatatgtttgaactatatcccatattattctagtaatagtaaagacatagctaatattctctatgccagattttatatagaaaagagtaaaatgaaataaagaactcgcttacccaaacactttaaaagcactttatcaaacctttctaacttgaagattgttcaaagaatacttcaacacacacaaattctccaaacacattactaaatattgtagtttagtttcaattagaatggtagcacacaattctaatagaaatgagaatatgacaatttatttgcactcagtccatgctgtgagagttcatggttttactttatgatgaaaaatcatcactaatgaatatttgaaaaacataattgtatacagaagatgggaattatttggtgcctgaaaaaaagaactattaattttggtggatcacttatgagtctagcgctttattcaaagaaatgcaacaatcaatttacatgttgaatgataaagccttttcttctacaagccttcatttttcaaggaacaatacagaaagaaaaaaaaatcaatatatagagtagtttagtcctggaaagggctttcataagagaaacctcagtcaaggttgaaagagcaattaatgcaggctcaaaaatctgggccattcggatagagttcggttaacatgtggcagaagtaatcatccacttgtgaaaatgattttcggttcattctcaaacacctttcagacactcatgatcccatttaactgacaacaatacaggctatctgtgggcaccattgcatttgaagtgaaaaccaatagggaccaaatgccctcaggcactttcagtcatccctacaagttctctgctgcttgcataaaaggaatcttcctttcactacattctttcttttatttgaccccacaagattaagacttttttgcgggggggtgaggtgggggggcttgtttcaactaaggatgaaaaaagaaactgattccagacaacactgggacctgggcattaagaaacttagaagtaaatactttctggttggttattataggcttgaattattatgggaaacagtaaaagagaggtggggatgcatggaaaggatcttcatcaaacaaaattacataacatttgtggagaaattatgactaaagaaaaaccaataactcctattgttgagcaagaacttaaaatttatgtgctatataaacaggagattcctaaaagcaaatgcataaaacatagagttcttcacttatattaggtatcacattttatagaattgtccctcttccttttcctgagaagttctaccttctgttagtttcatctcagttaaatccaagttaagcctcagctcatatcagcactgtaacagtttaaaacagtttaagacagtataaaactatactaaaaatttgcttgctatagcaaaatctagaaaatgaatgaaggcaaactgcccagataagaccataaaaccccattccaccctcagataagacatcaagaactgctgatgcagttctagctgatcattcttttttttctctttttgcaaaataattcattttattttatttatttttgagacagagtctcactctgttgcccaggctggagtacagtggtgtgatcttggctcactgaaaactccacttcccagattcaagagattctcgtgcttcagcctcttgagtagctgggatgacagaggcatgtcaccatacccagctaatttttgtacttttggtagagacggggtttcaccatgttgctcaggctggtctggaactcctgagctcaagtgatctgcccacctcagcctcccaaagtgctgggattacaggtgtgagccactgcatctggcccctttttattaaaaaaaaattttactgatatgtattttacatgtttatgggatacatgtgacattttgatacatgcataaaatgtgtaatggtaaaatcgggatatttgggatctccatcacctcaaacatttatttctttgtagtgggaacatttcaaatcttctcttctagctatttaaaaacatacaataaattattattaactatagtcaccctattgtgctattaaacagtagaacttattccttctatgtgactatatgtttgaacacattaaccaacctctcttcagccccatcctccccatcccccacccccaacacccttcccagcctctggtaattatcattctaacttctatctccacagatcaacttttttagcttttacatgtgagaacatgtgccatctgtctttctatgcctggcttatttcactttatataataacctccagtttcacccatgtggctgcaaacgacaggatttcattcttttttatagctacatagtattccattgtgtacatgtaccacattttcttgatccattcatttgttgataaacaggctgatttcatatgttggctactgagaacaatgctacgataaacatggaggtacaggtatctctttgattcactgatttctgtttcttttttaataaacagacattagtgggattgttggatcacatgatagttctatttttagttttctgagaaacttccaagctgttttccataatggctgtactagtttacattcccaccaacagtatataagagttcccattctccatatcttctccagcattttacaattgatcattattaaaggatatatcttaatatagatgtcaatgcactgtcacctagaaataaaacaactagaaaaataattaattctataaaatgtagttttcaataaatataagccaaataacccaactaaatcaaactgtgcagataaatattttattaaaagacagtttttcctgatatttttctttgctaactggtcattggcattcttttatatctcaattagcagaaaagaagtaccttgataaatatttttaagtggttcatgatcagtgctgatatttatacgactgtataaatatgttaggtctttattcctttttatttttaaaaatcaaccaacaaattgtatatatttatggtgtgcaacatgttttgaaatatgtgtacattgtgaaatggctaaatgaagttaattaatatatgcattacctcaatatattctaccacaggaggcatatttcataaagcatggtttcatgtttttcctcaatttaaatacccttcaaaatttttgtctacacatgcttcactgtttgctaaaagttaaagaaaattagtaggctttccaagctgattataaaatgtctcagaagtaaataaatgggaaaaatgtccaaagaatttactgagtagccccctctaccccaaccaggcaaacttgcagagaggtctattcctccatcctctaggaagaggactgggactgtgaaaatctgaatgtctctgggagtaagcctatggcacattccaaagaaaaggacattttgcatctcttggcaaaaagtctctgaggcatctaacaattaaaaggaaatgatttacttatgcaatcctagacatttttgtgagatactctattaagctttcctttccctgaaaacgtaaatagtttagcaagaaacaaaaggtttagcaaaggcttttatgtgtcaaaccatatcatgttgactaataaaaatacattctcttttagggcacattattcccaagatataacaaaatgatcaaatgttatttaacattacatgtaatacaggtaatcctgaattaacacaaatatgttaggccttcatttccttttttttggaaatgtaggtatcggtctccctttttcatattcagaatttcaagtgaaatatgtacataaaatgcccattctataaactacatacactctaaaaaaataattaagatgacagtttgagatacagtgttttccacagtgtgtgtcttggaacatctggatacaaggaggtactgtgaagaaaaagaatggcaaataaatgtgaggaatactcagttaaacaaaactaagcaagttctgtatttattaaggacttctaagagcctgtagcagacatgtgcaaaggtaggggagaatagtgtatgtggtatctccaaaagtgcagaatattttccatagaatatctgtaacagtcatgttctctagcacatactttgagaaattaactggactagattactgttaatgagtctttaagcaataaaattatataactgggtttttacattgtttggaattaactaatatcctagtcataattaaaataccatcttcacttctaacatatttttactacgtatctataaaaatgtatgtttggggctgggtgtggtggttcacgcctataatcccagcacttcggaaggctgaggtaggcggattgttgagccaaggggcttgagaccagcctgggcaacatggcaaaaaccccatctctacaagaaacataaaaaaattagccatgtgtctgtggacccagctgctcaggaggctgaggtgggaggaatcacctgagcctaggaggtccaggctgtggtgagccatgatagtgccactggaccacagcatggacaacacagtgagaccctgtctcaaaaaaaaaaaaattctttaaaaagttttctttaaaattttgatcataatctccatggactatacttggttcctgaaaggcctcttcttctagtatgttgctctctggtcttggctaatgaggacattttagcagagctctgaaatttagtaaacaaactatgtctgtctttagagtaacatcttcctgtaacttatttacaaaggtacctaaattcctcctaacactcagcatgtttcacagatttcccttcccaatagcctcttctacgaaaactatgtcacttgaacttcaactttacactttgtgaccaatcttgtcggtagtcaaggaggcttgtggagttctgattcaaggctggaggaactgagcagtaagatacgcttgctgttaatccagctctgatatcatcctttggcttcagtgtctcagtccctgccctgctcccttgtgtttaaatacagtcatacatcgctgaatgatggaggccttctgaaaaatgcatcatgaggcaattttgtctttgtgagaaggtaacagagtagacttacgtaaacccagatggtacagcctactacatacctagcacatactttgagaaattaactggaccatacggttgagttattaactggttattatattatggttaattgagaaattaactgggctacatggtacagcccatttctcctaggctataaacctgtacagcttgtgactgtaggaattgtaacacaatggcaagtatttgtgtttctaagcatatctaaacataggctacagtaaaaaaggttataatcttatgggatcactgtcatatatgccatcagtcattgacaaaatatcattatgagctgtgtgccagcagttgttttgataagctgcccaataccccaggctgaggacacagctttgctcttgttcttgctaaactttctctgatactttgtgcttgaattcttgacgtgttagttggtcagagacatttctgcagttgctcacatggataaacactgtgttgatatcctttgatacacttatttatttatttatttatttatttatttgaggcagagtctcactctgttgcccaggctgtagtgctatggcataatctcggctcactgcaacctccacctcccgggttcaagtaattctcatgcctcagcctcctgagtagctgggattatagccatgcaccaccatgcccagctaatttttcgtatttttagtagagatggggtttcaccatgttggccaggctggtctccaactcctcgcctcaggtgatctgcctgcctcagtctcccaaagtgctgggaatacaggcatgagccatcccgcctggtcttctttgatatttttattgtcttcctttgacacgaagaactcctctgtacaaatactctctgggttctcactactcttccaattgttcacatgtagtgtgtttcaccccatttgtcccacacattgtacaatttcatccatttctaacacttatttttaaattgatttagttcttgagtctcatatttcccatttattaccgtcttcttagctcaactatcattttctcagagaactttctgcattgctaattaggtcatattcctttattataccaactaggtgacatgtagacatttcttccacaaagtcatggccagcagattgtttgactaatgtttactccccacacaagactgcaaactccatgagggcaagggccatatcagctgtgactcaccactctatcctcattgtccagcactgttccttcatatggcagacactccataaacatttttggaatgactgaatggtcttttcctagtttgtcattaggaacaattgtaataaaactataataaaggaagtaaatattttgcaaaaattatacaacatatatcaaaaatgttaaaaagtcttggatagcctttggatttttgataaaggtagtatatttagatcaagagtattcaaataattttagcagcagaatattaccctgaattttaacttaatgtgaatgatgaaaacattaaggaagcatggagcagctgctgtgaaaacaggcttggaggttcaggaatctagtgcaccttaagcccctttatgccgaaaagggacttccagggctcttcaaccaccgctgaaaatggcttcaatctcacagcatcacaaggacctttcagtcaaaatggaacagaatatattatatgtctaaagatctcaaaatgctaccagatttctaactctcactaatatgctaaaaaaaaaaaaaacacaaaactgtctgatattgacagttggaatctctgaggagaccaagtaattcagtatctcttttctttgcccgagttctgaacaaattgacttaaaagagtagacagagtacaaaacatcacctttaatactggtaaagataatactgaatagagagagagagagagagagagagagagagagagagtgtgtgtgtgtgtgtgtgtgtgtgtgtgtgtgtgtttcctgcaagtggtgggcttccttatgaggttcagtattattatgacacgtattttccccagcccagtcacagatagtgctaagaggacaggctgttccatgagaagatcttgcccatgacaggcttgtgcagaatgaacagagaacattcattacggtaatgaatatcccttacatggaagcaagtattgggaatggagaataaatgtttcccccaaaacagagagagaagggtgaaaataatgagagagacagacaaacagagaaagagagagaacctaaatgattctctaaatggctaagtgccaggtataagatttacttttctcatttgtaaaacaagaatagcaatattagctcccttgctataatagatggggtcattacaaaaatctgctgcaatgatgtatgaaaggggcctttgtaactataaaacacaatgtagatgaaggcattagtggtggtggtggtggtggtggtggtggtggtggtggtggtggtggtggtaagcagaacagaaaatatttcaacttaacttgtttgaaggactctttggggtgtgaggatggtaataaacttttcagctttgtcccatttaaggaaaaaagctttccaagaatggggcaagaatgtaagtatatctttttctaaaatgaagaatacctacaatgtcacacattacaacaacaaaaactagctcttcttattcattagataaaagcaatgtttctaaagagtacctgtattatgttgcaagctacagaatttcttaagttcttaagaaattgctacttatcaaccaactaacaaattctagactactacaaaaattataacgttcagcttctctctcatgtatctttatttaggggagaatgaataactaagtaaagccagtagtcataaagaatccatgggcagtaaggatggactacataggactagatttatataatgtttcttttcctttttaacttaaagcttaagaattccatttatttatttgctgacaaaactatattcacagtgcttctgcttatgaatgtaggacacataaaaatgaaaccaagatagtaggaaaaatagcttttgacatttacacaacatattccaaatttcaagttttggatattttttgttaaaactgaccttgtgatatctttgattattcataaactactaaacattaaagtttttctatattaatttgatactttcttgacaagtttgatatgtccaaaatgaactaccacttcacttccttttaaccttttctttttacatttttgaaaaagaaaatgtgttgaaaattacttaattctacttaaataagtgccacttttattattaataccaagttttgtactttaagacaattattttctatttgggggaatgtttgcgccatctactggacatatacatattattacttttgtcctacaagaattacaatgccatgtccaaaggtacttgtgaagttgttccttataaaccactccgaaacaaaatctattccttttctttcttttttcttacggcacatttcagcacaggaaatcagtaccttcccaccccaaaaaagcaacactaagatatattagttcaaataactaaatatttctattttaatggaatcatttcacagactcatacattcataggcatacaaatgaaagaggcataaaaacacatttggagtaaaagaaataagtaaggcatttatttcactgaaaaaagtatacccatccctaattttacaactattataagcagaaatccttctcctattacacataaaactagggataaagactagaaatctgttacatgaacttgtagaggaacaatactaattaatagaaaagaataaaagagttaaagccagtctggtggtgtctctggatttttcttaatgagtaacaaccattaaatggaatgggaggaaaatcagcctttggaagaaaatgacttttaaatatatttttcctccctgtcttttggatggcaccatctaaacagcagaattgaaaagaaacataagatttattcagcttcaattaagaaggtatgttatttttccacaggaaaataaaatgtggatcccgcttgaagatccacgccaaaattacattcctgggtatgaggtttgattcaattgctggcacatttatatctgcttttcagggagatacataaataattggaaagttaacaagaattgcactataatgttaatagattagaatccaaataattctttaactcttcagaggtttttattttttatttccttcctttgatctacaattagaaaactggcatgaaaaacttactttagactctataagacatattttggaattagtgctatttgactcacttaatatttactttgggcagtttagaacagaagatatcctcatacttaatacaaaaataatgcagaagatattataaaaggtaaagataaattaccatggtagttcctacaagacagactttcagacagatgaacacaggtgagtaaatgatccttagtaatctaaaaataaaatatatttgtgaactctaaaaagcacaaaattctaacaaatttcaatatagttttcaacaataagctttgaaataagaaaaggtttccacttaggcttaagttagcttttttttttttttttcccactagctttcaagttaattaagcttcactctatctgaaagtaaaaacaaattttaaaaagtgagtaaaatgagactatgttacattaggaaatattctatgccatagtatactctactaatgttgttaaaataactatccccactgcattttatcaccatcattttccttataacaacttacctttcaaaagataaattttctatattctaagtattgtgctttatgctttacatatctcagttaatataacaatcttataaggtttcaattatcactacagacaacagtaagttataaccaacttctgatacttttaatactacaaaagactgtgctaaaaactacacataactattaatacacaatattcattaaatatttatactttctgactttgctacaagattcactttagcattctatttaattttgaagcaatggcttccagctaccatatatataaaattgtcttcaagtaagctttttacctcttttatacggaggagatggtcttgatctcagaacaacaggatcaagaccattccttgtattctggggagagggacctcctgtgctagatgctggattgattgtgaatgggaaagtgttcacatgtatagaatgccatccctggtgggcgtaagataggaatcttcactgagaaaaaaccaacaacaactaagagttaagtagtagggaagcctcactgaggtgccatttaaagtcagcaatcttgagagagtacagtgtcacactgcagtagagaaacagctcagaatccatcagtgacagcaagctgtactggtagtttattatattctttgtgattactttctcatttgttgtcctttagcataaagactttcagaagttctacactgctttaactgcagagagcgtcaaagaaaagagtgtccacaatggaagagaaagaagaagaggtgaagttagggtatgtctgaggtcaagcacagtattgtggaaaggatgtgagaatccccccaggaggggaaccctcagaattcaagttccagcctcacagtctagtcatctacacctgcaagattctccttcctaaaaccagaggtttgaagttcttctcttaagggcaacagtattctcttttagttgttcccactaactcttaagaatggggcaacaaaattacctacttattaaaaagagaatgagtagagtccctatactaatatacttacagataagaattctaagaattctaaaactggtctcagttgagtctcaatcagttttttctaattgtaaatggagataacgattggtttcctaattgcttcaaagaattatccagaggatcaaatgacccaatatatgtattatcccttgtaataagtataaagatactacagagatgttttaaaaaatactgttagcaggctgggcacggtggctcactcctgttgtcccagcactttgggaggctgaggtaggcagatcacaaggtcaggagttcaagaccagcctggccaatatggtgaaaccccatctctactaaaaatacaaaaattagctgggtgtggtgacaggtgcctgtaatcccagctgctcaggaggttgaggcaggagaattgcttgagcccaggaggcggaggttgcagtgagccaagatcgtgccattgcactccagcctgggtgacagagcaagactccgtctcaaaaaaaaaaaaaacaaaacaaacaaacaaacaaaatactgttagcctgttagcattatcttgacatctaggctatgccccgacattgcaaaaagttagatttgggaaattctatcaattggctgatttttctacataatacaacaaatgatttatctcaaattgttcctttttgaggaggagataaaaatgaccattcaactaactactctgacttatatggacacagttgcacaatcacgggcaaaaaaattaccttaagtcttcaggctcatctatttatctattgctaatgtaggtaactttcctaagaaacacattttctacaatattccaaacatattaataagctaattgataacttaatttttaaagagttggaaataaagtatttcaaattgcacatattctaattcaggggttttcaaatgttaataagcaacaaaaatcttacatggacagcttgtgaatatacacactgccgcactccgacctctccccacccccacccccctaccccgccaaccccacaacctcccagagttccagatcgacagatcaggcctgagaatttgcatgttcaagttctcaggtgatgctgacgctgctggcctggtatccagtatccacacttttgagaactgctgttttaatctgtacctattctgaaacttaaaaaaatgaaaagaataaaagccaaccatctctgtatatttaaaaggtattttatctaaaagtatacagttatatttcccgagagtacgataaacaattttaatggaaataaaccaaaataacatttttcttgtttgctttttaaatttgatcatagtgcccccaagtggataaaaacattacttacaaaaaaggaacactaaacatttctcactgggatagggttatgcgaatttatctttttatttgtcagaatgcccaacctagtgctttgcccataacatactcagtaacagggttaatacataaatgctccgcacccccacccccatttttagaaaggcctatcactcttgccctctagagatgtggggctaagtaaccctcaaatctcttttagctcttaaattcctacatatctaatatgtaggatactggcagttgtctatttgtgccagatgctagagaaattccttgaaagaaaatcaatttttctttctagataaaaccaataatatctttattaatatgtagaaattattaatataaagcagtagttaaaaaaatagcctggagcttaaaggcttgataacgacaaatctctttaacaattaataattgtcttacctgaatgtatgtaactctctacctagctccctgccaccagctagcatttttatatccatttctttatcattcttttaatttcagaaaatactcttctattttaaatgtacacccatggtcttaaatttttgtaaccactcaaatcaacaaactcacactgcttaacggaaggacagaaattcaaagaatagaagcacaccttttggtggcaccaatataatggggctaatgaatgcatttacctctttgtgtttcccttagcttccttaagcacatgtatttctcatatgaaatatccagaagtctcatgttattttatgccaattaacaaattgctaacatgtcatgttaataaaaaaagcaattgacctaagtagaagagctaattacatggagtaagataattaaacgattctcaatatgtaatcaaaaattatggctggaagtgtttcacaatgttgtctttttgttttcaagtatctgcctatctgcaaaattctaatcagtgtatccatatgcataaaagacagatccagtgcagatgttaatttgttgcatgatagaaatcaggtgttcaattacaaataatggggtgtatgagagaacgtccaagatttccatttagccgaacgcatgcatctctgctggcaaatgattgcaaagcattcatattggaattagctactaacatgcacccaaggcacatcacattcaactcctttattatcctcattatataatattcacatctccagctctgtgtattacctaatttgccaatgatttaggagtctgaacatttgctgatctgaattctatttattgcacctgaattcttttaaaagcgtgattctgatttttatctaaactctagacaactttaatatgagggattttgtttcctaatcttacatttaaacaatcaaaatcatttgcttttgtagtaaggtaaattccttgaactgatatgatcagttcaaaataggctaagcttttaacatatcaagactatttcaacaatgcctcccaacatagtctctaagtgatatttcagcaaagtaactacacagaggagagcaaatatatttactaggctgaaagatattatgcagatttgtttttcatataattcactacaaagtcacaggcttaaggcatagttataaattgagatattcaccatgccaaacttacaaactgatacaattctgagatgagaaataaatgtcaaactgatgatgaattttatgtcctaactcaagaccctaatatttagagtttgtaaattattgagtaaatataggccaggcctcagatagccacagaagagataattgatttgatggcagattaacagtaatgtacatcaatggaaatgtcattatttttaataaatgacatgaagaaagatttaaacaggaaaaaagtgcatttttaattcctttcattctcttatttcaatgaaatcaatttcaaaatatgtgaatatccaaggttccttagccactaagaaaagaagcaaatacagtttctgagtatgtggcaattagcagaacctctaaattattcaaaagtagtaatggggagggatgtttctataaaccaaaaaataaaaaatggtgactcatggaccaaatctggcttgccaatgtgctttgaaagctgagcatttaaaaatatattttgaaatcccttttgcaggacatgttctcctgatttctataatcctgatacttccagtcctcatgacttttaacctaatcactttacacaagtatttgagttgcctggcctctggtggtacttgagtatcgtgaactgacagtgatcacttaaagagaaaagtattttgtattagtaggtggtgttgcctagcagtttagagaataagctctggaatcagacaagtgagttcaaatcatggtcacttattagctatatggctttgggcaaatttcttaacctccttatgactcagtgatcttgtttgtaagttggtatcatcatacctatcacatagtgttgtaagaactaaataagaatattatttaatgtgatagattcttcaaatgtatttaatctactatatctggatgtcagagatgtaagaagtcatatgtttggatcagcttgctaattagagtagtagctgagtactctaaaaaggtaatagtataccagataataaatatgttttatttttataaagtctgttaaagaacctttccagtatgttcacaagacttttacaaaacaggcataattaccagaattatcctattgatattgaccacacattcctgtaagaactagtagagaatattgctgtatcattgatgaaaacaaatatatatttggatttttgataataactcatgcaaatagatcttgttttaaagcctaatggcaagagttgtagattgatgggatgatatactgagccccacatcagtgaaagtgacttgtgtctcttgggaccttttaaaacttttacaaaaattccactgcgagtcttactctcacgttttccaataatactttatcaagcatttgataaagtgaggataaagaaggataacaagaccttagaggaaaccctagactattagcaccatatctacccaactgaactaagtggctgctgtgaggcagtcctaaactatctccctactgggaagagagacagaacctgtagcatgacaaggcatccttatacaaattgccttttgtaattgggtttctccaaacctaaattttataatgtaaatttatctccacagaataaagcaaaacaaaacaatattagacaaatgatatccttttgcttttaagaaaaatgaatagttgtagaatagttataaattatagttactgaataatgaacagactagaaaaatagaagtatttaagattatttattagggacctgttaattgcaaaacagtgtgttaggaattaaaatgaggaattaaagatgaaaatgacacagatcattgccacaggacacttaacgagtaagagagctaagaaagataccttcagatataattaaaaatatatagtagaaagtgctataggattctgaagatgaaaatctgttttgtatcaattgggcccataaaagatcaaggttacttcctactttgagtagaaatcacatctgtgaggatcaataagatgaaaaagtacccaatccattgcatttctaaactagaagcttaatgcttaatgcatggagaaaaaataagcacacaaacaggcgagagaccatttactgatgagggtcagtaactggagtctgaaatttctacacaggtgggtcttatggaaaacaatctttttatatgaatgggatgtcaaggggaaaagagggacctaaaggattcttttagcagttgagtttgcacagcgctttcagattcagaaaacctcaactctcacatcagaggtctgaaagggtgctaatgaagattaagggacagggggcctaagctctcaagctaccttggtcagacttggtcaccactggtcaaaataattcattgatgatagtaatgaaatgcctgatgaatgagattaagggaagctgatatctgaaaataccacatgttttcacttataagcgggagataaatgatgagaacacatgggcacatagaggagaagaccacatactgagacttttttgagggtggaggatgggaggagggaagaagatcaggaaaaataactatttactaggcttaatatctagatgataaaataatctgtataacaaacctccatgacaaaagtttacctatgtaacaaacctacacttgtactccaatcttaaaagtgaaaaaaaaaagactttcaagaagcatgtatacaactatttatcaaagaagtatatttacaactatttgtcctaggttgtttagataagtatctatgaatggtaatacaagcaaaaaaaaaacaaacaaacaaaaaacaaaagattatgctccagagaatacagaagcactacataacagaggaaaaattctaaaagaaaattataaagtgtaatgctatgatgaagaagattctttcttatgctaatagagaatgaaattaaagataaaactaggtgaaaattttacacaaaaactcaacataagcagaaaaaaagctcttttgaggtgaaacaactgcaaaagaattagaaaaaaaacttttccttgagtaataaaataaaacaaataaaaacaaaaacaaaaatttcatattaaaaactcaaggctattgggatataagaaatactgggaaaaataagctgaattattcaactcaaggatttggaaaaaacacaacccaacaatcctagggaaatagaagaaaggaaataatgaagatttgggaggaaattaatggaactaagattttttaagagagacgaaattaatacaaatgtattagtcctttgaaaagattagtattgcagacaaacttctgcaggaataacagaaattaaacagaatatttgaagtgagaaaaatgaaataaaaaataattttaaaaaaggataaaaacgcaagagaagattttaaataatattaatagctaaatctaataataatctggaaaaaaatactttccaaaggaaaaactaacataaaatgcaaaaatttaaaccgatcaacaattactaaaaaacttgaaatggccaccaaaggtattcaaaaatacctccccttacctccaaccgaagtttccaatccagatattattgaaaatacatttctaacaaactcccaatgactgaaaaatcccacttatacaaattcagtaaaaaaaaaaagagaaacaaagtgaaaaagagaatgcaaaaaaattactgtccaactgatttaatgaggttaatatacctttgattcctagactgaaaatcacttcagaacagtgaagaaaaaaattatagaccaatttaacttataagcagagatgtgaaatttggcagtggaggtgaatataaacacacaaggagaagcttaattaggttttttgttttttttttttaaaaacacaaggagaagcttaattagtttaaaaaaaaaaaaaagaacatttaccttaactcattagcagtcagataaattgaagggtattatttaaattttatttaattttaaaaaattttcgtaacatttaaataaaaatattgttttccatgaatgtaaggatgttttaacacaaaaaaactccaccaatataaattactatattgatagttcaaggagaaaaatatcattgcttccccttaccagaaaagcaaaaattagaaaggccagtaaaaccaattttgggtaaggagataggaaagtacactgtaagtaggaacagataatctggaaagcaatcttgaaatacttagtgaaattaagtatctgtatgcctcattcctgattatacatagtggagaaattcttgcacaggactgtgagtggacatgatcaaggacaactactggaacactatttataacgatgggagttggagacaattcaggtgtttatcattagaggatcaaataggtaaaatgtagtagacactgtggtatgccaggtagtacaagaagcagtgacctaaaagaatatataacaatgaatgtaggtcttaaatactggatgtttaatgaaaaaaattaaatatctatagcacaaaacatcaatatttaacacacacacatactacacattttacaaggatacacaacatccatggctatattaaccaatacaaagtggatactgctatggtttgaatgtgtctcccaaagttcatgtgtcagacacttaaaacctaatgcaacagtgttgagaagtgggacctttaagatcacaaaggactctgccctcacaaatggattaacaccattattatggcagtgagatcctgatgaaatgatgaattcagcccccctctctctttgacccatgtgacgcctttcaccatattttaatacagcaaaaatgccttcaccagatgctggccccttaatcttggactttccagcttctaaaactgagctaaataaatttctgttcattataaacgacccagtctgtggtattccattagagcaacacaaaatggactaagacagatacctatgtgggcaggagcgaaataagagatgggatcagaaatgaaatatttaagtaaaacaaaagaggggctggtgatggtgagtcattaaaagagaaataacagtattcaatgctctgtgctccaaatcctaaggaaaacaaaaaggcaatcaaggtaaatccatcaacagcctttgtaaccaatgtaattgtgtaccagtcataaagggaaaaaaatgagtatttagaatgttgtaaatttaaatgtaaatcttataactctgcctgtctgtccctctctctctgtctctctctgtctctgtctctctctttctgtttctctccatctctctttgtccatctctgtctttctgtctctctctttctttctttagtaaagcatgctttaattttatgcaataatcatatgaagaaaaacattttttcaccttttttttccattttcctaatgtgtccttaatcttcataaaacttcaactgatgattttaggtaaccatatgttcaaaatgtttcaagtcacattttatatttaatatatttactcttttgtgttaagtttactgtttaagctcatttcaagtacatgtcattttcagttaatttattttagctgcgtatttgagatttagtctagaattttaaaagtccactgaatcatgactacattacaagtttccatgtggtatcaacagaatttataattcatatatgacattatactcatgttggcatcatttacaaaagaagattttccctgaactgtaataaatgctaaaactaaaaaatttagaataccgataccccagaaatctgaaagcaatttaggactttaacttagtattatagtaatttaaaaggaatactaagttttaaaatactgtgaattccatttttcaagttgaataatccaataaaaaattaaatggtatcaaattaaagaaacatttaaagttttatgattgttaacctttcttaaccatagatcattttaacaaagtctgttgtgggtatgctcctcaatttggaactaaatttatatctcggctcttacaaatattcaaactaattatttcagaataaatgtagaatgacactttaattagtaatgtatctcctggcaattaaaattctcttgcttctctcagcaattaaaacggcaaggcatattattaaggtcccacaattcttcatacctcttcctgacaattaccatgggaaacattaaagacaagattgtagttataatccattcactgaatatttggtagcaggataaacactttcttctttcttctccttgtctagtaatttttcatttcactcataatacctatcaatcattaacgcaatttgtgctctgtatcacaaagttccagttttcattttatatgacttataaaaaccaattgattttatagaaatgtaagttatagcaatgattttaattaagaaataatttttaacccatttattcataatatgacttttacggtctgaacactataaatacatagagagtacttaatgctggcagaaaatgttagtgttggaaatagaaaatgtctaaaattactgtaaattgagtatgttaatataacaaagatatacacacagagaaacaaaaatatgtgcaccaaataggtgatactgtggttcagaatgaaatagaaaaagcagcacttttaactttcatatacctaagaatattttttaaactggtattatgagatgatttttttttttttttttgagacggagtctcactgttgcccaggttggagtgcaatggtgtgatctcggctcactgcaacctccacctcctggattcaagcaattttcctgcctcagcctcccgagtagctaggattacaggcgcccaccaccacacccagctatttttttttttttttgtatttttagcagagatggggttttaccatgttggtcaggctggtcttgaactcctggcctcaggtgatccgcccgcctcagcctcccaaagtgctgggattacaggcatgtgtcattgtgcccagccaatttttgtttttttttttttatgcttctcttataattccatttttctgtaatgaatatacatatattcatatatatttatatattcatatatatttatatattcacatatatccatatatattttcatatattcatatatattcatatctttatatattcatatatgtttatatatttattcatatatgtttatatattcatatatttacatatattcatatatatttattcatatatttacatatattcatatatttatatattcacatatattcatatatttatatattcatatatatttatatattcatatgtttatatattcatatgtttatatattcatatatatttatatatatgcatatatatttatatatattcatatatatttatatattcatatatatttatatataactattgcaacagaagaatatctaaaagttacatggaatatatcatatgtgtaatagtagcataaaatcaaatcatcatttatttgtaaatcataaattatctattgtgtaatgataacagctaaaatggacagctaacaacgtgccaggcaatgttttagtcactttagtgatactagttcatttaatccttacagcatcattttgaaattggtgattgtcatattcaattttacaggggaagaagggaggcacagggaggttaagtaacttgccttaagatcacacagtgatgaggctataattggcatgctggctgcagactctaggaactacaattaagctgtcctactatgatattacactatcctttagtaaattttaattatgtattaacatttcattattcatatatattactacaaacacacctaacactctcgttctctcagatatgatagtaagtcaaatggctaaatctttgggtaaacaacacatggttttctataactaagtgcaagtttgggaaggtattattagcagattctattaaatgttcataactttcattttaagatcaagggaaaggctaaacaaatgggaacttgtctttctataaataaaacatgcatatttgtgtccaatggacaaatagatattgtggaggataactttatctatattctttgcagtattttcaactgtaacattactttcctgttttattgtagctctctgattcattttaatgttttacacatttcaggttcaatcctcattcactttattcattatttttttttctgccctgttcatcatagtctacatcagtctagaatctctctgatcactccggttttatcatcttcccttttacagtttttcacatttcataagaggagttaagccctttctattcttaaatgcattccatgtttaataaacatccataaacacatacagttctcacaaccactaccaacaaagacagtatttttcagttactgttctcaaataatcattttatatttgttctttccctgactagggtgaccaatgaaaattccatctaagtgacttggggcaacactatcatgtatagtgttaatatacattaacactcaaggaagaataaagtaagttatttttttttaataatctgtgaattctggtataaggatattttggaaacagcttcaagctaccagttaaaatagattctgtgaaccccttatttatggtatctttccaaatggatgccaaagtcatggaagaagcaattaatatctaacagtacactacactttttacatatgattatgctgtgttttgccagcttaaactgttttcaattttacagttttaaaaattttctagtctatgctatttggttaacagctgttccatttcagtggggcaagtaattagctctactgtatctaatgcattactcttgatggttttttaagtatcactattattacagcaaatttcactcattcactcatttgagtctgacacatagtctcaataaatttactcatttattgagtctgacacatcaataaacatgtgttgaataactgatttgatgaaatcaagcatgcattcagtgcttggtcaaataatggtgaacaataaggtccagcccacaagaagttgatctgagctggtgagacaaataggagggtggatgttataattttatagtagggagtattcaagattatctgggaacacaatttgggattcccaagtcagtctgtgatggaaaaatgaaaaatatcaagggaattttcatattgtctcttaatctgaaattctgaacaatcaaaagtatataaaaatcaaccaattatcagacgataatgtgtatccactatgttctgaagcatttggactaagtaatgaaataagagtcaggatctctgccttcaagagacaataatataactataaacaaaaacatgtgaaaagtatcaaaagaaggcagtggatggtaaaagccaaaaaaagagaagaactgaaagatcttatatattgctggaagaaatgtatactggtagaactatctagtaaaacttgaaaaagttttgtattatcttgtaaagataaacattcacattcttacgagctcagcagttccactcctacgtgtccactcaagagaaactatgcatatatataccaggagacatgtacaagaatgttcacagtagcaatacatgaaatagcaagaatcttgaatgattcaaatgtccattttgatgaaatggataaagtacagtatgtttgtagcaagccatattgtgcaggaaagattatatatatgcacaaataaatgtatagatcaatgtgacatacatcatgggctaaggattatgattaatccagctccatgcatttgatgtataatagaaaaaataaattgaataggattttgtaagacaagagtgcacagtatctaacctttgctgtatagcatactgccctaaaacctcgtgacttaaaacgacaacgatttattatttcttatgagcctatagtttattaagcagttctattgacctgagctgggcaggccatgaccaactcgtgggtctgtggtcagtttcacgctggctagctggctttgttcatttcatctggactcattcatatgcctgaaacccaggtcagcacaactaggctgatttagttctgctttaccagtgggctagcccatgtgtgtcctcatggtgaaggaagtgagcaagagaggaagtgaaaatgcacatgtgctttttgaagtatatgcttatgtcaaatctgcttctgtctcagggaccaaagcaagccacatagccaaacccaaagttggaggggacaagaaagatttagggcacaaggtatgaatttaggaagcctgtttattggttctatttatgtgatcaacctaccatacgtacaaataactttgtaattcacttatctccccctttaatatagcaaagggcaagtctggctgacttaatcaaaaattttactaagtaaggtcctagacagccagaaaaaaggaagaaagtccattcttctggtgtctgtaggctgtggtaaaaagtaaagagacggaatagggaacacaggtggttgagaatgccttgggtagaagggcttctgccccacctcccattccagattctcttgtgcagcttgtaaggtaacaaatgtggagtaatcttcatgaggcagagggagggccagcatctctttcgattatcttggtataaaaaagactcaatagttctctcaaaaatcaagggagtggggacaagatggcttgcagttagcggagagtctgcttctgaggaaacattagttacacagaaaataaactgcctctcttggcacatatgtatgagaaaatgtgtaacctggtactagagtggcaggatttggtaaaagagtgaaagaaatagatttgagcaaataaaagcatgctcagggtacatgaactgatccacttggcaaagttaggagttcgtgttgggtataaaatctagacgaaccagatttttgaagaatctgaatgctagcttaaaggatttgcatctaatcccacaggcacttgggaagcaactgaattttttttttagtagagatataattgtattcctaaattcctaaatggtgtggaaaatgggaacatcgtagaaaagtccttgaacaagttttgtttgttaggatggagactgaattagggttggcagaaggaataaaaagggatttagttgtgggaagtactacagagagatagagattaactaatgtcagtgaagaggaagttgtaaattgaagataaacctaaagatcaatcgaactgacagaaaagatgaggctgccagtttcacaaaggtggaaataggtggtattcaacttttctttgattgacctgtggactactgttatatccttctaatccactgtcaaaaccatgttttgaaatgtgttttagaagtattaatattgatacgtaaaataaccagaggcattaaaaatacatttgtatttttttaagtaacaagccgatctttttttaaatcatgagaataagatgtgcttttctcttctgaattactaatgtactaaccttaaggatataaatgaatgcaggatgaatacttagaaatataatgtttgtaaaccctttcctctgttcatgtcatcgacactggtattaatgttaaaattgtggtgatgtttctttttataatctgaacacacatctatcacgctaaagcaagttcattgtataatcttccccagtattgtttacttatgattttcaagtgcttcagatacagtctacatagggggctgtggccgtgatattataccctattaacaacgccccattcaagtaagttctagttatgattatatagagaggagtaggaatactctttaggacccttatacccgtatgttaacatctatggaaagaatgccaaaattaaatacactaatagacaagcttggactacttttgaagagattccttttcatcattcctgtatttttaggccatgtcctatcctttgctatgttccataaacactcattttctcctctttagacctctgctgatcttaagctttttccttccttttttcagggactttcaagtaaggccagctttgctgccatatgctgtacttttgctgctattgcccttcactactgccatgtatgatgctttctggtttatgtaaccttctgctcctaagtttcatcccgactttggcccactgccatgctctgactctgaaatctttgcaagtcttggtactgtcagcccatgcttttgcttgcttagtccattcctctccgtatacagtctaggactcttcctgcctgtctcatcattaaaacactggttccttgtatatttctcctcattcttgtcagctgttggggaaaatattttcatgaattatttttgagcctatctaaatgtgaaaaaaaagtgtacaccaaatagaattgacagaataaatactgaaataaatatagcatgactattcaaattcaggggtcactgtagcagaaagaaagcaaattacttttatttagtccataaagataatatgaacgaagctcaaatctagggtgttttttttttgcctttaatttttataagtattggttacataatacatcattcttacaaattaaaacatattaaccctggggtatactctacccacaagaaatgttgctaaaacttcttcctacagttcaaccacagggatggtctaagaataaatgttgacaggcaacaagcctccctgcagacagtaattaatttcaatttaaagttttggggaaataatatatttctttttaatacagtctttagatttatagtcaaatttaaatttgtgaaaaaaggagacttcctgtaattcttctggggcaataatgttttgaaacacactccaacaaatccaccttacagtggtaccaattagataatttgaagttaatatccaaacaatcagtccacttacaactgtgagcataatttctgcattctattcttttctaaaaaaaattcatcaattcaacaaatatttgtttagcttctactaaatactaggcaatgttctaaaaattgggtttaaaaatagcaagtgagacaaggttcctattctatggcaatcaaatttagttgggaagctaatcaatagcaaattacaccatggcaatagcattctagttgaggatacagttaataaacaataaatatcacacagataataagagcttaaaaaaaagaatgaagccagttaaaagtagaattggaagcagagagagaagggttctttgtagggtgaacaggatgggctgctgtagagacagcacctgataagagacagaagaaacagaggaagtgagtactatgagcattctagagtagagctggcaaaggtctttagaatgctaatttcaatgacactagtctctctcactgattctttccacaaaacatttaattaggctaattatacaatcacatgaatgtcttgagtgtgatggtaactacaaaataaaagtcatgtagacagtaagtattgagtcagctgtttaggtttatcaatccctcttcaaataaagcaatttagctgggtgtggtggctcacacttgtaatctcagcactttgggaggctgaggaaggaggatcacctgagtccaggagttcaagaacagcctgggcaatatagggagaccccatctctataaaaatttttttaaaaaaactagtcaggtatggtggcacacacctgtggtcccagctactcacgaggctgagatgggagggtcacttgagcccaggaggtggaggctgcagtgagctctgttcacaccactgcactacagcctgggagacaggataagaccctgtctaaaaaatttttttaaattaaaataaaaatgaatcacacataaaactataactaaaaataaacaaaaacaacctgagatgaaattaaaactaactcacctggtatgtaaatctaatgagatcaacaatgtatcataaaacttgacaaattttaatatcacaactagcaagatttgatagactggtagagctatatggatcaaatcatacttatttaatgatttaagcaagaaaattacaagttaaactagcaaattgtagtaaaacatacaatgagcaccaccagttatttaaaaagtgttagacagcattagactgaaataaagtgaaagtgctttcttattcctctcacttgccatgaaataatctccagatgctctttatttttagaacctgagcttatttcttagataaatcactcaagtcagttgctcagacatggttcaaagcccttatgtaatattttcatttttctcccttggacatagagagaagacaaaataaagttagcagaaaaataaacacacaaagagcaacgaactaccatatctacatccataatagctgtcaaataaaaatgtaaattaaagtctaacaattaagcaaaggacctaatagggatataactgttatactctcaatgaattaatgatgatttgtacatttctatttttctcatttgtcttcaagcattttcttttgaataaagtcaaatgatgtggttaaaacttgaagaatatcataaggccgagcacagtggctcacgtctgtatttccagcactgtgggaggctgaggcaggaggatcgcttgagtgcagtagtttgagtccagcctgggcaacatagcgaaaccctgtctctaccctgtctctaatacaaaaaaattggggattgataaacctaaacagctaactcaatacttactgtctacatgacatttattttgtagttaccactgcactaattaatacaaaaaaatcaaggattgataaacctaaacagctgactcaatacttaccgtctacatgacttttattttgtagttaccatcgcactcaagacattcgtgtgattgtataattagcctaattaatacaaaatttagccaggtgtggtggtgcatgcctgtagtctcagctacttgggagactgaagtgggaggactgcttaagcctaggaggtggaggttgcagtgagcggagatggtgccactgcaattcagcctgggcgacagagtgagactctgtcttaaaaaaaaaagattagtattaattaatattattattattattatagttcaagggactcaagtaggatttcggtgaaatcaggataagccaggctgggccaagttcaacctgggaatgcaagtagacctacacatacatacatacataggttcaagtcaaggtcagatgtcgaaacatagttattttagacaaggacacaggggaaagtcattctaaaaggtacatttaaaaatgaaatatcaatttgctttgtgaaagaacagacttggctttgtttaaagcctggactctttgagcaaatactacctcgacgcagctaagattttcctcccctaaattagttggagatcataaaccctgaataataatctaaacaatgaaactttactagagtgcagtcatttcactttatgaggaaatacaatgtctgaatatttagtgtgtgaatgcagtttatgtaggcatgctgtcccaacctctggatgcccagctggccctctctctgggaaatggtggggccacaaagcagccggtgtggggcttgtctcgtttttctgctggaagtttaactattgtctctccttgcaacaagagatgagcccaatgccttttctatctttatgatggaaattaaactacagagttttatctgtgacaatgtcaaaatattttaatccatccgttcattcaacaaaatgtgtaaatagccaagcatgactctacacaaagagaaatatgagattcatctcagagtagttttgctaaaattttatcttaccaattagaaactatgataaaagtcttctattatagttatatagttacgaaactctatttttactataaaagtaatcagttgcatgcagacttctcatagatcatggtcataatgcttccacatatttgtgaaagccaattttctctttttcagttatagatttaattgtcataacagtcatttattagttccattttattttactttttttggttgagaaagtaacctttgaattaggaaaataattttatttaataaaaacaggaatagttatttgagttttaagttaatactgttacttagccactaggctatgctaaggtatagcccatttgttcaagaacacttctatcttcatgctacagacacacacacacacacaaaccaggaaaataaattcaaaagctggatgtgaatcatttaaccattcaaaacatagctggtaatttgttcaatagatttatctaagggttagtttctataattagtttagatgacatattccaaaagaataaataaactcaagtttttgctaaatatacgtcttgtggtaatgcccagtttggttttaaaaggatggaatcatagttatgcttatttgatccaaattaaatatctattttcatttacatgtagttagtcctacttaaataaactataatatatagtcgtggactgattagttatcagaaacatgagctttagattggatgcattttaccttctggtttaaaaaaatagtcatattaaaatgcaacattgagaactaaacaccatttatttcatttattttaggcatttttttacattaaaattatgttctattctcaataaactgtgtttagaatcttttaaggttccatttgtgaataaagcttactctcatttgtattacttttcccttaatactctagggagcacaatattacattttcaccatcattattcacattaatatctatctctgattatacactgtgggaggcattgagaattcaaataggtctaagaaacttagagtacagttgagaacacacagaaaaatataaataacattgataaaaatattttttaggggccatagataagtgataaatgaataaaacagagaatacatgttacaatagttcacgcaagaaagatctatttgacgtccacattattaaaacagagaataggtttttactactgaagtcctaaagatttcaaagtctaaagtgctctgaagataaaaatccattatcctccaatttatttttaatccacctaacaactctatctgtaacaggagtttgctatattttaaagataaattaatatttttaaaacttgacttgtctctcaaaattattatccatctgttaattattgattataggagaaatgattgacaaaacacgatccaggcccaaagcgaaatgctattaatctactattcctgttatgttattgctttggtgtatgatggaatacttggaagaaaaagattaacttactttctcttcttaaatgtaattaagtgcagtaaaatccattgatgaagtacctcagaaaaagacgaatatagctatgctgtaggtgaaatgtttgccaatacatgtttacacacaggtgtattattcaaaatgtttaaaactgttaccacatgggtactgagaaaacagaacagatgcttaggttaaagcacctctaactgtccctgtccatagggagcaattactattatagcattgctgaaaatgtttaattcttctaatattagtattaaaatattttaattgaaccactattttggaatatgatattcttaattctgctacataacacactatcttagcataacatcatcacagataattttcagttctaacattgcttcaatgtatacatcagaaactgaagagatatttaaatatctggaaatgcctgtatctcttagcaatgttagataattgggctatgaggcatttctggtccgtgtccttcagtgagttcctgagctttatggattaaattaagagacgatgatatatcctctttagtcttttccttcacctttagtcttgggcagaaggcaattgcaggcctttctaggggtactgatttagtcaaagagatgtgataaaaacataccctacccccaaatcaagccttgtaaggggtctggattgtctcacctatcctggagtatgctaaaccaaggaactgccaggtaagagcaagggtttcttcccactggagctaaaggttacaggacctgccctatgcatgttcagtctttgttcttgagacaagctgaaggtccaggagtattcaccatggcatagtactggccatgggtaaattagggtcatctcggcactatgataggttcctgttttttttttttttttttattattgtgccattcatcaaaagaaaaagggactgagtgaaaaagggtagagaaacaactgcagttcctggaacatactgtgttcttttatgtgtaactctactagtctctaagcactttagagcactagcactctctctagtctcaaagcactctatgacagtttcactgaacttgtcatcatcagctaaaactccttccaggactccctgcctttgtacatgctgtcatgtagctggaatgccagttctcccactgtctacctgataaatttatccttcaagttttatctcaaaagtcaggtgtcctgtgagactttcattcactatacctggcaaaaatcaggtattatttctcccaggttcccatttctgtcttacagcacttatcactatcataattatttgcatacaagtctgaattcctgactagccagttcctataggcctgcaataatatcacattaaagtttgtcctagttggaagacagtagtgctcaatacatgcctgctgcataaattactggtgagcaggtagatggatgcatgaattaaatattaaatcccagatactccatgtgcattataatctgagtcatagttagacttgactttacattactacattaaagatgcataatgttgtttatccaaatcatggttccatttctaagagcccaccctctcatgtactttttccctttggtgaggtctgttctgacactgcacatgctgcctactaaaccaaaaagcaatacagtccttagcaccatcccaactgtaatgtataccttgggtttccccctgcccagagcctaactttgtttcccctaatggtcatctaaagaatcctcctcattttttgaatcatcagttcgctccaccctgatgttagtgattgggccctaatgccagcagactctgcttgttacaaggatgcactttcttagacctctatgtctgttgctactaactcagggtaagccacttcaacaactgcttttctccatagtaagaaaaatggccccttttctttcctaatggctaatacccctatgctgggatttggccatagtaagtccaaagtgttattctgaggaagtcctggatttttggcaattcattttattcaagagttcagacctgtttcatcaccagctgcaacagacaaagaaccttggcagagatgaaggctgactctgacccctggtgatccccaggagacagtccctgcatttcttccccaggcaacagtagcagttttctccaatattgattcaattctcactcacatgtttggatcaacactcatatccctcttgttaaaatgtatatagcctcgttgggttacatctacactatgttttagtttttatacagtctatggaagtttaactatttctaggaacctcaatgctaagcttgtttcaactattattgtaatttgaagaatgtttcttagaaggtatcagtgccctggtgccctgtatcaatatgactgatgagtaatactaacacaatcaagttccaatatcgtggtagctcgcatacagttatcttaactaaggactcatgtattgagctataaagccgtctatgggtataaaaacattgagtaagataacttacgtatgtcactttttgagaaaactccatgtgaaagcctgctatactggttctctcactaaactgacaaaaataatacactgaaatgaaattcaataattcaggaaaaaaatcctcaaatttatactcacccactatgcttcatatgtgctggtttatccattcgcactgccagtttgatttttaagtcagaatcctggctattttttggaactaccattcggtgtaattcagctgatttggagctattagaagttgggtataatatcacctgtatggaaaaaaaaacccacatttaaacgcatgatacggagtgtctatgggttggaactaaaatattttctatgttttcctgtttgaaaaaatgatgtcaacacccaaatgtatccaataaacaatttgactccctactacaatagctgatggattttcaatacagactcaatttatttttttgacaaatatgtgttttcacattatcacataatgagttttcttcctgtgtcacttcataacgaattaatagcacaacaagccacagttgaattgacgttgaaaaatactcaagagacacccataatttcaagaaaattctaaactcctcagggcaaagccgttcagaaagatattctttgacattatggataacatgcttaaaaaccaaagtcaattatttgaaacagcacaaatatgcctcatgttttaatattatcattgtaaaatagtataaaaggaaatcaactcaattagagatggaaaacagcacattttctgctgtagatcaataccaaagaaggactttttcctgacatgttttcaaaactatagatattataatgactgaaacaaagtaattatttttaacaaaactgccaaattgacaagtgattatttcacaaccctcacttcacagaatcaacccaggaaagacaagcctactcttcagatgttaggtgccatgcagataacacaaggtattctcccccttttaaaatcagttatgacatatttaggcacagtttacatctaagccttaatatttttaaatgggagaatgctcatttgtataggctaaaatacaaaatatgtgaagtgcactgcattatattttaagccataaacctgaagtttagatatgaatggaagaattataaacattctcaggtattctaattttttcacaaacaaaataaatatgttcattaaaactatattgaaacatatcttcttgtgcataaatcttgaggcaacacaaagtgattgtgaatctgaaatttctttgtaatactgttataattttactttaatataacaaaactaagtccagtctcaagttgttagggatagtctttaccaatttaataaggctgccttctattcttagattctaatactaaaatgttttgaaagcattcatggcaattgactttgtcatgcccttcccctaccctcaaatcctcatttgcagtataagcagaaatcttcactgagaaatctttaagcaagactccccttctctctaggaaagacaacacagtcataaaagcttctcaaactattctcaacttgcaagttgttaaatgtatctactattttgagacttttctcaagtccttcctataaagccatagctgtgttgaatccagcatatctatatactcaagtatataaaggacatctaagaacaaactaaatgacatttacaatgttttcacaattatgatcatactctagaattcattttgactgctaaaatatccagtgtaatattttacagattctttcttaagtgacagtaaagaaaaataagctgatagcttttggctcaaaccagtagacaaaggaatatcattatcaacttagaagattattccaaaaaagaataaaagactaagatagatctctatatcctctgtagctatagctgctattttcctaataagtctggaaagctttttctctttctccacacccatcccccacaccaactttaaaaaaattatttggcatgagccacttacagactttattgttttttaattcttccttctatgtttatataaaaattggtattgtaccaaactctgaactcttatacaggaagggaatatttaaattaaaacttttgacaatttctcattctgcaaatgctgatgatggcttgctaaattaggtcccaaaataactgattttggctgatccacaaattaaaggctatcccaatatcgaataccattttttctgccacattttattttttgatgggtatttctaactgaagtcagtggaaggatttattgctcagctctgttcaattaaataaacactgagttcttactatgtgaggatacacaaagattaaagaacatgaatggctcacatctctcaagagctcagttcctcttcaatagggcttagtttatgtcttttattaatagcactcttagctctgataatatcacttcttcctattgctcttctttccctagagtatgcaatggtttcctgatttagttaatttctgggtatattcacaatcatctgcttggcttctccctatcatatgtatatctaattccctatgttatgttccctccactggaaagacgtgggaatgtttgtttttctggacagactgactgataaaggtgtgaacattggcacgtgtaacaaggggaggtccacagatacgaaatcttctgtttctaagagaagtgcattggtaaataaatgctgaacttaaacttcaaaatggtctgtaaaatagttttcaggctcccaaattgcacaagcaaaaaagtggtcatactcctttatccaatttcgccatgaatgaatagataaggaagcagctcccaaggtgcagagcccagagggccatggagaataaaggacaagggagttcttttcagaacacacaatacagctctaatcaagagatctgggacacttccttggcagggtgtcttcacagtgcctgccagataggatttcattattgtaattggacaattactgccatgcgtttcccatttttcctttttccacgtggcaaacttacccatagctctcctgtccctgttccgttactgtatattggatttatcctgaggcagaatggggagggaagatgtcgtaggcagttaccatgaactttagttcacaggtttccagcctgcaaagggccactgctagctgtgacacagatattggactggatataaaaatgaaataggactttgggctgtttctcttgagataaggtgaatgtgttctaggtttaggaagaaaggcaacaaaacaacttggtggccacaagggtgaactatggcacaccggctggctatttgccacgattcatgctttcaccagtatagaactgttgctagtaaacagctaattagccaacaaccaggttttctagctcctcctgcttctaagtagggacatatgaaagttcttgttaaaggtgacatgtgtcaccttgggaaaaggtgatcaagatacaggtttgatgtctttaccccactttattccactgccagccaagttcagagaacaccaatacctaggaaacgaaagaaatcagagccctaaatcaccatgtggaagaaagtcacacttctatcaggaatacctgtggtaaactcttacaaacctgatattattttgaattattgaaatgtaacgactttcttgttatagcatttagcagtatcctaactagtatatcaacaaggtattttgtttcaaaatctttcaaaagtaaataatgaagaattgtttttttttattagaagcagttccacttcaataggactcagttcatgtttagagattgtgtctgatgttgacagtcataataattaaaatatttaacagatataaaagcttactaaggatccttctgtatcctaaattcgcatttaaattaaactatagctctgtacaaataacttttaatattatttagcaaactattttgttctttaccattcgtttctcttaacctttccgtatgcatttctgcttcttctcatttatttttgtcaccaacactttaaatgtcttgtcagcatggcacaaaaatgatttcttgtcttaaacataaagctaatgtatcttcttcataataaaatgtcagtgtcacttgtcatctttgctaaggtgtaatggaaaccacaaaatggatttttaggatttgttaaaaattccatcaaatttaatatacaggaggaaaaactaagacttaaaaaaatgaaatataaaatacacatttacacacagaaatgtttagagtgatatggggttcagaagtagctttctcttaaaatatataagctgtcacttctacattgtttcttttctactgagatacctgattgaggccaaactacatacatttgtgcataaactctgtgatctgtgaaatcaagactatttaaattgctaaactctgtttcaacaagcacctgaaaaactaaaacaaaaaacaaaacagcactgggtgctgggggagacaagctagaaaaacagaggggctagacagacaattcactaccttctcccatatatgtctcttagcttagagaaaggaaaaaagaccctgggaccacaataattgcaccatatcttatggcaaaacagcagacacacagttggtacaattctagctcaaagatgagtgcattcagcaattcttgaaaaaatcatgacagctttcatagaggaattacagtttcacttggaagtctaaaagaacacctaagatttataaggctgacatggggtaggggatgaaaaataaagatatgggggctgttgaaaccaaacactgtaacagcggcaccctagaaaaaaacacatgattccaatgctgacatttgtaacattactctaggttctcaagctcttccccaagcttggctgttcaactttttctctgttccctggacttagcctcagtccgtttccaccgctctccacgaaaagaacttcaatcagtacaaacactcattacattttctgccatgtcaattctctttatgttcttaaaagataagaagagagggccaggtgcggtggctcatgcctgtaatcccagcacttttgggaagccgaggcaggtggatcacgaggccaggagtttgagaccagcctgaccaacatagtgaaacctcgtctctactaaaaatacaaaaaattagtcaggcatggtggcgggtgcctgtaatcccagctacttgggaggctgagacaggagaatagcttgaacccaggaggcagaggttgcagtgagccgagactgtgccattgcactccagcctgggtgacagtgcgagactccacctcaaaaaaaaaaaaaaaaaaaaaaggaaaagaaaaagagagaagataacccgagaaccctctgggcaccacctttctagagttaggaaaagggacaagactctataactgagaccagtcaccaaggaggcagaagaaagctgaagtttgtgatgtaccaaatttaagggggagagttttttaggtagtaggaagggggcatcagggtcacatggggatcaagaggctgcacattgttgggtctgaaaggctattgcctggttaaaaaagagagaggtgactggagacctgagcaggaaaaagtttagttgcggccagatagcaatggtgtgagggacatatcatgtttgaggaatagaataagacttcatttaaggtttaagttggcaaaatcaggtaagttgggcaaaatcattttggctagaaggttactgtgtgtaaaggcagggaggatgacaatacagacaggtaggttgaaggagatacaagaaggtaggttgaaggagataccagaaggttaagcttatggataaaaccagtaattatggaagattagggatagactgtaagaaatgtgttttgctaagcgtgtgttatcctatataggtaacatttagtaaaacaatgtttacaaaccagagaatgaaaatcaaattttcatactcaagtaaagaataattcccctctctctagctacatacatctcagagatgagtcatgtgactcaatgatcaggtttctcatatccaactaagtgatgaactagcctcaaacagaggaagaaggaactaaaaacacaattagcagaaatcatggttcaatttttgattaaaaatcacttctgcttacaaacaggtgtccttgagacaaaggatattttaggcaaatggctgagggaacatctttccagataagtagagcctatctctacaagaaaccttgactttttgggtttagttgatgtttctttttctctttcaattgacagagattttatactttagcaaagattcataaagacagtctctagcaaatctttcaaataccttcttgagagtgtagaaccttgaggtagcatatattatgaaaggactacctgaagtttttttcacttcagtatttatttagcagatgttaataaccacatatattaatatttgccccaatatcagaacccttatagtatgtgaagatggatcagatgatttgtctaagggaaatctatattattccttagtaacagtttctcgtgttttaatacacttgaggttgctaaatctaaattatttcttatttgatttaatatcatggcttcctgtcctacttagtgaaaacaaagaacacctgctcactcttacagacacagtgctcttttgtatactgaaagattagcattaaatcttgtcaaccttattttccatgggctaaattgagttcttttattttcaaagctggaaagaattttggaatttacaatatgcaattattcaaactcccaaccttttaccaaatgtgtacttggcccaacagagaaccacacaccacatctccttccttctatacacttttttttttaaacaagaaaggcctttttttgaaaaaacaaaatggggtagaagaaaaacaaagtattatcctaagtggatatattttccttgacattagcttgttaaaagatcaagattagaagctttgttatttgcatgatgggaggattaaggataaagcaaggaaaagaaaagtaagatgtgtcaatcattctccagtttttcctgacatctctatttaataatgatatgaagggggcattaggcaagccgttagtagtctacgctccttgagagcaagagctattgtgtagtagacagggtaattcatttgtaccacatagagtcacttaaatgagtatctttaagacattttttttcaccagttttttattgaaattactatatttaaagtatgcatcctgatgttctgatacatagtgaactgatcactacagtcaagctaattaacatatccatttcttgactgttaccattttaaaaaaatctctaagccttcttaatcacagtttccttcacagtctattgtaaacactcaccaagtatttgttggttggatgattggctggaaagatggatggatgaatgaatgggtgggtggatgcttagaaaaattagaaataaaaatgtaaacctaaaattaatacttcactgtggtgaaaagagaaaaagtcttgataactaaattactgccaaaatttgataacagagaatgatggtaattaattctacagtgtgttgtttacttaacagtctctcaaaatctatgaaactttcatccttccatatctggaatgtaacaggtagaatactggcttcccaaagatgcccagatcctaatccccaggacttgtgaatatgtttttaccttaaatggcaaaggagaattaaggtagcaggtgaaattaagattgctaactaggcaattattcacctatccaggtgggcccaatacaatcacaagggttctgaaacacggcagaggaaggcagaagagtcagtgttgatgtgaaaaggacttgaccagccattactagcttcataattgaagagagaaacaagtcaaagaatgtaggcaacccgcagaaatgggaaaaggcaaaacaaaacacacaacaaacagattatcctctagagcatctagaaaggaacagaaccctgctgagagcttgattttagctcacagagatccattttgaacttctgacttcagaactataagataacaaatttatattgttttaagtcactaagtttttggtaaactgttgcagcagcaacaagaaactaatgtgtagacaatgaaagctaaaatttcatcataaaggaaaattaaatttaccttttaaatttctcctcataagtgtgtgatttaaagatatttttacatattgatttctatcatcagctttgcttactttgtgtgtgcttatatcttgcacacacctgaagcattctgcttgtaaaaaatattttgaaatgcttaattttctctcattttgtattaatgtagttaaagttttgacttttcttacaataaactgaaaaatttttttaaaggtttaacaatgaagctgattattttggttaccagaatgaagaccattatgtttatattactaacaaagttcaagttccacacaacctaacgattaagaattatttctgctatttcaaagcctttcttgaagattccaaaagacataatcaagtttgtcagtcactgtatttttcaaggctcaattaaggatagtgtcttttattaatatacatagatcacttttcttgtttataaggtattgatttcatccttcttagatagagcaatatactccaacacagctatatctgtgtttttaatatgtatatagacaggaaagcatcactattcttgatctattgccctcagccataaattatgaatagcataacctttacattactttatcaaaacagtttctattagaggatactgcttgagtagctttatcatttttctttttactagtctgattataataatgcttgccatttatggagaatctatcaactgagtgtcttggaatgctttgtgaaatttaaatcaattcccacatcacccctcaaaggtaggcactattttgttatgtaaacttggcactgaagttaaataaatatctagaggcaaatcacttcaaatcacttcaagataacaacagacactttcaattttatatcgcccccctcaattcaacatattatctccttaattatttcataaatataacaaatttagttttgttcttaatctttggttattaagtacaataagaatttttagagccaattcaatgtcagtcaatccataacatacggtggtcggatggaaaagagggaggtataaacaatatctagacttggacaattattttagctgtatccttaaagtgaagagcatggaacataaagttatggcaaaatgttttgggattggctagctaattcatggactactgatagatgtgggtatttaaattaaaaaccaactacaggttgtgcattcctaacctgaaaatccaaaatcagaaatgctccaaaaccctaaactttttgagcatccatatggtactcaaaggtcgtgcctaaaggaaatgctcattggagcattttggatatcaaatttttggattagggatgatcaaccattaagtataataaaaatattccaaattctgaaaaaataaaaaaactagaatacttctggttgcactttggataagggatactcaacctgtaccaccttaaactgtgaaggtgagctcttgttcttcatatgaataagggatccatgcaaggtctaacaatcacaacataataatgtaccaaaataacactaatgaaaacctttccaagttggaatacttatatactgttggtgggaatgtaaattagtacaacctctatggaaaacagtatggaaatttcttatttatttatttatttatttagagatggagtctcactctgttgcccaggcaggctggagtgcagtggcatgatcttggctcactgcaacctctgcctcctaggttcaagcaattctcctgcctcagcctccggagtagctgggactacaggtgcacaccaccatgcctggctaatttttgtacttttattagagatccattttcaccatactggccaggctagtctccaactcctaacctcgtgatccacctacctcggactcccaaagtgctgggattacaggtgtgagccaccatacctggctggagatttcttaaagaactaaaaatagaaatatcattagatccagcaatcccactactaagtacccaaagtaaaagaaatcagtatatcaaaaagacacctgcatgcctacgtttatcacagcgttagtcacaataacaaagtcatagaatcaaccaaaatgtctatcaacagataactgcataaaatttttaattgcataaacatatgtgtgtacacagacacacacatacacacacatgcacacacacacacacacacacacacacacaaaacactacccagacataagagagaatgaaattatgtcttttacagcaacatggatggagctggaggccattatcctaagtgaaataattcagaaacagaaagtcaaatacagcatgttctcacaaatgggagtgaaacaatgggtatacatagatatatggagaggaagggaataatagacactggagactccaaaagggggcagtgggaaaggagggtgagcactgaaaaattacttactcgatatgatgatcactattcaggtaatgggtacactaaaagcccagacttcaccgctatgcagtataaccatgtaacacgactgcacttataccccctgaatttatagaattaaaaaaaaaaaaacttcccaatttgccattttatatgtatgcaaactagtcagtagtcacttaagcaatgggaaaggaagatggacagggagtatgaggttgagaaatctctgcgatacattttcatatgctcaaaaaatcaaataaattcagaaaagtaaataacacaggaagatagtggggaataaggtcaggacatggaatgattcatgggcagaagagatgttatgtgacttgttcatggcctcatggctactatggcagagccaataccagaattaatgtcttcaaaatcaggtttcaaagttttcagtttgtcatgctgaataaccaactaatttgaatcctgctcttctgatctaaggagttcttgactcatacaacgcatataatacaaaccatcagggaataagagtgttttctcataccactgctaaaggcaacagaggtaaatatttttttccagctttattgaggtatacttgacaaaattatacatatttacactatacaacatgttttaatatccatctaacatagtttttgtgtatgtactgagaacatttaagatatattctcttagcaaattttcaagcgtataattcatgattattaactatagtcaccatgccatacaacagatttctgggactgattcatcttaacgaaaactttgtagcctttggccaacatcttcccattcctcatcccctccatgcctatgaccctggtaaccaccatcctactctctgcttctaagagtttggcctttttagattctacatgtaagtgacatcatgtggtatctgtctttctgtgcttggcatatttcatttagcacaatgtctcccagcttgattaaatgacaagatttcttcagtttttaaggccgaataaaatcctactgcatatatgaaagaaatgctcaacatcgctaatcatcagggaaacgcaaataaaaccacctcacacctgaatggctattaccaacaagataaaagataagaatggctattatcaacaagataaaagataagcattggtgaggatgtgggggaaagggaacccttgcatattgttggtaggaatgtgcattaatatagccatttcagaaaacagtatgcaggttcctcaaaaaaagtaaaagtagaattactatatgattcagaaatcccactttaaggtatatatccaaaggaaatgaaatctgtatatagaagagatatctgcactccaatgttcattgcagctttattgacaatagccaagatatgaaatcaacctaaatgtccatcagtgaatgaataaaatggggtggatattctaaagtgactttgaatagctctgagatacacaggacttattttattaatatagtgactaaaagagcttagtaatacacttgagaatgtttcaatttacttctatttcaggtagaagactaaacatactagaacttcactcgctgtaggatccaaattgtacattattctataattgttgttctagtttattacttgattagggatatcaggcatccaaacaaaagtaactaattctgctttctagcataactttgcataggagaaatgaaaccaaattaagcacatttcagatttattcatttgttcacctatccctccaacattaattggacatacactgtgagtcagaaactgctagacagctgctgttgctaaagtgcataatatgtccatggccttaccctcaaaaggataacaatacagtagatgccactatgaactggaaaaatttaatttgcatctttgtgccacagttgctttatctggaaagtgaagagattggattaagtgagctccagtgtccttttaaactccaaattctactaaccaataaaacagaaatagccagaaataacagttagttttgtttcttaattaattatagataaaatatcacatgaattatgtaaaaactaaactaatttatctagtagcttttcttcaaaattcagctgaacataaaatttcagtttcactgacttaggaagtacagtttgcagcgaactcaatcccatcagcaccttgaaagataacctctactctcccatcactagatactcagcttttaatttatatgaaaaaaggcactgactattctggctaggttgtttgttttatttgtcctaaggattacaaaagcatcgactttggtgtgatgcacacatgcaggacacccctaccagcttcctgaacatcccctttttttcttcctgaaacaattctgattttgttcaaagcaacaattgttaaataaatgtacaatcttctaaaccttttctgaacctaaagatgactatgtgacactagtttaaaagataactaaccatttaaagaatgtaaaaacaatgtagtgtgggtttgtaacatatgtaaaagtacaatgtacaatgcataacaataactcaaatgatgggagggaagaactagaggtataatattgtaaggttcttaaatatacattaaatgttataatattacttgacttagcctctgatgagttaaaacaacataaaataacaagacatttatcagtaacagagcaacaaagaagaaaaactagaatcttaaagaacattcaacctaaaaaaagcagaagaggagaaacgggataacagaagagaaagaaaaaacatctaaatgacagatttaagcttaaccatatcaatattcatattaaaatataattgaaataacccagttaaaaggcagaggtgtgtcagaatggataataaagacacaattatatgttgcttcaagaaatatagtctaagtgtaaagaaacaaatagattaaaaaatgggaaaaatagaacatgctaatactagtcaaaagaaagctgggggctgggcacagtggctcatgcctataatcccagcactttgggaggccaaggtgggtggactgcttgagctcaggagttcaagaccagcctgggcaacacggcaaaaccccatctctacaaaaacaaaaataacaacaacaataacaacaaaaagaaagctgaggcagctaagataaagtagatttttaaagtaaagtatactaccagggataaagaaggtcatttcataatgataaaagatcagttaatgagaaggaaatcgtaatcccatctatctatacactgccatatcagatattcataaaacatgaggcaaaaaaagataaaacaaatacaaaactatagcaagatatttcaatacctaatagctatataatataatatttacaccaaagagctcaatgggacagaatagagagtccaggaataggcttacagatatatagataattgatttttcacaaagatgttaagtaaattcagtggagaaagcatttcaacagactgtgctagaacaacatgttcaaataaaaactttgatctatatgtagctctagatctgaaaattaactaaaaataaatcaaagactaaatgtaaaaatctaaaactatacagcttctagaagaaaacagaggagaattccaactttgggtttggtgaagatttcttagatacagcaccaagaacctgagccaaaaagaaaaaaatcataaattggacttaatcaaaattaaaaatttttgttctttgaaatatgattaagagaataacgagagctatctatgacaaacccacagccaatatcatattgaatgggcaaaaactggaagcattccctttgaaaactggcacaagacagggatgccctctctcaccactcctattcaacatagtgttggaagttctggccagggcaattaggcaggagaaagaaagaaagtgtatccaattaggaaaagaggaagtcaaattgtccctgtttgcagacgacatgattgtatatctagaaaaccccatcatctcagcccaaaatctccttaagctgataagcaacttcagcaaagtctcaggatacaaaatcaatgtgcaaaaataacaagcattcttatacaccaataacagacaaacagagagccaaatcatgagtgaactcccattcacaactgcttcaaagagaataaaatacttaggaatccagcttacaagggatgtgaaggacctcttcaaggagaactacaaaccactgctcaaggaaataaaagaagatacaaacaaatggaagaccattccatgctcgtggataggaagaatcaataccgtgaaaatggccataatgcccaaggtaatttatagattcaatgccatccccatcaagctaccaatgactttcttcacagaattggaaaaaactactttaaagttcatatggaaccaaaaaagagcctgcattgccaagacaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccctagaagaaaacctaggcaataccattcaggacacaggcgtgggcaaggacttcatgtctaaaacaccaaaagcaatggcaacaaaagccaaaattgacaaatgggatctaattaaactaaagagcttctgcacaacaaaagaaactaccatcagagtgaacaggcaacctacagaatgggagaaaattttcgcaacctactcatctgacgaagggctaatatccagaatctacaatgaactcaaacaaatttacaagaaaaaaacaaacaagcccatcaaaaagtgggcaaaggagatgaacagacacttctcaaaagaagacatttatgcagccaaaagacacatgaaaaaatgctcatcgtcactgaccatcagagaaattgaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgtggcactattcacaatagcaaagacttggaaccaacccaaatgtccaacaatgatagactggattaagaaaatgtggcacatatacaccatagaatactatgcagccataaaaaatgatgagttcatgtcctttatagggacatggatgaaattggaaatcatcattctcagtaaactatcgcaaggacaaaaaaccaaacaccacatgttctcattcatagatgggaattgaacaatgagaacacatggacacaggaaggggaacatcacactctggagactgttgtgaggtcgggggagcggggagggatagcattaggagatatacctaatgctaagtgacgagttaatgggtgcagcacaccagcatggcacatgtatacatatgtaactaacctgcacattgtgcatatgtaccctaaaacttaaagtataataataataaaaaaatttaaaaaagagaataacaggacaagccaaagactgagagaaaagtatttatatcacactctcataaagaaggtataaataatatgacctttccaaattcaaaaatgagaaaacaagcaacccagttaaaaactggggaaaatatttgaacagattcttcacaaaagaaaagctgcagatggcaaaaagatgctaaacatcattagtgtttttgctaagtgccaattaaaaccataatgaaataacaatatatacctattagaaggcattagtacagtgtacatgtctaacatttgttctacccgagacagaggaaaacctctattattctgaggaaatagtaaaatgtcaactacttttactataatcacctacaaaggacaccatagaggatgctgtgcataatatgatcagcccctgtaagtggtgataaggaaagaaatactttcctctacctctacagtgaagactcaggccaacttctcagagaatgaccaaggcagacacaccgagcaacaactttcaaagtcaggcatggaatgacaggtagaaacccataacacttcaaagcatgtgattaataagccagacctaattagaaagaatttgcatcttatgtgaattagccctggacctttccctgtctgcgctcctgcttcgtcactggtgtggtgactgagatatgattataaagtctcatgaagaattgctatctgaaaggatttaagccatatgtagccaatacatgtaactggaccacggaattaaaattttttctctaattatctagtttataagtagttatcatggaacttctaaaaaacttatgaagtaacagatgaggagtagattaaagatgttttattgaataattaactatactaatttttcacaaataattacaaaaaaattaataatcactttaggcctttccttaactctcacagacaaaatttatattggggatttaagaatgccagcattatatatctacatgtgaatgaagaaaacattagagaagctcctcgtgaaatcataatcacaggtatttttcttcaatttgaaagcaaaatttaatggctaattttattgaaacagcactaaatgactgactgatgctttacctagtgaattaatatcatatgctgcaagatggaatggaaattcttttgcatcctatgtatgtctaattcaactcttcatatataggagacttttatatttgtggtacaacttttcttaaaatcacagaaaagttatccttcctccttaaatcctttcagatagcaattcttcatgagactttatagttttatctatgctttccccatccccatggaagcagaggactcagcatccttctgtatatactgaagatgtggtattaaggccatgaactcaatctattaatggacaataggttccttctgtttgtagaaatgtttttatagcaaaatttctaaaatgaaagaaaagttattttggcaaaccctccaaaaatttttttgtactgaagatgaccctttatcaagttaaagagttacccaggagtatatactacccaatatttcactgtgaaagactcaatggaaaatgcattgcccacaaatagatgtcccttgggactgctatttagatttttatatggctatgttaggcaaaacttgcttttcaagtttttcaggacaaaattatcttcattatgataaactatatacttagggatgcttgactggtcagctgtttacctgctaggacataatcataattgtttcctgagaaaaaatccttgttctgcctccaggtattcccttagcacctggtggagggttggccatcaattcggatgaaaaatctccatatgccacctctatttccgtaaataggtatttgcatctgccatccacaaacaaaatttgcatgccaagtacttgccaaataatataaccttcaactgcccaatgtctacgaaatttgagctatcatttcacaaacctacaggttatgatatttttcttacaacaaagagtcactaggttctgaacctgtccgcacatttgtgtcaatgatgctatttataccagtgcttctcaactctgtatgcacattagcatccccttggaagtgtttaaaatactccctccttggcataccccaaaccaactaaaggaaatgcttggacctagaaactgaatctttttacaaccttctctgaccaggcatagtggctcatgcctgtaatccctacactttgggaggttgggatgggaggatcacttgagcccaggagttcaagaccagcctcgaaacattgtgagactccatctctatacaaaacaaaaaattggctgggcatagtggcatacaacagtagtcccagcaacttgggaggctgaggtgggaggatcgcttgagcctgggaaattgaggctgcagtaagccatgctctccggcctgggcaacagagtgagaccgtcaaaaacaaaacataacaaaaacaaacaaaaaaccctcttcaggcagctctttttctaacaactgtcagaaagaatgttttcatagcaacatttctaaaattaaaaaatcattttggtaaaatacccaaaatgtactttgtactcaagaataccattcaacaaactaaatagttaccaggaatatattacacagtaattcattcacaaataaaagtgcactggcagccagatagtaccctaagaagattcaaacattttataaaatgatataaactgtatgtctaaaatgactatgtataaaaatactttagcttaaataatatttgatttctgaaaaatctctgcaatgactgaacctgcaatttcttcaaatggttttcactgtaagaataaaaataagaaattttatcttctattgcactgggttacttttgaacagagtattcagacatacacacttactggaatacattctaaagacaaatcaaatggcaaaaaaaatgtttatctttactatgtaagtttgttggtggtggcactgacacggtatttttgaaattatttacgcaaaatgagtaaatatattgatgtcgttgagaagcagtaaactcatgttttaaaaaaaaatgtgtatttcttgggctgggaacagtggctcatgccaggaatccaagcaatctggggggctgaggtgggaggatttcttgagttcaggagtttgagaccactcttggcaacatagtaaatccttgttctaccaaaaaatctaaaaatttgcccagcacggtggcatacacctatggcctcagatactctggaagctgaggtaggaagatctcttgagcctagcaggtggaggctgcagtgagccacgattgtgccaccgtactccagcctgggtgatagagtgagaccctgtcttaaaaaaaaaaaaaaaaaaaaaaagtatatttctcaactaagaagtgttgatacatatgtagaatgttagtttctaaattccatcatcactaaaaacaaccagtgctaataacaggcctggggcagggagagtacaagttgagcctctaaaatttcatgtcccagaaagcaaagaccaataggtacatgatttaaaagaaaaaaaaaacatattggtgctgtgggggaaatttttaaaaaaggaaaaggaagatagtaaaggaacacacatacgcaaatgcatacacacaactttgacacaatctgatcatgaaaaaataacagacacagactataacacacaaattttttttaaatctatgaatctttagctaaaacactgagtgaaaggtggttagagaaactctaatagtaacaccccacagcttattaaaatcaaaacagaaaatgatatctttacgatggagagaactggcagatgccaccttaaccaagtgataatacttaattaaaatccccaatattagaaaaaactgtcactctgtaacttttgataagatgcaacgggaagcacaaaacattatgtaggtggatgcttggcaaagatgtttacctaaaaccagtcatgaaaaaaatagtcttatttttttcttattctggatttttctaatccagaataaagaacattttataagactaatttggatgcttaaaaatgtcattataataaaagtaaaaaaaaaaggtggtgggagcatctaaaataaaggagactgaagagctacaacagcccagtgcaatgtatgatcctggattctatcctagactgggggagaataccagcttttattgacatgttgggataattagggaactctgaatattgactgcatagcacatatttctgaatcaatattaaatttcttaggtgtaatgaagaaattgaagtgatgtaaggaaatgttcaattctttttcttttcttttctcttcttttccttttttttttttgaaatggagtctaattctgtcacccaggctgaagcacagtggcacgatctcggctcactgcaacctccccctccagggttcaagcgattctcctgcctcagcctcccaagtaggtgggattacaggtgtgcaccaccacacccagataatttttgtatttttaatagagatgaggtttcaccatgttggccaggctggtctcaaactcctgacctcaggtgatctgcctgcctcggcctcccaaagtgttgggattacaagcatgagctactgcacctggacagaaatgttaatttcttaaacagtatatgctgaggcatttcataaaatatttaaaagccttttttattataaatgtttataataaacactatagacgttttacgttttagaataatttaagacttacagaaaagttgcaaagatagtatagagactttctgtacactcagtttccctcagaatgaatagtatacattaccatggtacatttgttataaccaagaaacttacattggcacattactattaactgaattccagattttatttggatttcacaagtttgttcatcaatgccttctttctgttccaaggtccaatccagggcagcatattgcatttcgttgtcatgtctccttagtctcctctgatttgtgacagtttctcacttttcttttttatgaccttgacagtctggaagagtactggccaattatcctgtataatgtcaccaatccatgtttgtctgatgattagcctgggttttggggcaagaataccacaggggcaaagtgtcccttctcaaatcataatagagagcataggatatccacatgacatcagtggtagtggtcatcttcatcacttggttatcaagagagtattggcagcatatgtttcccccttaggttactgaggtctgtttcttttctcatcacccctttcagtggagctatgtcatacctgtagagtacaactaatttcatctgtctcagtctctatcctatgttggcacccttttgatgctgctggttgatgtgttcattagggaagtgtgtgtgtgttcatgttagtgtgcatacattaatgtacattctttgtaacataaagttctatacctcttggcaaatacatacaagtatgcatctgatatggttaggctttgtgtccccacccaaatcttatcttgaattgtaattcccataatctccataatttccacaagtcaagggagagaccaggtggaggtaactggatcaccgggatggtttccctgatctgttcttgtgatagtcagtgggtctcaggagatctgatttttttttttttttttgagatggagtcttgctctgttgcccagtggcgcgatctcggctcatgaaacctctgcctcccgggttcaagtgattctcctgccttagcctcctgagtagctggggttacaggtgcccaccaccacgcctggataattttttgtatttttagtagagataaggtttcaccatgttggctagtctggtcttgaactcctgacctcaggtgatccccctgcctcggcctcccataatgctgggattataggcatgagccaccatacctggcctgatctggtggttttataagcttctggcatttcccctgcttgcacttattctctctcctgccaccctgtgaagaagtgccttccaccatgactgtaagtttcctgaggcttccctagccatgcagaactgagtcaattaaacctcttttcttcataaaatacctagccttaggtatttcttcacagcagcgtgagaatgggctaatactgcgtataacacacagtaccacacagaacagttccttcactctaaaagtcccctgtgtacccctttctggctgacaacccacctcagctcaattcttggcaaactcgcaactgttgtctacccctataattttctagaatgaatggaataataaaatatgtcatcttttgggtttgacttcttccatttgcatttacattcgtctatgccactgcattaattaatagcttgtttctattattgaatagtattccattgtatggatgtgccacggttttattcacttgctgactaaagaacatcttggttgcttccaagttttagtgattaagaataaagctgtttaaacattcacacacagatttttgtgttgacacaaccttcataaaccctttggtaaatatctaggagtacaatttttggattgtatagtaagtctatgtttaactttatacaaaaaactggtaagttgtcttccaaagtgactacaattttgcactgccaccagcaatgagtaagagtttctgttctgcattctcacaagcactgtcagtttttctgcattttcgccattttagtaggtgtacagtggtatcttgctgtggtataaacctattttaagtgctctgttgttcattttcaaatttaaatgctacccgaatttttaattaaaaaaacttcatgttgaaaccaagctccccagatatactattcataaaactttatctacagatgtcagatcatgtaaggttttttcttttaacttaatagaagttatttgttctaattagaaaagtagatatatatatgtgtatatatatacacatatatatacacaaaagtatatatatttatgtatatacttttgtatatacttaatatgtgtatatatacacacatacattatgtataccaacaatatacattattggtaatgtgtgcacatatatatatacccacacacacatatataaaaccagtagctctaccatccagagacgaacaccaattttttccaattgtgtgtgtgcacatgtgtgttcagattaaaacacatgtaacaacctaaagtctaaagcaggtatgagtgtacaatgtttgaggaaaagaaagaaagcacggtgtaaggaaagaatgacagtaggcaaggaggttataacagaagatgaatttggagacagaagtcagttcatgtagatcagggattctccaactttggtgtgtcttaaaatctttaggagggcttattaaaacagaaggtagccctgcacccctggggtttctgactcagcagatctagagtggggtctgagaatttgcatatctaatgtgcagggccacacctgagaacacctgtcgggcctgctacactataatgaggagtctgatttttattccaaataaattggaagacattggaatattttaaggacagaatgttgtgatttgttttgaattttaaatagatcatagtgactgaggtatgaaggtcaaatcagagagaacaaggtggtaaatgggaaaatagtaaacagactctttatgtgaaatgatggtgctttgaattagggtagtggggatattaataaatggatggattcagaacaaatacagaaaaagctcacagaagttgcaaatggatctggtgctagggtgagaaaaggggaaacaagggagatgtctaggtcacaggcttatttaataactgcctctatggaaggctttatggggatacaagtcataagttctattacaaaaatatgtggtttgagatatcaatatacaattggaaatactgagtacggaagttggatacacaaatctgaatctacaagaaaaatagtaacaatttgtaagtcattagatacaaatgatatttataatcttccaacctattgaggtcattagtatagattaatggctctcaggcagggttgattttgcactaccctccaggagacatttagcaatgtctggagacattttttatttgactagaggttagggatgttgttaaatatcataaaatatacaaaaaagcacctgccaacaaagaattaccctgctcaaaacatcaatagtgctaaggttgggaaaccctgtaatagatagaaaagttgtctttctagtatgaagagagtaagggagcataagcggtttctcagatataaaattgcatcgaatatatatatatatatatatatatatatatgtcacttatgtatccaatttagaaactgcttaactatattatttgaccagctgataaacaaattaaaaatagctcaagaattacttatagcattagacttaaaatggctgctgttaaacagtgagatatagttacaataagaaaagtaacattaattttacccttaaaattaatataataatagtttaaatgaaaaaccctgattaataaaaagaccatatgttgtctccaaagctcttgtattagattatgctacctgcacacctttgttcaatgaaaacaaatgcacaaatacgtaagcacatgactgaatgagcagtaacacagctctcttaggtattaacaaatacacatatcaataaaatggaagaggaaatctggattatgaatgcagagtcaaaatctctggagtgtagatacagacttacaaatccctagaaatagaaaaattccaagagtataaaggaggtagaagaaaagggtctgaaactaatagaaatcctgacttcagttttttaaaaaatttctagtatacagaatgatcctagcatctttttgcatctagcactgtacaagcagtccattaataccagacagaaattttcaagtaagatttctgaaggttttatttgctggaaaatatctctgaatacagtcttcaggtctaggtaagataggttcacattacagagggcgggtgttggtggcttatgcttgtaatcccagcattttgggaggctgaagcgagtggatcacttgaggtcaggagttcaagacaagcctggccaagatggtgaaaccccatctctactaaaaatacaaaatttagccaggcaaggtggtatgtgcctgtggtcccagctacttgggagtctgaggcacaagaatcgctcgaatctaggaggtgggttgcaatgagccgaggttgtgccactgcactccagcctgggcaacagagcaagattctgtctcaaaaaaaaaaaaaaacccattaaaaaattcacattacagaagacatcttcatatagactactcaattagaacacctacttcatttataagtctgaagatgacctttcacacagatttacctaatgttaatgcttttactgacagcacaagctgagtatagtaagggtatactgggattagaaggtaaacatatatatattctaggtatgaagaggtgactataggaaaagaataatgttaaaaggtgtgagaaaaagggcttttcatggggaaagtggaaaagataagagagacagatgcacttcggagatattctgtgattaatcacaatgaacatgaagagcagatgatttcaaatataaagatgatcctttgaacccagggacaaaaatatgttacatgagaattacccttcaccaagagcaagttggccagcaccattcacattcaatggccagtggagcacatgtgtgagaatgactgagttggtgacaaggaatttgtatttaccccttacacaaccaaatcctatcacaatactttctgtgttatagacaattagatttaataaattagaggtgtatactgggcttgtgggaaataacaaattattttatgtaatttatgaacataaagttcacatatggcatactgatctaccttaatcatgaatccaaagaagttaaaactgttctaccctggacacacaggctgaccacaactcacccttcccagttctttatcttccagggccagaactccagtgctttctgtgaagagtttcactttgaccacaggccgaggatgggtggtggtgaaatctccttgagtcccccatctgtaatgaagtaaaaaaaatgtttcttaaaatgcagcattatttttttccccaaggagatgtgtctccatagaaggcaaattaaatacagaatcttctgtgctcaatgagctttttatctttgcttttgtttctagcagatggcacaatcaagaaggaaaagaacaataagctttacagcttgtaatagttactcagctattcaaaaaattagcatgttggactataaaaaattgcatgttatgagaatttaggttaaggtaaagcaatatagttgtagctattgaaatctattactttattaattcaaatgtaaattatagcaccatttttactggcagctgggaaaattgctcagggtttgtttacgtaagagagagtttctcagaaaatgatttttatatactaaagactttaccccacctgagaggtctttattaaacattatctttttttaaagtaagcataattatctcagatctattacttcatatgacttttgaagctcctgccaaaaagaaagaaatatgcatcataagaatctgaatgttttgtagttaatttcccactacattctcttaggaagggaataagtctgtagacatctggcttttgaaatcatcacaacaaaataacatgctttcttggcttatctcttaattaatagcatcttgcctttattgcagaccagttcattctacctgatttacaaacttaactggcacacacctgatattaaaaaatcttatcaatatttctcacaactctgagagatcagatgcaatgagactcagcacagcatgaagaagatgccattgagcaaaataccagagaaaaaaatgagatttaacaaaatacagatcatgttaaaaataaaacaacaaataaatatcaattttcttatgctgtcttgaaaaaacaaaacaattcaccattttcacggagctgtctacattttattttataaatctcattcggagagcttacaacatacagaaaactcagtaaagcaggtataataaaaattgaacaaataattgtgattgccttcctctcctatcacagcatttataataaatgtatacagtaaagcagagaccatttcaatgactgaagaaactggcatctagatgcagtctttttttttgaaatatcataagccagagggaagagaagaatcaattagggaagaaaacagcttaatttctattttagacttccagaatggggttagcaaagagactttttgcaatttcatataattaagatggtttacataaagcaatggtaaaataggaataaaaacaaaaatagattcagaaccaaaataaggcataaagaaaaattctcagtttagtgtttggaatcttaagccttgaatatagtcaggcaatgtggttaacagcctgggagctaattctcatgacatacccttttaaattcagtgtcacatggttaaatttagaagactaataaccttgggaggcattctcttataactgaaataaaagatttttgatagtcatatagaaacagtctaataggtttccatagaatttgctttttaaaatcctccccataaaacttccatgtattacactgatttttttcctctaatttcaaaatcctttgaaactatttacactacatgttcatttttaattcccaaacctcctgcaatacatgattcttcaaagagaaaagtgaactttgtctttgaacctggtccttctgaaatgcatcccaattccactttgctggatagaataagacaaataacaatgaatgcggaggaaaaaaaaaaactgctcactcatggttccatgaacttccagagaactatcttttacctttgatccttcacagacaagtatattcaaaaactattctacaatatttatcaccatagcacatttctcatttatgcattaaaatatttttatacaatgatatattttaagtgtccataaaatgagattcagttaaagaataatgataaagtgaaaaccaacattcctgccattcaggttaagatggggaatgtactagaacattaggaaagcccttgtgtgcccctggtctcatcttcctctcctctccaccgtcactactctgaagtacctagcatcctgaattttatatttatcactcccttgaatttcttcttaaaaggaatattttcagcattttacctttaagtgtgataactgctctaggttttcagtagtcttttataggtaaaaaaaattcccatatttattagacacacacataaatatatcagaatatatgtgtgtgtatatatatgtaatatatgcatatgatatatacataatatataaaaaatatatatcacaattatatatgaaggagatattgtacgtgtgtatatacgtatatacatatgtccttcatatcatatacctcacaatagcatatataacagacatcctaacacacatacatcatgtacataacaatatcatatacataacatacatatcatatacatcacatcatatacatatgcatatgtatattcatatcatatacatcacatcatatacatatgtatataacatatgtgtatatatacatacactcacacacatataaagatccagaaatgagtgctctagtttatgaaacatttccctacatttattgaaataatctgtaattatagtagattactctattgtcttcctttcttgagataaactttaaaaaaaatactagaatgagtaggctaatactttatttagccttttatataatgtccattattgagactagcctgtatatttacttttttgtattctccatgtttggttttattgcataagttgaaaagtgctatatttttattatctgaaagagtttgtcaaaaaatgataattatctgttcctataactcacctattaagctattcaaacctgatatttctgtatgggaagatacttgctaatgaagtgatttctttattggttgtagctacagaattactcaggttttctctttctccttgagtgaattttgataagcactaagttttatgttatttatttcatctaagtttttcaaaagtacttatacaaagttgtaaattttttcatctttgaatccttatagcatctgttatgtccttcttcattcttaatgttttcttttttccatttttaaacttaacagaggttcatcacttttattgttcttttcaaactcctgtcacttgactttgacaatcctctctacttcatgttttttattttattgcattctgctctttgctacattattctaatttatctattttaaccctgctgtttaaaattttaagttgaatgcatggtcattaattttaagcctttcttccattccgggcaagcatttgtgactataaatttgctttaaacactttaactacagcaccccataaatttagaaagtgctatttttactatcattcagctgtttacaggtgtgatttagaatttctctctatatatatcttttcctttttcttattaagttctatttttattacatcagattagatagcatagcctgcataatattgatcatgtaaaataattgaaatgggctttaatttccagattttgtgtgtctaagttttccatgagtgctcacaaagaaaaaaaaattctccattatgggtacattattgtatttatggccggaggttctacttacaaggtttaggacttctgagtcaaggggaggaaatgctaacgaacacctcctgtgaaatgaagaaggcttaaataacgtgttctcaggcaaaggagaagctgaggcacaaaaataccagcagatcctgactgcagcaggccagaagacaaagcttttactgacattcaacaaaaatgtacaattttaagggggtgcataaatagttatttataaatatttatccttgtatcctggaaagttgggatttatcatttctttataagaaacaataaataagaaactttcttataaagaaaatataaatcccaacattccacgatacaggcataaattggcaccaatttgataatttcttctttgggaaataaaagttgaaaagacacagttagaaaaatcataaattctagaatgaataaattaaaaacacaagcctccccaaaccccactcaacaaaggaaaaaaaaaaaaaaaaggcaggaaaagaggaaagaagacaataggcctaccttcaatattcaccaagacatctccttattttctacttaattggcatatttaaaccctgtcggtaattaataccagttattgtcttcccattttctcaatattttatgacaaaagaatacattatcttgctgtcattttgtgttgactcaaaacgtattgcctttctccacttctctgaatgtattatttatgaggattcagaattccaaggtaaatgttcgaatgaataaaaatctacaaagcacctttacgagaacagcaggacttcctggctttgaaaacacagggtaattcatataccaactgaaataactgacattaattatgtatttgctattaaataaagggtactggaaatttgtatcaggagccaaaatacatgttcatatcttttaacctagtaaggttatttctaaggacttatcctatcaaaataattgtaagtattaaaaagagtctaagcagaaacattcatgacagcattatgtataacagtaaacacttaagcaagataaatataaaatattaggggaatgattatgtaaattatggggcatgtgatgaactattttgctactttataatgatggctataatggcaacataaaaccatgcatgatataaagtgaaaaagagggaggatacaaaactgaacgtgcacattttattcatttaaaaaaatggagtaccttttatgtggagatgacattctagtgtgagcaaccgaagtccctatccccttgggatttctattctaataggagattttagataataaataattatactgtaacatatattccttctcactcctgccctgccttctcaacaggttgtatatttccatggtctcttacagtagctagagcactagatataacttgtgcccacttttgacctgtctgaaagtcgatagtgatatgaaatgacagttttaattttccacatgtcctaaactcatttgggtaagaaatcaaatatatttataaaattatataaacttgggtttggttttgagctttatgttctgcagatctctcctgagccgagttaccctgttttaattattgcagctttgcaagatgttatgttatctgttagaacacaaagaaaacagacattttcatcttatttctattcaacaaaaagggaagggaggtggtgtctctgttaaactctgttctaacatttattactggaatcttaaacttttttcttcattatgtagaaaaaaacacacattccttaatttatttcacagtatttaatatatcgggatcctaaagaatctatttcctttatattgtctgactgttgcacatatgtaagaaagttatggttaaactctaatcatttttcaaatgatttcatttccaatacagtgagtgcttttaaaaattatttgtcaccaaataaccaattaactctattaaaaagattattaaaattatcaaataaaaatgacatatattccaaatgcatcactaattttataacagaaaacattaaataaggatccagcaacagggatataaatgaaagcctataaaaaattacaaataattcttatgatttttcatgctgaattttttttttttacttttttatttttagttctggggtacacgtgcaggttgtgcagatttgttacataggtaatgtatgccacagtggtttgctgcgcctatcaacacatcacctaggtattaagcccagcatgcattagctatttttcctaatacttttcctcctcccatcccaccccatgacaggccccagtgtgtgttgttcccctccctacgtccatgtgatctcactgctcagctcccacatataagtgagaacatgtggtgtttggttttctgttcttgaattagtttgctgaggataatggcttccagcttcatccatgtccctgcaaaggacatgatctcattcctttttatggctgtatggtattccatggtgtatatataccacattttctttatccagtctatcattgatgagcatttgggttgattccctatctttgctgttgtgaacagtgctgcaatgaacatatgcatgcatgtatctttgcaacagaatgatttatattcctttggtatatacccagtaatgggattgctgtgtcaattccatgtctttgctattgtgaatagtgctgcaatgaatatatgtgtgcatgtatctttgtaacagaataatttatattcctttgggtatataaccagtaatggatttctggttctaggtctttgaggaatcgccacatcatcttccacaatggttgaactaatttacattcccaccaacagtgtaaaagtgttcctatttctctgcaaccttgctaacatctgttgtttcttgactttttaataatcaccattctgactggcatgagatggtatctcactgtggttttgacttgtatttctctaatgatcagtgatgctgagcttttctcatgtttgttggctgcatgaatgtcttcttttgaacagtatctgtttatgtcctttgcccacttttaaattttttttctcgtaaatttttttcttgtaaatttgagttccttgtagattctggatattagaccttgctcgaatggatggattgcaacgattttctcccactctgtaggctgtctgttcactctgatgatagtttcttttgctgtgcagaagctctttagtttaattagatgccatttgtcaatttttacttctgttgcaatggcttttgtcaattttatcatgaaatctttgcctaaatggtattgcctacattttcttctagggtttatatacttttgggttttacatttaaatctttaatccatcttgagttaattgttaataaggtgtgaagaaggggtccagtttcaattttctgcatatggctaaccagtttccccagtatcatttattaaataggtaatcctttccccattgcttgttgtcaggtttgtcacgatgaaatttttaaaacaatccaactctagttaaattatccttcttaaaatttagccattttaagattaaaatgatataacagattcttctaataatagaataaaagttttggttcaaaactcaaacattcagtatttatttggtagcattgattctgatattctcttgggaagtagaaaatctttccaaaagtttcctgcactggactttaactaggtctaaggtctttctgctgtcctatgagagatttgctgaagaaactgactttggattcactcaattcatgaaaatgagtaaggactgtgttattttcattgactcatatttggtgagaaggtagatgggcacctcccccaaactcattatgatgaatcaagaggaaataaagattcttgaaaataggatagtgagttgatcagaaaggcctgatggtattctcaagggtgtcaagcaatatcatttttaaccgcatgccttcttgagaactgggagccaggaaacttgcctgactgaaagcatacaatgtgtctctgctcttgcagctatgtttatgccaatgagctgtagtatcctttagtttcattaaagaaatctgtatgtgttggtgtctttctattagtcattgccctgcacataatggccacatatactccaaagccatgctgaagtcactgggaaaatgtgtatgtttaatagatgtgtaaaatgtaccaagtagacacaatatcccacctttactaataaacagtattatctccttttaattgaataatgtaacaacctctgaaaattgggaattaagtttaacaagagagaaatacaaaaagcctgattatcaattatataaatggaaattaaataataaaacactaaaagacttataaaacaatgttaagcactgtacaaatgtttttaaaaatagctttcttcattaatataagcaattaaggcagtcttgtggaaaactctaagcagaaaacaatacttacggaagagcagcttttaatattttaaaagttcaacacagggcccaagtatataaaaggcttatataacactaatgtacttcagccaaagactcagtgaaaaatgacgaagataagtaagttttcatgggaacatgggtggctgctgacacgtcgtttactatgatccaaactataagagataaagaaacttatcttgggaaattcaagtgcttgattccaataggctgttgcaaatccagatacagatttgggagtgattaacatagaaactgttgtataaactatgaaaatgaatgagcttatgaagggtgcccactaataatgatagtagggacttctaccttacaagtatgggcttatacatgtatctctatgcttatgtgtgtacttaaacgtatattttaaaggtttgcaatcatttattgaggtatagtttacatgcagtaaaatgtaatcatctcaagtatagagcactgaattttgaaaaatgcatgcaatcacgtatacagaacttatccgtcaccaaaacatttccttatttaagatgtttgcactatgcaaaatgaccagtggttcaacgtgaattccatcaaaatcctaacatttgcagaaatatgaaaatctaccctaaaattcataaggaatctctagggactcaaagtagccaaaacaatcttaaagaaaaacaaacaaacaaacaaaaaaacaaagtggaatgcatcacatgtcccgatttcaaaacctactaaaaaataatggcaatcaaaatagtgtggtcctggcaaaaagacagatatacaaaccaatggactggaacagagagcccagaaaccaaccctcacacatatggtcaaatgtaatgcatatttattagtcatttaaaaattaatgggatatccaaattgttctataacatgttcttttatgtaacactatatcttgaacttcttcaagtgtcagaacatggatttatgtaattcttttcaagacttaagacattccccttgtatggctgcgctataatttagtcaatcactcttctaatgatggactgtaaggttgtttccagtcttaaccattacaggcagtgctgcaacagacaccttcatatatattcatatataaatgatgaaaagaataaaagatcagagacagatttctaaggcagcccaatactttaaacttctcttaaacataaaaatgtcatcctaacagattgattcataaaaaaatttacctatctagtaaataaaatttacaacaaatagctccaatataatcctaagtcaaaaattttaaataattcactgcaatacaaaattcaaatttactagctagaatttcaaaattttattataaacaaatactatttcccttaattttaatagttaatttatacagcaagttttaaactccttttatttactgaatgtattttaaaacaaattttctatacatctaattaaattagtttaaattgggtgatcaataatgtttatagaaactgcctaacttatcaccatcattgttgttgacatactataaaagtatctgaaattccaaattgtccctgtttgcagatgacatgattgtatatttagaaaaccccatcatcacagcccaaaatctccttaagctgataagcaacttcagcaaactctcaggatacaaaatcaatgtacaaaaatcacaagcattcctatacaccaataacagacaaacagagagccaaatcatgaatgaactcccactcacaattgcttcaaagcgaataaaatacttaggaatccaacttataaggaatgtgaaggaactcttcaaagagaacttcaaaccactgctcagtgaaataaaagaggacacaaacaaatggaagaacattccatgctcatggttaggaagaatcaatatcgtgaaaatggccataatgcccaaggtaatttatagattcaatgtcatccccatcaagctaccaatgactttcttcacagaattggaaaaaactactttaaagttcatattgaaccaaaaaagagcctgcattgccaagacaatcctaggccaaaagaacaaagctggaggcatcatgctacctgatttcaaactacactacaaggctacagtaaccaaaacagcatggtgctggtaccaaaacagagatatagaccaatggaacagaacagaaccctcagaaataataccacacatctacaaccatgtgatctttgacaaacctgacaaaaacaagaaatggggaaaggattccctatttaataaatggtgctgggaaaactggctagccacatgtagaaagctgaaactacattccttccttacaccttatacaaaaattaactcaagatggatcaaagactcaaatgtcagacctaaaaccataaaaaccctagaagaaaacctaggaaataccattcaggacataggcatggacaaggacttcatgtctaaaacaacaaaagcaatggcaacaaaagacaaaattgacaaatgggatctaattaaactaaagagcttctgcacagcaaaagaaactaccatcagagtgaacaggcaacctacagaatgggagaaaatttttgcaatctactcatctgataaagggctaatatccagaatctacaaagaactcaaacaaatttacaagaaaaaaacaaacaaccccatcacaaagtgggcgaaggagatgaacagacacttctcaaaacaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaatgcttttacactgttggtgggactgtaaactagttcaaccattgtggaagacagtgtggcaattcctcagggatctagaactagaaataccatttgacccagccatcccattactgggtatatacccacaggattataaatcatgctgctataaagacacatgcacacgtatgtttattgtggcacaattcacaatagcaaagacttggaaccaacccaaatgtccatcaatgatagactggattaagaaaatgtggcaatatacaccatggaatactatgcagccataaaaaaggatgagttcatgtcctttatggggacatggatgaaggtggaaaccatcattctgagcaaactatcacaaggacagaaaaccaaacaccgcatgttctcactcataggtgggaattgaacaataagaatacatggacacagggtggggaacatcacacactggggccttccagggggatggggggaggggggaggaatagcattaggagatatacctaatgtaaatgatgagttatcgggtgcagcacaccaacatggcacatgtatacatatgtaacaaacctgcacgttgtacacgtgtaccctagaacttgaagtaaaatgaataaataaataaataaataaataaataaatgtatttgaaattccaacttgagatatctaaattgaattacacagagtttaataatatactgcatgcaatacagtgaggacaatgaatagaatggctttctaggccatgaggataacattcatcccacaaatcacactgtcatttaagacatcaaactatactactctatattttcaacaaaacaaaaaaaattctgcatggcaatatataaaagataacaatctaagtgaaattagtgatacaaatactacaaatttattctacatagtttcacataaacattgtggaaaaaagaccgattaaataacaaaaggaaataaaaaagagccattacctgagccctcgcccacagccgagtacaatggtacagaaatagggctaccaagtacagacccaagagacagattctgggcttggaaaccaccaataagtgaaaagacccggggcgagcaactttaccacaacctaataacatgttcctcataatacatttgaggcatcaatgaaaatgattcatgttaataaatgtaagagcacagcacatctcatagaaagtgcacagagaatgttcgttattcttactagcatccatattagtactgctttagctttactaaataatatctacctgaaaaaattgacagttttgaatattaaagttttcatctgtttcataaaatggtgacactaaaatccagacaatatgaaaaaaaagagagagagcaatagagacgtcaactaacagcaaaacatggcaaaggagaaagagagaggaagaaaaagaagccatgtgagaatctgaggagaggaagagaaagggagagaagggggagaagaaatgagatgattaatgaaaggtcaacttacaataggcaaagtgttacaaactgagatttacttttaatcttaatgtatttttgtatatcatcttttaaccttcctttaaaacataatttacagtctataatactgaaatgacacaaattttaatagaagaactagacaataccttttaaagtaactatgttttatcattctaggcttttgggaggatcttttaaaaacactgaataaaattttttattatgatggaaagataacacaaagttatttgtttcttcaaacatgacaagaactgggtgtagcagcacacatctgtaatcctagctattcaggaggctgagataggaggattgcttgaggtcagatgatcaagaccagcttgggcaaaatagtgagacccagtctcaaaaaggggaaaaaaaaattacaagaagagacaaaatcctgagatgacatcttgcactttaaggcagaaaaatattgggaaatgggttggggtgggtaatgactttcataataagaaaaatcctgcaagctttatctgccttctcttccttattgtctcatagaagtttccctttcccttcaaagagctagttctcatttggttgctctaaggattacaaaggcctccagaataataggataaaattgtcctttaaagtctgtatttcttttgtgaagtattcatgccattaaaccaccacatccagagtagaaaaatcatattacacttgtatcactttcttctgggaaagtctagcaagcctgttagcacaaaatcaggtttcagaaataacagaagagataatctctcacaagcattttcctttctctccctcatagcagcacagttcaaagacattagcttgaagcacctaattttaaagagaacaaattggtcacatcttggcttacaattttacttgaccaagtaaaattgtaatccaagatgtgacaaacaaataatgtacaaaaaagcacagtgctttataagatgaaaaccaagatttttaaaaacttacatataggaaagaataagtaattgatgtataacttaatttaacttcaaagcataaaacatgcacaaatcccccagatgtctaaataataaaatgcaatggtgtggaaatgagcacaactatactgtatacaccaataatcagtcatctacagaaatttaccaatatgttatgttcatattgctcccaaaccctcaactttgatgcctatgtgagaatctcaacctacttgctcccattttgtgggactaaagagttagatgtgttatatgaaccaaaaaaaaaaaaatcctttcaaatgtaacataattaatatattaccttttaaagataaaaagtactagagaaatttaaaatatagggttgcaaactatgaggttataattatcactaggtaatcagttcagcatatgaaaagtaagagtgcccatcaataactagtactttctttacaagatatcttcccctaattgatgtctaattcgatggaactttaagtgggggttatgttctttggggccagtcatttggggttataaaaatgttttgctttacattttcttaatttgaagatcttggaattgcaaagtactataatgtcagtacatactattcttaattgcttacatttaaaagcaaatattcctcagctgtttccagctactccaaaggtaagagagtcttaattctgtatcagagcagtaacgtggaggactttacagggggaatgccaggatggaccatctatatgggtttattgcatttcccctaggaatgctccttttgggctccccctgcagataaaacaactttttttctttcctaaatgacagtttctttagttgaaataaagagaatttccaactacacagaagtagaatgggagcaatagggaaagtctctgcattacacaaacatcccagatgccagagagggtaggatcacctgagactttttctgagagttgaaaagagccaaaaacaccaggcattcaacaaaagcatgatgcatagagcagaggcaagtggatactcaagtgcaatgtgagggctcaaaaccagccccaggaatatccagaggaatactagcactgcggtccactgtacagaagtgacatgtcacaagcagcctcaggagtctggtcaagcagtgaaacctggtaatcttcacaggccagacagtcactgccagttatcctgctgctgctggttcctgtgagcactacccacatgttactcagggaagggagccccacctgctgtggatttcccatggccacagtaacaactaaatgttgagataccttggaacaaaaatgctatacacacaggcttttaagctcaagaacatttaagctcattttgttagaaaacatttgatcctcataacaggagctccatcaagaatttaaaggggtggaaatcactgctatgatctatgtttctccaacatttacctacctggcacttaatggaacatttaaataatgacactttgtgttaattcttgtcctcatttgtccagaatctgaaaggatatttaataagcacctattatgtgccatttatgggaatgaatgatgaaaacacaaagatgaaggcaaacagactctggccttcgtgactcgggcttgtgttaaaaggaaaagcgtgaaatgtaaacaaatactatagcagtgagaaaagcttcacgatgaccttcattttaagacagaagtcattacctatgtatgtttatgatttccctcagcaatcatagctacatccccactgtaaacaacattgtgctctggacataaaaggcacacattacatattcaagacagaagacaatgatgtgcagaaataacacagactttcgaatctaagaggactgggtttgaatcctggtttccctactgaagagctgggttagtctaggttcctttatagcaacacaaaacccactgtgtgttgctataaagaaatacctgagactgtgtaatttatagagaaaaaaatttatctgggtcatgattgagctggctggaagactgggtgtccagtgagggcatcaggctgcttccacacctggtggaaggcaaaggggagctggcatgtgcagagattacctggggagagaggacacaagagggtgggagagtgaatgccaggctcattttaacaaccagctcttgcagcaaataaaagagcaagaactcactcaagccattcatgagggatctgccactatgagcaaacacctctcatttggccccacctccaacactggagattacattactacatgaggcttggggggtcaaatatccaaactatcatcatacgtcagttaaactttttgagtatctgttttcttttctaaaaatagaaacactaataagtcctgcctcacataattactcggaaaaagaaatcagtaagtaaaataactatcattatatctggcaaatcagaaggcttagtaaataaatgcttgttcttaatttacctgagcactgctgctatggtctgaatgtatgtgtccccctacagtgtacatgttgaaatcccaactccccaaggatggtggtattagcaggtgggacctctgcaagatgattaggtcatcattgtgtgtatgccctgtgtcagtagagaataattatagaatactccacacgaataaaacaccacatgactgcttaagtagaaaccatagttttgtctctgaaatgaatctcttatcatttttttattctctaaaaattcttccctgaaataaaaagtaaaatacaaagtccatttgtacgtattttaaaatcaaatgctgcttagaggttagaaaagagtttaccttcaatttcccctgtaataactcacaaacattaagctaaccaatcaagtaacgtatctgatatgctttgggagaataaaaaatgtaactgtggatttttgttccaatttactcaggtataaatctattaagcatatctttcaatgagagcatacagaacttttggcaaaggcagacttggcatctttttaacattttttttttttgaaacaagaataacacaaacatgggacattattctaataaaatattatctgggtcctttgaccacaaaaatcatatatgtttacaaaacagatgacattttgttgcctagttaggtatttagttattttagaactaccatttcttttttcttagattccttacataaatatattttctagcaattgttttgtgagtccttatttccataggcaaaagtcagaagtaagcaatgtgagtggaaaatttttaattgaaaagaagcacagttgtgtatttggttaaatagaaatattctacctttgctacaaagattttttttttgaaaaataccctgggtattcacataagagttgggaaaaaaggaaaataccccctatgttttttaaatgagagtattataatagctttagaaacgttcaaattctagcttacatttaaaaagtagtttctccaagaaaccccaagtgacatataaaggaaatttaaataatacataccatttttgttgctgctaaaatattctggatatgtaagatggaatattaatgttgcaatttgtgaagggagatttgggccacagaaagtgattcgtacaatgtcacttagcagattgtatttaattatgtagtgggtggaaattagggtgacaactggctcccagatgctattaagtccattcagactcatttaactttctcatgtattaatactagcaggccagtcagtgaatatctatagttttataggcataactaattttggtaaaacagtgtcctccctatagaagcactcttattaatacttcattaataggttcaagataatactgttgtcagttattggaggttaaatgcttcatcaaataaaggttagttacagaaccagatactgaggatacgatgttgaataagacctgccttctgtcttcagtgagctcaaagtttttgagggggagcagataaaaagagagacaactagagcaaacagtgagagttctggggactgagaacatatagggtattactgaagccctctggggaaggagggaagcaagggctcagggaagccctcacagagaaaagcatgctaaactggagccttcaaggaaaagtaaagggaaagtagttaggtgcagaatgaaaggaaggcaggccatgtgcaaggacagtgttcttcccaggaatgggacctgctcctagtagggacaacattttttaatgtgtggacacaggccagggaagttcaataactccagatgcaggggatagctcaactgataaaaacagctccctccaaaacgcaacagaattcctgcttgaaaataccatacagcatagaatctaagctggagatgcaagaggtacagaggtaagtggaagccaaaccagagagaggctcctgaaataaacctagcaagggctcaaaccaaggggcaggcaaggatgatgtggtaagaaagatttgctggatattaagaaggcagaatcaacagaatttacatatagaaatcaaaaaagaggaagaaataataaatgcccaagtctctggctaaggaatccttacagctagaaataccacatactgagttgataaacagaaaaggaggagtgtgtttaaaggtgaaatataaatgtttctatttttaatgtgttgagtaaggtatccatgtgaagatatccccggaagagaaggctgcctagtgttaatctggataactaaaaagcagattttgtcaaccgtagaatttattttagtaacagttttctttctaaacttgaaagctatttctttgtattctttcacaggtttaggccctttgtaaaagtgtatttcagatagacaatgttacatataatatgaaatatacatacatataggatacagtatatactatattctgtgttactttaacatttatatttcacctctaaacacactcctccttttctgtttatcatctcagtacctacactgtttcctatctaattaaaggcagtgattatattttactgtgaaattcttgctcatccatgccatatggataaatattcctagatcagattatattcctcgtaatatatcttaattcacataagtggtgctataaaactgtgaactattttgatcaacttaaaggaatttgctgtttgacaattacatcttcagactggttttaagaaaaggatggctataaaaatggatggacacttttcatccaggccgtcagaagctacatgatggaaagaaaacaaagcaaacaacacatgcagtagctaagtcaaggaattagcctctttgcaaacagaaagagcagctccatggagtcaaagcaacaaagctaagctgagattggtgtaaacaagtttctctttctaaagatcccaccaactgtgggaaaacagcaaaggtcactggctaggttggggaccttctctgaaaaaactgagccatgaaacagtcatagatatgcccaagaaaatgttaatgatgaaattttaatgtaatcaccaatctgtctgattataggggaaacaagttcatctgttagtaagtctcatcaaaaaagtgactaatcacattaagtccacaaacttgctctgagccttctagaaatactgttacttctgtaattttaatgagtttgccacagcagaaatcaagacccctgctctaagcaatgtataattctattgccactattagtagggtatatgcttaacaaaaagctcaaataaacagtaaagtccaacaaaaacttgttatgacatgagtttgttcagagctgaacttaaaataacttttgtctgtttgggtcctatttactaaaagtttcgtttaataaagaactaatgagcctctcccagatattggttcagtggccttcacccagaatccagtatttgcagacagagaacacgagaatgaggcaacctgaaacactgctcacatataaaacaaataactggatgtgaacattttgggttttcagagggaacagctaaagttatttaacattaatgtagatgttgacatttagctactgattttaacaaaaataatgcaccactttagaaacacaattttttaaatgtggataatgataggttaagtttttacatcattagaatcatattcatagtgcataaatattgtatcacttttttttcctagacatctaccatacttgaaagtgaagtaataaagggcataaaagattatttttcatctctaccattttggcagaactatataaaattcatgattttttttcacactcaaatattaaaatttttgaagattcttatgagaatttgccaaattcagtatgatccaaatgctgccatctgccagcaaagctatattacggcaaaaaaggaaagttaaacattagaacacagtgagaatttcacagacttgcttcaggtaaaatttgctattttataagccaaaagacttcacatcttcgccaaccagatccatcttgcattttatgtaataaggaagtctgagccaggaacacgaaagtgttacttgtctaaaaattgactaattcttcatttttattttttagccacacttcaccaccactgcgatttctctggtggtcttaagtcaatgaagttctgggaacaaaataaattaaaaataggatcatcttctcttccttaaaaaaacatttctttaaataatgttacatgaatatctttgcagcaatgtttctagagcctgtaattttaatttggaagacgtgtaagtgcaaaaaaaacccccaaatcctaagtttacatagacgtactcttcccaggaaaacaaaacaaaacttaagaaaaaatattgctgttatcatccaggtcgcagagttcctatacttagaaaattttcttcaaatttcaaagagaaggagaaactactgtggacaatagctctcatgctgcaaaagttacctgataattgtcagtacttcaggagatttaagtctcccttttaaacgggaaggcttagaaattatgattttaaaaaactgtattaatttaaaaacattcagcttgccattaaccttactaaataacttactgacaaaaaatgtataaataaaaggagaaaaatcaccatcatggatatataaataatagtgtctcagtaaggaaaaatattttacttaggtggtttgagttaaaagtttccgttaaagcaggagaacctgtagcagattcacatacctataaaataattacataatgcatagatcagaatcatggccaaattaaggaaaaaaaaaaagtttatttttttcatatgggaattacctcatttgaatgtgtgagatgggaggtgtagggcatacatttaaaaatacatttcacttgcaaagaatgtcaatcttcatcttacgaccattgcaattttactgcatacacaactccataactaaaaaatctctatataacgtgtatatacagaaacacaccatggaagctaaaaaatgaacatcttttgctctgaagctatacataagtcactagcatgaatataaaaatggaaatataatacattgtattgactttgtgctaatgaaaaagagagggttctgagatcaatgtgggtacaaaaccttcaagttgaactggtcttgaaatatcaatcagagttcctaggcagagaaagatcagggaggcaccatgtgtacatacaaaggcatgagacagtatggcatttttggctcccactctgcttggatctccagttcactgaggtcatatgaatactttgattcacagaaacaacttcctgtattctcttcttaccactgaggacttacaaagtgttccaagatatttttaggaactctttcagatttccctgtatctgaaagaatagcaataatataaggttggattcaatttaagattatcctttcttttgctaatccacgtgtcagttgcagaggaagatcccagcttcaccttaatttcataactccagaacaggtaataacaagtgctcttcatgtaatgtattaacatggtgccaacatggaagacatggctgcaaaattactgtcaacaactgcaggctattatgctgcaaggcactagagatcctttgacggctacactttagcacagcagatataaatcttcaatgacatcaactgagacacaaaaccaatgttgatagagaatatatgacaactaacaagtcttttcccttcataactgacaattaggcattattcattttgaaaactacctccatttgaatgtagctaactctcaaatcttaaaaaaaagattataaagtgcttaccaaataaatattatatgacaatacaaacacccaagccaaaaatctcagaagggacttgggaaacaaaagcacattccgcttcataaaataacgtttgcagtttggtactgttaaagacactcaatcgtttattaagtgtgaaactcctcctgtaaatttcctggacttaaaaataggatgctaaaagaagagatttaaagaaagtagagaaatgaatacatgagcagaaaaaaaaaacactcaaagcaaaggctaaaataaaaaatagtgaatatatgggcagaggtacctgaagaatataacgattgggtgttcctacctatattaccccaattaactcacaaaatagtccttgaaataggtaccactgtttccttcataccaatgaagaaacagactcaaacagatataaatagccatagtaacacagctaatctgtggcaaagctaggatttatactctgcaatgtctcaatctttctcttaaaaccatttgtactgataaatacccactataatcccctgtcattaacattttaaaacctagaaattttgaattcttgaaaaattctactactgtatgatctttatatgtagaatctaaaaaagttaaactcataggaatgaagagtaggacagtggttgccagaggctgaaggtgagggaaatgagatgttgatcaaagagtacacattttcagttataagatgaacaagttctaagaactctgtacaacatgggggatgatggatatagtaacttgattgtaataatcattatacaatatatacatatatcaaataatcatgttggataccttgaatacaatctttatttgttaagtagataattttaaaattttacaacacaaaaattctacttccttatctttcattcaatgtatttctgtttttaaatattatgaattcggtaatttttcaaaacatgaacttatttaccaattcataccaagagctatgcaactaggtttcttaaaatgcctttcctaacttatgtatatcaccattgttattcactcacagattgttgaagatcttgacaaatcctttacatgtgctatctccatttgctctctacagcaacactctcaagtagttattaatgtgcttgtgtcccaacagaagatttgtactttaatgcccccttaggaaccctgcctgtgtaaagatctgcaccagcagcactgagggtggaccagccccaggcatatctcctggactgctggacagagctctagatttaagagttgcagcatcttagaataaaggcatttcttctgactgtatgggttcaaaagtttgcatgtgaagtatgacaacactaaagtctttagagttcaggacttagttcaggctcaaataaatggtatctcctagaaaagcaacccttcaaaccttttctcatgcacttcccacaataattctgaaaaatttaccttcttcactcatttttaagtggtcacctagaaatttttaacataaagagttacaaaaaatataatttctggtgcatttgaaacattgacatttaacataaaactgtggtgtcactcttaagtaaataccatggaatctaactacagtcatgcattgcttaacgatgggaataggctctgagaaatgcatccttaggcgattttgtgcttgcttatgtgaacatcatagagtgtgaaaatcacagagtgtacttatacaaacctaggcagtatggcctaccacaaacctagggtatttggtatagccaattgctcctgggctacaaacctgtatagcatgtattgtcctaaatactgtagacaactgtaacacaaaggtaagtatgtgtatttctaaacatatttaaacatagaaaaggtacagtgaaaatatggtataaacaatacaaatggtaaacatgtatagggcacttaccatgaaaggaaattgcaggacgggaagttgctctaggtgagtcagtgagtaagtggtgagtaaatgtgaaggcctaggacactactgcacactactacagactttataaaaactgaacacttaggctacactgaactagtaaaaaaattaagtaactgtactacgatgttacgacggctatgatgtcactaagagataggaatttttcggctccattatcaacttattggactggtcattcatatatgcagtccatcattgactgaaacatcattatgcagtgtatgactattttatagcaatatgatcccaccaccgatgaaaaatacctgcaaactctttacagaaatttacaatatttcttttttcattgaactccttactttgatttcatttcctccagaaacttagaattgttttctactgtaatatatgttaatgcctgactattaatgaccttatcaaaattacctatgccaaatctatatatattttttctctgatcttaaggatctagtctcaaaaatcactgaattgagtttttattagacagtaatgctcaagtgatccaaaacaaatatatcacacaaatgtgcatttataatacatataataaataaatacatttattagatatgcatctcaatgaaatggatagtgctatttcttccaattagttcatgtatccatagattgaaacagagttcagcattaattttaatccaggatttttttttctgttgtaagctctaagaaaataaatagatgggagcattattatagcaatgtccatcaatttaattcctgcctatttaaatgtccccaaaccacacagtgattaataagcaaaaactctttcaattatttagcagttgaatacttgtataaattctttgccaactttactgaaagtaaaatacaagccatctaatttgcagaagaattgattacatcatcaatcaatcacttcctcaaaaccaatggtaatattacacatttgccttttgaacggtaccctggaggtttttccactctgggacaagaatcaccactgttaaaacctgagttaagtgagagttgtacctttcctttgtaaagcgggagaaggatgactgtgaaaggcaggctgagaatgagactgagcagaagacctttaggaaagggtacttacagaattagagggttcctactcagtcctattaaaaatatacatgtgcctatgtattcctggggaagttgtcttgcttatccaggtagcctcatagtttgaaaaacatcgtcccagttagggtagcaaaggtctggaagtgaccatggaactagggcctaaattgaacacacacaagaaaaagaattggccctttatggtgaatatctttcacatggaacttctagaaaaattggagcttggggtaggagaatgaggactggactttctaccaatctgggcagatgctgggccaagtgtcatagtctgagaccgactgagaggctttttttaatactctaaatagtacaaaaagtagtatgattagagtactgagtgcctactgagccatactattgtggctggtgctaatggggaaaaagaaggtataatacacagcccttgtcttcaaggatcttccaccttatttgagctatctgttaaggaaatgaaatttaagcagaaagaggacacacagtctatattattaaatcagtagcccaggggaagaggaaagagggcagccataggatgtataatttggcgagggaatgttgtgatgttagaggtccctggcagtgggagaactgctaagaattcatcggagaagagttacatgtggacacctgatatgacaaacggcatttgctaaccaagagagaactacaaaagcacctacatacatagacatttcacgccttcttccccttcctaccaactgcaatcctaaacaaatgttgtagacagattagacgatcaggaaaagcaagaatggataaaagggactaaagtccctttttcccactacaggtttctgagtgatttagaaggaaagaaaaaaggttttgaaatgtgtaagtcttggtttaaactgttctgaaaaatttagtacctgaacatgttatttaatacccaaaataaccagaaaaggtatggtatctgcaaagatgtcttcaaggatggtatgagagagagagatcctagagtacctaaggattgtgctgtggtaagaattaagcttcctacttaagcccttccaaatttagaccactcactaatttgttacataaaccaaatcaagtaataacgaaaactataaaagacttttccgaaaaaactgtcacagtatataaggggacgtgatttcaagctgtaaatcaacaacaaatactactaatcataattctataaactttctcccaaattttctcatgctgtttttcactggagctcatgaatgctcttcagctaacatctggaatctaaatccatcatattttcttattaattcagatgcctctcattttaaagatccccagattgctccctttattataaataaattctcaatgaatgtaaatttctgtatttggctaatgcttatctctttaggcttcattttgttctgcaccaaccctatcggtcttagagaaatgttacttctaatgaatttatttatataaaaagaagcaatctgtcatgattttgaagatggaaatgagaggagagaaaacttttgtgtggtttgagtgttttgcctttggttcattaaaaataggcacagttggctgacagcggtggctcacacctgtaatcccagcactttgggagggcgaggtgggtggatcacgaggtcaagagatcaagaccatcctggccaacacagtgaaaccctgactctactaaaactacaaaaattagctgggtgtggtggtgcatgtctgtagtcccagctactcaagaggctgaggcagagaattgcttgaacccaggaggcggagattgcagtgagctgtgagtgcaccattgcactccagcctggtgacagagcgagactccgtctaaaaaaaaaaaaaagaaggcacagtttttgatagatcatataaaaatgtagcatattttatctctagtctataagagtatctgactaatgaattatacttcaaaaataattctgacattactgaattaaaatggaaactaatatgcttttaaaaagcacggttagattatcttggtttatatgcagtctgtatttaatctctcttaaacattgtctcagtaccttgccattctgataagcattccatttgtagctgcaatgttctttcaatagtttgacagatattacaattctggttaagaatttaaagtttccagaagttggtactggagactgtatttcccatcattttcatgaggcaaatggatgctctatcataatatccataaatgtagttctctaatgacacacaattcattagtttttcttattgcttcttgtctttttattactttcaggtggtgggcagtagagacccattaatcttcaaatgcttttaataaaacagcactatgggatgaaggagagacagagagggtggcaaaaacccagtgtggcttcctggtgtttttatttttttctctaacaaatgttactgatatttaattgcctactgtgattatcagtgcacttatattttattgtggtactgcactggacacttaaaaatttgttaagaggttagatttcaaggctgggtatggtagctcacacctgtaaccccagcactttgggaagctgaggtgggaggattgcttgaggccaggaatttgagacaagcctgggtaacatagtgagacttcatctctacaaaaaaatgacaaaattaaaaaagaggttcgatatcatgctaaatgtttttccctatttgtttttaataatgaatttccttattttcctggcaccaagatctatcttcaccttccatagggtattactagctcctgagtttgtttaggcactcaaaggatacttaacacttggagggaataaaagactagtacatataaggaaatttaggactactatatgaaaataacaaatcttattctcccttcaccaccccacagctggtcatccctcctactatccctccatttccttttcagtggtatcattaagggtatgcactaacattaaaataaatgaaatgtctggaaagggtaaaatgctataaaagtgtagaaacaattcctccgtatctcattcatacaaaacttttcctggtttactaagagactatgaaacaatgacttaaaaatccataaataacaggaattttctccataactgaaaaatacagtttatccacactctcttccctattttacaaaataaaaattaaaatgaaactttcacaaattacattgcctcaccgttactctttgtaaatcaaacgtgtctatcaataccatgtttattagaccccaggtcctatattctaggttatgtaccaacctcacacgctgtttcctcctaattgctggcaggaaatcagaactacaggaaggaaataggtaatggccagaaatcttgattaagtgtattggaaatacggactaaataaggcactataattagtatcagacagaaggatgaatttatctccaacaaagcacaaactgttgaagcattaaaatttggaaaacgtgtctgagacataatccactatgatgatggaggagatgaatctctttcctgtcatgcaagatgagttcaggatgaaagtaacgacactgtgacactgctaaaaagctgcagttggttagcattcatgagatacctttttaaggtaatctgcccctgggataccatgataaatacaaatctcttaatttatttaaaaagttaactcagtgttcgtggggaaacacagaaaggctattttaaattaaaggctattttaaatcagacaaatttccttatagaaagagtaataaaaaaaaaaaagagcactgggggcttattataatacttcctctcaggtttcaaagtattttagttcacttatattgttcatgcacttgttccccaatatcagaagccctttcaaatacattatgaatatattgaaaattaaataacagcccatgaaacttttactatttgtaaaaaaaaagtgttaaaataacgtaacttcagataaaagttaattgatctcacgaaccaaatatttaagtatcaattaaatataagattctgtagaaactacgataagcaaaaaaaaaaatccagatacaaagactacatattgcatgattccatttttacaaactatccaggaaaagtaaaattacagagcctgaaaatagatgagtggtttcctggaactgagagtgggagcaggaatagactgcaaatggccatgacagaactttctgaagtgatatgtttaaaaattgaattttgatgatagctgcacaaatgtataaatttactaaaaatcatctaatctacaatagatgaattttattttatacctaaataaaacagagaagattatgtggggaaaaaaaaccatggcattgagattattagagaagttgcactccctcaaaatctcatggattagtagagtagaattaataaaataatctaaggaccatgaaagagcttcccaacaagtggtggtacactagtgttcttccaatgggtttcagaactggcaagacttcaattctctcggccactggagtgacatggtaggacctggggcttgtattccctgcagctaagaatcttcttccattgactctatttactacagaaacaaaatattttgctgatcaaaggcaccttgatgaatgaaaatgaagagagatcatatcattacttacaaatgcaactaaagcagcgcttagagggaaatttatagctgcaattgcctattttaagaaaaaagaaagatctcaaatcaaaagcctaacctttcacctaacacactgtaaaaatgagagcaaactaaacctaaaatagaaggaagtaaatagtgcagaatgaagataaaatagagaacagaaaaataggagagagtccaagaaatcatcctagaaatgttatttaaaatagtcttttaatggacaaacttttagttagatgggctaagaaaaaagaaaggctattcaaattactagaatcggaaacggaaaagaggacattattactgaccttatagaaactaaaaataattacaaaaactatgatcaaatgtgtaacaataaattagagaacttggatgaattgaaaaattaatggcattaacttttaatggcaaaaaacacaattacttttgcaccaacataacaggaaaacacaaaatgactcaaaagaaagacaatgaatagatctataacatgagatcaaattaataatcagagaattactaccaaagaaaagctcagtcccagatggctccactggtgaattctaccaaatgcttttaaaaaatacaaattcttcatacctttgaaaaaaattgaagggtccacttaaaacttattctacaaggccactattaccctgataacaaaatcagagatatcacacaaaaaaattacaaggacaatatctcttatgaatatagaggccaaaaacttcaacaaagcactagaaaaccaaatccagtgacaaattttaaaaatcctatattatgatagtgggaattgtgcaaggaatgcaaggttcatttaacacctgaaaatcaaataatgtattacatcatatcaacagaataaaagacaaaatccacatgatcatctcaatagatgtaggaaaagcatttgacaaaatcaaacaccttttcattataaaaacagtcaataaactaggaatagaaatgaacttccttaaactgctaagagtttctattaaaaattcagagctaaaatcagatttaattataaaggattatatgcttcccccctgtgatcaggaacaacaccaacatgccttttcttaccacttatagtcaacattgaactggaaacaattagtcaaaaaaaataaataatggaaatctaaattagacaggaagaagttaaactatcagtatttgcagatgacatggtcttgtacatagaaaagtctacaaaatccactaaaaattttaaagttaataagcaagctcagtaaggttgattgatgcatataaaatctatatacaaaaataattatatttctaataacttgaatgatttaaagataaaattaagaaaacaattcaactcaaaatagcataaaaaagaataaaataatagaaatacatgtaacaaaaaaataaaacttttactttgaaaactacaagacattgttgaaagggaaattgaaggtctaaatacatagaaagacatcccatatgtgtggatcagaagacttaatattgttaagatggcagtatgctccaaattgacctacagttacaacataatccctactggaatctcagctggtaatctttgcataatctttacaaaagttgataaactcttcctaaaattcatatcaaatttcagaatagccaaaacaatcttcaaaagcaacataggtgaaggacttgcaatcctgatttcaaaagttactgcaatggtagagcaatggtaatccagaaagtgtggtagtggcataagaatagacatatagattggtaaaacagaattgagagtccagaaacaaattcatgtatctatggtcaactgattttcaaaaaaggataaaaagaacatttaataaggaaagaataggtttttcaacaaatggtgttgggacaactgaatagttccatgtaaaagaaggaagctggactcttacattacaccatatacaaaaatcaacctaaaatggatcagtgacctaaatataaaactatgaaagtctcaggagaaagcacagagctaaatcttagtgaccttaggtttggcaatgaattcttagcggtgacaacaaaagcacaagcaacaaagaaaaaaataaattaaacttcatcaaaattttgtgtttcaaaatacaaatcaagaaagtgaaaaaaattcacagaatgagagaaaagatttgcaaatcacatatatgatgtgggcctagtatccaaaatagaggaactcttaaaacttgagaaaacagaaatgggcaaagcacttgaataaacttgatatatggcacttgatactggcattgcacgtcaggcaagaaaattgtaatggtgctaggacatttagctttccatatgaaatatatatatatggaagatatttataccatatcagcttgtataagtatactctatgatgttcaacaaaatcacctaatgacacgtttctcagaatgtatccctgctgttaagtaacacatgactgtatataattctatttatacgaaatgtccagaatagataaatctataagagacagaaagtaaatcagtggttggttaaggctggattggttgggggttgatagctaaagggtacagttttttttttttcttgagatgatgagcatattcaaaactggatagtggtgatgattacacaattctgtgaatatactaatatattacccccaaatatatactgtgactaggtcacaaaagtaagtttagtcgattgaattaataattccgcttggatgcttactaagtactcagatataagattaaataggataagatgttttgcccttttctcaggaggaaatacattgcaaaataaacaggtaattaacacagtcccaaaattaaaaagtggtcagccagaaaatgtacacctcccactgggttaaagggaaggattattctcagtgatggttaagttgagattctcaatgccaagaaagcagctatacaaagataagagggaagatgactacaagcagacgggaaagcaagtgcgacactgagaatgggtggataagtgtatgagggactgcatgaagtccagggtggatgaactgcagaagatcgggggaacagagggagaaggtgagatcccagaggtcatgagagattggtcaagggcaggcctgtagggatttgtaggttaggatgagaagcttcaacttgtttcttttcaaccccctaatactctgtgcacctcttttctgttacacataaccctctgtatctccctatcctgcctgctctaaagaaaatgaacatttctcatatatcttcagtgcctatttgggatctcaacagaggtttcctgaatgaacaggtcacatattggtattataataaggcaaaatcctaaatcctataagatatttagaataaagattaaatagaagaaaaaaaatgttttctaaaggtaatgcacaaatgaaggccaagcaaattgaatctgaattcctcaggccaacctggttgtttctactagagaccatgatggttccccaagtttgaatgaattaaagcgaacacttactaatttaattaactcattgccagaacctgaaacatcaaactgttggcaaaaagcagctttatgctctgaatatcgtgcggtagtcgtacattaactgcttctctagcccgctcactaagtattccaagtcattgtgcagaatcatggtatctactgttacatcaccaaaaactataacagacaaaaatggaaaggctattatacaattctcagaactgaaataggattatgtattacctttcaaataacacatggtgataaaatttgctttccttagaaatgacttataaatgttttattgcctaatgattagctttgcatttgcatgttggattttctgtttgtactacacagggattctgccaaaattccaattataacatcattatctagaaagggacacactagttctaacacatttgagacaaagttagccaaatagcagttttagagggtaataccacacatttatgcacataaacagagcatgtttctttgggaggattaaaaaaacaaacaacaacaataatacacttttttcaactggcttactgtggccttgaggcttcggcctggtctgtctgaagtttttctccttccacttccattgtacagtaaacaattcgattgggagcaactgacttcaggccttgcacttccattatgacaatctaaagataaaatgattttaaaataatgcatcaagttgataacatttagcaatatacataaacagcagcatgaactgtaataaggaagattgacaaaactgaaaaaaaatttgttttttgttaacatcactggtattttatcttctttataatccacctctattcatagaaggtataataaataacatttttaggaaatctggtaactgaaaatatatctgctgccagatacaaataaaagtaaggtcaaatgtcataaatataagccatagtgaattaaatgaaatttaaactcagatccttaacaaattaaggcaagtctgcacattaagcagaatcacaaatgaaaattcagtgcagatgataacagcagtacatgataagtaccatataaaataatatagtatatattattggtaaacattgataccatcatactaactcactgatatcaatatgtgatatcagaaattttctatattcacttatttgagattactattattgtctgtaaaagagtttaatttatggactgtgtcttattaaatagaaaattataatttgtcactgaacattttaatactaacttggtaagaaaaaatattttttctatccattaaagatatgtactaatttaattcagtacactggaaaagggtggaaaaactgatattgccttatgtacttgtaactcctgggagaaaggacaacatatattttttatgtgtgctttttaatgtttgtcgaagaggctgccaatcttaaaacactgtaacctatcattcttattggatgtatgtatcaaatatgaatattatttaccatagcgttttcaatcaaaagttgcatcatgaactcttctaaattctcaaaatttaatttataaaatagattaaaatgcatttttatatatgtacattgatgtcttaattgatcccatgtggtatttgcacaaacaataataaaactcatgttatgcagcgaccaaaacatctatcataaacataatctgtatcagttactgatcatgtaatactttattacagtcatcacattttttagagtcatgataagaattttgatccaaaagggctcaaaaaacaaaccatcttaaaagtgttcttcctttcagctctgttacaagagaagggtcatgtttgtaaatatgaatgtgtatttgttttttgttaaattttgttttcataaaatatataggaaactgatcactcagttatttatcaataaaataaaaggtcaaactcagaacaagttttcttcctcatccagggcttttgtcattttctcacatggaaatacataccaacatatgaatcaaaatcaggacttaactgaaaacagactaagaaaattaatggagaattgatagagaaaagcagtatctttcacagctgttctaatactcatcagggaaattgggatgaaatactaaatcttgattaaagaaaataagcaaaggaagttatgcatttttaatgactcagattttttgttagtaatatggaaatttgttagattcttatacaaaatgaaaccagaagctgagataaatcaaatatataaccatattaattaaaaggcaactacacttggacttaccaccatttctctaataacttcttaataataaaaatgtttgatggtcatttaaaatgtatgaaacaacagaattgtgtagcacaaatctagaaatcgtaagagcattgcttcatatttcagaatattattgttgacactgcatctctttctgcagtgtgtttaaataacccaaatgcaagaaaggaagcatctgcttgacattatttctgtcacctctactataagctactgtaaacatgacctcctaaaacatacaacttgtgaaacagtactctgcttttcaaaacaatacttccaactgtgctgggaacgttttaccctgcagaatcgtcattttcaaaagatacagcttctgtgatgaatctatatgtataaataaaacaatatgattctacagatctgatatccaaaaggaaaataaaacataggtggccttaataattagtgataaagacagccaagaattccatggaccatcagctaatctaattttaagtgtttcaattcccagcaaaacttgctaatggacctacagaagctaaactgacctatttttcatcttctcttccccagtctctctgtagctgatgtcataagcataaaataaagttgtcctagaagtaaaaagaagagaggcatgtataaaatgtgaaactaggtaacattcttccaagtgaaacactgaccacagagttaggagacatttaagcatgtgtagtttataaaaaaaatgacactgggcaatatggtgaaattggggaccatatagcaccaaacatagagaaagtcatgggatctgctagcctaatatcaatgaaagaattcagtctaaaaaatcaactataagccgggcacagtggctcacgcctgtaatctcagcactttgggaggccaaggcgggcatatcatgagctcaggagatcgagaccatcctggctaacacagtgacaccttgtctctactaaaaatacaaaaaattagcctggcttggtggcaggcacctgtagtcccagctactagggaggctgaggcaggagaatggtgttaacctgggaggcggaggttggcagtgagccgagatcgtgccactgcactccagcctgggcgacagtgcaagattccatctcaaaaaaaaaaaaaatcaactatattcatgccactgataacattcccccactttccacttcttaagtgaacgtttgtttttctagtattgcttgaacatttaacattattgaacagcttagcgttttgtggattggctcatctcttgctttaatatttcttctgaagccttaatgaacagagatacctaaaagtaatcctgaacggctgtttttttgataccataaaaatccttaatccagtaagtatttattgagtcaattgtgtgctaggcactgtttaggcactttcaatacttcagtaaacaaaaaagaaagagaaagaaatataaccttcctgcaacttatattctagtagagaaagccagctaattaacaataaacacaataaataactgaactatatgttagttggtaagtactacagcaaaaactgaacttggtaagggaatagggtatggtgggagaagggaggggtgggagcaattttaaagagaaggtgaaatttgaggagagtttttcaaatctgcactttattccttcgactcagtatagttcttagaaaagattcctccactggaccacttctaagcctgactaatgaaatgtgtgagctttaaattgatttaactgcttgcctttcagagtcttcttaggctgaaatatggggtctgaggagcaaggcttgctgaaaggactagagataattattcagtttagcttggctgatgtcacaggtcctgtgactagaggcatatctattctctctggtgtcctataaacatgcactgcaccatcgtcacttaacacgattttactttgttgctggacacataactcctgcttaaaatactgtggacattgagaacagatttgtattatgctatggtaggaaaatatctgccttagatagacatagcaacagaggatgtcaaaacaattttataaatatgcaaacttctcagaccatgcaaagtgaagttttagctcatattctctgcctaacaacctactgccaactcaacagccctcctaaacatattggcaataaagcacagaataacaattcataatttcacttaaacattgactcagcagcctaattttgttttcaacaggcaaaatataattcataagaagttaattattacaattgtttaagatttttgaacaatagagaaaagataaaatgttctgaacttttagttctgaatgtttacatataaagataatggtagatttgtaaattataaaagttatttgctctacaaattatttttttcatcaataaatttaaattatagactaggcacggtgtctcaagcctgtaatcctagcactttgggtggattgtctgagctcaggagtttgagaccaacctggacaacatggcgaaaccccatctttactaaaaaatacaaaaaaaaaaaaaaaaatttagccaggcattgtgttgcatgtctgtagtcccatctactcaggaggctgaagcgggagaatcacttgaacccaggaagtggaggttgtggtgagcagagatagtgccactgtactccagtttgggcaacagagagagactcagtctccaaacaaataaataaataagataaactcttgttggaaaaagttatactataattaagggacgaattgtgttttgtataaagccttaaaaaacagaaaaagttgacgttttgtatttcactcagcaggagatctgagacaggaataatgaggaaattctataggtaacatgctatgtagtttcaaattagacatccttatgtcaaaaggctgaaaaggctaagaagaaacccagtagtgaaaccatttggcaaagtcattaggtaagcccagaattgaatcttgagtcagaagaaagactcatagttctaatctgacactaagtttaatccattaacctacaaataaatcattaatcctgaagtcaagaaagtgagaggcagatgtcctgaagtttgaatttatctcagagttaaatatatggagaaaaaagaataaaaatcaaagttttctttttctgccataaactaaggaagtgaagtttcaataaaaaaattgaaaactgttcttcgtaagactgtatttacttttctttgtcaatcagcaaatgcaaatggcagcactgggaaccagcagagaggataaaaagaatgagctataagcctcaatataatttttgagagagctatgaattaaagtgtcacattgttactatttactcacggaataaaaatcatggggaggggaagcttaagtttaagccaaatggtgacttgatactcctaattattatgttataatcttttatcttaatgcctgacataagttctttctcctaggaactaaagatgtcaggtgtgtgtgtgtatgtgtgtatgtgttgtggtgtacaaacccacagacatataactagataagcccacatacacacatcatcaatgaagagatatcatgtaaaccatcaacagaaagctgtacaaagagtattagtctttggttcccagtgatttgcataaaataatgaaattctgaagttttggagaacacaattttaaatgtatgacttttcttcttgctctaatatgtacagtgcctgtaataaaacttgaagtcctgaaaaagaattatctatttctcatcatccatgatacctaataatgtgcattagaactggcttatttgatatgatcctagaaaaatgatcctatgggtaaagtagatttaaaaagaaaggttaaccaaaaatctgaaaggaattcccaaattacaaagaattcaattatatgttgaattgctatttctacccacgtgcgttttgatgcttattttatcaatgaatttttgttattgttttatttttgagacagggtctcactctgtcagccaggctggaatgcagtgtcatgatcaccattccatgtaccctcaacctcctgggctcaagcaatcctccgcctcagcctcccaagtagctgggactacacgctcacatcatcatgactggataattttttttttttagaaacagggtctcactatgttgcctaggctggtcttaaacttcttggcttaagtgatcctctcgcctcggcctcccaaagtgctgggattacaggtgtgagccccaatgctcatcttattttatcagtaaatttacaatagcctcgctggcataaagaagacttgccttaaaacttctattattttatttaatcctaatattgttgttatgtttaaaggaaaatttgcattcatttgcatatataagctgagtgtccaacaaatggagaataatttaacatctccaacatatattacactgttttaaattctaaaagttactgcaaaggtcaacagaaattattgtgcatcatcatttatgctgtcagaggtgagcatgagataaagctacttacctctaaggtgaatgacagtaccacgtcggactttgacagctgaatctcattctcatctcctatgtccaaaaatgcagagttctgtgaacgttttaatttttgtaatttaaattccggaccacctttcgaaactggaagactttccaaattggccattagcaaattcactgaagaccgcaactcttctatatacatattctccatatcttttgctataaatttggggaattttctttccttgaaaataatttttaaaataatagtgttacataagtcatatttcaattttatcatacaaaattgtatgatatatatacttcactgtcttagaaattacaacactctcaatatatctatcctacttgagtcactaggctgtaaaatcctcaggctttggcatttttgattatatctatggtacttcagatatcttattgaggatcactgcagtacaaaatgaaaaaatcgcatatattttcacattaaatttatttgtgataagatttgcttaaggaaaaacaaactctgaaaacatgcatggaagatattttagcgtatagatgaaccttagccactagtagctttgcgatgcttgggataactggtctataaaaaaatgttcaggacacacagctttccaagttaggaaacaaacattttaacaatagcccaatttcttaccacagatatgcgttgttggaagagtatgctttttcataaataggcattaaaaactcacattattgaagagtgatatggtcatatttctaaaattagtaaattttcacattacattaatgtgccaagatctcttctggctataaattcagttttttactaaaggcttagaaaaagttaagtttaaagcaaaaggaaatttatgataaaaactattaagggaaaaattaacaatatcaatttggaagattctattttcttgctaaattatatcagcattgccattcaataattttaactctgcaatcagatttgtttcttctgctcaattaaaaggatgttccaaatattgatatttagatggtgccgaatcattcttagagaagattataataaatttatattccccagaacagcaaatgagagcactttgttccctcacattcttggctctttctttaatgtttgccaacctggcacttaggttttctctcttaaagacagagggtatatagttttacaacattaagcctagtttaaaatgaccaccagtgcacagaaccggctggaggatgaaagcctaaagcagccatctttcaaatggctgctgaatgctccagaaaagcactgcctttactgttgtctcccttgacatcattcaaaatctaacctaagaaatctgcatgtgtagtacaatttgaaagcatccagcatgctcttgtcaacctgcatctagtctctgactcacttgcaccagttcattcatgggattggaaggaacatctggcaccacttcacagatcagtcccagagtctcaggccacctgcttttcttctcctccaatataacattcacatatttctttttaaaataatttacatataatcaaaattaaaattgcataatgtcacagacagattaaatatctacattaaaaattaactttcccaaagaaggttcttaaatatccttttaaaatttctctacagtttgaagcaacattccaaaacagcaaatttgtatccttaagaaaaacaggcaactacccagctataaaatacctgggtttcctttagtggggcgggggagggaaggaattgtctttagaatattttttcagtacaagcaaagagaggggaaaaaagcaaaatgatccataaaaaacatattttacgtttttggactaactttaaggctgccagaaaaagcatccaaaactgagaaataaggcaaagcaatgagggggcagatcctttcaatgtcgtatggaggtgaaggccatccaatgatcatttggggaaaagttcttagttcaccttattatttattattgattaaagattccagacaataaagctacatgttaccttgtaaaactgtgtctgaaagaggtgcaaataaagtttggtgaataatataacccacaggttcagtttaaatctgtattagaaattaaccaatttttgattaaaccccattaatcttaccttagtaatgcccccaaacacctagtttctcatatgctctttggtctggttttaacacctaacttgtttgcttattaattatgcgttgaataaaatctctattgtgtgtccattttatatttatatgaaaatcacaattctacccctaaaaaagtagagtttaacaaagaaaaaggcgagcatgtcacgtatctgaaagttctgatatactaacgctttgctttcaaattttcaacatgttatggaaaatctagcattagcacaagaacaaaaataatctatttgtatttagctttaactataaacacttcatgaactatctatcatctgtcaaacaggagaaaagcaggcatctccaaaattggctcttttatcagtatttccaaacatttcagggactagactatacttgaatttttttctccaaaaaagctcaaaattcagttttaaagctttgaggtttattgataatatttcattaactctattcagcctgcttgtgttgtccctcactggcaaacaacaaaactaactgtatatcagacaaatgtacattttaaatttgttgttttaaactagaattgaatgagaaatagggttatttcctagttgtctaactgtgagtcactcttacaagtcatgtgttctaattaggtcctctgtacagcataggtccctagtggtcttaacccatggtatacacaaaaacaatatttgcttctttaaaaagtttttctcattattcaaatatagtcactttttcttatgcgctcttaaccttccattagatgacatctggggttcatatcacaggattgtttctctaagctgatctctgctgcttcccatgccccacattaattttaggttctaatctcagcatcatggcatcaagtgaactactggctgtgaagctggttccaaacctaactaaatcgttgaagtgtttaaatgtttttgctacaaattagagcagattcagttatccttaccatattggtattctctcttcctttcaattcaaatatgcctttgagtgggagaaaagggagggagtctacaaataattcaagaattcttcacagccccagatttctcacaaatatgccagcatgtaagactcagtcatttgatagacattccctgagtgtctgctatgtgttctgctccaagcccctggatagaaccatgaagataatggacaaagtcctgatagacttagtaaacaaggaaataatttcttctgatagaaagtcataagtggcatggagaaaaagtctagaaggaggaacacagagtgagtggtgagaagggttgcagctttaaacggggtggtaggggaaggtctcaatgagcagatgatgccctttgagctaaaagtggataaggaagtatgatgattaattattttttttttttttgagacagagtttcgctcttgttgcccaagctggagtgcaatggcacaatctcggctcaccacaacctccgcctcccagtttcaagtgattctcctgccttagcctcctgagtagctgggattacaggcaggcgccaccacgcccggctaattttgtatttttagtagagacggggtttctccatgttggtcaggctggtctcaaactcccgacctcaggtaatccgcccgcctcagcctcccaaactgctgggattataggcatgagccaccgcatctagcccaattaattttgtttgtcagtctggctaggctatggtgcccagttgttggatcaaacatgaatttaaatgttgctatcaagatattctttagacgtgaataacatttacaatcagtaaattcagtaaatcggatcaccctcctacatctgtaggtaggtctcattcactcagctgaaggatttatgaccaaaggcgaaggtttcctaaagaagcagcaattttgcctcaagactaaaacacagaaaccctgtctgagtttctcacctgccagtccgccctacagatttcagacttaagactgtaacatcaaccctcacctgaatttccagcctgcctacttgtcctatggattctggacttgccagtgcccacagccgtgggagccaattccttgaacgcaatcaatctctctctctctctctccctgccctcccacacacacacacatatatatacacacataacatgtatgtatgcataacatctactttttaatattatatacatatttattatatctacctagatattggtctagatatatgaaaatacagatataatctcctattggctctgtctctctggagaacctgactacagcagggagaaagccatgtaaatgtcagtggaagttcgctgcaggtgaagagtcagggccaagaccctgtggcaaggaaaggcaaggaggccaccatcgccaaagtggattgagcaagggcaagagtttagtggaggataaagtcagaggggtaaaaaagaccagatcacacaggactggggtaacaaagaccagatcacacaggactttgcaggccattttaggaacttttctttttttctcagcaacatagggaatcatcacagatttagtgcagaacatcactggctgttgtgttaatgaggacaggggtagaatccaggagactggctaaaaggacagaacaatgatccagacaagagacaaagatgaatggaccacagtggaaagggaaggatggtaacaactgtcacattctggaaatactgtgaaggtaaagataaaggatttcctgataagttttgcatgaggtatgagaaaaaggagtcaaagatgattccaagttttttggcctgaatatctggaaggattgtactatcaagaactggcctgccctgaccacttgactgaaaactgtaaccacccaccacctctctcctacactcctcatcccactttttctgatctattttctaagtaacaatgatcaccttccataattcaattacacggcatgtttactccttattgtggggctatcgcaaataaaatgtaagctccaccagggcctggcagaaatatttttgtctcattttatcccaatgtatcccaagtagctaagactgcacctggctgtatagttggtgttcaataaatatttggtcaattaatttgtggatagaaaaaatgaggctcgaaagtgttaagtaacgtgcctactattatgtttagaaaatagctatcatgaatttggtcacaggtctttctggccctgtacacattttgttcactacttcctaattacctcttggctgaagtactaaagtcaacatgtctcttgaaacagagattttgccctgtagtttcactgttattatattgtgttgttctgtgaagtgtgggagggggtgttcctgaatgccaactaatagctgtttattaaccactcttctggaatgatcagattgcagaggcagcaggatgttaagagagcgagcccaggctctggaagcaaggccaggatttgaggcctgcctcagccacttatttgttatgtaatcatggtgaaataaataatcttgtctaagcctcaatttcctcttctataaaattgacttcatgatatcatctgcccttacaaggtttgtaggattattgtcagaaaataattcagcaaggtcagtcaattgttattaggcttaaaaatatttcattaagacggcttcactttggtgaacttgaagtggaaagcaattaaacctgctcaatctatgtcaatattttcatcaaaaggtatcctatttttagaggtatattttgctttccaaccccatcagctttacttctttctccatgttttttccactctatcaacatctctgatgaaaccattagggttctctcaaggagaagcctttgtgtgttcatcactaaccctttcttctgactcagcccaggagtttatgaacacaccttcttctcagtcatgaacctgagaatacgtctgagtctcttcttccagtcccataactctctagaaaatcacttaaactttattctaaagcattacatatgacaatgtgcccagtctcaggtacaatctatatacaagtaggtaattttcaaatgctgaacacagatccactgtccctcctgctgctgtcaggcacatctctccaggttctttattagctttaggtctcagaaaagcaatttcttttccagccaggctcaatacaggataggacttggcattaaaatatttttctttctaaaggtttcaatagcctcaagttgcttgctttctactctacaaaatccacattcaaatctctagaatgaaataccacctttctagaaacccagaggacaaaaataaggcatgctatcctttcaatcactgccctctgtgcaaatgtaactctttggcccctaatttatagcacactgtatcttcattcatctagagattcttcctcatgatctaattcctgcttggttcttacaacttactgtcattcttgttacccaattatctacatttttctctattttattatttatttctaatttctcaactttccctctactttttaataaacacttaaacagtgttagcattttaaaaacattatgtattaatatttacaaatacacattttctttgcagaagtaaaaaaataattgttaaaattagtatgggatataacttcttgaatgctggaagagttcattatcttgatctgggaggtggctacacaggatgtatgcgtaaacattcattaaactgtaaaatgaagatgtgtgcagtttattgtatacatgttacgagagagagaaatagagagggagactatccatcaaatattggaagtttttgctaagcagaaaggaaagggagagaatcttatgttcagagcaatcaacagcactataactgcaagtccattgaaaagaactaaaattttcatatcattgaagtaagttaataaattcactaaagaatgatttagacaattgggttccattctctctaaaaaccttaagtactagaaaaaactcatgccttttgtctgaaatttatctctattcacgatacacagtgatcacacaaataaaataagtacaatatgatgaatttcttgtatcaagcacacttcatctgccagattgcatactagatacttaaaataatattttttcatgcatttagtcattcaattaaatgttagtcagaaccactatgtgccaataactttactgtatacttaggaatgtattatatgattttgcggggaggagttttttctccctggttatattttgcttagtaaaacattaaaactcttctagatctggcagtttgagaaactcatgcattgctttaagagaagtctataaaagttatcattaaaattaaacagttcacatattaaggatgagtacgtaaaatgaataatatgcttcatttagataacatgctttcagatatttgggattaagaggtctatgtgtagaggagaaaatgttaaaattatgctggctcttttttttttaacctatacaaaacactttttcagctcacagaaatctaggtaaagaaaggaatgtcatacagtatgtccaagttaataatttacctttgccattttatctgccaattgcagccggccatcaagttcccttctgatctgggctgcttgttcatctgcgttatccagcttaaaaataaaacagaagttacacatatgtaattacttaatctatatacagtgacccacagactgaggcagtcccacagactaaggcaaagattaaatgactgaaaaatgtttaatagattgtatcagatatctattacaaagagaatacaggaggttgttcaattagattggcagaccagataaatttcttgggtactttctcattgtggttttactcacaaaaccaccaaatcaagaaattagatttcttgatcattaagtcagtcctaaatagttccagaaagatgaagctcttgttttgttctttcaagttctcaccatgtatttctggagggtgagatgctaatgtttcacttctttctttgtactttaaaaaaactccctttgctttaataataagtttgtattagtgctaaactataaaagtactctttgattgactgatacaactttctaccacttaagtcttcatatactcctcattctaataccagtagactaatactgccaagaaatccttccattcttttaaggattggcaccatattagaaatccattctcctgttctaaatttgactgaaaacaagaaaagtgtgctctcatcattttttttagaaatctcccatttacatggaaaattattttcacttcatgaactaatccttaactttttctataacttattttaactttactcatgataccttttcacccattcactcaatattagtccctttataaaaatgttaaagtgaggatgttaagtgttaattttctcttgactttagttttttctccttttgcactctcatcacgaagaagcctggactgcacaatacactttagtaaaggaccatctaaagattcgattgagtataacattaaacaccaatgagaaaacagtttacttgtcactttcccaaagaactacaaattgaccaggttacatttttaaaaacatcctcaaagagagtcctcaaaaagatgagtagaagcaaaccagattaacaggatagtggtggtaaggcaatttatatgaagagtcaaaaaaaaaaaaagaggaagatgttcctataaaagaacaccaaaagtctggaggtgaggaggtaaaactagacacacacagtggttcttttggaatgggataccagaagaggcagggtgagggacaggactggagagagaagcagggcaacttcataagttactcttcacaagccacattagggaatttggagttagttcctacaacaatgggacttccttgagaggtttaaagtgtaggagtgatatgatcagatgtaagctttggaaaggaaagatcactctgtctctagtacaaacaataggtcagaaagacggaagtcttattttgttttctttaaagatatacacaaaatgttaaattgaggatattcatgttaattttctcttgggagaaaaactatacaaaaggcctgagattacctgtctaaaatatgtttccaagttgatttttaaaaaaccaaattcattttaaaataagttaaaaaaacaggcaagattttcttaaagtaaatccttgttatataggagtttctatgtcatctcataaaactaacaaacaattttaattgattaatatgattcaaaatcaaacagaaacaagtttctcttcactgtgtctaaaatcaaaatgattaaaattaaaaactaacgtaattatgaagaaaaataatatgcagtaagtacgggttccaggttaactgaaatctctcattccaagctcctaaaaactaaaccataagaacactgaaactgtaacaatacttcaaatgcactaaatgtaatatgaaatatattatgatctttgcttaaatgctgatacatatttcttcaaaagacataaaaagttacttgcatataaagaaattatatttttctcacagcttcaacaaaaaatagcatttaatatcttaaaaggccacagtttttcaaacttcactagaaacactaacatatttttgtatctatatctccagattaacagctcttacttaagtgtaagtgaaattgtttgagttatttctaaattttggtagttttgtttgtaagagacaatttacaactacatattttttctttttgtggagatggagttctcgctatgttgcccaggcttgtcttgaactcctgggctcaagtgatcttcccgcctctgccttcctaagtgctggaattacaggcataagccaccgcacctggtctgtttttttaaaaaataattaatgacttgatcacatttgtctgaaaaaaaagtaagcaacaaaacaaaacaaaaccaaaaacaatgtagagcactgggacactacattgtcttttcttttttttttaatttcagatttggagggggtacagtgtaggatggtttcatgggtatattacatgttgttgaggttgaggttggggatatggatggtcccatcacccaggtggtgagcatagtatccaataggtagtttttcagcccacatttcccttggtcaatcattccccagtgtactattcccatctttatatctatgtatattcaatgtttagctttcatttataagtgagaatgtgtgatatttggttttatgttaaggtgctaatttgcttaggataatggcttccagctgcatcgacattgctgcaaagaatatgatttcattcttttttagggttgtgtaataatccatggtatatatgtgtgtatgtatatataaaatattttctttatccaacccaccattaatgggcacctatgttaataccaggtctttgctattgtcattagtgtgtcaatgaccatatgggtgcaagtgtccttttgatcaaatgaattatttttctttgggtacatacccagtagtaggatttctaggtgtaacagtagttctgttttaacttctttgagaaatctttaaactactttctatagtggctaaagtaatttggattaccacccacagaatacaaacatttgcttttctctgcagcctcaccaacatctgttgtttttttgactttttgataatagccattctgactgctgtgagatggtatctatctcattgtggctttgatttgcatttctctgatgattagtgatgttgagcatttgctcatgttttttggccacttgtacatcttttgagaagtgtctgatcatgtcctttgcccatttttgagttggattgattttgcttgatttaagttccttgtagatatctgtatattagatctttgtcagatgcatagtttgcaaatattttctcccattctgtaggctgttggttgactctgttggtaatttctttcgctgtgcagaatctctttagattaattaggtcccacttgtcaatttttgttttcactgtaattgcttttgtggacttagccataagttatttgccaaagctaaggtcgagaagggtatttcctagtatttcttttagaatttttaaactttgaagtcttacatttaagtcgttaatccaccctgagttaattttcgtatatgatgaaaggtaggggtctagtttcattcttctgcatatggctagccagttattccagcaccatttattgaagagggagtgctttccccattgtttatttttgttgattttatcaaagatcagatagttgtaggtgtgcaggtttacttctgagttctctatgctgctccatttgtctatgtgtctgtgtttgtactagtacgatgctgttttggttactttagccttatagtatactttgaatttgggtagtgtgatgtttctggctttgttctttttgcttaggatagttttgcctatttgggcttttaggttccatgtgaattttagaatagatttttctaattctgtgaaaaatcatgttgctattttgatagggatagcactgattctgtaaattgctttgggcagtatgatccgtttaatgatactgatttttccattccatgaatatggaatatttttccatttatttatgtcatctttgtcattttctaagcagtgttgtgtagttctgcctgtagagatctttcacctcattggttagatgtattcctgggttttttgtttggtgtgtgtatctattgtaaatgggattgtgttcttgatttggctctcagctagaattttactgatgtatagaagttctattgatttttgtactttgattttgtgctgtgaaactttactgaagtcatttatcagttcgagaagctttttggcagagtctttaggggttttctacatatagaatatcattaacaaagaaagctaatttgacttcctcttttcctacatggatgcattttatttatttctattgcctgatttctctggctgggcttctagtactacgttgaacaggagtggtgcgagtggacattcttgtcatgttccagttctcaaggggaatagttccagctcttctccatccagtatgatattggctgtgagtttgtcatagatggctcttatttttatatgtttcttcaatacctagcctgttgaaggtttttatcataaaggaaaattggactttattgaaggctttttctgcatctattgagattacatggtttttaattttggttctgtttatgtggtgaattatctttatttatttgcttatgttgagccaaccttgcatcccaggaatactgcttgattgctgtgaattaactgtttgctatgcagctggattttgtttggtagtattgtattgaggagtttgtgactatattcattagggatattgatttcttatttcattgtgtctcttccagattttggtatcaggataatgctggctttgtaggatgagttagggaagatttttaaaaatagtttcaggaggattggtaccggttcttctttgtacatctggtagaattcagctataaatgctgagctaagaagctgctatttcagggctctttttggttagtaatttttaaattactgattcaatttcagcatttgttactggtctgttcaggttttcacttcctgcctggttcaatcttgggaggttgtgtgctcccagtaatttatccatttcctccagattttctatgtagcatatacagaggttttcaaaataatctctgaggatctttttttatatttctttgagatattctgtaaatccatctttgtcatttctggttacacttgtacgtatccttctttgttaatctagctagcagtctatcaatcctgtttatgttttcaaaaagcaactcttagtttcattaattttttgtatgaacttttacatgtcaatttcattcagttctttgctgattttagttatttcttctgctagctttggggttggatgttttcctagttcctctaggtatattgttagatcgttaatttgagatcttcctaactccttgatgaaggtgtttagcactgtaaactttccttttaacactgctttagcggcatcccaaagattttggtaagttctgtctctattttccttaattttaaggaagtttttgatttctgtcttaatttcattgctcacccaggatttattcaggagaaaattgtttaatttccatgtttatataggtctgagagatcttcttggtattgatttctacttttattgccctgtcgtccaaaaggatgcttggtagtatttcaatattttgaatttattgagacttgtgttatcaccaagcatgtgtcaatcttagaatatgttctgtgtgcagatgagaagaatgtatattctgtgattgttagatagagtattctgtagatgtctattaggtccaattggttaagtgttgagtttaattctggaatttgatagttttctgcctggatgatctaatgctgtcagtggggtgctgaagtctctgactattaatgtgtggctaatttttttttttaattattattattatactttaagttttagggtacatgtgcacaatgtgcaggttagttactatgtatacatgtgccatgctggtgtgctgcacccattaactcgtcatttagcattaggtatatctcctaaagctatccctcccccctccccagaccccacaacagtccccagagtgtgatgttccccttcctgtgtccacgtgttctcattgttcaattcccacctatgagtgagaatatgtggtgtttggttttttgttcttgcgatagtttactgagaatgatgatttccattttcatctatgtccttacaaaggacatgaactcatcattttttatggctgcatagtattccatggtgtatatgtgccacattttcttaatccagtctatcattgttgggcatttggattggttccaagtctttgctactgtgaatagtggtgtggctaaattttttcacaggtcaagaagaacccattttatgaatctttgtgctccagtgttggatgtgtatatatttaggatagttaagtcttcctgttgaattgaaccacttttcattatgtaatgcccttctttgtccttcctgattgttattggtttcaaatctattctatctgatatgagaatagcagctcccacatttttttttgttttccatttgcatgatagatctttctctacctctttgagcctgtggtgtcattacacgtgagatgcctctcttgaagacaacagacagttggttcttgtcttttttatctagcctgccactctatgccatttaagtggggttttgagaccatttacattcatggatagtattgatatgtgagattttgatcctgttatttcgttagctggttgtttttgtagacttgactgtgtaaatgtcttatgttgtctgtgggctgtgtgcctaagtatgtttttgtggtagcaggttttggtgtttcatctccatgtttagcactcttttaaggacctcttgtaagggtagtctagtgttaatgaattcctttagtacttgcttatctgagaagtattttatttctccttcacttaggaagcttagtttggcaggatatgaatttcatggttggaatttcttttctttaaaaaagctgaaaacaggcccccatcctcttccggctcgtaaggtttccacaagagatgtttttttttttttttttttttgagatggagtctcactctgttgcccaggctggagtgcaatggtgcaatcttggctcactgcaatctccgcgtcccaggttcaagcaattctcctgcctcagcttcccaagtagctgggattacaggtgcacatcaccatgccaagctaatttttgtatttttagtaaagacaaggtttcaccatgttgaccagactggtctcgaactcctgacctgatgtgatccgcctgcctcggtatcccaaagtgcatgggattacaggtgtaagccaccaaactcggtctgcctttttaagatttttttgttgttgttgaacttggtgaatctgatggctatgtgccttggggttggtcatcttgtatactatcttgccagaattctctgtatttcttaaatttgtacgtccaactctctagtgagattggtgaaattttcatggactatatcctctaatgttttccaagttgcttactctctttcctctgtcaggaatgccaatgagttgtagatttggtgtcttcatataaactcatatttctcaagggttttatttttttaaattgtttatttatttttttctttttgtctgacaaagctgacttgaagaacttgtctttaagctctgaaattccttcctcagtttggactattctgctgtaatgcttctgactgcattatgaaattttgctttttttttttttttttttttttttttttttttttttcctgagacagggtctcactctgtggcccaggctagagagcagtggcatgatcacagctcactgcagcctcgacctccctgactcaagtgatcctcttacctcagcctcccaagtagttgggactacaaatgtgcaccaccatacctggctaatttcttgtagagaacaggaggctgacctcaaactcatgggcttaagtgatcctcttgccttggcctcccaaagtgctgggattacaagcatgagccactgtgcctggactattatgaaattcttgaagtaaattcttcaattccagaagttcagttgatttcttctttaaaatagctattttgtcttttagctcttgggctgttttacggaattccttgaataccttggattgggtttcaactttttcctggatcttgatgagctttgttgctacccagattctgaattctctgtctgtccagtagtcattacaatctggttaagaactactgctgatgggttaatgtgtttgtttcggcataaagagacactctgcctttttgaattgccagcgtttcttgcactgattctttttcatgtgtgagggctgatgttcctttaactgtgacataagttgagtatagtcagttggctccatttctgggtgcttgcagagagccaaggctctgtacataatctttatttatgtctggatttttgccttaggtttcacaggtgctgtatgctggcataatgtttttgatgtttcatttgggctgtaatccagtaggtgctccttaagagtggtggctggcagatagcctctaactcagccatgtagctctgttgtattttggcatacgcacagtagtactctgtggtcaggggagagagagctgacaacctcaccaggtttgctcctaggccttggaggagccccttctgatcactggcaccacgtccacattttctttcttaggtgttctgggctatagagctccctaaggcagagactgtggctggtagacaagactataccctttctggaaagcccttcagagggagacatgccctgctcccccaacatcctgagagcccagggatctcacccttttcagtattctgagagggagggcgtcctccccaccccctgcttggggctctgcccaagttaggagcagggtgaagttgaatcctgcccagttaggagcaggatgagtggagtcacccaattcaccatcgaagtgcttcctgggggaacacaaagctctcctaaaccacaggggtttagcaggttttctgtcaagagggagtagagcaatctgtccatctccagcaccatgactgcagcttctgtcagggccatggcacctcaaccaggctgttccagagtccagggcctgggggggtccccacggacttgagtgttgcctctgcaaaaactctgggtagctctctgtatcagtctagaggcccaagggagtcatggggtttttcacattctcaggattgcacaggtcactgtgggaagtatggatcccctgaggactcttactcactaattctatccctgtgttgaggagcttctcctgtcttcatgctggtcccaggcaggcagctgcccagcttcgattttctctgttctccatgtcccattactcccttgatgcatcctgaatcctgacgtggtttcttagatgatccacttagagagtccatgtttactcgtcactatttcctctccacgagagcagtacacactagctcctctagtctgccaccttgaaccctaagtcctacatgtcttttagtagccttctcttcataaagcgaaattttcagaggccaaagggtactaacttctgtggccactggtgtcattttgtgaaactggaaaagcatacttccaagcaacatgtttaccaaaaaaggaaaaagctaatgaaggcaatggataaaaattcaaccagtaatcctcattttatgtaatgttagaattgaaggggataaattagttggttaacgttcttttttacatgtaagaatcttagtttaatgttgcatgttttgagttttgagttttttaaatttattttcgacataatttatttaattggaagtttatataattcttatgagcattttcctaaaggcagaattcaactgagacaattttgattcacaaataattataaaaagtagaaaaacatccattatatgctcttcccagttttccctaatgatagcaccttataaaactatagtattctatcacaaccaggatcctgactttggctacgtaatcacccatctaattcacatttcctcagttttatgtgtgctcctttgtgtgtgtgtttagctctccacaatttattacttacataggtccatgaataaccaccataaagacactccatagctctaacatcacaatgaaccctcatgatgcccttttatacccacatccacctccctctagccagtccccagttggttagttttaataatgatgtgccccattttacaaaatacttcaaaataaattatactaagccaaatatgattttcttttaattgtcattaggaaactggagatgtggtcccttgagcgctcataaacattggagattttaggtctgcagcctctgacctcttctcaatctaaatattcactgcctggatgctctcctcaaagcctatgatcataagcagcatctagtctctgatcttccaagtgtgtatctatagcacgaaactcttgcaggagttccagacttaaatttcccattgcctactcgagtttcagcttatgtgaagacaaggcacattgaaattaacaagcccagaatagaatctcaattttcagctccgtaccccgatcattcatgagtaatgccgtgtgataaatggcatgcctctctaccagttgctcaggcccaaaacctacatgtcatcttcgacttctctctccctcacagtccacatccaatccacctagagtcatgtagagcgaaacctagaaccacatagttgagacctaggcagaccagtatgcagggattttcaggtattatgagtctgtggccaggtctttctctccctttccctcttctgcaccccctctctttctttgggtgtgtgtgtacattacagtgtttctctagccacttcaaagcactatttcaatttgccagtatggttggaaactctgtcacagtgaaaataattatctttctttactgaaccatcagaacttaaataagtggttgtgtgtgcacacacatatacacacacacacacacacacagagatagagagagagagagagaaaaaaaaagaagggaaggggagaagaaataaataaaagcctgaatggacaaaatttaggtctagggcattacaatttaaaatgtttccatgctgttccctaaaaaataaaaaataaaaataaaaaaaaatattgttggctgggcgcggtggctcacgcctctaatcccagcactttgggaggccgaggcaggcggatcacaaggtcaggagatcaagaccatcctggctaacatggtgaaaccacgtctctactaaaaaaaatacaaaaaattagccggacttggcggcgggcgcctgtagtcccagctactctggaggctgaggcagaagaatggcgtgaacccgggaggtggagtttgcagtgagccgagatcacgccactgcactccagcctgggtgacatagcaagactctatctcaaaaaaaaaaaaaaaaaattgttgacccactagatcctagtgccggatttaggctatgagatacataaaataagaatatgtgaactctggggattgtaatagagatcagaggtaaggcttcactctaccaaggcaatttcaccttttaatgtcattttttttttacttttaacttctgatttcaacattttatttaacaatagattactttgctcacagatgtcctttcctggcagataacattttacaggtctttttaaaagggccgttaatccttgatcataacagatacctaatgtgtatctttattatctgcaatgcttctagtttctattatacagataattttgtcacttcaattatcaaaatacttgacaaatatttagttcagaaaatatgcttttattttcctcctgttcattacacagggattactgtttccacattcagaattctctcggttagggaattcttgaattggacctttggaagtctgtaaaacttttgaagttgtgagcaaaattttgtagagatgcatatttttttcccttggggaattatttgaatttcatagcttacttgaggttctcaaaagggtgattaattgaaaagagataaagaaccatgaatcttctgtatgaaagcctctattatttcattctaggaaaggccatatgacttttgatacatcaaccagggaaaacagtcacctcagtcctacacatcttcagacttacacttacagagattttctaaattctttgtaaaggaacactaaaacacagggtcttaataatgttaacctgaatggtccatgattttattaattccatatacatgttttctatacctacagtacagcataccctgttgcaggattttcagtaactacaaaagttgtggctctccaggagttcatatgttacgttaaaaaaaaaaaaagtaaaaatagtaagtaaaacagatatcattatgggtactcaattaggagaaaaatgtttttctggaatgatagcatcaggatggatttgcaaagatagaaatattaaaaatggagaaattgaggccggccgtggtggctcaaacctgtaatcccagcactttgggaagctgaggcaggtggatcacttgaggtcaggagttcgagaccagcctggccaacatggtgaaacctcatctctagtaaaaatacaaaaattagccaggcatggtggtaggcgcctgtaatcccagctactccagagactgaggcaggagaatcacttgaacccaggaggcagaggttgcagtgagccttcatcgcattactgcactccagcctggaaggcacagtgagactccatctcaaaaaaaaaaaaaaaaggagaaattaatgacctaatgtaacagtctattagtcttgccttacaaatatcaaaccctaggctctccttgcccagtcactctcctgttgcatgggagcagctctgggaaataggaaggtcttcgagatcagcaaatctccctttgcagaagtcctagggagaactggaagcctgtgctggcagccaactatcctacaattaagaaaatgttaaacgtagcataaaataactactaagtttcacccaacagctttttttttttttttttacaacttattatattgctcttctagtactttaaaaactatgaacatcaaaaacttgaattcattaaatttacttatatcttaaagaaaaaagatcttttaaaaatgcttttcacagtactgtttagcatcattgccctctctaatatatctgttctctagaaccaagataaatgtccttatgttaacattgtcaatcactaaaaagggggattaataactgtttttccataatcatgtctttgtatatgttaatcctagttaactgcactcttccttctcctactgaaaaaaaatcaattagttctttcacttagtccccacaccaattatgtcatactctttttgagtgaattgcactcttttgttttcttataatatttatctttatcctttattgtgaaaatataagtagattagggtttatgatgttatgcaaatttggtgtcttccctgagattaattcctagctggttcactgtatttatattatctgtaaatctagtgatttgtagataatacattacaataaataatcagcacaaacctaatgctgattccaaaagaatactcttcctaacactttcttgcttaccatatctagcagcccagtgtttcatttggaaatgccaaatatgcatagattttgcaacacggcctcaaaacaatggtcaaaagttttattaagtattagcaaattaatgtaccttatcaataagtgtcaatcctccaccatcacttgaatcaaaaattatttacaataaagatagagcatagctctacccaactgactgtgatcatttctgctgttttctttgctggctccctactctctcagcccacaaacacatgagctctgtcctcagctgttctaggcttcagagtgtctgcagtaatttctcaatgcaatgtcatacatcagaacacagctgggcctctcgctttgagtttcagctttgcacttccaactgaaggccaggtctttgctttcaagcatctcacaatgacctcaaactaaaactgaactgattttatcacccattcctcaatatggttcccctatttctgcatatgattctcattacccttgattaggtgaaaatttctgagggggcagagggaagagaaaggagggagaaggagagggagaaaaaggaggggaagagggagagggatgaggaaggagggaaggggagatgaaaagagtgaggggaggaagcaagtgaagaagaatataaaaccatggacttggcacggtagcttatgcctataatcccagcattttaggaggccgaggtgggtagattgcttgaggccaggagttggagaccagcttgggcaacatggcaaaacccctctctactaaaaatgaaaaattaaccaggtgtggtagctcatgcctgtaatcccatgtactccagaggctgaggcatgaggcggagattgcagtgagccaagatggcgccactgcactccagcctgggcaacagaggtagactctgtctcgaaagaaaagaaaggaaggaaggaatgaaggaaggaaggaaggaaggaacaaacgaaggaaaagaatataagactatgaataagagagaatgaccaccaaacatcaaacacttcaaacactttagcctaacattcgggacttcccacattctatagcaatctacctttctagcctcttggataattgcattatctacacatacagatttatccattatttaccaaacatgttacattttctgaatcatgtatttctcttgcctgggatcctttttttcactaccttcattgtccaggtcaatctccaaatcttcttggaagatgacaaaccaattacttaacaacaaagcaggtactatctgatgacacagccttcatagttgtcttactgtgcaacttttcaggtatttatgagctttatatatttcaccttaccctaatgatagaaataacacaaattcacttctaatggtgaacgacttgcgttaattttattccaaaacagagtaattccacctgtatttgaaaggttcttggactccaatatcccctctgtgttgacccattttccaagaggcagccccctcaaaaacaaaaataaaaactggtcctttttcttaatcattgagaattagctaacaactataaggtaactaatgttctttttgtaatttcatacaacaaaaagaacataaggaaatgaagtcattcccaaactctcaagagcaacacattccctgtgtgaagttatgtatgaaagaatcaggtaccattctgtctgccagatacaaagcttttaaagaactctcttatagctaccttctaaattatgcattaaaaaatctgactcacaaatagcagtttttcatggattcttgtagaacagttataagggtcttaaaaatgcatttcccaaatcacattttcctttgaaaacttagaacagggaaaagatgaatgagttaattagatataaaattaccctatgtgaactgaactaaactatattaaataatggatcaaaatgttcaaaggcaagaacataagaagtttaacctcatacataaaaaccgtgggacttctataacctagagaatatgcatatatattaagtatatatatacacatatatgtatatacataagtatatatatacgctaagtatatatatacacacatgtacatgtgtgtatacatgtacatatatacacacatatgtacatatatacacatatgtacatgtgtgtatacatgtacatatatacacacatgtacatgtgtgtgtatacatgtacatgtatacacacatatgtacatgtgtgtgtatatatgtacatatacacacatgtatatgtgtgtatatatgtatatatacacacacatatgtatatatgtgtatatatgtatatatatttagcgtatatatatataagtatatatatacttatatatatataagtatatatatatacttatatatatacttagagaatatatatgcatattctctaggctatagagattatatatatatatacacacacactaagatacatatatctctactctaagatacatatatctctaagatatatatatatatatatatatatcttgggattttgctcttagttagatccactggaaaaaaactgcggtaataaagaacaagttcactgtgcttactgtgaatatcactgccccctgctatatatatgagatatatataaacatgaagatatatatatgtatatatataaaacaacagcaataatgtggcaaatttttgcatgtaatgaaatattctttagtatttcatttggtattaacatttcatcttctggaaaaaaggaatgagctattattttaaaataattatttactaactatacttatctcaataaaatagttgaatctgtattcacattaatagtgaataatgctgagattaaaggagtttatcattaagtaaagtaacaaagacactatcacttttccaaaactttcccagagcagatttgaactcgagtttcaacataataagagttcaatttatacagcacttgcataccaaaaactgtcctaaatttttataaacattatctcatttgaacctcagagccatgtctcgtcctcatctttcattctttcatttactatatgtaagtgcccaacaataggaaacacaagtaacattactgtacatatggtacaacagtacaagcattaatatttatttgatgtttaagttgttaaaatgccgtcaaagaggcatatgtaaacatcaatgcaaagtacaatatgacaggcttttgggttataatggggaaactgtaagctcttcatacattttttctctcccccagtataacaaaagtgaacagacacaggggcaggaaggctttctgaaggaggtggaatttttcatgggtcatgaagaatggagaagtaggaattccaaatgaagagaataacgtgaggtaaaattaaaatccaagaaaatacatggtgtgaactaggaacagcgagtaattcactttatctagaacacagactataaagaatcgttacatgagaaggaacagttgaaatgcagatggggccacactgaacaccacaactgctgaaagcttaaccaaggagtataaatttcatttttttccctatattcaaagttcagtcatgatgagatcaggaaggtgcttcaatgatgtttatctaaaaacaaaagtatgtaggattagaaggagaaagtaggtaagagattactgtcatgctccctatgtgagataatgaagtctccagctatggcaattgctatgaaataagacaagagtagcagataatgtagtattatagaggaaacagcagtatggagtaattcagttggaaaggcaataaaaaaggaagggcttgtgattatgagtcagaaaggtgaatatgacattaatagaagaactaggtattggatgaaaaagaaagtgacatttaaatctactgaatttcagaagtttcatatccatcagtttaccatgggtttaagtgacacagtgcgaaacgaggaattgatctacctaaaaaaggtggatagcagggggcagtggtattcacagtaagcgcagtgaacttgttcttttttactacagtttttttttccagtggatctaactaagagcaaaatcccaatatgttctaaattctcaaactctacaaggtagtgaacctatctatatttttcaaatcctattgctcttcatatctgaccatgtatacagagagtacacaaacttttgaccattgttcatagactgagatttaagccttgttcatcatatatcagaatcatgaaaatactttgcacgtaggcaatgaagtagttttagacatttaatagtaataatagaagtctttctgccagtttgtaacaaaaagctagaagtaatcattgtcatctattacataagtaatattctgctaagataacatcagttggccctgctccatctaaggtgattagggaaaatggaagcatttaacttttttctagtttaaagcaaagataatttaagatattttgaaccaagaagatattaatcagataaaacgcattaaatatcactgatactattttgtgagtatacataaacacttttgccacagccttttcaaaatgctttaaaaaaagctttatatgaaaaatgagaagctgtgctaatcagaacaaataaacaattaaaaacaaagtctaatgctatgagcctgacatatagtgtcaaataaattttttaaaataaatgattcaatgtactgtatagaaggaatttattgaatatataatgttctttgttactggctgattttctgaagcttttcatcttaactatttccttaccttgttagttcttctctaaacccacctcaataaggtttgctctcaaccatccaaggagtctgcccttatcaaagtcaatagtgttttccaacttgacaaatccaaaggttacttcgttgtcatcttaccagacttggtaagcaggtggcatagagattagctttctcctccttgaaatggcttctcttggattccctgatgcctcactctctagttcttctcccaccccactgtttctttcctcttggtacaacctctaaatccttgtgtccacagaactctgtcctgggctccttttctccttgagctctagaccctcccaaagggttctgaagatgtcccatggtttaaaatactaatgttatctaaatgattcccaaatctgttaaaattaaaatttaaacagattaaaattccagacttctataaccaggcatcacctgcaatctcgacatggacaatcaatatttgacttcagcatacacaaaacagaacccttgatcccctctgcccaccccgccaaaataatgttgcttcacaagaagaggaaccgtcatacaccaagagcctagaaaagtgcccgagtagaacgggcactgtgttaaaacaaaaataccctaatcagagaagccacatcatactatgcttaatataaaagctccagcaggtaaacactgacaatccctagatcctgccagaaattccgacacttttatcttgtccctttagagagtaggtagttcagtgttttgacccaggccatagttctcaagtgtgggagcacagtggaattccaaaggacaatacagagtgcagacccaagaggatgcaaaaacagtctcgtagatgaagtccagcagcctaagaacttcataggcaacacagaggtaaaaccaggcccacaagcaaaagatctacagcagaacaatgcgtagtgcttggagagattacctgaagggctaatatgtagttcctgttcattttaaacaacactggcccatgcccacagtagggtgaggctacctgcaattcattcttcagatcacagagaaggagctttccagaccctcaatttgttccagtcattcctttgcttataccccaacagtgttctctaccacaaggtaaattccaagctctttgatctagtatataaggccctaaatattcaaatcatttcctaactttttagcctcttcggctactccagcaacacacaccatacctccctaacagattccaatccatttcatgatcctcatgcctttgtaaaagctgttttctccctcatggttaattttgtgttcatcatccaaaactcagaattactgttttcttaaaacctttattaaacttcaattaaatgtccaagaaagaattgggttcccacactcccaaaccagctctatttcctggcacccaactagactgttcccagcttcccctacattagatgtgaccacaggacaaagtcctcagatgggatgtcaggccagtggtcctcaattctcactgtgcaccagcattatatgggaaaattataaaaaagaggcattgggcctgacctccacagaccatttcacttagtctgaggtgaggcccaagtattaaagctcttctattcattctaatgtgcatacaaagttggagagcactaaagaaatccatgccaactatccaatataaatgaagatgctgccacccatgtgctcctgctgtacagtatacatactcccagtaatgcactgatcaactataccattacatttcatacatctatatgatttatacatctataccatttataaaactatacaattttatacatctgtctactgaccacatattaatgccttgagggaaggaatcaaatcttgtcatttatgtattttcactgcttaacctagtaactgacatttttcttaagtattcaatgatttttttttttttttttttttttttttttgagagagtctcactttgtccagcgcaggctggagtgcagtggtgtgatctcggctcactgcaacctctgcctcttgggttcagcaattctcctgcctcagcctcccgagtagctgggattacatgcgcgtgccaccacacctggctaatttttttgtatttttagtagagacaggtttcaccatgttggccaggctggtctggaactcccgacctcaagtgatccacccacctcaggctcccaaagtgctgggattacaggtgtgagctactacgcccggccaatgaacatttttgaataaataaaagaaaaaatatatatcaaatatataattttaaatttgttagaatattttcattaaacaaccatgaaaaataaagatacagttgcttattatgcttgaaacagtacacccatataatcctttcttatttattagtagttgagaatagactttgaagtacttcagcaaaaacactttctttttagtattactaccacaaagatgtgatctctttgtaaagctgtgttctcttatttttaaaaagtggaaagttgggataactttctaatttccatggagcagaattagataaagtagaaaaatctaaaaataaatacaggaatgtctaaaggtaatctatattcattatctagggagatgctggagaaagcaaagacaaattcaacaaaacattttagcagaaaccttattttagaatattcttatgtaactcttccacatgtaagccaaaggtaagaaacaaaataatccacagccaaatggagcaacactaataaagcctataatttaatttgttaggaatatgttaaaattacactgacaatttaaaaatttttgagagcggaaacttaattctaccagagactcaaattcattttagtaaaattaaatccatccaatttacattatgatacatttatttaccaaaaatttaacacatatataaatattatggccactccaatgattaatttcagaatttcaaaaattctataacaatctaactattcttaagatcttgtttttcccttgctgcatccccaaacacaaatctgccatttaatacatttacttaaatattctcctcaaatgttttgagattttaaattatatatatatgagaaaaatatactcctccctaattttcattaccatggcatttatttttctattttgaagtcatttttgaaagtcattttgaaaggtatccaatgtaactgtcagtagaatgtgctattatttctgctgaagtagacacattactgtatgttaaatgaaacctattatcaatcacaggctactagttggaaaaaaaaaaaaaaagaagacagtggtggaagtcagtctccagtttcctttggggattcacatttctctccctgttttctttctgcacatgttgaatgaagatgtccaaaatggttaatgcctcatggctcctggacttctaggggaagacacccacggtgaccacagcaactgcctatttattgatttctttaaactcttagactcaaagcacttaatctccaaagcaaaaacttctagggaaaagaaatcataaacttgaagcctactttttaaccattcacaaatatttctgcttatcccttacaaatacccaaacagttctgtgatgttacttaacatgggtggtgtagtcttcagacatgaagaatttgagtgggaggagggataagtgaacaagatctcagttaactttgctttgacactcgggtaaatctgggtgagtcgctttcttcagttaatggaatgagattataaaagattaatgaaagctgcttttggcagaaaagagcagggtctagatagctataaaatttagttacttaatcattttaagagacaaatatagaagttaaaggaaaattataggagtagatatggtactatgtatcccactcttcagactctgttcatttaggattacatgcctctctatagtccataaggtgcttacctacctctgttaatatctcaaatacagccccatctcctgctcatactccagtagtcaacgatgtgaagttccccaaaaagccatgcatttcatgcctgcattctttgcatgtgcctgtccctctgcccagaacaccttagcatctactcattttggagaacctcttcatgatgtatccagaaccagagattaaccacaccactatagcatttacaacagcatttttttctataaaccttgcaaaaatctaggttttatctgtctctaggttcctattatttaacacaatgcctagtgaaaactctctctctctctctacatatatatatatgctctgcatgattatagataatgggttaactaattaatttgaacatactgcattaccttatgtcttatttaaaaataacttttcataaacacatttgttttaggaaaggcagttgattaactggtaccacttaagtaacagcattttcatttaaaaaagtgaaataaaattattctaagactatcaaatatacagttttaatattatataacattgtttctctaaaagaatatatatatttgaaattaactgcatttccttaaaatattccaaaattaaactttccactgacagattattcttccttcactcctgttcctttttataatatcctgattcaattaaatcacagctaacaatttcagattcttgtactgttatgccactcattttagactgtacatgttgatctttacttttttcttaatattttgttctatgaatgcgcaccactgcagatacattgttctcaaatcaaagaatccaaagtatgaaattttattagcacaatagctaatctaggtgctacttacattgtttttattcttttttatgttttcttgataacaataacaatttgtctttctattatccctaatttcatatcttaactatggtatgtgctatcttctatcttagtgttttaaaagtttccttcatgccttaatgttgataattaatatgttactggctctgactcaaagtaatgtaaatagcctttttcagaagagagtttcctgtttttccactcctgatgctaatcctgaagctctggaacaaaggatattaccaaacgatggccatcgatgtcatgtggcagccctggcaaggctcccttcccattcgtgtcctttccttcttgagttgccagagattgcctggctgctgccatcctgcacatttcaccagaacagccctcgatcctgagcttctgactcttaagcaagcaacatctttgagattttctagatttgtgctgccaaaaacaaggggccacacaagggtaaacacatacagaagtgacactgttacagttaggagaagtctcaaagcttttcctgaaacatggagaaggtggggtaaatctcacagacatacacctgagccaggttccagcagctccattggctttagatcctacctgcctccccaaggcctgctcttctatttctcttctcaggctattcctttctataaagaacaggctagtttctgtgatttctattgctttgccttatcttttctttttaacctttgttggaatataacaaaagaaaaaatatacaggcgtacatcattttattgagtttctctttattgcactttgcagatattatggtttttttacacattgaaggtctgtggcaatcctgagtcaagcaagtctataggtgctatttttccaacagcatgtgctcacttctgtgtctcattttgataattctcacaacatttcaaactctttcattgttattatatctgttaaggtgatctgtgatccgtgatctttgatgtcactattggaactgttttgaggcaccatgaactgctcccatacgagacaacaaattcattcaataaatgttatgtgtgttctgacagaccagccacttcctcatttctttccctccgctcagccctgcctattccctaaaacacactaacattgaaaataggccaattaataacccaataatggcttgtaagtgttcaagtgaaatgaagagtcgcatatctctcattttaagtcaaaagctagaaaggattaagcttagaaaggcatgtcataagaagagacgggtcaaatgctaggcctcttgcaccaaacagccaaattgaaggctatgagaaaggtaaggaaggtgtagaagaaaagtttgaagctaggagaagttggttcatgaggaaaaaggcaataagccatctccataacatggaaatgcaaggtgaagcagcaagtgctgatgtagaagctgcagtaagttatccagaagatctagctaagatcattgatgaaagtgactacactaaacaacatattttaatgtagatgaaacagctttgtgtcagaagatgccatctagggttttcatagctactgagaagaagtcaatgcctggtttcaaagctgcaaaggacaggctgactctcttgttagtggctaatgaagctggtgagtttaggttgaagctaatgctcacttactattctgaaaacatgagggatttgaagaatcatgctaaatctactttgctagtgctccataaatggaacaacaaagcctggatgacagcacatatgtttccagcatggtatactgaatattgagacttctaagaaaataaagattcctttcaaaatagtattgctcattgacaatgcacttagtaacccaagggttctgatagagatgtacaagaagattcacattgatttcatgcctgctaacataagatccattctgcagctcattaaccaagaaggaattttgactttcgagtcttattatttaagaaatacagtttgtaaagctatagctaccacagatagtgatggattagagcaaagtaaatggaaaactttctggaaaggatcaccattctagatgccattaacacacttgtgattcaagggaggaagttaaaatgtcaacatgaacaggcatttggaagaagttgattccaatcctcacagacgactttgagggattcaagacttcagtaaaggaagtaactggagatgttctagaaatagcaaaagaattagaaacagaagtggagcctaaagatgtgactaaattgctgaagtctcatgataaaacttgaatggatgaggtattgcttcttatggacgaacaaagaaagttgtgtcttgaagtgaaatctaatcctagtgaagatgctgtgaacactgttgaaatgataaaggatttagaatatttatataaacgtagctgataaagcagtggcagggtatgagaggactaattccaattttgaaaaatgttcttctgtgggtaaaatactatcaaacagtatcacatactattcagaaatcttttgtgaaaagaagagtgaatcgctatgcaaatttcattgttgtcttatttaaagaaactaatatagccaacctagtcattaagcagccatccacatcaaggcgagaccctctaccagcaaaaagattatgacttgctgaaggctcaaatgcttggtagcattttttaaaacaagaaagtatttttaaattaagatacataggttattttttaaacataattctattatacccctaatagaccacagtacagtaaaacataaattttatatgcagtgtgaaataaaaaaaaattgtgtgacctgctttattgcaatattcactttgtggcagtggtctggaactggacccacaatatctccaaggtatgcttgcatagcattcaggaaaaaaaaagtgtcttggttgctttctaaacaatttattttcataatttctgtaaaataattattattatatgtccttatttacaggggtactctttataatttctttttgttttaaaatcaatcaaaaataatcctcaagcttttctttcaaatctcagaactgaaagaaactatagttttagttcagacatataaagagcttggaagtcatcactcccatcctcagaataaaaagttgggcaagctgcaaatcattgacttttcttggacttctcagagaactgagtgtgcaggggaaaccactaaccaaaatctagaaagatgggcaaatccagaaagacacagcacttggagcagaagctgctgtatgccatgagtggtaggaatatttacttgtctagtaattttgaaaaattactataagctgggtgcagagagtaagaaattcctggagccacaatcataaagaggctcccaaactttgctggactttcctttcagttaccccacaaagttctaatagtgaggatccaaaaaagatccctgtatggccatggcagaaaaaagggggagaaagccattgttcaatctcccagatccttctctctagcaaaagcagaaaggttttgcctgagggaaacactgaaaacttatcccaggtggaagaagagaataccaccccactccagccctcttgactcacgtactgaaaagcaaaaacaaaaaacagagagaacaggagacaggacttcaaaaaaagagactgggaagctgcatccagggaagagaatgaagaatatggtagtaggagggagcaatcctcctagaccagggacagaaacacttatgaaggttacaggtccactaaaagactgagatttaatcagattagaggacactccatctctccaacactttaccacaataccaacacagctctaggatgacaagagtggattggtgacagctaaaagagctgcaggatgtagactttccctggggcagagtccttagggaagcccagtcaaaaggggagacaaaaacaaggatactggaggaagctgaagtttctcttttgctgtgcagaagatctttagtttaattagatcccatttgtcaattttggcttttgacgccattgcttctggtgttttagacatgaagtccttgcccatgcctatgtcctgaatggtattgcctaggttttcttctagggtttttatggttttaggtctaacacttaagtctttaatccatctggaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtttatgtgtggtattatttctgaggactctgctctgttccataggtctatatctctgttttggtaccagtaccatgctgttttggttactgtagccttgtagtatagtttgaaatcaggtagcgtgatgcctccagctttgttcttttggcttaggattgtcttggcaatgcaggctcttttttggttccatatgaactttaaagtagtgctttccgattctgtgaagaaagtcattggtagcttgatggggatggcattgaatctataaattaccttgggcattatggccattttcacgatattgattcttctatccatgagcatggaatgttcttccatttgtttgtgtcctctttttatttcgttgagcagtggtttgtagttctccttgaagaggtccttcacatcccttgtaagttggattcctaggtattttgttctctttgaagcaattgtgaataggagttcatttgtgatttggctctctgtttgtctgttattggtgtataagaatgcttgtgatttttgcacattgattttgtatcctgagattttgctgaaattgtttatcagcttaaggagatttggggctgagatgatggggttttctaaatatacaatcatgtcatctgcaaacagggacaatttgacttcctcttttcctaattgaataccctttctttctttctcctgcctgattgccctggccagaacttccaacactatgttgaataggagtggtgagagagggcatccctgtcttgtgccagttttcaaagggaatgcttacactttttgcccattacagaagctgccatcagagtgaacaggcaacctacagaatgggagaaaatttttgcaatctactcatctgataaagggctaatatccagaatctacaaagaactcaaacaaatttacaagaaaaaaacaaacaaccccatcaaaaagtgggcaaaggatatgaacagacacttctcaaaagaagacatttatgcagccaacagacatatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtgaaagacagtgtggcaattcctcaaggatctagaactagaaataccattcgaccagccatcccattactgggtatatacccaaaggattagaaatcatgctgctataaagatacaggcacagtatgtttattgaggcactattcacaatagcaaagacttggaaccaacccaaatgtcaatgatagactggattaagaaaatgtggcacatatacaccatggaaatactatgcagccgtaaaaaaggatgagttaatgtcctttgtagggacatggatgaagctggaaaccatcattctcagcaaactatcgcaaggacagaaaaccaaacaccacatgttctcactcataggtgggaattgaacaatgagaacacgtggacacaggaaggggaacgaaacacactgggccctttgtggtgtggacgagtggggaggggatagcattaggagatatacctaatgtaaatgatgagttaatgggtgcagcacaccaacatggcacatgtatacatatgtaactaacctgcacgttgtgcacatgtaccctagaacttaaagtataataaaaaaattaaaaataaggagatttaataatatgtaaaaaaaaaagtttctcgtacttatggctacaagaaacactaaacattaagcacagctcaactcctactcagattaacataaatatttatatgaaagccttagttacctcagttctcagttctcattacctaatatatctggcttacaacaaaaaattatgaagcatgtcaaaagcacaaaaccaaaagaaacacaatctggagagataaagcaagcatctgaactagattcagatacgagacagatgttagaattatcaaacaaggaatttagattactattattaataggctaagggccctaatgtaaaaagttgaaaacatgcaaaaacaatgcataataaaagcaggagacggaaactaccaaaaaatcaaaaggaaatgctagacataaaaaaaaaaaaaaaacaccgtggaaaaaaatgaagaatgcctttgataggctcattagtggatttgacattgctgaggaaagaatcagtgagcttgaagacatgtcaataaaaacttcccaaactgaaatacaaagagaaaaagagttgaacaaacagaacggacatcccaggactgtgggataacatgggtaacagaaacatgggtgacataaacatatctagaataccagaaaaagaataaagaggggataggacagaaggaatatttgaagtaataacagcagtgaactttccaaaattaataatagacactgacccacagatacaggaagctcagaaaaacaccaagcaaaagaaatacacacaagcacacacacccctagacacagcatattcgaattgcagaaaaatgaaagaaggaaaaactcttgaaggaagccataagggggaaaataacaccttacctctaaagagtaaaggataagaactacattaaactcatcagaaatcatgcaaacaaaaagacagtgtggtgaaattttcagagcgctgaaagagaaaaaaaaatctaacagataattctatatccagtgaaattatactttaaatgcaaagaagaaacaaggactttctcaaacaaaaactgagagactgcatcaccactagtcttggcctacaagacatgataaaagttcttcagagataaggaaaataatatcagtaagaaatttgaatctacataaagaaatgaaagagcatcagaggaggaataaatgaaggtaaaatacatataatcttttatttttcttatttttaattgagctaaaagataactgttcaaagcaataatagaaagaatatattgggggttatagcatattataaatgaagtgaatgacagcaatgccacaagggatgcgaggaaggaattggatatactctattatggagtagctgcagtacacatgaagccttatagtatagtgttatctgatggtaggcttagattatttaaaaatatgtattttaaactctaggagaatcaccaaaattttgtttcgttttttaaaaaaatgtataagcagtacaccaaaagacacaaaatggaattcatataaagtgttcaatcaaaattacagaaggcacaaaaactaggggagggcaaagaacaaatgcatcaagtggtaaaagctacaaagattttaaaatttaatccaactacattagtaatcaccttaaatatgaatggcctaaacatacccattaaaagaccaagatgatcagtctggatttaaaaaaaaaaaaagaaaacttgggccaagcgctgtggctcacacctgtaatcccagcactttgggaggccgaggcgggcggatcatgaggtcaggagatcgagaccatccctgccaacatggtgaaaccccatctctactaaaaatacaaaaattagccaggcatggtggtgtggtgcctgtaatcccagctacttgggaggctgaggcagaagaatcacctgaacccgggaggtggaggttgcagtaagttgagatcacaccactgccctccagcctggacaacagaggaagacttcgtctcggaaaaaaaagaaaaacttcaagacccaattgcacactgtctacaaaacatccactttaaaaataaagacttatgttaaaagtaaacagatggagaaagagataccatgttaaccttaataaaaagaaagctggagtggctgtattagcttaagacaatgtagatttcagaaaaaggaaaataatcagggataaaaaggaatactacatcacgataaaggagtcaattctacaataaaacataacaatcctactacaaatatatgtacctaatagagtatcaaaatatatgagacaaatactgatagaactgaaaggacaaataaacaaaactgctattttttattgttgttcaggccaactctgagcaaggacaaagccactgctacagttggagatctgaattgcaagtaggtttcaaatcacagaagactaaaaccagggtgcccacagtccagctgattctctagtaggcagacaacttaaacatattttaagttaataacataaactcataggaacatggaaatatattttataaccttgtaacatctagtatattctaatccatatgtaataactcatttagaggtcttataatatctttgtgttttaaaatcaataaaaaataatccataagcttttctttcaaatctcagaactgaaaggaattatagctttaactgagacatataaagagcttgaaagtcatcactcccatcctcagaataaaaagctgggcaagctgcaaataaatgacttttcttggacttatcaagtcttatcttatatagactttagccactacagaggaaaaaatatgttttttcgctcaacttggattccctaatacctacagaggttttggacttgaataaagctcaacaaatatctactgaatgtctgaatctgagttttcccactaaattatgttaatcaacatttatttgtacaagtgagctactgtttcactaaaaatacaaagttccagttgaagttatctttcaaatagaagattttggttttatagtcttcttccactattatcaaataactacctggtttaataaaacaatgaaatcaattacagtgagtacacaaattgttcacagggttaaagtgcctcagtgatttactattaactctattaatttgttgacttgaaatgatccacaaattaccaatgcaaagtaaccaatatggatataacacagaaattcagagaagatttgcaaaaagattaaaaacaaacatgtatattatagaagtgtaactcttaaggtaacacaaaaatttttaagtgtcagaattttatcaatttaagttttatattagggcatagttaaataatttataccctcaacataaacaaacaaaatgcaaatatagaaggactacattattagacaaatcattgggtctaaaaaatgaaaaatgtgaaacatgattttatacctccttccctgcttttttttttttttttttttaagacgagtcttactttgtcaccaggctggagtgcagtggcacgatctcagctcactgcaacctccgcctcccaggttcaagcaattctcctgcctcagcctcctgagtagctgggactacaggcatgcaccaccacgcccagctaatttttctatttttagtagaaaccaggtttcaccatgttgcccacgatggtctcaatctcctgacctcactatctgcccgcctcagcctcccaaagcattgggttacaggcgtgagccaccatgcctggcctttatcccatttttgtatgtataactagaataacaactgaagagaaaatataatattcactctgtcatctctttaaattacatagttcaactatcatcctcaatttatttcaatctggatgagttaaataaaaaaatttgaaatttaattacttccatacaactcagaagaccagcatcatatctttataaaatattattttgcagtgagaaatacctatttattataatttgccaagcttcttcagataggagatgattttccttttactctacatggcatggcccattaatacctaataggcacaaatctaatgtcctacagtaggacacatggggatgattacttactggataagaagtactgatattcttctccttctaccaaatacttttttcaaaacttctctcaaatatcactatgtgatctattcaaattcaattttgctcaactttccaagtaaagtgattatagcaagtaaaggacatcttcataggcttgtaaatacttcatgttcattccacgagtcagacaggggaagggaaaatatcagagaccacttacctgacatgcattataaaggagctggtgttccagttttttaatacccagaatctgctgaaacatttcatagagttgttccttgctcagaataagttcagacactgcacttagggccattctatttggctgtttgcacaagtcctcttcacctctgtaaatggcatcatatttggctatccatgagctcaacactgtctctttgctcaagccatctatttctggcaaactccgcacacgtttttctatgtttttcttaaatacttctctgaagtcattagcagaacaccctccactctgtaccattctggccactcggtcactctttagaaaaacctgaaaacaaaacaaaacaaaacaaaacaaaaaacaattacaattaggtgtagatgctaacaccacttgctttcagcaatccagccagagtttctacaaatatttcagccaaatactccacaatgattcaaaatgttttataatacatggtaactaatgtcataatgttggccccaaatctctctaaaattttaaaatgtgtaggagacacagtatacagtaaaaaataccagtaagatggtttactttgacctgtatgtctcccacctctacaacgaaatcctttagagtgatgtccttatgaatgtgattcgtgctcttatacacagactccagaactctctcatgccttccaccacatgtgttcagagtgaaaggacagctgtctgtgaatcaggaagcaggtcctcacagacaccaaattggctaacaccctgattttggacttcccaagcctccagaactgtaagaaataaatgaccattgtttataagcaaaaaaaaaaaaaaaaaaaaagatgattaggaaaacaactggagatatgaacccaacatccatacctgtgtctgagagttctagctggtttttcagcagggaaagaatcatgtattatttgagtgtggacttgaagatcaacagtagggtaagtctaatatccaagtcaatattcatcatatgtaatttttactcaaaattgcccaacagctggggggctagaatatacctgtccccatccctgattttaccacctctgcaacttctcacacacttatcataactagaaagaatggaggcttggaaagcaatacctctaagggacttctaattgtccattactactggaaaataaaataaaataaaaacaacaatagagacaaccatagagtaagatgttcatgagacaggtagcaagggttgggtaaaaataagtacagtaataaggtcatatttgggaagagacaccagagatttggccttaaatctctctgttctgctaagttatgtatctaagtatcagttaagattcattaaacttctgttatgctgtcaatattcctaagaatcctccataagccatataagactgcttttattcttgctttattctttctatgatgtcaaaagactctcccagaaaagcctgcaggacaatttaatagaacctccataaattatatgctgttattgagcttacagaacaaaaattcaagtcaacttttttttcttttttttgaaacagggtctcactctgtggcccaggctggagcccagtgacacaatcacagctcactgcagccttgacatcccaggctcaagcaatcctcccacctcagcctcccaagtagctgggacctgcaaacacacaccatcatgcctgggctagtttttgtattttttttttttttttttgtagatatggggtctcatttatatgactcaggctggtctcaaactcctaggctcaggcaatcctcctgccttggactcccaaagtgctaggattacaggcatgagccaccacacctggcctcaacttttaccctaagaactgactcattatagtgaagtactcccaagttatgatcatactacttgcaccacacttccacgcctgtctgcatgtgggcaagcagcacacctgcttgatacagtcaaagtggactcacttgaaccactggggctggcatgctcaaccacctgaccccaagccttttcccaccactttagttctccctcttaaggtcactcacacaaactgtttttcttgtttcctatctttactcaatggcaagaagattcctggagctcaaatatttcggctgacagacttccgtactgaaacactggtagtaaattctgcattgtcaaataagatgctcctcaaactacaatgaggttatgtcctaataagcctgtcataagttaaaaatatcatgtcaaaaatgcatttaatacacctaacttacctgaaacatgctcaaaacacttacattagcctgcagttgggcaaaatcatctaatgcaaagcttactttatgataaagtgttgaacatctcatgtaatttgtcaaatattatactgagtatgaaaagcaggacggctgtataggcagtcaaaatatggtttccactgagttatatcacttttgtaccattgtaaagttgaaaaatcataagcagaactgtcatgagtcagggatcctctgcatgtgtaacacattcccaaaatgcttcctctctctttaccagctctggctcaattacttactattggaaagtctccctgtcttattttttatgtttttaaggcaacacaaattaattcttaagtgacaggtatatgcatagtgctttaaatattcatgtatcaaagacaatgaaattgagatgtttaacaatatgttttgtctaagaatgacaagagctacttcagaactcagatgtgtctctacctcccttctcaacctcatctaatcactcattgagcagtgacatttaacatacataaattgtatatttataacctgcataagtatttatatgcaatttaaaattatattcacaaatattagaagtatttacacatatgaccttatatattacattatatacacacaattttggtctatctgtaccctaatttctgcaaaagttgtatctcaaggtggaactcagggaagctcagtagttaaaaggatggactctgccagctgtcagtctgttgcttttcagctccatttccacctttccattgccctacctgtgtctgctaacactttttttttttttttgagatggagtcttgctctgtcacccaggctggagtgcaatggcaccatgtcggttcactgcaaactccacttcccaggttcaggcaattctgctgcctcagcctcctgagtagctgggactactggcacgtgccaccatggccggctaatttttatatttttagtagagacagggtttcaccatgttggccaggctggtctcaaactcctgacctcatgattcacccacctcagcctcccaaagtgctgggattacaggtatgagtcaccacgcccagccagctaacacaattttaagcaacatcggtagaggctgccggaggacgtacactggaagaaaaagggctcttcttcctggttctcttcttacctgaaggcatgtggcagcaacccgtgggcagcttttctccagacccctgagaatggtctcccaatgtaccattcccactggcagattcccagtgagttctgcagtgtggcaccccactgtggacagcttccccctagaaccccagaaggccaatcccctgcaagtctccctgcaacacttcggtgaactactctgccatgcagtaagacacacctactccagtgaggtctggatcccagccctgggggagggggtgcctctttgggtactctgctccttatttctgctactcctatattctttagagttttctttacccatactaaccaatttgttattgtttatattaagcgttccctgttcaattattgtgtgttctctgtcttcacagtgcactctaactgatacaaaaatactgaagagctgcaagattgtccctataggaaaatattctaagtcaaaacaaccacctttgagaaatttagtaatgtatgtatagtttgaccagcaagatataagtgaagtatgaatatcttaggagggacatcagaaaaccctttaattgcttaatttctaatatgctaagttggcagacattttgtattttccaagttcttctgcctaacagagtcagagctagattccaccaagtaaccaaatcacatttttgaaacaaggacaccaagaaacttacatttttgaactcatttcccctacaaaaccatacctgaagccatactcaatccaattagatgtaatgtaatcaacatttagtgtcaacaacatttcagggattctgctaagtgttgggggcacaatgagaaatgaaccaaagaccttgccctcaatcagtcacagcacctgagagagacaggatacacatgcaaatataatagggcgacagcagcaatggaaacccacacagagggagaaaaggcaaaagaaaagaagttattaactctgctggggggccagagtaagagaggagaggagcacagggcagagacaagggacccatgttttgaataacccatgagctgtgtgagaaggaaagagagaaaaaaaaggatacttcaagaaaaagaaaataaaagaacaacagcaataaagcacaaaagaataacactgcaaggccatttgagggaaatacaaggactttcatactagcagggacattcactataagagtgggggccacgtggggggagggaggactctgggctgtatctggtgatgcagaggtcaagggtagctgggtagccaaggtgctaaaatggttagaagcatacgttaggtaattggtggcagcaccaagggtagacaacaagtgaccagagcagacactgggacatcagttatcacatgaacacaacagacctggtggaaaacaataagggctaggactaggctagagagaaaagtggagttaaagaggatttgggaaatagaatgaatgtgtcttggtaatttacaaaatgtggaaatataagagagggaaaattggaaaattccatttttttttactggggtgtctagattccactaaccaaaaataaagaatataggtggaagcccatgtgtgtgcatttgtatatggtggtgaatgttgggagagtcatggaaaatccatttagtttcggtacaggtcaggtttggagacaaagtatggttaaaaaaaaaaaaaaaacaaaaacaaactgaaagagtcaagacaaaatcttctgaaatgcctacattttaaaatttggcaaaataactggatccacggcaggttggtggtgtcagagtagactgctagtaaaaaatatggatttactagcagtcaagagaggagacggtttcagaataagagagacagagacagtctcagtcaagataagagagatagagacagtcccactggccttttaaaaacctccctttgtccatctcatcatgagagagagacagagagagaaatagagaattatcaagtaccataagagaaatcaggtcaaatgaagagagatttgctggtttttatcatcaccaggtcacttttgacagacaagatttactggagtggtgaagaggagaagctctcatctcctgagaggaagccctgtcttccccaccaccactttattcatctgccttactctttcattttgctctgttttttgtttccgcatataacatcatctgacatgcatttattgtccattcctccatcaaaacagaaggtaagcacctcagcagccactttgttttgtttgctaataaatccagtacctaacacagagcctgtcctttagtgagagcttaataaaaatttgttggccaggagcagtagctcacgcctgtaatcccagcactttgggaggccaaggtaagcagatggcttgagctcacaagtttgagaccagcctgggaaacatggcgaaaccctgctctaccaaaaatacaaaaaattagccgggtgtagtggcacatgcctgtgctcctagctacacagtagactgaggtgggaagatcgctcaatcccaaaagctggaggttgtagtgagccatgatcacaccactgcactccaaactgagtgacagagtgagatcctgtctaaagaaaaaatatatatatatatatattttttttttttgagaaaaagtaattactacccccacacactgaaatctccagagataaacaggaggattatacaggcatctagctcacaggtgtcctatgatgctgataactgtgggaaaagaaccaggggatggataaatatccagtaactggaagtctaggaagtgatgtattgaaaggcatgagctccagaaggaaatgggctttcacatgagggaggaagagtaacgatctgaaagcaggaatgaagacccgttctcttggccctacgtgtagaggacaacgaaaggcccacaatcataaggcggctacatttcccctgtcctcagcctgctgattaggtgtggagccttccacatcacacatactctgaaggccatcacgaagcctgaaccatcaacctttaatcacttaagctccacatttagatctccaatattacctcacatctctccttaggtgtcccactggcactctaaataagtctcagaattcatgacttttccaatatttgttctgcctcctgcttgcctatctcagtgagtgacagatcccagtttccatcctcgagaggcctggaaatcattcctgactcctcacatcctccacgttatattccccaacatacaacttgtccctgaaccctgctgattctatcctctcaggcccttcttcacctctctatctcccatgacggttctccctccctctccctggggctcaagggatgacagcaaacagccttgcaactgcttcagaggtttatctggcagccaccctattcccactaccattttttctgaacttattgtcaattggcatatatatatataaacactgatcatttaaatccttctccagcttaaaatttttcattggtcttccaccaaaatcgtcaccatggcctctgaggtcccacttcaaaaatgtctcaaagaagactgggcacagtggctcatgctggtatcctagcactttgggaggccaaagtgggaggatcacttgagctcaggagttggagaccagcctgggcaaaaccctgtctctacaataaaatttaaaaattagccaggggtggtgacacatgcctgtagtcccagccactcgggaggccaaggcaggtggatcacttgagcccaggagttcttttttttttttgagatggagtctcactctgtcacccaggcgggagtccagtggcaacatctcagctcactgcaacctctgcctcccgggctgaagcaattctctcacctcagcctctggagtatctgggagtacaggcacaagccaccacgcctggctaattttttttgtatttttagtagagacgaggtttcaccatgttgatcaggctggtctcgaactcctgacctcaagtgatccacctgcctcagcctcccaaagtgctgggattacaggtgtgagccatggtgcccagccatgagcccaggaattctaagctgcagtgagctatgatctcgctactgcacagcagtgaaaccctgtttcaaaaaaaaaaaaaaaaagtcccaaacttcttctctggcctcatcacaagttattcttccttgctggatctccgtgctccagtcccacaggccttttaaaaacctcccattgtctacctcaccatcccctaattatctcagtcaccattcagatctccacccagctgatccctactcaggaatttcttccccagttacccaggcttggctagatcctgtatcgtacgctgttacaggaccttttcttttttctttaaaatactgatcacactgttaccgtaatatttaagtaaaaaatttaattcttatctcttttcctcactggacagtaagttccatgaagtcaaagactgtttcattcaccattctatctgtagcacctagcactaggctacgtacatagacagcaagcacccagaaaatatccactggatgagtgaatgagtggtttggatggttaaaccaatgatttaattcccccatccatgcacatgtataatttaaataattaatgaatcaggaagagggaacaatactgcagaggaagaaatcacaaagaataacatcacagaggaaaggctggactgtggtggctcatgcctgaaatcgcagcactttgggaggccaagcctaggagttaagaggctgcagtgaaccatgcactccagcctgggtgacagagtaagaccatcgcttaaaaaaaaaactactactactactaaaaataatgttgcagaggaaagagggaaagaatgagcctcgtcttgtgagaagcagctgatcaactgcccggagagcagggctcacagtacagtgagaaagaatccctggataagcaaagaaggataggtacggagatgtaatttgatacaggaggcaatggaaaacacgaaagaaggaagtgacatgttgaaagattattttggagagtatttagcagaggagtagtgagtaggaaggcagaggtgtgagcaaaactagggcagactttaaagctgtgaaacccatccatacacttgcataatttaaataattaatgaaccagtaaggtttactgattcctattatatgctcatatacgaaaggagtataaaacatggaccttgtccatatgaaaaggggaggaaaggatatcacagggaaggaagcataatgagtaatgtcccaaaggacagagtgagattagttttgtgagtaaaataaattatactgtctaataaatatctaatacttcctataatctgtgttcttacagaaataataatagagtttaagacaatctttcaggcttatcagttatgaaactaacaatgatgggtttactctcactaaatataaaatacctgaatcctacatcctttcataacaacagttatcaagttaaagtcaggtaaagtgtggttacatgtggaaactggttccagagctggtctccaggcgtcggtggtcaccctccaactttctgctgtgggacccaggattctcagtgaaattctgcctggagtaccagcagggcaccatgctggtgtcgaagctgtcatgggaattccttacattgacaaactcaccaagtagcagatatcctgtctccctagagctcttcctgtattaactcctttaatccttacagtcacctagtaccctctccaatatcatcgtcttttaaaggttaagtggtttaagcagaggagataagtaactggcttgaggtcacacacctcctgggagaatagagacagaatactgggccttggaatctaaaaacactactcctttactccttttctctcccattcctccaccccagcctgggtgcacctttggcagccagatgtcctgctggttgctggccaacacctgtggaattatcgaccagtgactttcttgtgaaaatgccactgggcacacaacttattcagtgtggcgtttagtaacctcacgtcggaaaactatgacataccactgtgtccggaattggtgggttctttgtcttgctgacttcaataatgaagccacggaccctcgcggtgagtgttacagttcttaaagatggtgtgtccagagtttgttccttcagatgttcagatgtgtccggagtttcttccttctggtgggttcgtggtctcactgacttcaggagtgaagctgcagaccttcgcagtgttacagctctacaaggcatcgcctctggaattgttcattccttctggtgggttcgtggtcttgctggcttccggcttcaggagtgaagttgcagaccttcgctgtgagtgttacagctcttaaaggcggtgcggacccaaagagtgaacagcagcaagattcattgcaaagagcgaaagaacaaagcttccacagcggggaatgggaccccagccggttgccgcagctggctctggcagcctgcttttattcctttatctggccccatccacatcctgcagattggtccattttacagagaactgattggtccgttttgacagggtgctcattggtgcatttacaatccctgagctagacacagagtgctgattggtacatttacaatcctctagctggacataaaagttctccaagtccccactagattagctagatacagagtgctgaatggtgtgtttacaatcctttagttagacacaaaaggtctccaagccagattagctagacacagagtgctgatgggtgcatttacaatcctccagctagacataaaagttctccaagtccccaccagattagctaaatacagagtgctgattggtgcagccatgaatcccgagctagacacagattgctgattgttgcatatacaatcctccagctagacataaaagttctccaagtccccactggactcaggggcccaactggcttcgcctagtggatcccacaccagggctgcaggcagagctgcccaccagtcccgcaccgtgcactggcactcctcaaacctagggcggcagatgggaccgggtgccgtggagcaggaggtggtgcctgttggggaggcttgggccactgggagcccacggcggggggtgggggtgggggttggttggggagctagggcatggcgggctgcaggtccccaaccctgagcggggaggcggctgaggcccagtgagaactccagcgcggctcgggcgggctggcagtactgggggatccggcacaccctccacagctgctggcccaggtgctaaaccccttacttcccggggccagcggtgctggctggccgctccaagtgtggggcccactgagcccatgcccacccggaactcacgctgtcctgcaagcgccccgcacagccccgggtccccgcccgcacctctcccttcacacctccctgcaagcagagggagccagctccggcctcagccagcccagagagtggctcccacagcgcagcggtgggctgaagggctccttgagcatggccagagtggacatcgaggctgaggaggcaccaagagcgagcaagggctgctagcactttgtcacctttcactatgtatgtcacatttgtccacatttcagtaaattttaacttacatacagccttcaatctgagcaccaccaactgccactcttcccattaatctactcagcttatataccaaagaagtcactgaatatcttaacaaagtcgcggtgaactaataacaaaagtgaaatgtgattactataacaagaaactatatctgccaaaagtaagtctgctcagctgtctaaacaaggcttcaaacatacttttccacagaagcccttattgttcacacattgctgttgatttgaaccatgcattacttctttgatttaaaaggattttataatgacgagaaaaacattatctgcttgccaaatcattgtggctatgagatggttccaggaaggctgccagcatgtgttcagcaaaacgctgagaaaagtacaagagtctcacttataagacatgcctttttctcctgaataatgccaaataaaatattgtctcataatttccataacctatgctgtccttggagaaacagcaacatagattttaaaactacttttcaggtgttatcaattcatgaagctttgtaactgtggtgaagtttagtctcactagaaatcaaataattttggttttccagtatgtaaataccagtattttttttacgtggaaacattttacttcctgattcatacgtgttgtaatccaaacttaaaagagatacactttaaaaaggaaaatctgaacctcaagtgtgctgaagctctaagacatgaactgttttactggatggaaacacactaaggcagcatttgtccatctgtgggacctgtctgtgactcacacaaaacggagtcctctgtggtgacaccagacacagaaatgcaaaggagcccggggctccattctgactatgctgtccaagaagacacactttggctccctgttaacgccctagatgtggagaaagaacaatggtcacgtaccggaaaaggccagtgtgcctcctctgatttcaagtgaaaactctaaagtgatgttctctcctttcatttccagttattttttggaaaagtcatccaccaaggtgagttaaatgataacgtgtactaaattttttaaaaattatccagtctatcactgatgggcattcgggttggttccaagtctttgctattataaataatgctgcaataaacatatgtgtgcatatgtctgaataaagaaaatgtggcacatatacaccatggaataccacgcagccataaaaaaagaatgagttcatgtcctctgcaggaatgtggacgaagctggaagccatcattccaagcaaaccaacacaggaccagaaaaccaaacaccatacattctcactcataagtgggagctaaacaatgagaacacatgcacgcagggaggggaacaacatacaccagggcctgttgggggcgctgggggttaaaggaggggagaggattaggacaaacacccaatgcacacagggcttaaaatttagactatgggttgataggtgcagcaaaccaccacggcacatgcacgcccatgcaacaaacctgcacgttctgtacatgcatcccagaacccaaagtaaaaaaaacaacaacaaaaaaagaaattataacctcttgaacctcaaaataaaataaaataaagacctacttgtgcatcttttgccaaaggaaacaaacttaaggtaagggggtggggaggagagcagtaaaccctgggaaaagccaacatgatccgaaacttggactgtctaaattattaaaatattctttaaaaaatgaataggttcctgactgattagtctgtttacgagaaacacctacaatacattagagtagacaataaaataactaagggggagtatctcaattacttgttagggtccttcataaaattttattaatggcaccttaaatgtaaacactacagagaaactgccagaagaatgaagacttagcagaaaatacatgtcttttgccacaagtaatgagaaaacaagagccaaatgtttgtctttaaagttggtttgcttacccttcaactttgacattcatttgaaaaatgaggacattttatataccaggctgtatctcgactgctcactacattgcaatacaataagcttatgttcaagcagcagttggagaaggatgctgttagccccaattaaatatccacttcacacagcatgactacagagagatcctgcttcccatgatgactgatcagctcaagtaccatctggagagacaggagaacctggaggcctgctgtcagctgctcagccacatcctggaggtgctgtacaggaaggacatggggccaactcagaggcagatccagattatcatggagaaacttctccagactgtgaaccaaaccatcatttccatgggacaagattccgaactcactgtaagtgcttggtgacagtattttttttttccaggtcactttgtgtgcccaaagccagtcaatggattctttgttggcactgttttgtgccaggctttttatccatccaagtctccctcaacctaccttctagccttctcttccatttctttcaagaacatattttctgttccagtaaaaggacacacttgtgtagccctccacactctgcgtacattcccacccccatagcttaaccatttgttcaataaatgtttaccaagacaaaccaaaatgccaggcaatatgatcaggtgtcataagcaagggtttgcttccttcctagagcttacagtggggcaaacaaatggttatacaaaccaatatgcctgtggcttgataaatactagtgagaatttctggtgctataagtttgtaacaaagtttgaatctagctgaggaggtcatggtggcttccctgaggaggtgagcagagatctgaagacaaagaatttgcaaatcaaaaggaaccaaggggccaggagacagtgggtagagggaacacagcctatctaagggggccttaaggcagctccctgggctgcagtgaagggcctgagagtacagtggaatgggaggtgcctgaggaggacgggtgggctttgtcaggcctggaaagtgctctggtctttatcccaggagcatggaatgccatcaatatttaaggcagagagtcacatgataaaaactgtattttgcaaatagctaaaatttattttagggacttcatgtatattaaccctcacaactgcataaagaaggtgctagtatttatcttaaaggtaaacaacaacaacaacaacaataaaaacccaaaaagcatacagaagtaaagagacatggccaagatcacacagccagagtgtggaagagtcaagatttaagcccagtctcactctagagctccctttttcaccaccatgcaatcaagttcagcaatttatcaatttgtggctcattcggctgagctggaagggccaatgagtaaatggattggtaaggattaggcaggagaatgctcctgttcacctgtttgtcaagcattccgcagcttgatggtatttctctattctaagccatcttaatactttcccatgctctgtgtaggtataaaacactgctgtcctgtcttataccacatcattgtatgtctctcttgttaagactgcaaactgcatctttgaaatctctgtagtgtctagtatcattagacactcaaattttaaaggaaatcattaggtccttgtggtaatggactttggaaagttattgaatctaaaggctgctgtgctgaccagtgtgggatgaagttttcatgaattcaaagtgaaaaaagaaaatacaaggacttcaaagtccattttaataaagctgattttaatattctaatagttgaaactgtaggtacaagaagtcactttttgtaatacaatgttattaactgtaaatgtgtggttttgttgctgtattcatccaatggattcttcccacacagctgcacagacaaaaccaactcactgagactgtgctataacaatagagaaggaattttattaatgcaaggctggccacacagaagatgggagttattactcaaattaatctctcaaaggcttggagtttacgttttttgtaaggataatttggtgggcaagggtttaggaaatggggaatgttgactgcttagaggtgaaatcacaggtgtgtgggaaatggtcctcctgcacttagcctctgagtaggggccataggatgggttgcaccactactgtgggtctgggtggatttagttggtggtcaaaaatgcaaaaatgtgaaagatacctcaaaaggccgatcttaggttctacatagtgatgttatctataggagcaattcagggaagtcacaaatcttgtgacctctggccataggactactgaacagtaaggggttacagaaattatgcctacattttagcagaatgttgcaggaagtcagggacctcgaatggagggaccagctgaaaccatggcagaacataaattgtgaagatttcatggacatttaacacttccccaatcaatactcttataatttcctatgcctgtcttttatctcttaatcccgtcatcttcgtaagttgaggatgtatgttgcccaggaccctgtaatgactgcgttaactgcacaaattgttcgtaaagcatgtgcgtttgaacaatatgaaatctgggcaccttaagaacagggtaacagtgattttcagggaacaagggagataaccttaaagtctggctgcctgtgggccgggcaggacagagccatatttctcttattaccgaaaacaggtaagataaatatcactgaattctttccccagtaaggaatattaataattaacagccctgggaaaagaatgcattcctggggggggggggctctaaaatggccaccctgggagtgtctgcctcatgcacatgtagataggaatgaaacatgccctactctcctgcagcacccccaggcttgctaggattaggaaattccagcctggcgaattctagtcagaccggttctctgctcttgaatcctgttaagatgtttatcaatgacaatgtgtgcacagcaggacgtggacgttcattagtgattctagtttcaccctgaccttgtgatctcgccctaaccttgtgatctcaccctgaccttctgccttgtgatcttttgttgcccttaaagcatgtgatctctgtgacccacaccctattcgtatactccctcccctttgaaaattgctggtaaaaacttgctggttttacggctcagggggcatcacggaacctgccgacatattatgtctcccctggacatccagctttaaaatttctctcttttgtactctttccctttatttctcagaccggccaacactgagggaacatagcaaaggacccacattgaaatatcgggggctgaatttcccccaatagcagaactcaggcccctctcacaatcctaatcttgtggcctttcattagttttacaaagatggtttttagtccctgagaaagaaggggtttagttttagagagggactattatcatctttgcttccaagttaaactataaactaaatctttgccatgattagcttgacctatgtacaggaatgaacaaagacagccagcctatgaggctagaagcaagatagagtcagctatgttagatttctctgtcataatctttgcaaaggcagttttattgttgttgcaatggttaattacctttcttggcacacaaaaaaagtacaatatctgacctctgtttttatttactaatccatgaattccaaagatttgaaaaacactcgtttaaacaatcccatttctttacctatcaaatgtgaagaatcacagcttaaaactaatagcaaataatctgttttatctaaaaaataaattttgttaagaaatacctctagacccttatctataaactaggagacacttgctttcaaaagatccttccaacttttctaaatcccttatgattaatctaaacccctcatatcaaatctaaagcccttagaccaggccaggcatggtggctcatacctgtaatcccagcactttgggagaccaaggtgggtggatcacctgaggtcaggagttcgagaccagcctggccaacatggcaaaagcctgtctctattaaaaatacaaaaattagccaggtgtggtggtgcacgcctgtaatcccagctactcaggaagctgaggcatgagaatcacttgagtctgagaggtggaggttgcagtgggtcgggataatgccactgcactccagcctgggcaacagagtgagactgtctcaaaaagaaaaacaataaaacatctaaaaaactagaaataccatttgacccagccatcccattactgggtatatacccaaaggactataaatcatgcttctataaagacacaggcacacgtatgtttattgcggcattattcacaatagcaaagacttggaaccaacccaaatgtccaacaatgatagactggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagaccacatggacacaggaaggggaacatcacactctggggactgttgtagggtggggggagggggagggatagcattgggagatatacctaatgctagatgacaagttagtgggtgcagtgcaccagcatggcacatgtatacatatgtaatgaacctgcacaatgtgcacatgtaccctaaaacttaaagtataataataaaagaaagagctctccggtccgtgcctccaagatgacaaagaaaagaaggaacaatggtcgtgccaaaaagggccgcggccacgtgcaacctgttcgctgtactaactgtgcccgatgcgtgcccaaggacaaggccattaagaaattcgtcattcgaaacatagtggaggccgtagcagtcagggacatttctgaagcaagcgtcttcgatgcctatgtgcttcccaagctgtatgtgaagctacattactgtgtgagttgtgcaattcacagcaaagtagtcaggaatcgatctcgtgaagcccgcaaggaccgaacacccccacccagatttagacctgcgggtgctgccccacgtcccccaccaaagcccatgtaaggagctgagttcttaaagactgaagacaggttattctctggagaaaaataaaatggaaattgtaaaaaaataataataataataaaagaaagaaaaaaaacaacatctaaaaaaaaataaataaaaataaaaataaaacccttagaccaaatataaagccttgaactgtctatgccttcttacatcctgttttaagaactgagatgagtctagacccaaatgaatacaaatgggatttgaaaagcataaagcttttttttttgtttgcttgtttggaaaataatacatacacatggtattaccataatcttatcaatattatgaagtcgttctaaagcttttttcttctaatatcagctaatagcagatctttgagtctttcttcctaggtattttccaactaaatgcttagtttaaatttccctaagccaacagcaaatactccttaaccttgtacttatgagactgaaagtgaagatttaccaagcctcttgtataaacacaaagatcactgcaccctacctgggcttccaatctgtttgacactgtgcaacaaagactgagaccctaaagtggaagaaaaatcttgttgttcatcatggaaaagggagcaacggaatggcaaataagaatttctagagaaaagcttctacacgtagccacaaagtcaaagaagataccagctttccacgccatattttcagcctaagccatctcttccaccttcattcaatgtgtttcatggtgtgatagaaaagtctgaatgtttcttgggctattttccatctattctataaagaaaatgtttttcttgttttgccctcactgtaataatacagaaaataaatcttaaaaatttagtgtattacttttgaagcctcataatatatctaatgttgaataaatccttaatatatgtttactatctgaaaaaaaatatgtgttcccatgctgtcttacagctttacagtattccaacttcaattacagaattcaattcacctcatccttacttctgtgctactctccactcatcagctgggaaataatgtaacaaaactgagagggcatgaggagacccgagagttcaaggtgtgacacaagctaagagactctgaaccattctgggtcagtttcctcatcagtggaatacaggtaatctagagatgggataattcccttgaccttgatccccctcttgggtgggaactcagtggcctgtttcactcagcctgtcactggccactcctcacgagagagaacatgcaagcaagcaattgtagagactggaacaaacgattgctggaacggccagttgctcctctcttgtgggagcaggctctgtgtgggccctggagcagctcccagcccctgtcctcttggttcttgtctggcgtccaggaagaatcaggtcacatgaacagattgaagggtagtgtatgtggatgattttatttggtgatggaagtggttcttggcgggatgagagttggaaaggggatggtgcaggaagaaggtgatctttccctgaagccacgctgtctgaagttagccacatctatctgtagtttctgatgctcagttgctgcttctcagcttactcctcagccacttgtatccctgatgctcagcagcttatgtgttgctctgccagctgaagtctttttaagggcacaggatagaagtgtggcaggccaaaaaggcaacatttgggtgggaaaaccaagaaaaacagggtcagttgttttctcttacaaccaccattccaggcttaagggtgggggtttagcttggaacccagtggttctgtatcaatatcacttttaaaaatactttttgtttcgtaacaattttatatattatggggtacaacgtgatgttttgatatgtgcttacaaagtggaataactttctcaacatattttttttaatactacatgacatagtgaaataaattttaaaatcactgctacttaaaatgttatctgtggaccaatgacagtacccagactgtttcctgtccctcagcaagtacagaagggcggtcctctaataagcttgctttgatataatgttaatgaagaaaaaaaaaacaaacagattcccagttggggctgctgtctgtgtggagtttgcatgttctccccaagtctacatgggtttcctccaggtactccagtttcctcccacatcccaaagacatgtatatgaggttcactgtgtctacactgtcctggtgtgagttagtgtgggggtgtgtgtgagcgtgccctgtgatgagatggcatcctctacaaggtgcttgccttgtaccctgagctgctaggttctgaccacctgtgacccttaactaaaataagtggataattgtcttacttacttacttgtttttatttatctttattaaatgtatagagagctcacatttatttccatgctaaatattagaagtgttttggtttttgtttagaagtttggtgatatttttgtgaccagaaataggctgtaggaacttgactcttacttatatccatcagcctgtggttaaattgatatcattatatgtcgtttcacttaaaaatcacagtttctgagaatctatcaactatgttaagtgaggactgtgaggacttactgtacagagagcatagttttttagaaacttctgaactgatattacattgccatagcatccaaaagcatgattttcccccaatattttattataaaaatgtttaaacatatagaaaagtttaaagaagtttgtagtaagcatatatatatatacacacatatatatacacctactagattctacaattaacattttattctatttgttctttcacgtatcaacccaatccttcatcaattcaaattattgttatgcattttagaataagtcaaacacatgattttatattttataaaatattccacaatggatgagaaatcaataaataccagtcctttgctgctgataaaatacctcaaaaaaacctttcacttgagaagatgggtgatatgccaatgttaacaaggaagttgggaggaaagagatttctaaaagccaaaccattacatgttccacaatactaccaagacaccagagaatgagttgctaccctctcaaatcctaggtttataaaacataaatcttaaggatagcacgttatttactcttgataatccaagggcctgctgcagaggaatgaagttccaaagtaaaaatggaaaaaaaagtctggaaagtaaatcaattttaaaaacaaacattctgttaaattaaagcaaaatgaacccaaaacttaactaaatttccctggcatacagtggctctcaataaatatttgttgaatagattttatagtttataccttgtagttgtttatttttttaacagatggcaactacatgtggaatagcaatgttattgctttttaatcccagaatctgattcccaggattgtgagcgacccaaaggtataaatccaatcacccttctaaagcttgaattcactcaccatcaccaccactaaagtgacatccaaacaatatcaaactcctttaaggaagagaaactaggctctctgaaggcaataacctgtctacaggcaggaacaacatctgcaaagttgtttccaagtggcaatgctctccctgtagctgtcattttcttattgcatgctaatccctgcaaaaacaaagaaaatcaaattcttcccaagcccattcttcaagcgtttgatggcagctaacactgtcttctgtcttgcaggttaaacgttcctgacacttctcagatgacaagacccacttactatcctactggctctccttaacacaagtttcactttttctgcacaggttctagattaaggccttcattcattcttttcaggtctttgttcagctcattatcttcttggtgatgtctcttctatttaaagctgcatctctgtcttttgtagttccctattctgttttctatttttctccacagcacttataactacgtagcacatgacatttattgtattttcttcccactagcaagtaagctccatgatggcaggcattttatatggttcaccactgtatctccagggcaatcaatatttgttgaatgaatcaatgaacctgccatatgggtaagatcttacaatcaaggaggaagacagtaattcattccagttagagaagcaatgctgttaaagcagaggaagatgccacaaacctttggagggcctacatacactcccaatgccttaccctgaacttattttcacctacattattatggaagctaaactaagtatcccaccagtatttgtgaagctggttttatggacccgaacctagaaatttacatgactcccttctgaatttcacctgtggtccacttttttagtatattgatatcagatctttagtgaatataatggaattaactattctcttccagtgtggactgcccaaaactgttcatacttttcagtttttttctattcttttatttataaattgcaaattatctaaaatctattagtttactcacaactcccttgacagttgtgatagtggtagcggatagagaaaccagtactgggagaggaaaggatttctttgcacagtcatgcagaagtcagaaacctattgtacatgtgaaatatgcctaaatgtatcttgtattaatgtagtaatagcagttactgagattttcaattacactattatactatttttattacagctgtgatgcatcattgctgaaaatgaactatctgatctaagtgaggttcttaaactcgagtacgcattagaatcagctggaggacttggtgaaccagattgctgccccctcctcaagtttctgtaaactctgcagtgagcttaagaatttgcatttctaacaagttcccaggtgatgctgaggctgctcgaagatgcttttccctggggacagaaagtgaatgcaggtggtctgatgtaaaaggcacatgttctttttgaaaagtaactatgctctgcactgttctccaccctgacagagtctcattctgccaggctggtgtgcagtggcacaatctcggctcactgcaacctccgcctcccgtgctcaagcaattctcatgcttcaggctcccgagtagctggtattacaggaatgtgtcactacgcccggctaacttttgtatttttagtagagacggggttttaccatgttggccaggctggtctcaaactcctggcctcgggtcatctgtctgcctcagcttcccacagtgctgggattacaggggtgagccaccacacctggcctaactatgctttttaagcttaaacttttaaaaaggattgatatcaattattaggataattacacaattttttaccccttttgaacttcagcagaaaggcagcctacatcaaaacccttcaaactaaatactttttacacaagggagctactagctccaatatcagtacttcctaaatggaaacatccattcctacagctcaatatttctttttactcaaatcagatataccctggccatatcttcaccctcacacaactcctttttctttcctaattatgttgagatcacgtaaggtatcattcaaccaccctccagctagcactcccaatgcctttagctgggatttttcttccactgtgcatttctttaagcccttaaagctggactcatcctaatgctttgtcctttacttaaaaactagtgtttcaagctaactgcagggtagtggttaagaccatgagctgtggaaccagaacaagttcaaatataggttctgtgtgtcacataccagctgtttaactttgggcaagttactcagtctctctgcgtctccatttcttcatctcaagaatgaggataccaataatgcctatctcatagcattactgttaaggattaaatgagattctacctattaagggaatgtagcaacaccttgtgtattatagctaagattattaccacccctccctctattcctatcacacttgccagctttactcagcctgctaagcattcttgggtgacaaaaatatcttataacatagtacatagggatactacaaattcagggagccaaaaatagtaacactgaaatttacataatagtaaaatcaccactaatataaatgtcattggtggttaaattattttgttaataaatcacaagttagtacttaacatgtatcaagccttttgttaattttttacatttatctcatttaattagtctaagtatagacctatatttccagctatgccatgaacatcacccagaatctgttctatgacatattcaaaatctgtactcttctacttcaaacttaattcacctcattgtcattttccatctcactgaatgtcattattataacatagcggcccaagccagaaagcagggagtcattcttaactcttcactcttcctctactccccctgacccatacccacctcttctgtatccatggtgtgttggtaaattggagatgaactgaagataaaggttaggatgtagagaggttttaaaatcagtgttaccctggtcatggaaaaatgaagtagaaaattcacaccagcaagtgaaatcaaagaacatattatcttgtaggcgacccacccaattcacttgccactgccttcatttatattttcactttatcactcctggatcattgcaacagccttctaagtttcatgtgttaggttcagggtcaggttccagcccatgctgaggtctggagggagtgggtggatgagtggcaaacagctgaaagaaaactcagggagacataggtagatgaaatatggctttattcagaagctctctcatcagcacctctcttagagtgtccgctctgtctcagctgtttgagctggcagctcccacacacagctgtgctgctggctctcccttgccttcagggtcagcagcttaattttctctctctgggcacgagagtccctatatagtgtcagcagggcaatgataccttttacaaacaatagtggcttagagccaaatgatgagccttcccattttatggctacatggttgtggtaacggggagttatacacctgagctctaaactcgctgagtcactcagcctgtccttgacaaaagcacagccatgttccttacactccaccccctcggccaagggagacataggccttggatacacaggttatatacataagctttggtacataggctcgatatatatacacacaggctttatacataagttttgggtacataggtttgatatataggcttggcacacaagccttacattccaccccctaggctgatggagtccttttagtgaggaccggtgcacatagggctgcaccttggacctataggccacagcaacaatataaggagcaacaacatactactaatattcctgctatgctactcatgattattagagcccaatgtaggccagagcccagagatgcccaccatctcttccaggggtcatcatcaaggcgctcaatcaccttaacctcctgggacaccccttgtaaagctgccattatgttctggtggttgtcagggatgagttttcaacattgtgtccctacaagggcacaagtgccaccttgggcagctgtggctatgtctaaggccatccggttttgtagcaccaccttcctgatctgattaaccttatcagttaacaaaaggagggcaactcagatgcaattcagggcccgagctgtgtgctctgcaagggctgtaacttgcatttcctacagtaatgacacctgctccaggaacagttattgctaagggatagaaccacaagggggcccaccccactcacaaaaactggaaacgcagcaccctctagtcatgtaggtgaccaggcaatgtggaaagcacagtggcaggcacatggggccaccctcaggtacagtccaattggctggcagatatggccatcctgtgccctcacagacccatcaactcccagggggtacaaagtccactggggcccagccttggtaaggccgcttattccacaacacccttggtgtagtgatcgtgttatgtttgcacaaacctcagcaggcaaccatcccacagtgactttaccccagtgctgctctatacatggtggtgtccgcaatgggggcaccacgtgttctcccattagacagctccatccatcatggacgctagagtcagccagggggcaggcttgccatgggttttgtgacgcctcctattcaaagcttgatgtgttgcatcccacccactgtccacgaggcctggacagtgtgcagttctgcacagaagctggatgcacacgccagggcaagccatccgcagctgctgctggaaggacagtgccgatccaacagttagagacattggtcacctcagtaaggtgtggaaccagtccacaatgctactggagcatgccaacttacagctgaaacaacaaagcaagcacggatactaaccagggtaaatcacgtccctcaggcaaaattcaagtcaatttttcatccctggataacaatgcagctgccaagggcttctgccctgggtgatgatgctacacctcatcagctttctgtggttcccttgggtcctgcacccatgccaaagttacagggaagtttatgatagtccacacagacagtacatatgttcccggaggagggttccttccctggccgttcccctacgaacggctaattgtggaggtcacacattaaatacccaaggagtaacatgtaagttatactgcagacccttccccacaggaggccacaatcgccaaccatctgcaatgaggggcttggagggtccatggctgacaccaggttttgtctccctacttttaggggtattggggcaggtaataacagattatctctcatcctcgtaactggttggagaaggtcatccttcctctcatggatccggccacatggcctggccctatgtgggttggtgactaggtaattctataactttcacataattaacaacaaggttaagcctcaataaactgcccagctacagctgcagattactgtaggtgtcaccttcttggtgatcaccatccacattgctctgagtttagctcattagctactttgcccacacttggtatcaaaccatatagtgtcagtagaatggccggactgtgacaacagtccaggcagcacaagtatctcgactagacctgtgtaccatgccccattaggaatggggggataccattccttatagtgaaggtgcagattctaggtgtacctccggccccatggccttatcttgcattaggactacaggtcccaagacttcttgtaactctgctgctaagggacttgtactcagcatactccgctgctctaagcaggtgcttcacttcactaaagtggatgtctgcaccgtccttatccggggagtcactacccatgaatgcacccatcctgctatcaggtaagtcgtccatatgacgactgtaacccattctgccacactcttatgagcctgatgggcagcatatgtagttactaactgctttcccagtccagggggtcactacccatgaatgcacccatctgctattactaactgcttctgtattaatgaacactggagctcagctcccttccacagctaggactaaaagcctgttggcacttccaaggtctccatgcactgctataggccctagccaacactatttgtggtcacatgcacattcagtttaaatgggcacccctagtcaactacccataggtcttgtgcctactgaagagcctgcttggctgtgtaagcctcaccatgcaaccccaggcaaggtgggcattgccacttctaaatctgcaagagaaccagaggttcgcataacgtcatcaacaagatcatgacatatgatgaggctatgcatatagtcctgcagtgacactatgaaagtccattgtcaccctcccatgaaggcagactgttcctggctctctggagcaatgttgattgagaggaatgcattggtcaggtccaccacacagtggcaccatcccagttctattgtcaagcagtccagcaagtccgtgacagacagcacagctgtcaagctgtgcaaaacatccacccccagaatgtctccaggcatgggagagatgtgcacagtggacaagcagacagccaagtggcgaacgccaaggtgcagacacaggttccactttcactgactggtcttcataaccattaataaacacagctctgcccggaaatttatccgggttcagagactagtggattgccaagtccgcatatggcctttggttgtctggtgccacccaagccaggcatctcggccagtctcttatcaaacagaaaaggctttacacttccacctgactgcagcaggcaatctgtgaactggaatactcgggcaggaccaggttgtacaccaacgtccttctcctgaatgacttgcactaagtctgtacatgactgccgacattacttgcttgactcccgcaacatagcgggggtgcaggcaccatataaaatgtgttccaccacggtggtggggggagggtccctaggctcacccttggtgcccaacagctactcatgctatattttctggtggatcactgggcgagcctgcaacagaggttctttctccctgcgctgcatcctgcagggactgggcatgcaattcctgcagcacagttacaaacgcccatgtgactctgccagcgaaggtatgcttttccttagtgctgtgcagttcctggtgcttcagtaccttctccacactcatgggagacctgtctactgcctcccacgtttccactggggcccacccaggcagcaccgctgccactgggtaccacagcccatgctgcggccacatagccgacccaagacccctcagaactgaagacccactcacctcatctggccaactatgccaactgtcaggttcatgagtacaccaaacgtcatgcccagggtccagcccctgctgaggtccgaggggagtgggtggatggacagatagctgaaagaacactcggggccgtaagcaggtgaaatgtagttttattcagcagctttcccatccacagctctcacgcactgttctctctgtcttggctgcttgagctggctgcacagcctgctctccattgccttcagggtcagcagcttaactctctctctctgggcacaagtgtgcctatacagtgtcagcagggcaattataccttttacagacaatagtggcttagagccaaatgataaatcttcccatgttatggccacatggctgtgataacaggtggagttatacgcctgcactctaaacttgctgagtcactctggatgtttacctcagcctgtccttgaccaaagcacagccatgttccttacactgtgtcttcaagtttcttaaccaaaattccatgtgacactcaaagctcctttataaaaatactgttaacactgttctctccattagaatgtccttcttcccacaaagtagagttccatttcaaatatcatttccttctttaagtgttccctaattatcactccagttgaaattctgcccttcatatcgccacaagcctttatcaattcctctctatgaggaatagaaatttaacactttctaccttgatattttgatttctaccaagatactttcagtaaagtgaaaataagtcaaacttaaggaaacagaaggtgaaatttgggacctgattaaaggttctttggaacagtcctctggcagtggttctcagtcttgtgtgcacactggaataccctgggcaacttcaaaaactatcaatgcctgggtcccagcccagatgtcatgaatgcatcctgaacactgagacttggaaaagctctccaggtgattccgatgtgcagccaaggttttgaagtactactctatggggactataaaagggagtaagaggctgggcgtagtggctcgtgcctataaacctagcactttgggaggctgaggtgggcagactgcctgagctcaggagttcaagaccagcctgggcaacatggcaaaaccccaactctactaaaagtaaaaataaataaataaattagctgggcgtggtggtgcacacctgtaatcagctacttgggaggctgaggaaggagaatcacttcaacttagaaggaggagtttgcagtaagccaagatcgtgccactgcactccagcctgggtgacagaggaagagctctgtctcaaaaaaataaaagagttaagagattactgaaggatttttcaacagaagcaaagatctggttgacatcagataataataaatattacaacttgagtaatagctgactgtttagaagtattaaaagcagatgtagaaatgattcagggtaggcaaatgatattgtaggaaagtgtaggaggcaaggaatttggtggcacttggtaaaactaaaatgacttacaattgcttctaggctgaagctggaaaagaagagatggactgggaagatagggacaacaattaagggaaactgcttggaatgagaaccaagaataagtctgaagaagtagtggagatgagcagtcaagcaaatgcagagggaattctgaaaaagatgctgtgagttgttaagttttcaaagatgacagaacatgatgtgtggcaacaacagtgtgttgctaaactggacatgtgtagaagagttttgaaatcagagtcaccctggtcatcaacagtgatgaaaaatatgcatggcagcatctaaaaatcatcacgggacacagtaacttggaggtctgataaagatgctgccataattgtggagagaggggttagaagctgtggtgtggctatgaaaaggggaggtaacaaattgtggtagaataacacttactggtaggaaagagaccatctgtttttctaaagtacactcccttccccccacttataaaaccaagtatgtatttaaagatatttctgtgctggtaagtgtattaatttataatctttatttttcatcattaagaactaaatattaaaaaatacagtaagtacaaagccaaaaaaccaaatttgtttttaaaatacaaaaacaggtgttcatggtaaatgatggaatgggagaatggaactggcatgagaaagactccttcacagtagcagcatgtaaaaatttctctgcttgcttcagtgccttcccaaatgctcatctttctcccagttgatacctacgtgctgcttcaaaacccgttaaatgtggtgaaggggtttaaatcccatcagaaaagtcagatccctggctcactaatcctttgaaaggctcacactagtgcaaataaatagctgactaacattctctgcaggacagttgcattataataattctatagcaagagatagggatattatcaatgtagtgtgtcctataacaagaggtactgtatagatggagtgagtcatttcacctatagcaccacccgataagagttgaaatgcgttagaatatttttcactgtagtaaaatattaaacctaatttatctgaggagtgaataaaaaagcaagcttaattcttacaaggaacataaactcccttctgtaattcacattattagtcccatgtcattatgacaagatatgtttgcatcactaggtacaagagaaaatggtatatagcccacagaataagtgaaaatctattataatgaataaatttgatatagtagtgctatttccaagttctatttagtaaacccagagtaaaaggggtttattgatctgtttacaacattctaaacactaagattaaaactgttttgttctgacataaaagaaacagctatgtaaagtgcttagtcctctacctggcacatggtagccactcagcagacagttcccattttcactgacttgaccctttccctcccactccaaatatagattctaaccaccctttaaagaacatccatagaaaattctcagatcaaacaagcacactgtgttaaatgttaaatgtccacattaacaaaggttatatcatagaagtatgcacatgccaatttcttatgcatgggagtaactcaggtcttagattgacaatgatgaacaaaggaaaaggaggagaaaaaagaaaaggaaaaatgaacaaggatgtggagggagaatgaaaaacacaattgcactgtcagtgtgaatagcaaacaaattcctgaactaccagatgtcatggaacaagtaccccacacaagagtacacagagctgcaatgaccctggaactctaggtgcagggactgccaacactacagatgcattcattgtcatagctctagtgattttcttggacaaatggtagaaatcactttagccaccccacccccatccgctgctatcctctagtggcagaaacattaacagtggccaaagaatgacaatttatcctgattaggtgggcagctaatttatccttttagggacagctgtcatggggtcctcagtgtcctctctcttcagtgtggtccctcgtccctcaggaaatgactttactctcccagggtaagctcaaaataacacttagtgttcctgctaaatcctccagtagtccagtgctatgcagttctttcaaagaagagctcttgtgattaacacaaaagtctctaaagttgtgtgtaaaaaagcctttgtgtaccaagcaaggcatggctcacacctggtcatttgcccagtttttgccgattcttcctggccttagattagtgtctctcctcctttagtcttccatgaccccatggtcatggaagcagttatagctaactactgcccttctacctgtgtctgaattgcagtattgttaacactgagcaactcacaagattcctcttcactaggtcaccctccaaggctgcgcagcaattcaaatcccagtgttagccttagagttcaaagctgctcattaaaattatgcatgctgaactgtaataataaattctgggctaaaattataatttaatattttttcaaagtaatttagagtgaaaaacttcaaaattttctgttattttgtataattgggaaaaacagtcaagtttttcaaattaacacataatagttgcattacaacaaagatatttatcattcacttattcattcattcaaaaatactcgagtgccaggaactctgctggaccctgagaatatagtgaacaaaagaaacatgaccatatcataataataataatttctatattgtatcacttatttcaagaatagtctggcatagattaaacattttatttaagaaaacaaattggggagtggggagaaacacatgggaagtaaatttgccatgactaagtatcaaagtcgttctatgtattatgaatatgtaacaattattgtaagtaacactggacactaaaatagttgctgttcacttaaagagtgctagtattttattttaaaatttcactatacagatgcatatcacaaaaaaaatgtactaactgcttgaacagaactatttatcaagaataagaataataagattttgtaaaatgttcatgccaagaatgcaaaagaaaaaaacagcacaataacctcacaactaagacatactataaatatgttatcaaaagataatttttactcttcctagcacataaaagataatttattgttttcaaacttaattgatactttctgtattagaacatattacatatcagtaattttcttaccaaaatagaacccaatatatgtacagtaaatatttaagaaaataagtttgtccttagctttaacatgaatgtgtacatataaatatacatatgtacactcacaggagtaacatacattgacaaaaaattacacttagcaaaggtccaaaattgcacaaaaaaaatcccgctaggacttttttgctatctttgaggttggacaaagaatgtataaaattactgaagtaacaaaaaaggacacaaaaaccacacttcaaacagacaaactgcttgtcagtattaggacctgatttcacatacaggtttaatacacttcctcaaaagtcatgccatcaaggtgaaggatgaacatcttccactactgaatgaggctggatgtcattattctgagaagtagggttctcctccacatggattactttatctgaggttcctgcaggagaaacttcattatttgtctcctcttcactaggtgataaggtttcaggcagttcatttgacattagaacttgcaaaggttctgttccattttcaacaaccacttgaatccccaaaactttaagaatatcacatttgcaaatggggcatgtcccatggggtaaaatccaggggtcaatgcaattcttgtggaaaaaatgtttacaagtcagaatacgaactatgtcattaggcttatagcgttcaaagcaaattacgcagctatccccatttggatttatttcttcatccccctcttttactactcgaagttggagttgtccaaatgtgttctgaagatctgttgttaatcgctgccatctccggttctgaatccttgctaaacaaagtctatgaatgtgataaaagatgaaatatgctaaggtagcagttgtgacaatcacaaaagagaccaaatagtgattcatccagatgatgtgctttctccccacctcaaccacggctgtaatgagaactcccttcttaattaaatggaaaatttccgtgccttttaagttaccaatcataaccacaacgacatcttcaaatgcctgatgaaacatggggaacacctggttgccagtacctggaacgttatagatgatcactccactggctcccttctcagttgccactttaattttctgtgtgaaggtacaacctccccgttcaataagtgcaagccaggtctctgagtactttgatcggctgaaaatggtattgggattacatgcattttggatttttccctctggtggcactataactcctgccactctcttcaaagtggagcttcttccaaagactccagtctctcccaactctgacaacacatgattcccaacatgaaatgatatgttcatataagccatccaaacaacacttgctctgcaacagttctgactaacaagccaaagaacactgaacttcataagccaggaagaggcagtgttgtttctccaagtgccaaccttgagtagatgcatctctctcttctccgagtgacttaagaaccaacctaacagttgcacatctgttgacaattaatttaaaataacgaagagaaaaaaatcttcaggatacaaacaagatccactgtcttccagcatgtttttgtaagaaattcttaaagatggcttatgagtttcagatgtcttactagagagaggtgaaaaactttagattgaaaaataaatcccctactgttaactctagatactgcttactattgtgtgatgtgattatgacatgcaagacccagcagccaattagataagagcttagagcatactgtgaatttattggcttaaatgctgttatgggtgatttctatgttgttataagatggatataatcactgagctacatataatggtagtagatagcacattaaactaaaaattaaatctaaaattcatacaatgtgtgctctttaaagcctgaaagcacatgtaagaatgttttattttcccagcaagtgaaggagatatttccaacaaaatggcaagctaaaaaaaaggataattaaaaattagtgcagtgaccggatgtgaggcaaaagtggtgagcttagtgacattatttttacatcaaaaagtaaaagtcacactgctaatttttgattcatcacataaaccattatattgcatttatttaatttaagctttctgagaagtttgtggcttttgttttatggttttgctgttttaaagtaagggatcctgctcagtttacttctgcctcactttctctgtcttacattgactgtacaaatgtagtaagactgacaggagtaaagaaaggactgatatctagggaagctaatttctctgcagactttgatgtctgttattaatcaaacaatattttgaaagaggaggagaaagggtgtcaagggaaagattaaatatagtcatattagtttggcacaattcattttttaaaaaacagctattaagaaaaacttcaaggtgcacacttaaagttaaccattagcagcaataagtagatgcttttatcaaacatttttgcagaacttaacaaatatccctattagaagattccacaggctctgtccactctgcctatgtttttgccacaatcatgtcagtggcacaatatgacatcaaagctaaaggatggcatgtggactcacaagcatagtaagttcacaagcagccacgctgctactggtacactttcttggcggtgaatctcagtgggttttttcccaccagctaggaaaccgaggccaaagattctgaccttgaacatgaatgtctctggtctacatacgtaaagtgctagaagtcacttttggttggaactcaccaggactaaaggagctgttacttcttatgaaatgtaaatctacaacatggtaatttgagacaagaaagatgaaggaacaaagggccctatgggccaacaaaaactagtataaaaagaatactgatgatataaaacatacccataaaggttgattttctctcccaaaggccattaatccgattttattttcatacatccctgcacattttaaaaggtagtatatggtgtgtatattcacaaagtgacactgaggtatcaaaagtttagcatatcatccagaaacagaaattttcatcaatacaacaatacctaaatctttctgtctctcattgttatataggtgtttattcatctactagaaaaaaggaagatgcaaaataaggcaaagaatataacatcgaaaggcaattgaacaaaattttagctctgccctatgttatcaaaatgcccccagagaaacattcattaccatttggagaggaaaagagaagcatttactaaggacacttctagaaaagaaatctgctaccatagctgagtcactatgctaggatttaaagagctctggcaaacaaaagtgaatgtttgcaatgttatcctaaatgaagcctataataatttagaacacttttccttacatatccaaagtactatcatctaaaataattatttagaacacattaccaatccagtgagtagctttggaaactagatttcctgggtattaataaaattaattaaccatggagaatcagagatataaattattagataccaaaattagtcaaaatgtggaaacaaagtacaagaattagtattaaaaaaggaaactttaaaatagcatggctaattctctatggcaatgtcacaatcctagtaacttgaagaaaaaaaaatttgtttttaacatatactaatgttcttatttggataagggcaaaaagggatacgattaagaaaatgtggcacatatacaccatggaatactatgcagccataaaaatggatgagttcatgtcctttgtagggacatggatgaagctggaaaccatcattctcagcgaactatcgcaaggacaaaaaaccaaacaccgcatgttctcactcataggtgggaattgaacaatgagaacacatggacacaggaaggggaacgtcacacaccggggcctgttgtggggtgggggaagcggggagggatagcatttggagatatacctaatgttaaatgacgagttactgggtgcagcacaccaacatggcacatgtatacatatgtaactaacctgcacgttgtgcccatgtaccctaaaacttaaagtataataaaaaataaataaataaaataaaattcacctaaaaaaacaattaaaactgattagaaagacaagaagttcaaatagctgggcatgataaggagttttatttttaaaacacaaatttcacccttgttcatacttgggtagagaagctgaaattttctctctacataaagtacaataagacaatttatctaatctttgtatttggaaagatctggttacatcttcagaaaattctccagatttcttaagttttcaggatgtcacacttgcacatgggacatgtcctatgggctaaaagccaggggtcaatgcatgccttatggaaaaaatgtttgcaagttaaaatgcgtactacatcttggggtttgtatgtgtcaaagcaaacaacacagttgtcttcatttaggtctaattcctcatccccttctttgagaactcgcagttgaagctggtcaatagctttcttcacatctgtctttatttgacttcgcctcctggtgaaagaattgggcactctaggtgtaagtctccagacgcaatctaagtaaaagtaggcaattgtggcagccaggaaggtaaatagatacatgatgtaatggctcacccactgcatgtgcattctccccacttcaatgatgactgtcacatagactcctttctgaatcgagtgcaaaatttccatgcctttcaggttgcttatcatcaccgcgactatattttccgtcccctggtgagacatgggaaatactttactgcccgtaccttgatagttgtagatgatcaccccatttgctcccttctctgctgccacgttgattttatgtgtaaaagtacagcctccacgttcgatgagggccagccatgagtctgcctgtttgggcctgctgaaattggtcaaaggatgacaggcattctgattccatccttcaggaagtgccaccacaccagacaccctttccagaggagaatgattcccgaacactccactctctcctaattccgatgtgatctcatttccaacctgaaatgttatattcaggtgagctgtccaaatggcttttccgtttgagtcaggaaagctaagtagtagaaagatactaagcctcaaaagtccagatgaaacagaactatgcgtcgaaggggtaattctaaggaagctcatgcctccatttgtctattaagagacaaacatgagaaaacaaaacaacatcagttgtagaagaacataaagaagatagcttgttggcggcagattactaaagcacataaatggaaaaggtctccctggatcaaagctatcttgctccttccagtattttaatatttagtagattatctttctcataatgaaacaaaataacaagacttgtgattggtaccatgtgatttcaagaaaattatgacatccaaatggggaaattatgacatcagaggtagttaaaccaatccaagagtttatattagtgcattgcatcctgaaatcctattggccaaaaagctaagcaatgagtcaagatacataacaatttgaataggctgtaaagcaataaataaactggtaagaattttttaaagccttgggtttcttccttagttctggagagactgaaaatctacccagccatataatgttttttctagctgtaaggcaaaggcaaagataaaaataattcatgtattagtgcatgtacctgggccagttgccagttttcatgcatggttcaacactacccaatatggcattctgtgggatggttcaacactaccgaatatggcattctgtgggatggttcaacactacccagtatggcattctgtgggaagtaggagcaaaccattcccacccacttcccacattaaatgcctatcccacacctaaagatccaacactaagaaaacagtgtaaactcttattgttagcctaatacagtcccatcttctggtaagaacctactatgtgctggcaaatactgagagtggacatatattggagaagaaaatagagacggccctactcttgtagaggctaaggattttggatgatgtcccaaggacaagagaaacacactgtagggttctaagccagggaggtgacaaatgtgtttcaaaatgttcactttggttgctttatggggaaaatgtattggagagggagaataacaagagaatgagcttaggcaaaagaagatagtggcttggactcaaagtagcagcatagatgtagagacacagacaaaggctgaataacagatttagtaactggaaggacagtagtgggaagaggaaaggatggccacaatgataaaaaatcactacatgatttttgcaaattacagaatctttacggctttaaagatgccttattgtttagttttatcttaaatctttatctaaagtctgtttcaaggagccaataaattggcaacacccactcaaaaatttattttctatcatgtataggttatcttctatgtgctcagcatgccacaaagtcctagggatagaaaaagaaaagaccttatttcctagtgtgaaaaatggacatgaacatttaatcatagacatgatagagttttctcatttggacaaaagcatttattgtattccctggcctattttagttaatatttgttagtattccctgtattttagttaatatttgcttttttaaaaaaaaactctaggaaacagtctacttgtcccattcatgcaattctgttgaagcatgattcaggtaacacctgaactgtccttacaggtagactttttttttttcatgttcaaatggagtgaattcctggctgattctattaacagtgacaaattgaagcctcattaagaagacggtttaacatcatcatattagaggtaatttgttaaatctgtgattatttaacctttggaagtaggattacaaaataatataactctgactttttattttgcagattttttgtgggtgaagtgtttaacctgtaactatattttgcttcaaaacatatctcacatcaaaaggttctctgtatggttgaaaggaccaatttgaggaacttagctcattcattctatttttctcattataatataaagtggttaaggcaatgatagaactgccctctcttctgccctcgtcttacaacaaaatagacctataagaaacaatcatctatctcttaaaaagtggttttcaacttgggggcaattttgcctctcaggggacatctggctgcttctgcagacattttttgattgtcacaattagagagtgctaccagcatctagcgagtacacaccagcgttgccactaaaacatctgaaaatgcacatagtagctccacataataagaaattatgtggtccaaaatatcaatagtaaggttaagaaaccctaatctaatgaaacagcctgaggagagaagcatcccaaaactctcccaaccccgatgggtggtcaggtataaattctcgacacaaaataagcttttataattgacaatgcttccatcaaggatgaggccctcaatgcaacttaatttctctagttttccctggaatagaaacaggagagatctgtacaagttaccttttagtccattaagtatcatgacaaattgcatatattttatcagaatgaggtctaagagtcttcctggaaccgcatgtgactgggagacagagagagagactggatgattgaggctactgtaatctgttccttttagatcatttattcaatacatggacattctttctaacagccaaatattgaagagtttttcattctgttgaattttgcaggtaggttacagagaattgaaatatattagtagagataatatataatatgtaatataatattatatattatctatattatatattatatatatttatattatatattatctatattatatattatctatatttatattgtgtattatctatattatatattatatatatttatattatatattatctatattatatattatataatatattttatatattatataacatttatatatattatatatgatatataatatattatataatatatctcatatataatatattatataatatatcacatattatatataatatatcatatattatataatatatcatatattatataatatataatatatataatatataatatatgatatattatataatatatatcatatataatataatatatatgatatataataatatatatttatatataatatatattatataacatattatacatattatatataatataatataataaatataatataatatataatatattatataatataatatataatatattatataatataatatataatatatatataatataatataatatataatattatatattatataatatttatatatattatatattatataaatatatattatatattcaaggatttatatattcaaggaatatatatatgtttatatattcaaggaatatatatatatgcttatatattcaaggaatatatatatatgcttatatattcaaggaatatatatatgcttatatattcaaggaatacatatatatgcttatatattcaaggaatacatatatgcttatatattcaaggaatacatatatgcttatatattcaaggaatatatatatgtttatatattcaaggaatatatatatgcttatatattcaaggaatatatatatatgcttatatattcaaggaatatatatatatgcttatatattcaaggaatatatatatatgcttatatattcaaggaatatatatatatgcttatatattcaaggaatatatatatatgcttatatattcaaggaatatatatatgtttatatattccttttgtaggcaggctaaagagaactgaaacatattactagggttggttcaactggttcaaaaagtcattctacctaactcttgttaacagcgaatatgtatatatatatatatcacacacacttaagagataggttgtgtgtgtgtgtatatatatatagttacatgctcttaacaagagataggtagaacatacatatatatattcttttatatatacatattccttgctcatatatatgtatatatacttatataagagcaaggaatatatatatatataaaatgtatgtgtgtgtgtgtacatacatatatatatacacacacacacatatatatatatgtatgtacacacacacacacattttttttttccagaaacttaccagacttccctcaatgtctctttggctagaattgcttcacaaacccatgcctaatgaaatccttggaaaccggagtggaatcatcatgattatcttaggttaatcatgatttatcctgttgtagagagctctttccctggctgagcacatggccagaggaagggtgaagatttgaatgctgtgttactaaggggaaagacatgaaccagaaggtaagcaggcaggcacaatggcagttacaggctctaaattcctgaagtatccccaaaggaataatacttaaccattaaccgcaacaaacatgtaatatgcactgtacacaaggcactgacatgagccagagtctctgttaatggggacacaacatggctctgaccttaaggagggcatcatctaggcagaataaaagagttacatgcaagttggatgtatatatgcatgtatcctataacttccaggcgccaattaaattttttagaaggttataactattattaagagagaaaaaatcaactaactgacctctacccctctgctattctttgatctctatgggtaagagtgctcacacttccagaaatctctactccaataaagcaaaacagataaatacaatcacattgcactgctcagatagcatctttaagatgaaaggaaaaccaataaactacctcacaagtgtcagtatccagagctataatatcatgagagctctctaggaattcaaaaaacatttattttgcatttaggctcaaacactacaactatgtatgttttttttgcaagaaattaaatgaatcataacgagatctgaggaaaacagaatattgactctaaagtacctcactgagagcagcacaaaagcaaagagtactaatgataatatttttctgaaagcagaatctttacttttacaatttttaatgttttcttatatatatatatatgttattatttgcaagcatctcctctaattacagctaatatattactggttaaaaaaacttcatagtttcatgtaacaaaactagtttatataaaggcatttctggattgtggcaactataattcttatttctatatatatattttaagtaaattttgttgtgtatatttaatgtgtataacatgatgctgtaaggtacacatatatagtaaaatggttgctataatggaacaaatgaccatatctgtcatctcatatagttatccatttgtcctcctgttgcaagtgctgctataatctacccatttagaaaaaatcctgatataattccctctacaaaattaactattctattaatctccttgaaggacaggattaaatcttattctcatctttttaatacccagcttctaggacaatatctaccacatcataggttctcaataaaagttgaattaaattgatagcgtcattatcctctgtattctatccagtaatattccttatgcaaaattgtatctactgagttttatcttcagaaaggtgatcatttcagtaagagtataggatagttagaatattcataatgagttcaactgattctatatatgtacacacaatatgtgtgtgtatatatatatgtgtgtggatatatatatatatatatatatatattggatatgtagatccaaacatattgtattcgagatatatatatatatatatatatatatatatatatatatatatatatatatatcttccttgctcttagcaatcataaaacttgattccttagccataccttaatacaaagataaatgagcatttggaatatgatcaaatccatttaaattgtaatgggcataaataaactaaattaaactctcttcttcattcagaattcaagtcatggtctacataactttaacaataaattgaaaacaattttttccttattcagtctaccgatttagaagatagaatggtaatcagagtaggaactcattattactactctgggaagtaacggggggaaaaattcacattgtagtctttgcactaggaggcagaaggaagaggtaaatagtcttaagtaaacacaagattaagacaatatttggccgtagtataattattatctttgagctcggaacaaaatgtatcttcatattaactcaaccatttagactggatttttgtttgaggcagtggtgaataggcaatatactcaaaagaggaaaaatataccaagcagattcctttaaatcaccaccagcaattgtcctgttctcttaataggctactctgcccttctcattattaagatccaaggatgaggaccaaaaggttctgcaggctgcttctgggactccatcatttcaagattgtcctaaagcttaaaacagactctaaatcttcctaagccacaaggatatgaacagacacttctcaaaagaagacatttatgcagccaaaagacacatgaaaaaatgctcatcatcactggccatcagagaaatgcaaatcaaaaccacaatgagataccatcttacaccagttagaatggcaatcattaaaaagtcaggaaacaacaggtgctggagaggatgtggagaaataggaacacttttacactgttggtgggactgtaaactagttcaaccattgtggaagccagtgcagcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggagtaagaaaatatggcatatatacaccatggaacactatgcagccataaaaaatgatgagttcacgtcctttgtagggacatggatgaaattggaaatcatcattctcagtaaactatcgcaaggacaaaaaaccaaacaccacatgttctcactcatagatgggaattgaacaatgagaacacatggacacaggaaggggaacatcacactctggggactgttgtggggttgggggagagggaagggatagcattaggagatatacctaatgctaaatgacgagttaatgggtgcagcacaccagcatggcacatatgtaactaacctgcacattgtgcacacgtaccctaaaacttaaagtataataaaaaaaaaaaaaaaatgaccttctgccaacccaaaaaaaaaaaaatcttcctaagccacaatcagtcattgaaagtttgcatatgcattgccttcctaatacaagtcctatgatggttaactctgagtgagtctgtggttaactctgagtgagttcccagcagtcagaaataacagggcagaggtgattaaggagattttctccttacgtttttccaattcacagatcacaaaaccctttcttatttgttatataatttaatccctcccgtgaaggagcagagaaaaacgatgacaacaacatgagcatagagacatcacactagcagaaacagtgaacagtgtattaaagcaccaggccgtgtgacagatgtgtcatgtagtgaaatccagtttctgctacatgctagccatttaagctgagccacattgagcctcagctttctcatctgtagtctggaaaagtaaagtctgcctctagggccttgatgagtattggatgacatatttcacttctgtttgtaaatcgccaagcacactgctagcttagcttggtaggtattcaataaatgggccttccttcctcttctcaatcctgaaaaactttttcttccattttccagctaataaaattcccatcatctttacagacccatttcaatctcccatttgtgatctccctagccaaaaccacctgttcctatgacacattatttttgtacctatttggcagtcatttaattttgccttatattatatataattagaggcatatatgtctgtctatactttcacttggtttagaatatcttgtgagcagtggtcttatctgattcattttttaaaaatcctgttttctcccttctgtctctacactagcacaataaaacttgctcaaggtccctgacaaaatgttgattttcaagtactttctcttcaaaatattaagacatatctggagcttttataatctatgctttatacaactactcacttttttaaagaaagagaacaggcaatgatttgacaagtcttccctcagttaagaattacattgacaacagttgtccagaaaaaggcttatttaatatcacaggatcagaggccatctgtcttacattttctctccaaaagtcgagaataaatttcatctacatctctgtatctgaaaaatggactaaatatggaataatatgcagccataaagtaataaccatttctaacatataagcagcagcctttacagggataaaaattctcctttaattatttttatgtaaatgaatatatagctatatctctcaagatatttaaatatagatctacaactatatatcaggtcatgagccccaaagagtcattattaagagaaaactataccaattatgtataccatggtacctcagagaaaactctaacattacatcaggagtaatagttaaaagaaaaaatttctaattgcaaccaactttttctccaatccagaatgccttctatttctaccccaagtgacagttgaatcctgcagtccccacaaagcttccctgattaattcagtgcaaagtgagttctttttcctatgaactgtcacaatatatgttttacattttttttctttttttagacagagtctctctctgtcacccaggatggagtacagtagcgtgatcttggctcactgcaacctctgcctccagggttcaagcgattctcctgcctcagccccctgaatagctgggattacaggcacgtgccaccacacccggctaatttttgtatttttagtagagacggggtttcaccatgttggtcaggctggtctcgaactcctgaccttgtgatccacctgcctcagcctctcaaagtgctgggattacaggtgtgagccaccacgtccagccatgttttttatttttgtatttaaacatattttgcagttaaaacagtacatacagcatacatgtacatttttaaatttaaaaaaaaacactcttgtatcttttaagcaataagcactattttcttcatactctacatcctttcttaggaaattatttctataatatcttgtgatatttttcttctagtgttgaaaacaatgttactttttccccctcttacaaaggttgtcatctttacctctcaaattataagattttcgagggcaggacttcgctatgctccttcatcttcctacaggacccagtgcactgatttgtatcaatttcttatttgatttgatataacaaaggtgcttctctggcatgactaaggacctgccatgccttagttgtttttcatattccctctagaagcacaatctaagaaccatctattcaaaatgtctacattattgattatttcactcattcgaatatttatcaagaccctactatgtgcatagtacttaatagtaagtgcacacaattttagggctacagcactgatcaaaaaggaacaatctcctgtcctaatgactcttttgtgtacccagggattcaaagatgaggtcatggttatattttttccaaggaactgactttctgatatgataatacgctaaataaggtatgaaggaaggaccagagaagcacagtatcttagtctgtttgggctgttataacaaattaccataaactgggtagcttataagcagtagaaatttatttttgcacagttctggaggccgagaagtccaggattaagtagatttggtgtctcatgagggcttgctttctggttaatagaaagcaccttttcgctgtgttcttacattgtggaaagagtaagggggtctctctcaagcctcttttataagaacactaattctactcatgtgggctctgctcccatgagctaatcacctcccaaagtccccacctcctaataccatcaccttgggggtcaagatttcaacatctcaaggggaacacaaacattcaggttacggcacacacaaaaataaatcctgtccccaaggtaggacagtttaatcattatatagttctgatatcctaagttatcactttccttaggatatttcatacaatgaaaaacaaagcagcccatacagcatatctgttcacaaagtttccttcattcagatctgatggagctttaaatttttatatttaaaaacaaagctttgttttatataattttcacagtcttaagtctcgttagttttaccaggaatagcaattgttgaattttgcaagtttaattaatttttaagccagactgcctgagtttaaatcctgtacttaacactagctctacaacttaggcaacctatctaaactcatgtgccttagttcccttacctgtaaaagagagataacattagtaccaaatttttgggactcccatgaggattaaaagaaacaatgcacagtctttaaagcacttagagcactacttggctcatacacaaactgatgtgtgttcactgccagcacccatcatatttaaatcattgtcttattcacccaatttactaaagatgatgccatgatctgtaaccatttttttcaatcttaacaattgtaaggaagtttctattttgacataaaatattggtaaagaaaaaaaaaagtgataagtatcacttttccatatataacatatattcttgaagacaagtgatctctttacacaaatacctagtaacacctccagctaagcagctagtatttgaatgcacattagggataaaatatttcatgattcatagaagatgcatgaaaacagtgatagaacttacttattatacattttatagttataatgtacaggccaactttaaaaaacaaaaaggtcttttttgttccctcacatccacagaccacccataaaaacaaaagtaaaacaaagaagtaaagcttttcattagctctgctggcacaatatttttcaatatgttgacaaagagcctggtttctccaactaattattacattcataatccatgtcaaacttcaagaagaacattcatgtcaccaatgattcaaatttagtttgagatttagggaaaagaggaggttaccatgacagaaagcaaatgtttgtataatccacttaaacaactagttctagcaagacctagaggtaaattattattgttctagtagtttctatttatttggtaaggttatactaacagattactcaggtgggaaaagtaaacgatattccataaaaatcgagaagcaaaacgacatggttaatctgaaaatacatgtaagtagcagtctatacctacaagaatacaaagtggacatagtattcactgtttctatcaaatctacaactttcagattgtttctagctgtctttagtatttagcttgatttcctatgtctcattttacttacatttccattttaaaatctttggtaaacaacttcttttaatgttttactatcatcatttttttaaaaaaacaaacaataagtggggctatgggtaaaacagttacaaaaagaatccatagtcaagtggagagacgaaggacccaaaaatttgctttttgcatgttaatttcttaccaaaacaaatacatacaagatgggctatgaagggtaagcaataaatcttcaagaggagactagcacaagatccattgccactcataggaataagtctatttactcacaaggtgtttcgtatagtgttcttacaaaactgtactagctaatatttcaagtgtattacttataatttgttgaataatagaaacttacagtaataataagttccgatttgagtctttacttaacatttggtgtttagcactctgtcttatctcatttaaaattcacaacactgcagtgaagtagacactatcagaatctcgttttatcaattagaaaatggagatcaagtgtgtaattggttaaacgtcatacagctataagtggatgaaccacaggaagacatctcccctagagcttctagagggagtacagccctattgataccttgactacagacttctggcctccacaactgtgagagaataagtttctgttgttttaaacaattccgtttatggcaatttgatacagcaactacatgaagctaatagagcttattggtcatttaagtttcctattctttgacttgttattcatatcccttattcacattgttcagggattgtctgagttttcataccgatatacaggagttatggacacaccttagattttaagcctctgttgactataagcactgtaatgcctttctcagtctttggcagccaatgtccctagttaggactggttaggcctcagaaccctatctcctaggtaaggtttctccttccagaacgcagatggcaaagtggtgacttgagcttgtgaataagacacatgaatccatgattggctcttttataactgacacaggatttccgtgccttgtaatttaaaagtagcaaatattattctgcctatgccttaaaaacatgaaaaagactctcttttctgtacactgtccaaacagaggtcattctgctttgaataaggtctgaagcatacagggtctgcctgtaaaacgaaagctgctttcctacggacaaagatagctttagtcatcttctatggtcaaaattctcacagacacaaggcttaaaacctctcaacacaacgcattgcaaagaaaaaaaaaaagccaattgtacaagtacaaaaaccaaccacagtgcaaagctccaaagtaaaaaccccacatggtctgcccctagtaaggtactaccaaagcttaaagtcatccaccctgacactagcagaaacaataatgacatgattttgctcctctagattttactaagagctgtaatcttctatctacaattcaatatgaaaactctaaaggtattttttccccataagtatgcagcaaattcattgggggaggggaaaaaacctgatatttcaaaattgctagaagaatacatttcaaatgttctcatcacaaaaaaagtatgtgaggtgataaatatgttacttagcttgatttactcattccattttgtatatatgtcataacatcacattatacaccataaacatatacaattataatttgtcaattaaaatattaattttttaaaaaactgatctgaagtaatggaagtctatgcattcattcagtatgactattcatatatgttgctgaaggaatatttgttttatgaaaaaaagcctgcctcggaccttactggggtactatctaacatgtggcatatgtactatgctacatttctgatatctaaaacaatggtccacactgcatagggcaggcccacccccttctgctaccatcactaccaaaaaggcaggaaaatacaacctacgtctctactcctagacaaaatcccttgcaaagctaacagcctaaaagagcaggggtaagggagctcccagtcagcagaaagctccacacagaaaggaacacatttggttttctgtcctttgtagggtcgggggagcggggagggatagcattaggagatatacctaaggtaaatgatgagttaatgggtgcagcacaccaacatggcacatgtatacatatgtaacaaacctgcacgttgtgcacatgtaccctagaacttaaagtataacaattaaaaataaataaataaataagaaaggcaggcatgcctggtttctccttccagcctcatctaccaggtaaatcatgaggagggagtaaaaggtagagtgcgaccaaggggcactgactctgctaatatggtggttcttgggaggggtggggaatggagggaggcccagaaagggaaacactgatttataaacaagaaagcagaacccaaaggaaataatggggttttgtccctacttgcaatgtgaacatgactttttctactagaacacaaaataaaatttcaaatgttgacaaactctgtaacgtggtatcatttctgattttcaatatcccaacaaaatttgccacttagaactttataatgagctaaatggcaaaacaaagactccttttgttgtgtgaatacttcctaatatatttttgatatccatacttttgaattcaggatacaatttatcctacagcttattttcaacatacttgtctttatctttcacttgttataattgtgagttaatttttcaaataggcttgtcaaaacccaattaagaagttatctcatcttctcaatttggtcccacaaagcaagtaaagttgacaaacatttagtagcaatgcctgagtagtctggcaacttcaaagatgtgtaaattgagggtaaaaacacataaaaaccagattacaaataattattcctgcatttttcaaatacttttagaataggtaagaatattaaactgaaaagaccacataaaaatgtttacaaaaattataagacacttacttatgacacaacttacatatgatactggttaaatgtttctatgtggaagttatgttggaactgaaagagtaataactaactttcataactagatgtaaatactcaaaatgaagtagcttcaagattcaggagggtaaacaacactctaatatagaaaatcttcttatacaacctgcagcaaccgaaatctttccatccctttcattgtttagctaatgggccttaaatttataaatgcaccttggtgagggcataagcattttccctgtgtagtaaaattcctgtgcagaaaaatattgaaatacaactcaattatcctagcacaagagcagtatatcccacattcttttttgtctgtttgaagacaaggtcttgctctgtcacctacgctggagtacagtgacacaatcataggtcactgcagccttaactagctgagttcaagtgatcctctgcttcagcctcccgagttgctggtactatataggtgcattccaccacactcggctaatttttttttttttttttttttttttttttttttgtagagacaaagtctctctatattgcccagactggtctcgaactcctggactcaaagcgatcctcatgcctcagcctcctaaaatgttgggattacaggcatgagccaccacgcctggccccctcattctttagtttaaaaaaacacatttagagtttactaagctagaagctttatatatgtagtttatgtgattgccattatacaattcaaccattacatcttaatttgactactcaaagaactgcctgtcagcattctccatcatattcctatatatctggaaatttcttgacatggaaaaatgacaagaagggggaagaggatgtgggaggggcaaaaggaaagcaggtgagtaggggagagagggaaaaggaggtaggagagaagtagaaagagggaggaagaaagatggggaggcttagggaaagcagcctataggatattgccagtgagctcagtcttacaggacaggaaaagttcagatagttaagggtagccatggccttctaaacagggaacagaataaatagcaagttgtatatggcatattcagtacccacaggtttttctccgttgttaacagtctagtgagtgtaacaaagcttagtgaaatgaggatacaagagttggcagggaactgatcaaatggggccgtgttaaggcttttataatccaagcattacaacacaacacttaaagaaagaaccaaacgctgtggtcaagctgaagcgctgaccactgactacctcttagaggaccaagttgtgagctcaagactctaatcataagctggtatgggataacagagaacagatacaatggaattaatctgtttcttagaaagaatgtgcccaacaatcaatggtcatggtggactctatcctgctttctcctccaacttggcttctctagaacctgctggatttatgataataattacttgccacctactgttttgataataaaacttttaggactgacatcctatgccataaatgtacacaattttgaggaagtgagtaaaggaaaagccacaggtaaatccctctacgttatataaacacagctccctttgaattctcatcagagacatgggcaagccagggtctttgggtgtaggaggagggagccatgggcatcagtcactgagagggccctgaggggtgggacagcttgactggtgccaagagctctgcacagaggggaaaggagaagtgaggaaaggaagaaagtgaggggaagaaggggtgggggagagagaaagggaatgagtggcttcatgcatgaggagaacaagctggaagtccccaacacagccttcctccctgctctgaacttgttcaaatcacccacttcctccgactatctgactatccccctatccttctgttaaagaaggcagggggccaagttcacaccagagctgccaccttagtgcactggcatgtgcaatgacgccaatttgaaaaacaaaggcatgctgggcagaaagagagagagaaaaggctggtctccactttccttcctaacatgcacgagcagaggttaagtgtatttaatacttttattcttgaaggttcttcacatccatctacaatcactgacttaataacttctgtccatgctacaccatcaaatgtgcacataaatttattaggaaagtagagaatcaggtcggcaattaaattctatgtgatataataatttttagaacagaaaactcaataatgaagctaaaatctcagcagtatataaagaattaaatatattccaaggtgattgaaaaaaatcatgactgaaaaaaaggaaaaaatatcatcatttatggctttatcaaaatcttgcatagattaatggtcattagggaaagaaaaactacctctctgcagtcatttgttgtaacatagaaaatacaagctcatataaaccatctcaaagaggaaagaacttgctcaataaagagttattggaatggaaactctaattattaaaatagtatttcctaaacattatgcttgaattaaatactgcagtctcctcctaactttggagcactggactatttcaataccaaataatcagtggatacttgaaaggtgactgagtagaagtaaaaccaatagaacgtcatactaaaagtgtcaatcagacctaacgagtcattctagagttaactattttaaaggcagtaaacgtatgccataataaaaccacaataccatttaattacacttttagttataatttctagaaggaatttgagaggacacgcaaaacatatccaaacaaaattaaaaacacatgaaaatagtattaatgctgtaattgtatattcttaaatatactttgacaataaataaggtttcaggtactgtgaaagcataaaagataacttaatagaggtttgtatatatatatacatatatatgtatacatatctacatgtatatgtagatatatgtatgtatgtatatatgtatatgtatatacgtataagtatatatacatatgtgtatgcagatatgtatgtgtatgtatatatgcatgtgtctgtatatacatacacatgtatatgtatatacatacatatatacgtatacatacatatatgtacgtatgtgtatacacacagagcgagagtgagagcccgtgcgaaactttgggatcttttaatatacccctaaaaaggatatacctcctgtaatattcctaaaagtgaatcacctagtttcagattgaaaactgaatgttcataagattactgccacacatagaaacaacgatgagagttaacaagtagaattgattattgctgtttgaatattattaaatttaccgacataaagctggggtgtatttttttgtacatcaaaaatggccaaatattggcagtttcatatggtttaacaaaaaagctatcatttgaaatatatgtgccaggcgttgtgttaattatgttaacatacttaatcttaattttcagagcttcatgagaaattcatgtatcaatttctgtgtgcataatattttcattttgaggtgggcatcatcacattcaagtcctctaggtttgctcaacacaaaaaggaaaacttaaaagaaagacatcattgtcttcagtaccccactccaagctggtaaagtcggccaggacaattctaataattaattcctgcttataaatctgtctctccttagagacacaaaaaacccttcaaaaaaccaacaaatccaggaactgcttgtttgaaaagatcaacaaaattgatagactgctagcaagactaataaagaagaaaagagagaagaatcaaatagacgcaataaaaatgataaaggggatatccccaccgatcccacagaaatacaaactaccatcagagattactacaaacacctctacgcaaataaactagaaaatctagaagaaatggataaattcctcaacacatacaccctcccaagactaaagcaggaagaagttgaatctctgaatagaccaataacaggctctgaaattgaggcaataattaatagcctaccaaccaaaaaaagtccaggaccagatggattcacagccgaattctaccagaggtacaaggaggagctggtaccattccttccgaaactattccaatcaacagaaaaagagggaatcctccctaactcattttatgaggccaacattgtcctgataccaaagcctggcagagacacaacaaaaaaaaagagaattttacaccaatatccctgatgaaaatcgatgcaaaaatcctcaataaaatactggcaaactgaatccagcagcatatcaaaaagcttatccaccacgatcaagtgggcttcatccctgggatacaaggctggttcaatatacgcgaatcaataaatgtaatccagcatataaacagaaccaaagacaaaaaacacatgattatctcaacagatgcagaaaaggccgttaacaaaattcaacaacccttcatgctaaaaactctcaataaatttggtatcgatgggacatatctcaaaagaataagagctatctatgacaaacccacagccaatatcatactgaatgggcaaaaactggaagcattccctttgaaaactggcacaacacagggatgccctctctcaccactcctattcaacatagtgttggaagttctggccagggcaatcaggcaggagaaagaaagaaagggtattcaattaggaaaagaggaagtcaaattgtccctgtttgcagatgacatgattgtatatctagaaaaccccatcgtctcagcccaaaatctccttaagctgataagcaacttcagcaaactctcaggatacaaaatcaatgtgcaaaaatcacaagcattcttctacaccaataacagacaaacagagagccaaatcatgagtgaactcccattcacaattgcttcaaagagaataaaatacctaggaatccaacttacaagggatgtgaaggacctcttcaaggagaactacaaaccgctgctcaacgaaataaaaaaggacacaaacaaatggaagaacattccatgctcattgataggaagaatcaatattgtgaaaatggccataatgcccaaggtaatttatagattcaatgccatccccatcaagctaccaatgacttggaaaaaactactttaaagttcatatggaaccaaaaaagagcctgcattgccaagacaatcctaagccaaaagaacaaagctggaggcatcatgctacctgacttcaaactatactacaaggctacagtaaccaaaacagcatggtactggtaccaaaacagagatatagatcaatggaacagaatagagccctcagaaataataccacacatctacaacagtctgatctttgacaaacctgacaaaaacaagcaatgggtaaacgattccctatttaataaatggtgttgggaaaactggctagctatatgtagacagctgaaactggatcccttccttacaccttatacaaaaattaattcaagatggattaaagacttaaatgttagacttaaaaccataaaaaccctagaagaaaacctaggcaataccattcaggacataggcatgggcaaggacttcatgtctaaaacaacaaaagcaatggcaacaaaagccaaaattgacaaatgggatctaattaaactaaagagcttctgcacagtgaaagaaactaccatcagagtgaacaggcaacctacagaatgggagaacatttttgcaatctactcatctgacaaaggcctaatatccagagtctacaaagaactcaaacaaatttacaagaaaaaaaacaaccccatcaaaaagtgggcaaagcatatgaacagacacttctcaaaagaagacatttatgcagccaaaagacacatgaaaaaatgctcatcatcacaggccatcagagaaatgcaaatcaaaaccacaatgagataccatctcaaaccagttagaatggcaatcattaaaaagtcaggaaacaacaggtgctggagaggatgtggagaaataggaacactttcacactgctggtgggatgggaaactagttcaaccattgtggaagacagtgtggcgattcctcaaggatctagaactagaaataccatttgacccagtcatcccattactgggtatatacccacaggattataaatcatgctgctataaagacacatgcacacatatgtttattgtggcaccattcacaatagcaaagacttggaaccaacacaaatgtccatcaatgatagactggattaagaaaatgtggcacatatacaccatggaagactatgcagccataaaaaatgatgagttcatgtcctttgtagggacatggatgaagctggaaaccatcattctcagcaaactgtcacaaggacagaaatccaaacaccacatgttctcactcataggtgagaactgaacaatgagaacacatggacacaggaagaggaacatcacacactggggcctgttgtggggtggagggaggggggagggatagcattaggagatatacctaatgtaaatgacgagttgatgggtgcagcacagcaacatgacacatgtattcatatgtaacaaacctgcacgttttgcacatataccctataacttaaagtataataataattgaaaaattaaaaaataaaaataaaataaaaataaatctgtctctcccagtagactgtgggctcatggaagtcagggaccttgccttgttcatctttttatttccagggcatagggcaatacctgactagcacttaaaaaaattcacttaattaattatttactcagattaattgattgcttagtgtctagtatatgttcagtgtcgtataagccatggtatcctgctctgaagcagcttataattatcacaaagcagtacacatgataatataaattaagtgctgaattgtgcaaaaccatggcagatacttgtgggaaaggaatgctgtaggtaataatagtaatagcagctcacatttagctaaggcagtgtacttagcaatttaacttcattaactggttcaatcatcaaccatccttggaggcaagtacattattatctccattttacagatgaataaactcaagtatgggaaggttacataaactccgtcagtcacacagatctggaagtccaatccagatagaacaaaactcgcaacgttttttcacctttttttttcccatgtgtttaaattctatttcctctgtgctgaagcctccacaagtcctgtaagtcagcgatttctaaccatttttgaatcatgaaccttttggcagtctgttgaagtctagtgattgtgatctcttctcaggattatgcttttaaatgcataaaaataagtccatacgattacagagaaaagcaattataatgaaatagttataaaattattttaaaaaacaaatttgtgttatagtagtatgtgtttctatgacaactcattaacaaagtttaaaaagggatttaagagtaatgtagtttcggtgtagttcatgaacacaaacatattttgagagagctgcagtggaatgtaatgtgatatgaaaatatatgtgtttcttttggtgataatgacacaggcactgctagtactactgtactttattgtctaagtcataatataagtaaatgctatatcttagaggttagtgaatataaggatctaatgttttcccatcctagttcacagaccccctgaattctatccagattaaaaatccctgtttgcaaactacaactcgtccattttactgtgaaaacatctcttttatatatatatgtataggtatatatgcatatgcgtgtgtgtgtgtatatgtggatggatggatggatggatagattgattgatttagggggtataagtgtagttgtgttatatcatggatatactgcatggaccatctgggcttttagtgtacccatcacccaaatagtgtacacgtacccaataggtagtatttcatccctcacttccctccccccaccctctcattttgagaaatgcaaattaaaaccacaatgagatagcatcttaacaccagtcagaatggcttattactaaaaagtcaaaaaatggccaggcacagtagttcacgcctataatcccagcactttgggaggctgaggcaagaagatcacttgagcccaggagtttgaggctgcagtgagctttgatcacgtcactgtactccagcctaggatacagagagacaccatggtcttgcctcacatgtaggttacaaatgccgggaatatactctaatccatactgaaacaggaagtacttaagagcaaggtagaaccaacacgccctgcaggacgcctggatgacacctcacagatagcagatacctatttacaagataaattcatccatattttatatcatccccgtgtccctaaaaagagttggtgtctcctaaacagtttgaattttttttttcaaatagtgtttattcaagacagtaaattttaactcaccagcttaaccactctaaataaaactcccattcacccatctggattcagaggcaaaagaatgcttttcccaatgatcttatgaaaataagattctccatactgtcttatagaaactgtcaatgacaaaaatgaatattcttgacaactgtaagggggactatgtctttagtatgttttatgttgtgtcaaatgaaaattatcctcccaataagtactttgataatcaatacaaaattaaattttataaacaaaaccaatagtgtactaggaaacagacgaacaatgactgtcttagctaatcacaggcttgcgtacgttacttgtttaatgttccatgctttccaaaagcttaatctatccatttttatgacactgaaagagaaaagctttaaatatgtcaaggtgaagccagcccccactgtgactgtgctaacacaggtacacgtgttttctctcaagatctatccctgaagccaaagaaaagaaataaagctctaaaatagaagcttaatgataaaaagaactattgagtaaatctgacagaggattagcaaacgacatgcacgaaactgacttaagagtaacatttgagcaaacataaaacttatgatgctgtcagggtcatagagtcagggaaatgggattatttactcttaaaaacttttaaaaaagaacataaaagaaaattgtaaccgtaaaattaggaagagcttcctgatacaaaaaaaaaaaaaaaactatccacatataagatagagtttgcttgaatgaggtggataactaactataggtgttcaaagaaacattacttaaccttaagctgacaagataaagtaaaatgaataaaactaaataacttcctgaggaaaggcatttaaagttaaagagcatttccctgattaatgaaggagtaatcctgtaaaatggaatctgtggtcaaatggacctccccatcagaaagcttcagcagtgccacggctcagaattcctctaagtactaacttggcatttttccctcatgaaagacacagctttgctgacactggatttaaagaaccaagggtatcagagagcctgataaacaaatgtgcccttcaaaggattataaataggtatgagcgtaaattctttctgaactggggtgccagtttaaagtattaagactatggcatagcacaaacataagcatctcagatctgtcaaggtcctacctttgcaatgtgttagctctaaactgagcagcctttccttgggcctgggaattagaaaatgctacactgaagtaaattgcatgtgcttctttctgttattggcagctacctagcttgggttaaatttctaggccactggtgaaattgagaatttacaccagatttacttacccacagcccacctatatagatgtactatccttttttaagaatatacaagcagaagaaaagagaatgaagagttaacagaggtctagccctgccctctgccacaaatttgctaagtaggcatgaaaaattgacactctcagtttcacctaaaaatgcatgaagagagaagaggaaaatgctcaaacaagatgttttcctcagctatcctcaagcaacaaaattctacaatccatgcattatccagtcttcataacaaaatggatgccatcaagaatgcaggcaactttacagaacacactcacaggcagcagaaacccagatattgtatacaacaataggaatctcagacatgaaaacacattgtgcaaattcttactcaacacttaatttaaaatgccatccttagaatataagaaaatatgaagtgaaacacaatggttaatatcaaaaacagcaaatacaatgtgatctgcagagctcagtgcaaatttagaatatcacttctcattactggttatggatttcatctatgaatgtgttgacattttttatctcctcttgccacagcctgccaatcttggtttacttagcgatcaacaactcactacaaaaaaaataggctttttccagggcattattgcaaagtttaaaaggtatttagacaggtcaaacatcccttgaaatatgaaaagtaaatttttctattccaaagtaaaatgacaaaaatttttcatcaaaatatttaaatgccaatcttcccagctcctctctctctctagcttacaaacataagaccaagcaatgcagtatatctatcaaggataaaaaagtaaggtaattacataaaattttaaaagcctgaaaaggctcttagtttttacaaagaaatcaataaacaactgcaattatttttaagtaaatatgaagagttgaggtataatgttaggggaagaagagagataagtgaaatggaatgataccaatctgatagctggtggtagaaaattggagtagatattcccaaattccttgggaagaagctaatttctgaagtcaagttccttggtattctagactaggaagtaagagtgtgtataaagattgaaaaacaatgacctgaagatttgtcctgaaagtaaagtatcaagtcatgctcctttatttgttctttacagttttgggggactgcaagaatacctaggataaaggaaagagaagtacaacggaagaaattaacattcagacacttgtgcaactggagggagctttgtttttatttttttcaattttatttattttaaatttatcttttgatacattatatttgtacacattcatgggggcacttgtgatattctgttataggcataaggtaacactaatgataattttcttacatttgtaatgatcaaattagggtattcaggatgtctatcacccaagtatttattatattacaagtcgcctctcttctgttttgaaaaatacataattgttaactataggcaccctactctgctatcaaacattagaactttaactgtatgtttgtatccattacccaacctctctttaccctctatccaacacctgctcttcctagcctctggtatttatcattcgtttgctacctccatgtgatcaactctcttagattctacatatgagggaaatcatgcagaatttgtcctcctgtgtctggcttatttcacttaacacaatgacctccagttcaatccatgttgctgcagatgataggatttcattcttttttttacggtcaacagtattccattgtgtatatatatcacattatatttatccattcatctgttgatagacacttaggttgattccacatctttgctattgggaatagtgccacaataaacatgaggatgcaggtattcttttgacatattgatttaatttcctttggataaataccaagtaatgagattgctgaatcttatggtatttctatttttaattttttaaggaaactccatactgttttctgtagaggttgtactagtttacattcccaccaacagtatataggaaatcccttttctctacatacttgtcaacatctgttattttttgcctttttaataatagccattctaactgaggtgggatgatatttcattgtggtttttattttttcatatacatgttggccatttatatgtcttcttttgagaaatgtctatttatgccctttgcccatttttaacggtttttttttttttttttttttactgttgagtcctttgagctccttgtatattctggatattagtcccatcttcccccttctacagatagggaaacagttccaaagcaatggcatgagttgcaccaacataatcagctcttgaggagaacctaaatcacagaggtactaatacacgaggggtggtaactggaatgaagaggagcagcagcagagggaagtatgatgtaaatcattgttatcagtgatttataatcatgaaaacagaatccaaaggaaataaaatgaagtgtagtctctacctgaaatgtgaatgtgtctttcatcctaagagaacagaaaatgagtgaatattggaggtaagaaacttacaaaaaattaatgcaaaatacaaaaaacaaaatgaagaaaataatcacatcataacagagggttaagcatcttcttagtgtataaacaatgcctatatgaatcagtattaagaaaatgaacatgtaaatgggacataggacatgaacagataattcacaaagaaatatgaatgaccaatatagaaatgttaaacttcactaatagcaaataataataataagggaacctaaccattggcatttattttatgataataccaaatgtgcaagtaaaaacagcactcatatatggttatggtagaaaaacctgttactactttgagggcaatttaataatctgtataaataacctaaacagtgctcatcacctatcacccagtaattctacttgcagaaatttatccaagataataaacttatgactatgaacaattatttcagcatttactttttaatagtaaaaaatgaaaacataactaataagcaagatattaaataatatttagatacaagcacacaatgatttattatgcatttacttaaaaccatgtttatattgagtatctgatattaaagtatgctaatgtcatataaatcagattccagttttatacatacaaaacagaaacaccaaactgtaaaaggagttgctatagctattgaaattatacaggcggtatttgttttctttttctctctttttataatgtactatttttagagcagttttaggatgacaaaaacatttcttattttaaatatttcttaaatttgccaacataaacatatactacttctattaaaaagtgttcttaaaataatatcacagtagaaaatttctgaatttcacaattcaagacattttgcaaaaaaaggccagaattagaacatttttgagataaaaatgagtactgttccccaaatttcataataaacatattgaaaaatttttttttaattcattgaaggaatgaaggaatttgtcccattataaagcaggaaatctgaacagcaaatggtggtgggggtgggggtggcaacaacaaagctgattttaatacttttttggtaacttttaaaagattaaatacctctctctcatttattctttggaaccaaagtagaacataaacaaatgaaaacagtaagaaaactatacatcctttctgaaaagttgtgaacaaagccaagtcacaaattttttttttttttaagaagctctagcatccatattttgtacaacagcagaacttgaaagtttgtattatgctgaaagcagctagtaagcaactgtatactgccttttggaaatctacaagagaaagaccatttacttttccacatgtccactgtaaatcacattgtcatttgttatatttggataaagtgcacctgaattctgtgaaacagaagcagatatctgaggggaagaatagcttggaaagtaacaaattgcaatcaacctatgtttacctaactgcagagtcagatgatgtttcctaaattgaaaaatagaccaaaaccaaaaaatggccaaaaacgaagagcaaacacttgtagaatttgtgtacattttagcacttcctttagacaatgaggtgcttaaagaaaaaaaaaaggtgaagaggggaaaaaaaaacccttcaattaacaaaaaagatgaaagtgcagcagaatcaaacaacaattaggaaccgcaaaattatcaagattataactgccaacttttattaagtagttaggtatgctacctgccatttctttcttctcttcctattctggtccgtccctctaccatcatgtctgccaacttaggtggtttagatatttgggtcaatttttaattatgccaactgtgtgtgtgagaatattgaagaaatttcacaaacatacttctttattattcttgttacttataatacttaagacatcttattaaaaatatgatataaattatattgttacataaaaatcattatcattcctcagtatatgcttttatgtaacatgttgaacagtattcatagtaaatattaattataactaacatatacacacaaagacaccccccacccaagaaaacaccacatagaaatacccaaaaagatctaatcctggaataatctagctgaaagaaattatttcctttaaaaaaatgtaccaagaagaaatgaattttgtcaaataacgtggagaaaaagaaatatatctcgggtttcataccaagatcccaggtattaaagtaaaccgaatatctgaaggtacaaccactataagaacagacagaaaactttttttttttgagatggagtaattgtctatagactatatagacctacaatcaagatggaaaaggctattcataaaaatcattcaagaaatagcaatcataaagctgagagagaaaaataatagcaaacagattttgagaaaatgtatatactacgagtacaaagatatcttttcaatttaatttgtaatacacatttattaggattgttcatatatatattgttgaagaatataatataatatatattctaggattagatctttttgggtatttctatgtgctattttcttgggtgggggtgtctttgtaatatatatttgtgtataatatatattatgtaataaatacatatatttacattatatattatatataattatatattacatatcattatatattatatataatccttcaagccaatccttcaacatacattatgtatataatatatatacattatatattatatacataatgtatattatatataatatacattatatatgctatgtatattatatgatatacattatatatgctatgtataatatatattatataatatacattatatattatgtataatacatattatatacagattcagaaatggctatcacagctaaaggattgtaaacataataaatgagcaaattaccacttaaagattattaatagttgacaacagctgcatacagcaaacaatatatataacatccctgaaaacacagacttcaaatgatgtaagaagccacaaaagatcatagaatcacagaataactaggttagaaagaacatgaaaggccaaccatgcttcatatatatctagcatcttcaaggaaacacaaaatcatgaaatgaaggacaatcatattcaaaagaaatttcattacaatacaaaagtaatacttttagaaaaagagaattgtggagaaagtaagaataaaaacaagatcaaaatatacagtttctagatagagcaataagtactgcaatacccattcactcagtcatcaagtattcattgaatatatttgtgtgctaaactggggatacaatggtaaacagaaatggctctttcatggaacatacattctagaagttataaggtctgcatcaatatggttctcaaatgacaatgtgaatcaaaattatcaaggctgtgaacaaatgtgatcccaaaagagccaatccttcaagatggatcccaagtagctaactaggtttacattcaaattgagtcaagtggccatttgctgactagaagtcacaaatgttactctgagttccctgaaaattcacacctctgtttaactttgggacttcaggaactcacctgaacccaccaatcagagctcacctaccttgtccaatcagggcccagtgatatccaaccaatcagaacttgcttgtgttgaccaatgagagctaagcaagtttgaatcctttatttgcataagtggacctgactgggaacctagtgcaaaatctttcactataaaatcagagcccattgcttgagtcaaggatttctaggccacagtaagctatgatcacatcactgcactctagtcggggtgactgaatgagaccttgtctcaaaataaattaaattaaaaatcaaaattaaataaatgaaattgcttttcagagaacttttgttcacaaagcacaggttcaaaattcagatgttgaagccccattctcagaaattcttattcaacaggtcttgtatggaacctaagagtctgcttttagtcagctatggtggtatgaggtccttagctctgcttttaattagctatgcagtattggacaagtcacttaacttcatgagtaagatgggaataattatcttgtttataagacttattctaaaatataaatatatatttaaatatattttaatttctctgatgtctgagattgctaatagattttgaagtgcccacagtacctgacataggtatattcaaaatggcaactgtgaaataacgatagcatgccagaaatagtaaaaaaaaaaaaaaaaaaaaaaaaaaaaaagaaaaaaaaaaaagaaaatctggattcacatttaactcggatgcttacaatatgtaacactggaaaagtcatttaacctctatgagcttcaatttctatttatgtaaagtgtaggtaataatacttgcactgtttattgcaaggagatattgaaagaagaaaagttaagactgttctggtaaactataaaaattactacataaaagtaataatacataaataaaacataaagatcatgatcacaggaaaatatgcaaaatatacttctaaaaaaatgaaaggcattttgggaaaaaaattgagaagcaacttttctaccttatttttccaactaaatttatttattcattcaagagtttgttgcataccaagtgtgtattacctggaaaacagtaactccacaaatgcaccccaggaatgcagactccataatgagcatcacaaatcttaacaccattttgagacgtgcacaaagacatgttagatatagtttcacgactaaacactagctggaaatacgaacagaagtatagaaaaaccctcggtcaccaagtcaaaccacctcttcaatgcttacatctctttctgtaaaaatcctagcaggtagtcatttaattccactggttagcaatccaccaattctaagagaatcatctggaaagctttcaaaagcatgaattctgtaagtctgattcagaaagtctgagacagaaccccaggacctgtttctgtagtatgtttcccaagtgactgtgaaaggccactagaatcaagttgtgatgctatactcaaccagtccattctattttggggcactgcaaccaaactctagatatattaggttgaaatcttccccacttcagtttccacccaagtcctagttttactcttgggattgcatacaacaccataaaccgaatctgtctacaggctaaacacccccagctccttcaacttacatatggcatgtttcaaacctgatcactaaatttgtgcactttttttattcatatatggtgcccagaagagaacataatcctcatgtagaacacaatggggatactctctccttcactggagttacaatatttttattagcacagcttgtgtgcctttttttcaatctgtattctgttgaaatgtgtgcctttttctaaactgtggccacatcatactacgcttacttttaaaaactcacttattttgaaatattctaggtttacacaaaagttacaatgatagtacaaagaactccctcatccccctgctgatccaatttcagtttccctaaccttatcatcttagagtgcagcagtgcatttatcaaaaccaaatataagcctactgtttcactaaaaactttatatctttttatacagattactcccctgagctacatttccttcatcccaaatacagacttttggcttttctttagtttaagtacatgaggcaaatatagaaatttacagttaatactgtaagattcaaatattgaattttacatgatgaaatcttcctctgactcttacaaggtgaaatctaaggtcctatagatgttaaaattttgagctcctataacttgttaagatattctgagacaaggtccagttggacatacccactcttgacattagatttatgttatatacatatttagtcagcaaaacttcatttaattcaataggctgaggcttggggtaaggtaaacttctctagagttgcattaattaacctctgatgcataccatcactattacaaatccaatcagttaacagtacatccaattacttaatatttttacacaaaaatattcttgcctcaggtaagttcagacccattgtatctccacattttcccttgtttattagtctaatatatattcgcatattatgcttcttcagctgaaaggtgttgagtacctgcacaatgaaaggaatccattccctcaaatgactctgaattgcttatgcaaaaagtgaattctctaaactaacagctagtggcaactcactgaagcagttaatgaccatgtgtgaaaactggtgctcataggaaatccatagagaaactcctatgagtcacaagctagaatcagaagaaacagcagaatggtattggtagtattatttctttaggaagcaaagagaattcaattcatcctcttgaaattagttactagctttaattattataaagcttagggaacaaaattgcataagatagcaatttactattgaaatccagatttaaaaggataatttagacatgtggacctaaagatagctatagtcagctgtatcaatcactgccagaagatttttctaaatagtttacttctcctcaaaagatgtgactaatttcgattctgtttatctctcaaaaccaggctgtggaattagagcttttaaattgctaaatagaactgacaatgctttcaaaaaggttgcaaattcacagccttcctgtcagaccagcaagcttctttaaaatgagaaacccataaaaataataaaactccttttaaaatgcatcggaaagccaaaaacaaagctcttcaaacttacctcataataactccgaactgcgttgcaaaatgcttcgtcagctacaatttgggtttccccattgaggaaggcctggaaccgttctttcagtaactgcaactgttgtttgttaagctacaagaaaaagagaaaataagcagataaattggccagtacatgaaaaaataatgactattaaaaatcatatttgctgtatattagatttcacatctagaattaactttatagtaaagaaaaataaaagctaaaacatcctactacttgttctaatggttagacctccatctcaagatggagtcaagctctgtcttccaggctggagtgcagtggtgcgatctcggctcactgcagcctccacctcccgggttcaagcgattctcctgcctcagactcctgagtaactgggattatggtgcctgccatcacgccttgctaatttttgtatttttagtagagatgttggccagactggtctcaaactcctaacctcaaatgatccgcctgccttggcctcccagtgtgctgggattacaggcatgagccactgcacccggacactaatggttagactttaaaacatttccaagccatttcatgtactctgtaatcctgatatggaagtggaatccaaatttctaccccaaatttccagaatcctgatatggaagtggaatccaaatttctaccccaagtttctatctcaaatttccagaattcttgtgattgccacaccagtttcttcatagagacagggaaaatataaaatttggataagaaattaactaatagttaatattaataatattatacaaaatcgccagctgttctaaacagagaaagtagagaggagcttagagatgagggagggatgccttggacaagagttaataggaagaaagactgaaaagacagaacgtaccctaagaaagatccctctggaaagaacagccattgcatgccaaaatttggattccatgaacaaacatacatcaatacctgagtttagataattgaaggaataataaggagaagacaaagaagacaaatccaaaagagaacagagaggcagcaggtaggcagtgaatgcgtctttgagcacataggagaaaatgctctgaactggggaagtttacaaccaagggtccttaccctgggtctagcttccataattaatacagagggtgaattagacatgaaatgtgacttatcaatcatgtcctctagtcatcaactacaagcagggtgagctacttaatttgtagggcccagtgcaaaataaaaataaggagcttcttagtaaaaatattaacaatttcaagacggcaggaacagagagcattaagctgagtgcagagcccttctaggcactaagccctgcacaactgtacacacaggggcatgtacttcactagaaataaggcgtcttagatcttaggtaatgcagaagctttttttttttttatgcttaactggagagaaaacaacatagtcttggagataaaacaacaaattccaaaatacataagaaacagcaaaggaatgatccttccatttcattcgatcctgatcagactttattaacaaactcattccagttctggaatctacagagggatgtgaagcatctggaaacatactgaggataaaatgattaaaggattaggaagactaaacaaactggtatgacttggctcaaaaagaaggctgatgtgaattaagtataaatctgttcaaaaggcttattaaactgccattcaaataaaaggaagacaagctctttcaaaaaatgggttttatttaggactctaacaaataagacagtttttaaagaaactgtagctgggagtaacagactgatttaaaaaaaattaaaaagtgtcctattgtacccagggggggaaaaaaaaaaaaaaaaaacttttgccatgggcagcgaagaaagaagaccattccatctctttactaagattatctccttcattttagaggaagcttaaccaagctgaggtgcaggaacatcatcattatattacaatctccatttctgtaatattaagaaaatggaagcaggtaccttttgtatgggtgcatactagcaacgcaaattaagttcatgactttagctctctaggcatgattcacaaaagggaccaaatggaaatgggacagcaattgctgagagtgaggcggctgaaagcactatagttactaagctctgggaatgccaagaagagcttctccttgcaagccaagtaaaataatggcaatggaaatgtatgcaaagaatgacaatgaactgaaggagaccttactgatcacttgtgccaactcctttgcttgataaataaaatacatactcttcaaaaactagaaactgtgtattttttcattcaattttattttatcaaagatatcttttttgttctttaaaactcttctaaactacaatatttgcaatttctacatcattagtatttaagttccgctattataacagtgagttactctttggtaattacagtgtagaaaattcatggatatgaatcaaggaaaggaggtttgggcaaatcatcttcttggaagctccaacaaagttgatatagttcacaaaataagccagagtcacctggctaaatgtcaggcttcaatatttttatgaatagaggatactgcagttacatttaagacataaaatggatcaaatatgacaattacatacaaaaagcaaataaatgaatactttattagcataaagaagaagtctactttttcacataggcaagatggggcaggaaaagaaaactaaacttaaaatctagcactggggatagctgtcagaaagcagtttcctaaaagctatttgcattatcaagataaaccagactgtataccaagagatagaccagtggaacagatcgaagaaacagaccgaaatacaatcagaaatgtactataaaacacctatatagcaactcaaatcagtagtaatggatggtctactcaatgaatggtgttaaaataatataaaagatgttccacctcatgtcatcagggaaatgcaaattaaaataatgagatttactacaaacccattagaaagaacaaaatccagaacacagaaaacacttgatgctggcaaggatatagaccacaggatctctcattctttgctactgggaaagcaaaatggtatagctactttgtaaaacaggttgatggtttcttacaaattaatacacttctatcatatgatccagtaatcacagtccttagtacttgcccaaatgagttggaaatttatgtccacacaaatacctgtacacaaatgtttaaagtagcttttttcataattgcaaaattcagtagatgaatggataaactcgggtacgtccaacaatggaatattatttagcaagtaatgaaataagctatcaagccatggaaagacatggaggaaccttaaatgcatattactatgtaaaagcagccaatataaaaaggctacatactgtacgactccaacgatatgacattctggacaaggcaaagctatggagacagtaaaaagatcagctgttgataacagtgtaggctatgcatgtgtgggggcaggatatatatgggaaatttctgtaccatccactcaagctcaattttgttgtgaaattaaaatttcataaaaaaataaactctattaaaaatactgaaatgtcatcaatttatttgcattaaaaataaattttacatggcaaaaaataccataggcaaaataggaaaagattaactagaaaaaaaaatacttgcaactcattacccaaagagttcatttctaaccatatagagagttcctagaaattgataagaacatcataaataaaccaacagaaaaatggacaaaattgatatgttcagataaaagacttaatccatgaaaacaagcctacattcataaaaagaatacaaattaaaactgtatgagaagccattttaaaggtacatatccttggaatcagcaattccactttgagattggatcaatactacagatacacctgcacatgtgagaaatgacatgtgtagaaggttatttaccacataattcttaattgcaaaaacaaggaaaataacctaaatgttcatatataggagactaaattatgccacatctataaacagtggtatactattcattgcattaaaagaatgtaaacattctctatgtactgattttaaatattttaaaaatatcttggggcagaaagcaagttatagaacagcagttaaaataagtcaccactcacatagaaaatggataaataacatgtatgtgaatttgcttccatatatagacagaaactagggaagaaggatggctgtgggaactggacagacagaaaatacaggtaaaagagatttttcaacattagcactttattcattttgagttttcaagtgaaacaacccttaaaataagctataacagcagctttgtacatcttgaaactcaaaacagttatgaagcactgtgaataccttaaatcctatcctacacggagactggacagcacaccaattttttccattctttcaggtaaaaaaacttaccttgactctgtgtctatttttttaaatattacaatcttgaggatttcaaaaagcttaaaccaagatcctattcaacattctaatcaacatattaatctgtacaaaatctacaaaagtagactttcagattccagttgggcctattaatacacacacatatacatacatccttttattatctcagtgaatcctattctaatttggaacaagtataaaaattgaaatcagtgtccctatggcttccatacaactctagtactatacactatctaagacaaaacagactgttactttcattctttaacacagcagttcaagactttgagaacaaaataaaatgattatttaagagttttctcttttctagaacaaattttaccagttcgctccaatatcctgggtactctcctaaggatacattccagtttgccataaaatcaccatgttaaataaaactaagtatgatggatacttggatgcaatggatcataagttctgagtttacagatgcgcagagtcgctattatagcttttttaaaaatctaaacaaactgggcgcagcggctcatgcctgtaatcccagcattttgggaggtcaaggcaggcggatcacctgaggtcaggagttcgagaccagcgtggccaacgtggtgaaaccccgtctctactaaaaaaaaatacaaaaattagccgggtgtggtggcatgttcctgtcgtcccagatacttgggaggctgaggcaggagaatcgcttgaacccgagaggcagaggttgcagtgagccaagatcatgccactccactccagcctgggtgacagagactccatctcaaaaaaaaaaattaattaaaatatataatgccctttgatataaaaattcaaaaggaaaacactttgaaaactataagattaagcaaatgaaactcactacaatagcaatgtccctcttaaaatgtactagatagactgatcaccattctcttaggatagtgtggccaacagagagataagtgagagggccacttcccacattctaagcattctatgtctattaattcaaactaaaaacaaattaactcttcttggcagtcacatctactgacttacattgtgcttataatcaacaaaaacttctaaaacattcttacatgtgcctcagtaagccatgttccatcttgctagatgtatctgagccactgttctagttaagaattattttggaattctgattccttcacctgatgactagagagctctcttagctttgttataatcactaacataataacatattatccatagtctcctccaggtcgttttaaaaatattcatcagttcaggattaaggaaagaatcctgaatcctgccattatatatactccttcagtttaacataatcaattaatattatttggggcagttgatttattattatttagcatatgttttaattttgtcttcagactactgtatttaccaatgaataaaatatttttaaatatgaaggaaaatttgaccagcagaaattatctatcaggaatttataaggcacatcctatataaaactaaattgcagaaacttaactaaaacataaatataattgcaaacatctaaatacaaccaacagattagccttgtaaaaagaaaaaactaaattttataaatctgacctggctgtgatacttcatccacaataataactgccaccagaaaaaacacttagattctagggttcagaggtgtctcatgtttcctgttttttcatattcaaattagatttcatccttttcattctgaatcatggatcaactaaagacttaagccaggatttatactactgcaggagaccagccaatatgcaacccaggaacctagcaaccatggctgcatggagcctgccctgacctgcagaacccatcaggagtctcagtacttacagtggaagctgtgtgacatcctagcaagtaaaggtggtcacagtcagattccacagcaaagtggcagaaaacttgtgggtccctccaggattggggcatgggtgtgcatttacctcatgtcaaagagtaataaaaatgagaaaggtttttcaaaaaggtaaaagtctttactctaggcacagatgtttcttaaaattcacaaacgcatagctttaaggtttgtcaattaaagaaagatattaataggaaaacgctaaaggatcagtactattttcttcttcccttcctatcaacactgtcaaaaacagctacatcaaaccactgaagcaaaatcatcagtgtcttccatgtttttgaaataacaatgcatcccaagctgtatatcagaaaaatagggggttccagctacgtctcatacattataaaccctgtgggatgtgctgatattatcagtgtcgtattcaaataaactttcctgtcctcttccataagcacagatatttgggacagtgaataaatatgcccatctaattctacaaatatcaggttcacttgataggtatagacatggtcaaatgaccaagttaagaccaaccagatgcaagcaaatgtatgcctgacttccaggaaactgtaacaggtggctaaagtaaacacactttgcttctttctcttttttcttttcctgctgaatggaatttgatgtgctagctgaagtttcaccttgattcatgaagatggtgaggtggcaagataaaaagtgcctcacaccacagagtggagcagcactgcaaccctagaccacctacctcccaacttccttgacatgagagagaaaacctccatacatcctgaccactcttattgggatttattggtaatatgcagttaacagtaatatggtaccatacctaaccagagggaaaataccatggtactatcgtgtgtttttttgtaagaaatgttcatcttaatttattctaaaacatttttccatgctatttcatatgaaaaactccttatccaataaacttgccccagcgaacagtgaacacctaagctggctggatatagattgaaaacaaagttattttggcaaaccaaattccactgtcacacagtgttgacaggacgatttaaaagcccaaaatttataaacaccatattaatatgttttataataaaatgtaaactaagtgataagtacagaacagcaaactcccattgcatggtggacaaatggaccccaacccagtctaggctcactcagcactaagtgaatgacgcctacccacattctcattgatctcccagtccgattcaaacctcagcaaaattacatgtcatcatggcattgtctggcgtgggcagggagctggtgaatgctaagctccaaatgttaaatccattaattattccatgagtttccttgtcatgttctactgactacattccatgtacatctcatttttctttttttttttactttattgaactataactgacaagtaaaaacgtaaacatttaaggtatacaaagtatacaatgttttgatatgttacactgttaaataattaaaactaagctaattaacacacccatcatcttacagttaccttttgtgtctgtgtgtgtgtgtgcatggcaggagcggtgagaacatttaaggtctactcttagcaaatttcaaatataaaatatattattattaattatagtcactatgctgtacactagatccccagaacattttcatcccacataattgaaactttgccctcttctaacatgtctgattaatcttcttaaaattctctatatttgttacaaaggatgaaactaagctcaaagaagttaaggatcttacttaacctcgcatctagtaagagacagggatagaatttcaaccagcatcttgatcccaaagcctatattctttccgattaccatattattccgtttccctcacagctacagacttctttcaataaaaggtgtttatccctacgcaatgtgttgtatacagcttgtaggcatttatttgcttattatttaagtctttccattagaacaaaagtggctttaggataagaacttggttttagcctaaaaccaagttcttatcctaaagccgcttttgttgtagataaggcctagcacatagaatatcctcttttttttttaaagaatgaataaatgaagtaagggaaagcaaatatcagttggttgctatgaaactattccctactgggatagctacatcctctattctcatgcttgcctgaccccacaaaaaagtcggtttatcatgcaataataaaaattccagataatttcaacacaccacaatggatcagaaaagtctatcatagataacttaacctattttattaattagtaagtttatgtattactaacggggaagtagaaataataagagttctgaagtcagactacttctgtttttatccaagattcccctacaagttgtagggtcttaagcaggtcccttaacctcagtgcctcaagttcttcatctatataataaggcagtaaaaatagacatctaatagggctgttgcattaaatgatagaataaaaatacttaacacatattaaatgctttataattgccatgattttagaaatacatggtcattttatttcagcaattgcagaagccacaaacaaaaacaaatattaagatggatgcccgtgaataattaacaatagatggatccacagttgtgctgtccaacacagtggtcactaaccacatgcagctattgagcacttgaaatgtggctaatccaagttaacatacgttttaagtttgaaataccagatttcaaacattcagaaccacaaaaaaagaaaagaataaaaaaatacctgccaacccccacattatagataagaaaacagactgagaggttaaggtacagacccagttaggtcatagaactgggagcctaacctaggtttcctgaaccccaatccacagtttttactctatcacaggggtgtccaatcttttggcttccctgggccatattggaagaagcagattgtcttgggccacatgtaaaacacactaacactaacgacagctgatgagctaaaacacacagacacacacacacagacacacacacacacacaccctcatgttttaaagtttacaaatttgtgttgggctgcattgaaagtcatcctgggctgcatacgacctgtgggccagacaagcttgctctatcactacattccccttacccactgttatattcttatttgattctaggtcttcattcacctgagccttactaatgataatcaaggtaagtgctgaggagttatttaacaggactctccctgaacatagtaataagtaactaagagagaattggcaagtcttgttggtcattatcttccaaaattctgctttaggactctcttattcattgacagcgtctgcctcactcacttctctgagagtgaaaaggaccatgataatagcctctaatggtccccactaacaatgtaacctcatcaaaagcaaatgtaaaccaattatcacaaatagcagcctgagtgatctctgtggcaaacagcaattgagagatgactgtggaggcagagagttgaagagaaatagaaactttaatgagccattctgagaagttctcattgcaatagaaagccattccccccaacacccagccacccactaagatctgacaaaatccaggaggttttgcaaacaagtcttctcagacatgtgctatggaaaaaaggaggggaaggaaggaagctcaacacacactgtgaccctttaccgtcctacaaaatagaaaacagagcctgtcataagccagagaaaatttctacccaacgcttttctacaaataattccagtggactatgtcaaattaaataatgagggactcattctttagaaacagtatgatatccccttgactacccttaatatatgtctaatgtaacaactagtcataatagctaacatttattgaccatttactacacactcagcacaattctaacctctttacatagattattttaatgtcagctccctataaggtgggttcaatgtttttttccaaatgaagaagctaaagcccagagaatttaagaaagttacccagttcacaaaatttgggggcagaaccaggtatatctgactgatatgctcttagccactggctacacttggggccaatcacatgatttaatcagcttgaagaggtaaaagctcctctcctccccatttaccttcaaaacgccgtcccattcatgttgtttatgtcattgtgcctttgcacagtttgcttcctctgcctagaataccatagaacctaattaagacgacacctccaagaaatctccttctttctgctgcccccaaattatgtcatcttatcctctttgtgccacttctgtacctcatacatacatctgtcacttgcttatgtggccttttccttactaggatgcagatttcttcaacgcagatgccaaccttcaatatatcccaccttaagtacagtgtttgctggtgtaaatcatctacagtagaagaaaattcaccattcactattactttttgaagaatatatcttgtcataaccattgagcaaagactccagcactgaagcaagtgagtgaagaggagggagcagacaaagcctaagaaaagaattctaagatagctgtatgttgtccaaataataagttcatggacagactcaatgaggccaaaagaagagcaaaggatttctttgttgagatgcagcatgggtagctctgttttgcagatgatatcactctcacgcaggaagaactttgtgcctcagtaccatctggcatttcatggcacagatccatatgctgaagccatatttgcaagaaacagtgactttatgtttatcacaaagtattccgacagcctcaggagcagacaactgtgagccagtgtaaaagcttaaagatgctgaccaactcatgccacacaatggccttttccagcaggcagtaagtggtttaacagagttgctttcagaagaagaaaatatgacataaaattactttcctcagaaatgtctgaagtttttgctttctttcttgaccaggtattacatggatgagaagtggctatctgcaaaagaagaaaagtagcagcagaaggcaagggactttcagctcatcatctttgtgcaccatccttctaggataaggagtggcagactctcaatatgataaacattaaggtctatcttacacctttaatgtagttagaatgcttttcactgaaagtaatagaatcctcaactcaaaacgccctgttaaacaataagggggtgggggagggattattatcaggtatctcaaaaagtacaaaagtaagagaattccagagttagttaatttaactcttaagtgaagtatttcagggccctggccttttccacctgtctacattctccacatgctagcttttgtcttctagtttactgcctccaaagaaatccacattaactgtgcaaagcatcctcatacaataataaaccaaaactgaagaagaaaataattttattctaagaaaaagggagaaaattctcccagaatcagcatcctccttctgtcatattttctcccacgtatcactgaagaattgattcaagtgtgcattcctaaagaaatcaatgggtaagggaaatggaatatcacgactgaccaatcaagattcactctggggactcaagaggaacccagccaccactgtataataataggtgcctaatagctgattaaaaccaaggatttgtgagagaagaagggtagtcagagaacagccactggataggcaactagcactgctgctctgtcctggcctatccagtaaggagacctgaactagcaaactgtacataaaagactgagactaccaccttctaatagctaacttgacatttccctaacaaataacaaaattctgctcagtacctaaaacagaaacattagctgcaacccactttaaaataatacatttcaagtaaattaaattatattgattagttattgcatttatattcatgtatttagggacataaaatgcaaggatcttattactccttttataataaaaatcattttatatttattaccttctttaaacttaccaaattttagtggcaaaaatgccatgctaacttcaatacatcattgttaacaaatttacattagcaaattcaaggatttgtgaggattaaacagataaaagccctcttcaggattggcattaaaaaaactggatatctacattagggtgacataaatacatgcttcagatttttaattctaaaagcaattctgattatacatacagaatgctgctaataagaaaaggcaaatttttagcacatttgttcacctgtgaggttaaaaaaaaaaaaaaagaaaaagagagagtatgtaacttccccaggaagagggacaagaaaatggaagtttattctatcagttacaaagctatcattcaagtaattatcaaagaaacaataaacaaactgaaaaataaagctattttaaaataaagcctgcttctggggctagtttaactgaatgactattgtatgctacactgctgagtctcaacagtatgccatggcccttctttcacatcagataggggtgccaaattaaatacagaattctcatttacatttgaatttcaggtaaacaatatgtcatttttgtgtaattatttcatcatcagtgcagaataaatttttagtataaatatgtcctatgcagtatttgggatatatactaaaaagaatccattatttaactaaaattcaaatataatgggcaacctatatttgcattcgtattgtgtcttctgatgccccctctttctatgtctttgacaacatcttcctttgttctttggattgtcctgtttctatgcccagttataatgcctttgtctcttaggacttaataatgtctcctggctccagtcagctccaatttcttaatcttttcagtgttgtctgaaaaagcagctcaaaggaaatttccacagcagaacttgacatcctgtgcaatactaaaaccagacaaatagatgacactaagagacatgtgtgatcatttttaaagaaagaagaacaagtgaacaaatcccaaagccagctaattacaatcccctgaagagctttttttaaaaaatgcaggtacgaaagacctaccccacacctactatttcagaattttgaaaagagtggcctggaaagctgtatagttttaaagttcctgagggagtctgatattcagctataggtttgggattttctggagatggtaattatgagttaagaaatctactaaaagctgaggagagctcagtgagtagatttagacttaaacaacagaatgctgaacccctaaaattttttttggaccaacataaaaacgaaaagataaatatatgggacacacaggataaaactcaaaccgatttttaaatcaggctttcactcatgacaaagaaatatgaggagattcattttctggtttgtataattatgaatcatattttaagatataggcatttctctttgttactgttttttggtagagacagggtctgcctatgttgcccaggctgttctcaaactcctgagctcaagggttcctcgagccttggattcccaaagtgctaggcgcttcctaagagtctatgttttgtctgcttggaaaacaatctaaaatgctaacatctatgcaaatttctcattagaaataatgatttaaaaaaatcatgtcgagggaatgggtaatgaaataagggccccctaaagtttatgcatctattccactaagtggaagactgagagcatagtttcgtggaaactgaaagcttgatctccttcacctgatatccaggacaattctccctcacacacaacctccctgaatcttgcagaatgtaaatgatgaccttttgtcaaaacctacaagaataactttttgtaacagaatactgacatatcataagaaattaaagtaattcaaacaaacatgaaaagggtctcacaatacacacggcacatacaagtctccacagccaacagaaaccacaaggatggagaagggtcactgcacactgcctttcatgagtgaccacatatcccacacactgccacatgctacactgatccaaagagaaaacctacacaatactaaacatattaacaaggctgctacgcagtgaaatgctgtgtaactcaggctatggtatatgcattttggtcctaagtgtattggtaaaaggtatgcctttggctcctcccatctgctgcccacctactgacagatatagggccaggtcaagtccttatttactcccattagcatttagaagcattatcctgaagaagagcgagtccttagatactcccattagcatttagaagcattatccactccattttataggagaaacttgaattcacaaaacagatgtccaagaaaactcaagaacactcaaaacgaattcaggaagctaaaaactgaaagataatctaggatgtgaataaatagaatagaaaaacttaaatatttttgtgctaaagtagatctgaatttttttcatactgcaacacattacctaacattagtttctttctcagttaatttctcttgcacaaaattctattaagaaaccctgtttactctataaagatatctacttacattttaaattatagaataactcaaaattatctctatagcaaagaacagataaacaaaacattctcatactttctggaagagctttctgaaatcctgagtattataaatctctgaaatgtacctggataacactgtgaaatttggcaataaggtagaaaaacatttataacctcaattgagaaattaaagttattaaagaagttaaaaatataatttaacactaaaattgtttgcatattataaggaattacatgaagtaatgaagaaaatgtcaatacatagggcaaattttacataacccaaagacatagatgtgatagtttgtggctcctcacatcttcccaaacattagtcatacaccctacctttgcctaccaaaatgcctagtgttctacaatgacaaaccctttcagttatggtattgtcttcagaactctttccctgtgaaacttcctacaacaggttaatatataaacccctcagtcctttgaagtatgtaacagcttaacactagctcaactgactgataacctgctcccaaaaaagaataggacgcatcaagtaataattttcctcgtttagaaattgagcggggcacataaaagagaaaagaaagacaaacaagagagggcagccaaatggttgtagaaaggaaggaaacaagaagaagatggagaataaatgggagttcttaataagatgctgagattggaaattctgctctccaaagggagacaccccaagaaagtgacacacagatattctggcagtagatcaaagttattcaatggccccggggtaaaatgattacttattactgaaaccaactagtacctattacataaattagtttaatagtgctcacatcttacaagcacatttttgaattaaaatctagtagggtataattaagtcaaagattacttttctaggaaaaagagatgcattttatgctacatacacatggagcacagaaattcattctcacattattcattgtttaagtctaaagcctttcacatcacttctctatgactacattcaccctacagttttctaaatacatgcaaagaggaaactttaaacttttttaaagcaataactgcctcaacttttatttaaagggactaagttccaatttggtgtttattcaaacatccagtaattcaataactcagcaaatatttattgagaacctactacatacctgtactcctacagtgatgggggagacaaaaagtgagataaacctaaccttaaataatggtttagtgatattttgggaaaagtacacctcattttccaacacactgtaagttaaatggagacattttgaaaggaatgttcaaatacagttatgattgaagaaagtaaaattttcttttcctatgatcttggtttgtaaaacagtacactttagccaacagctatggctgccaaaaattagatgacaaatctaaagcaagctcagttgtatacatataaacacacgaacgcttgcatgctcttggggacatacacacttactcccctactcacccactggggtgttgcatatttcacagagcacaatttgcccaatcaatacactgcaggtcaccaaaaacttttttttttcccttttaaacaaccattcaaaagtttaaaacagttgaattttaacattatttaaacattttcctccataaaccttcttaattttcattttggctaataggatgtggtgcagagcactccccaccaggtaggagctgtgcagtgttacacaaaactgtgtctctccttaacctcccactaaatccttcagtcagtaaggttgagtcacaatttatcactcaaaaagtctttgtttacatgcaaatgtatttagttttcattgcaattaatttgcttttgcttttcaaaactgtccctattaacaaagtagtgctgtttatcattaccactattactaatttttcttattattagattcttaaattttaaattttatcagttggtatttctttatccacttctgcttttgttttatttgttaaccaaagtgtgactcttgaaggaatttgataaataagttagaaaaatgtttgcttctaaggtaaataatcaatgaaatttaattaaaatgacttactaaaaggccttgacagcatcagaatatgtaattttgaaacttttgttttcatgaaatgtcttttttctttttttctttttgaaatggagttttgctcatcacccagactggggtacaatagcacaatctcggctcactgcaacgtccgcctcccaggttcagttgagtctcctgcctcagcctcctgagtagctgggattacaggtgcccaccatcacgcccggcgaatttttgtatttttagtagaaacgggtttcaccaagttggccaggttggtctcaaactcctgactcaggggatctgcctgcctcggcctcccaaagtgctgggattactggcataagccaccacacccagagcctaattttcaaacttttaatcttatgaatgtaataacacataatgtaaatgtctaaattttaattactgaattaaatgaaaatgtatacctcagtatctcctgatgctacttttaaacatttccaaatagtctgttttaaaacatattcttaagaacataggagaacttaatttttttaatcaagtttctgaattcataatggctcatagtctcctttagaactttatatctaaatagatttaatttttacaaatctttgtccattaagacaggcagcttcatttttgtttttaaatgaagaatgtcttcagataatagtaacaaataaaaacatttgctactgagcagtatgatgacaattacaccaaatctagattttagatttgtatattctaatgattctttcctgcagtctacatgtcttgttttgcatgttgcatgtaaacattatcaagttatgccaaggtaccaagcaaaccatgctgacgtctttccttaataaattcatcttaaacttaaaaggctatgaagtttaagatcttcaaaattattttatgaactagggcatataactaccagactgaactaaagtcatgcaatgagtagctaaaaccaaaatgcctcacatcaactacaaaatcactttttctttatcagctatatattatcaacactgtattgtatttgggaccaatgaagcaaagaatattgaaagagtatcagttgtcaaaatgtttaatgaagacagagctgtcagatgacagagacgacactaattcaaaagattattaaaacaaaagaacttccagtacataaaatgaatccccagatgttaaaaatggtcctattttaaataaaaatgaaaatccctgaaaagttatgcttggaagaacacgatttgttttgcagagaaaaacccaaacaaactactgggaacaaaatttagagaggctaaaaaaaaaaaagggaaactgataagatatttcataaacaaggcctatgtttgtgttctatactgataggaatatgtaaaggctttgagatcaagagcttattctgaaaacactgcaactcaagtaacacctagttctcttccaaagaatctttgcgatgtagacgttttcctggattccacattaaattatgttaacaaaatagtgaatataataaaatccaagctgctactgtcccatctgttttcagcttttatgtgaaaagtgggatcagaacatcatttgttattgtttcctaccacagcacactgatgatacagaaaagagtttaggtttaatcaggagtttatgagccaaatgttgaagttttttagaacactgaaaatactttattttccctttcagattcattgaatagttactggttacaaaaggcgactaacttaactggcagtggaacaccacaatgaactaaaattatacaaggacttaattaatatatatattggtatgtaccaagtttatgaattcaaaacaaaaatccaacttagaaaaaatcaaatgttgcttagttatcatttgtatcctaatactgtagaacatctaaatatacaatagtcattactttcaaatttttgatatgagaaggttcaattcaatttgaaattcatttacattatcaaaagaaatgtatacaaccacatttcttaggaaagagatgtcaaaatttaaagaataaaaataagaagttatatttttaaaaaaggaagacatagatgttacagaataatgtacccttgatatataattgaatttccaaatactctgatgttatactatgtcataatcagctattattttaaaaatggcataaattctttcccaagggttgggcgcggtggcacacgcctgtaatcccagcactttgagaggtggcagtgggtgcatcacctgaggtcaggagttcgagaccagcctgaccaatatggtgaaaccccgtctctactaaaaatacaaaaagttagccaggcatggtggcatgcacctgtaatcccagctactcaggaggctgagacaggagaattgcttgaacctgggaggcagaggttgcagtgagccaagattgcgccactgcactccagcctggggaacagagcaagactccctctcaaggaaaaaaaaaaaaaaattacatcctcagacctcctacagaacccaatctcaagttcatatctttaagtgcagtatgaaaggaaccaccacactgcacaactccacggacacctttgacaatgataagtgtgagtgctacttcctgagcagacctgtatattacacaaaggtggggaagctctgaactgttgaccaaagggcaatgtttttgaacaatgctggtcttcttctgttaacataagttaggtatagtttttatttattttgagacagggtctttattgcccaggctggaatgcagtggcataatcatggctcactacagcttctacctacctggctcaagtgatcctctcagttcagcctcccaaatagctgggacttgggaggtgcacgccaccatgaccagctaatttttgtattttttgtagagacggggtttcgccaagttgtccaggctggtctcaaacttcctggctcaagcagttgcccacctcagccacccaaagtgctgggattacaggcacgagccactgtgaccagccaggaatgttttttaaagcattctgtactacaataaatttagcaccccagggatggtaatgtttctggttgagattctgccaaactaagaactctcgttcctgatctagatgctttgtggtgatttatgtcataattttaggcagccctgacacccatgtcctaaaaaataggcccaaattttaaaaattattgatcaacactctagtaacacttacgtttggacgttcaatccctagctgagttttttaaaacaactgactaacagctactagatgcctgtcgattaggagaaataaagaaaaacggtaattttattaaaaataccaaggtagtcattattcacacgatactgcttgtgcataacagaactcattttaaaataaagacaaagtgatacaagtcttatttaggccagactcaattagtatggatgtttttctgcatatattcacatagcacagggaaaaaaaaactaacatcaacagaggcatgagataaccattataactctagctacgatttttccaagataatgatgcttttcctacctaaaatgctaaatttaagtttaaaaagtcaacatcatttgacaaactgacattcacagcaaacagaatcaagaaaagtcaagcttgcttctccttatactttaataacctccttataatttttagatactatcttgataaaatgttggttattaatatacatgtattaccatcccatgcccatgaaattataagttctttttgctgaaaattgccaagccttattcattttcatattgcctgcagggtctcaaagaaatgaatttctcactccttttggtattatgtatccatctcagcagaacaaagaaaagttcaggctgaaaataaagcaaaccttttagaagttgaagtagaatatatccaattctttgcaatcactcatattaaggttcttataaacatcgcgtatgtattataatgaccacaggggtaaaacaaagcaaatgcaatctcacatcttattttaaaggcctcttatatttgatgtaaagcaccatgattatgtgaaataatatttttgagctgtattcaaaatactatacctttaaaaaataaactgttgtcactttttaaacaggcacatcatatcaaatcatctctattattcttagaatatgaaatcagatacacaaagacatagagcaaaagcttcaaaagccccaaggaagaagtgatttgcatacatttactggcctttccctaagcagtcctcagagcagatgctaagctacctttcagaattagaaagtactgggttcattcactcaattatttttctaccatgaaagccttggggattaaaaaccaaagtgatagctgcaaaccattaacgtttttaaactaatcttcatcaccagagtttaggggaggaaaaaaacaggaaaaatcaataaataaatgaaagcaccaaggttaacataattaaagcatacgtttgtttagaagaaaaatttttacttagcgcaaaccaaaaatagcatcctaggattttcttatttcaggaaaaaaaaaaaaattaaaggtccttaaaggaaaaataatgagccaaaaaaatcttcagtttcagagcaggaaactacatttctatgaagttgagtaagacaaaaaattttgccattttccctctaagtggagaatcacagtccatagttttagcagccattgccaaaatactgtggagcttgtctgtttgggtttgtttacctgactgacatctttcagcacccacctgaaagtcaggatccagggatgtaatgaaattattatggccctgagtaacagttattgtatcaaaaaggcatatactcttaagagtaatgaagtagatgtcagccagcaaaaggcagagttaaagacacaagacaaggggtggattgaaatgcaaaggttaggaaagaaatcaaagactgtttgaataaagttatgtttcttttctagtttttcaaaagtacaaatagaaaacaattgccagctttgtacctttcatcatacaagtcacattgtaaataaacagatatggtagaggtagtgtttctgagttctcagaaattgtttggggtttcagaaaaaaaggcttttgaatcttctgaacattatgtagaagggcttaattttatagactacatagtcattatactgatttatagaggacttcaatgattttaatggattactgagtagtattcagaaatgagactgcaggaatccaaaatttcttcttgcccagacctttgctattaatccaattgtcaccatttctgaagaaagcaacttatcatcgtaatttgattttaacattactttgcctaattttattcaaattatatggtaaatgtctaaaactagctagcaaaggaagaagcaaaatctaaataggattattcctaagtgagcgtataaaatagaagccaactacacagctaatatgagtctttaaactaattcagtcacaaattttatttatgtgggtgtatataggtgtattttatatatatatatatatacacacacacacacggcacagcacatatatttacctatgcttatagtacaatgaataattttacacacagtctatactagaatcaatatgtttatacatttcatacacataggcatacatagatatagacacactgtataattactaagcaaactatataattataattaactgtacctgtaaaacatattattaagcactgtatatgctaagcaaagaagtcatcagcttcaggtaaaaaaagatgaaaataaaatcatattgtacagcaatccccaattataaatgtctgtatatgtatatttaggtaattatttatagatatagtcaactaattcatttttcatgtttagcagatatatataatattaaattgtattcattcctaacacatctcactaaaagtaaacatttttaagacacactataatagtaagagtcaacagcaacaaaattttggaaactggaaaacacatgaataactattaactgaactagcggattccaaaaagccaaatcctaacctgataatgtagagagttcagtaccatccctagttaataccaaagaatccttgaaaactggactaagaaaatgtggcacatatacaccatggaatactatgcagccataaaaaatgatgagttcatgtcctttgtagggacatggatgaagctggaaaccattattctcagcaaactatcgcaaggacaaaaaaccaaacaccgcatgttctcactcataggtgggaattgaacaatgagaatgcatggatacaggaaggggaacatcacacactggggcctgttgtggggtggggggaggggggcgggatagcatttggagatatacctaatgttaaatgacgagttactgggtgcagcacaccaacatggcacatgtatacatatgtaactaacctgcacgttgtgcacatgtaccctaaaacttaaagtatgataataataaaaaaaagaaaacctcagacactgtcagcatctaatacttctggcactgtatgggtaaaagcaggggtgggaggtgaacaaaatagtcttgttgaaaaattatcatgaaacatatccttatatctcctaacaaattctacactgctgggcaactgcctgtcactattttgggaaaacactgaagacttcttctctgggaaaaagagggtctccagcctgggaaacccagacataactgaaagtgggatgcaatactgaaaaggaaagaattaagtgaacgtttccatacacaatgttaaaaagaaagcttcttcctccactcattcctggaacatgggcagccaggccaatactcatctctgaggaatcaaactaagcccacaagatgaaaaaataaatatagctgatggccagagatgctcacaaagtaatgccagatcacaaattaataagcctcacctatatcctgagagctttcaaacattttttaatccccttaactcttacaaagtgtgcatacaagcaaggattgtctgagaagtatgaaaagtctctaacacaaaatctttaaaaaaattaatggaaaaaggcaacttagaagaatcagaccagcaggacgacaaaaaccaccaccctattcttactttatctgaaaaataaaatacacaacaggaaacaagaatatgaagcactaaaaacgtattaagcaaacaaaaaaaaagctcttgaaaattaaaaatgtaggccaggcatggtggctcacacctgtaatcccagcactttgggaggctgaggtgggcagatcacttgagatcaggagtttgaaacaagcctggccaacatggcgaaaccacatctctactgaaaaaaaaaaaaaaattagccgggtgtggtggcatgcaccggtaatcctagctactacggaagcttgggtacaagattctcttgaacccaggaggcagatgttgcagttagccatgatcatgccactacactctagcctgggtgaaaagtgagactctgcctcaaaaaaaaaaaaaaaaaatatatatatatatatacacacacacacacacacacacacacacgtatatttatgtgtgtatatataaaagtgtatatatgtgtaatatacatgtgtatatatgtatatgtatatataaaacaacagaaaagaagtactcaatagaggcgttggaagataaagttcaagaaatcccccaaagatagagaaaaaagaagaagacagagaaaataaaagtgaagggataaataaatcagagaacaagctgggcggcagtccaacagcagattcagtggaattccagaaagagagaagagaaagctattaataaaaagcaagtcattaacaaataattcaagaaaatctcccagaagggaggcacacaaattaacaaattaagaatgctgagttcccaacaaggatggaagttaatatgaatcaaagcaaatcattgtaatacaaagatgaagaattagaatagcttcatactctttaccagaaactaagaacagagaaaagacttcaaaaatttgaaggaaactgatttgccattaaaattcgttacccagttaaactatcagttgagttggataagaaagaaacatttttcaaaatcaagaatttaaaaagtatttctcccatgcacctctctcaagaaagaggataataaagtcataaaacacaaaaactttaaccaaggagagaggaaaagggaattttcaagatgacagaagagatcttaggatgacagataagcaccagtcatagaaggccaccagtccaaatgggagcagtgtgtctcaaatggcacatttgctaagtgtcatcctgatacacttcatcaccctaccttcctttcaatgatgaagctacagagaatatgttccacccaaacaatgaaaagaccaagaaagagaaagataggaggtcattgggaacagggaaaaggactctgaaaaaaagcaaaaggaaatttcaggaggcctgcgaaggtgacctacagagcaaccagtttcaatagtagatggaaacacacacacacacagatatgtttcttggatatgatcaactttgtggaaggctgtgttaacaggcctttggatgatatgggaaaattaatgattgatacagagaaaactgagcacacaaataaccaagtcatcatttgatttaggaaaaacaaaaggaaggaaatataatcatattgcatagcaactcccaattgcaaataatatttggatgtgcataatataaataatgaatcatgatctaagcaaaaacatgaatacaagtctatgaaactaagggattcctccccagaaagaaagaaaagcaaaggggatagtgtgatgagagtgctgaatcctactccacgacaataagaaatcagcaaataatggctaaaattgacaaacccagttacagcagtatatgaatattatttagaaatatgggtcatatgtatttgttagaagaaacagagaaaagagccaaagtattgatatattttgggataatactgtcagtaatgccatcatatccatcgtcaaaatggactgtatcataaacattctaaaggtaaactccattattcagtgttaagggtctttgtccattttaattcatagtgcttggcacaaaggagttgctctataatgcttcttactgaattaataagcgaataaacccaggaaagtaaatatgacaagctctggagaactttgataattccaaaggggttctattcatgacaaaactgacatgaaagacagacatgaaatgttttcaagatctttccaaattatgaaagcagaaacatcaccatttctgagatcagatgagatcgggcgcattcagggtgttacagccatagactgcactatttccaatacactattttatatgacatgggatttattgtagccaaataaatatgattacatatttgtttcattgacatatccaaaagtgtataaattcaacttggctaaaaagtacttttaagatttcctcatttaggcacataattataacctctaagatgctcgagctttttggtcccctaggcacctccatttggagctccctctgcctggtttgccttccctgctcaactccccacatacttgtttcactccagctgcttctacacagcttcttctgactcagcttagatatcacattctccagaatgccttatctgatccctaaggctgaagaccctcttacgtgttcctacatcaccctattcatatccctgtcacagaagagcacacacagtaaatttcctgtcttacttatttcctctctacttgaaaataagatgttcatcagactagctgtcctatttataactgtatcctcagcaaccataattgtagacacataactatctgacaaatagatttgttcattaatttgaaaaatatttagttcctacaatgtgccaagcgttttcctaggcattgaaaatataatcctaaagaaaacaaatagtctatctttgtggagcttacgttctagatataaatacagaaagacacaacaagtcagtgtgtaaacacagtgtaagatggtgctgaatggaatgaagcaaaataagtagtcagggtatagcaacagagagggagaggaaagagtgctactttagatagaatggtgaaaaagggaagaactcttaaaggatgtaagactagagacctaagtgaaagaataagtcattcaaataatatcagtgggaggaacagaccaagtagaagaaacagccaaacatcaaggcccagagaaggaaatgtactgcgtgcatcgaaggcagacaggcaagcaggcattccattaactggatagtttccaccgagccatttcaactttctaagccttattttccccatctacaaaatctgaagcctattacacttaaacccacacttgtagcccaggtattttactaaataactttgctatttctgtacctcctaccacaactcagcttggtacaatcagatggttcaccaagtaggtgcactttctgaaacacatggagtcacaccctgattcactctctcatgaatttaatacaaacatagtagctcatctgacacttccatggattataccaattgggctgtacatgttctggcatgtaacaaagttcaggcattccaaatagtctgttggacagatcaagatttagaaggctcacagttatattttactccagcaaatgtcagggctcaaattacagttccatcaagtaggggtctaagtctctaattcaagttttaaatttggctatggagaatcgtagtatgcttatactgcttactgctgacctgtatttttaaaaatgataaattaatcaacacactctgggagctgagggtggacagccatcatccagaacagtgcccagaacatggtagaaatctaaataaaaattaatgagtacatggataaatgactgagcagttgggaactaatgaatcacaagtgcctatctaaaggactatggtatcaactttttctgggctccagatcctcctacagtacctacttcatgaacattgttacaatgtctatttaaaataaaactataatagttatctagctaaagtatattccattggttaggaaaataacatgtcctctatatagaggactgtatagaacaacaataaaaattatagttgaagtagcagctatcaataattgacatccttgtatatactatgctagctgaaatctaaactcatttaatcatcaaagcaaactatctggtaatttttatctctattttatagttgagaagacatactccagttaggtgacattgccaacatcacacagagctggctggttgtggagctcttatataaaatccaggttggatttctgggctcaattcctgtagaggaattgtgaagatgaatagacaacgtcttagtccattttgtgttgctttaacagaatacctgacactgggtaatacataaaggaaagtttattggtcttgtgattctggaggttgggaaatctaagatttgggaaccccttctggtgagggtctcatgctgcttcaactcatggtagggaaacggaagggggagcaggcacatgcaaagaggccaaataagaaaaggaacaccacactcttgcagtaacccagttccaagagaaaatgaactcactactagagaaaggcataaaaatgtattcatgaggaatccacccccatggaccaaatatctcccactccctaccacacaacactgcaactttgggaatcaaatttcaacatgagttttggagaggacaaatcacatccaaaccatacacacaataggtagaaggtttctgcattatttgaaccatagtcacataaatgcaatatagagtgactattagccagttgtaatttagaaatattttataccgataagaatatttctacatttctaatcattttaccaatttgccatttagttcactccccacacgcaaacctgttacccagccctaaaaaccaagtttattggaccacaaggtaggacaactgttcattcctttcactttgaatatatggacagattcagctcaggagagtatgtcctttaataaatcaggataattttgaaacgccatcttgctcacaactaagaaaaggtgtaagtgtgtataccagtgtaaaagtaaagctcaagcagtggctattttaaaaactttttaaaactttgtagaacacagagatgtggaagaatgtgtgtcagcagatcatgacatcatagctgacaagataaggagtgacaggtaactgtcactctgtttggcagaactgatattaaatcccagctctatcatttgctagttactgggaaagtaacacattctcatattcttcaaagctgtatttcctacatatgaggtaggaataacaatagtatctatttgacaggactgacataagaatgaaattagtgaatacatataaagaacaaaagacaaatgtaaaacacatgtctagcacttattaaatacttaatacaaaaatcattgtatcctaaaacaatagttgagagacagttgccttccaaagcaggttttagtgcaattaaatagattgttttgaagcagatgtttctagaaattttatttaatgagtttctaaatacatattatgtcattttaatattttcccctacatagttcagacatccacatttacaggatccttcctgggttttagacactaaactaaaaagcatttttttcctcatctcatctttacaactgtgaggtcgatgttattattcctatattaaaggtgagaacacatttcagaagttaaagaaactgcccatgcagataagtgatagagctgggattcaaaacccaggtctgcttggttccaaaggctatgctttgaaatagtatgctaccctaaccccttatttcctcagagaccatagttgtgccaaccatagtgtttttcaggaatgttaagcttctcggttggagagggattactgtgtgactatttctaaaatgaaaagtcaatagttgagaggcattcaaacgcatacagttagaccaacaaaggccctaattctgctcagctggcacaccctttgtgcctttctctcactccccgggacctacccatagatggtgtgtaaataattttagtaactgtaaattagtcatttattaatattccaaataatctaattccaagtacctttagtaaaatatgagaatagaagctattactaatttgaagaactcccagattttcagtcatgcattaggttggagttaaaaggagtaaaagaaagtgttttatagtagaacgtagatgatctgcattgaaaatttgagcttctagaattctgggatgctaactgtgacacggatctgctgcctcttgtttgttatttcactagagacaataagcctacattcctttttgttcacaattctagaaaaataagtgatatcaggagggagagatggttaaagtgagtttctggccttatatacaggttttattaccatctgcagccagttgtcaatcacaaaataacaaagtaaaatgtggtgatgaaagccaaactttctccttaataaagtgaggtttaaagcagataccttcaagttacttaatcaaggacttgaccaagtgagacaagcatccaacatatattagccatagaaaaacagctgatcttggtgagcacacatttcctaccttcattccatcttcatttcctaattgctactttagaatggtagtaaaagtgaaggtaacgtatttagttacccacatcagaaatatgcaacaaagtcatatataaatctaagcaaaatcatcctgttagaaaaacaagaatttttaaagtattcctactttgtttcaaaactgatttaggacatttctaaaattaaatatgggaggcaaatatatgactgcttaatcttaaggtctagaaatctgaaggctttagaaatgccatgttaccttgcctactgatcgttcagtagtgatctttaaaaccgtatcagacaaagaggattctgactttctaaattgaaaacaaaatgcctaaaaaggaatcaaaataaatgttttcaatattgtagagatataaaattcatgatatttttaaaatttcttcttcaatgtgaagaaaatcatactgtggataattagataagtaataacagctcctctggaagccatatgtttaggtttataagcaaatattttctcttttatgtcttgtatttcagtactgaatagcccaaagaccccatgtgtagaaagccacaagagagcatggaagatatattttatgctaaaaagaaaacacaaatgaagaatgacagccaagtttcaaagcacagagcttaaaacggaaaatgtagataacctgaaagacagcatatgctgctaagtgccattatcagaaaaaaaaaaagaaagaaacggtcacagctgtcagatctatatttctagatcacaacaaggctgccattcaaatagcgctgtcaaattgggtctatgtttaatgtgagatacagaccacaagagtttcagagaatcaagtaagtgagtaagacaactgtaagtaatgttctgcttttttactagcactgccctcaagacaattcagcctagtttatgattatcacataagaagactcttagtttgtattctttcaccaacacatggttttaaaattcacagctaaaaattagagtcaaatctcaccctcccctttggatagagctctggcaacatttctgttcactccaaattcctaacaggatagatagagctttccgtatcttgggaaagccatacatggacccacaacttacagggacacaattctgaggactcactgagccctccaggaacagaatccctacattccttcactccacctctttgtgttcattcaaatacgtcacctacatccccaactcttcacctcataacagcaatgaagaatgacagccaagtttcaaagcacagagcttaaaacggagaattcctcctctaaatcatgctatacacagaacacaagtgtttggaaatgttattcatccatttgctaaaagccattttctcaagtctcttagataaaataaaaactaaaaatgtcctaattataaatttcaaaatggaagtggattaaataccttcacctcttgttcaggggcaatacgggatcgcacaaaaggcatgggcttcagggtgagacagacacaggtttgaacctaccaattgttgactgtgtaaccttggacatgtgatttcaattttctgaggttcctttcttaaccccctaaaccacaaatggctgctgtgataaaaaccacaaatggctgctgtgagggttaaattataattgtcatgattttcattacagctaatatttactgagcactttctatgggtcaagtattattttcagcattttacatatattaactcaatccacacaaccacccataagataggaagtactagctctgttttacaaatagggagcctgacacatagaaaggttaagcaactcccaagaacatcaactataactgagggaacaagaattagaaccaggtctcactgaagaactcaaccctcagcacaccttacctcacttaaataagaattctgtgtgtacagtctgtttatgcaatgacagccatacaatgctcatttcttttccttctttcctacccccattctctacccaccctatatcatgcaaatcatgaaatcattgtagtaagtaggaagggaatacaatactgttatagaaaaaaagtatagaaaatatgagggactaagagatcctctaattattattattatttattttttatttttggaaaacctcactttaaagaatacagtgagaaggatcaccttccaccttagccagtgacaaagtaacctccttagagggaaatttacacgtaacacagtatctgctgcaactcacaaggttccctgaccccactcccctgaactcagtacttatgggagaataagatacttttgtttcatctaatgaacagagtataacatggaagagacaaaaaagacactgtttcctcttcaaattagtgcccagtacagcttgcttggagcaaatgcagagatcaattatccagagggctttaaggaacatggcccagcttctgcatgctcaggatctaaaggtgcctgcattatagatggcggcacccacagggcagatgtggacagcaaccatgccacaccatgaggcagaagcatcagcaggtgcagcaggagctgctgcagggcactcaagcaggttccagacaactaggacaaaagggctttaaggcgtcaagtgacgaagcaggtctcagcagaaagccaggaagccaggaaaaattctcagtgctccataaggctttactcaggcatttccacatatactcagtgactggaggctgccagaaattctgaagctgtggacagggcaagttttatcctgctgcagagttagaatcatgggctttttgaaaaatgcccatactgaggctgaacctcagggattaatttaattggtctggggcagggcctagatatcctggaattttcaaagctccccagggaaacataacctgcagtaggagttgacagctgcagccttgggctgttaaagtctggagaaacattgcttaaaatactttatcatatgaatgttgaaagtcactgaaggatttataatgctttgtaaaaggattagactaatctttcagagagaacactccggtagcaatgaggaagaggaaaataccaggctatggatattactataatgtaagctatggttactactataatgaagacaatgggtgctactataatttggctatgggtagtctgttcacccatgcatccatcctatcacccaacaaatatctactgagtctctattatttaggaggcacattgaataagatgaataaggcatatgatttttcctctcaagaaatttccagtggagaaagtggcaaggaaattaattgaaataatgtgcaataagtagaatataaatgtaaaggatacaatgggagtagaaaggaaagacacctaaaatcagtgtgaatagccacagtgttgtaaaacactcccaaggtgagggggatcccaagccaaagagggaaggtgtggtcacgaagaaaacaaggcagtggatcattctaggctgtgaggactccatatcctgtttctgtaaagttaagcaatgcagtaaggctaaaaaagagaaactgtgggtacctgacaacagtccaagctggaaataacacagaaaaagagtgtcaactgaacagtgaggtaaggtgacaccatcatttaactttaacaattgaactggcatgatcagatttgtgttagggagagaaaaatcaggtagggggacaacttaggagacagttccaatagaccaggtgaggaacagtgaggaacagtggaggagatggacagaggaagagatttcatatattcagtgttagaactggttttgagctaatacacttgacatggaggagtgaaagaaaacaaagtttagaattcagtgggaatgttaatgtaatactgcttagatgagaactgaagaacagaggtagggtttgagtagcctataaaaacatccacatttggtgattacactaaatatttgaaagattaaaagtgaatcaattatattaaaataagtatccactaagattgtcatatttcttcaagaacggttcatagtaaaaatgtgattaacatatcacttcaatagtccaaacattttgaaaccataaactgatgttaatacatgccaaataaacagcattcctaacaggtgaaaaattaatgacagtcccactgaaagctagaccaaaattttaaaatgccactttacttttagatactacattccatcagaaaaccagaatgacctgagtaactaattatttgccaataagggagtctggtaaattcaacagatacagttaaatttgcaaaaaatcaacagctttcctgtatagtaagaataattgtttaaggtaacagaaaaatccactggcaaaagcaatcacaaactaaaatacaaaaaaaagggctcaaagattctatataaagaaaacaaatctttactgagatttaaaggatggcttaaaaattggagagacataccatatgtttctagatgggaagctgatgtcagttctcaaatccacatgcacagttattgcagatccagtaactacaacagactatgcctagataagatacttaagccatataaagttacaagaaaataaaggtaaaaatctaagctcttgacagagaaggactttccaggcaaaggagatgacaaaaagtcaacaattttaaatagacaaaatttctgtttatcaaaatagattctcaagaaaattgaaaagccaacaaatgggaagaaaatggcaccacatgaaatgaacaaaaagttaataactttattagagttagatctcagtataatgaaggtcagaaaacacgaacaattcacgaattgctaaattatttcaaatgtccaattgttctagtaatgaaaagaaagcatattaaagtaagttatttgtattgattaaatgaacaaagatttgaaaattatagtattaaatgctagaaaggacacggtgatatggaaacgtggtgaacatgtttccatatcatggaaactggtagagcatttctgaaaaaccccttagcctaaggcctaaagactgtttatactacttaaatcagtaactccttttctataataaatcaatctttagaaggtaataatatccgtgttcatttacttaatgctattaattacagcactaaattatcagcactaaactgctgataatatgaaaatggagacattgtttaaactttaaagataccttcggaaaagatagaaaagataaatggatcactttaatactgtgcattaaacactatgaaacaatgaagagggtgtcttggcacaaaagaaggaatataacccagaccagaagttcaaaaaaggcttcctaaaagagctgtaggattcatacaaactatttttatttgtttacacacatcctttatgttgtgcagtgaacaagtattgctttttcaggcattgctttaatcacagaaaagggttggcataaaaagtacctttttaaaaccttcttttctacttgtagcaaactacttttccataactgtacttcaaattatcatcccagttttcttgcaaagctttccttaaattacctttcacattttaaagaaatgaagacagctagctcttactagttttgttccctgatgtttggcattcacattttccttcaccttgtttgttctgacaatagacgaattataaatttatgtctgcttagctttctgtcttgcataaactttatatattataggtcaaagtttttattaataggctacaaaaaaatgaaaaatagctagaaaaatcagtgtagttcagagacactaaagtcttgcaagcattttagattttaaaataaaaaagagaaagaataacttttcaattacattttcaatttcaatcactattgccatatatattaatctctaaaagtctaaattattgaaagttgattttgaagttaaaaattaatttgctaaaatttattcaagtctcttcaacaacaaatatatatatatagacatagatagatatacacacacacacacacacacacacacacacacacacacacactctggaaacaaaagaactgacaaaaaagtcatctcaaaccaatttactttctttaaaatgtaaagagctgtatttttttcttttctataaatggaacaacgtgttaacacaggcttatatttagccatgagaaccagaaccatttccaagaaaaagttagttaagacagttttctaggcctgaattcttccttcatttattttgggatcagtttgtttaataaaagcataggttataaatgttctaccaattatggtttgcccaattaccataatctttgctatagagtacatttcttatcaattctgcagtctaatttcacatctgatatgctctctgatcctcaagttatttagaagaatgtttagtttctgttagattagaatttttagttattctgaatttctagtttaaatggatgtaggaaagcaaataaagactgaattatttctactcttgagaatttattaactttcctttgaggcctacaatatatatttaatgtatctaactgtttcatgagcacctaatttacattacctttttaataagatggtatgtgtctgtgtgcatatctatatccacaaataattaatatataaccactcaagctttttgagggtgatggccaaatttcctaaaattacttacttttgctcattttttctgttaaattctcaaagaattgtgttagtctctcaactatgtgtgttttttttaaaatacaaaattaacctacttctagaagttttcattttatatattcagttgctaggttgttttgtgttataaaagttttatggaaattatattcattctgggtacaccgtgtcttttatccaatggcgatattaaaaacatttaacaaacagtgcagcacaatgtttgtgaagagtctaagagtctaagcctaagactaaagtcttagactatttgcaagataacaaattagtctgccatagcgtcatagacgctgacacaattcatgaggctcctgggtcagagataaaggatgttactgttcacaacacagaaggcagcaatagcttcatgttcccatgggctgtctttgctgccagatcccaaagggtgattcaaggtagcccagggggatgctgcatctaaagtgcatctgtgtcacacctgagaaaactcagagcccaggaaataccaattattttaaaggagctactagcaaatctacccaaactttgcccaagagaaaggcaacatatttatttggtaccctggttagaaaacaaattcaccctctgtgccatatttcttttgtacttgtggttacctttaatttagcatatctgaacctatatttgattatcaccatccagaattaacactataaatgatatctccccctaataaaacatgaccataagcatggttttaatttccaatccctgtcaccttcctggattgtattgatgttagattttcagtttttttaattagcagtacagctcttgaattttgaaaatcttttcctaacaattgcattaagtttcacaactttcttaggaagtcattcaaatttaatcataagttctgctagtttcaatgtctgctgtgattccttccattccactcctttctctgttcctataagttgttttcatttggtacagtatttattcaagttcaaaaatttttttctagagaagttagatgggcatatactttcttaggtctacataataacaacaaaaaggagggttttttaaatattgtttcattcacctattgttatataccaactatatggtttggctgtgtccccacccaaatctcatattgaattgtagctcccataatccccaggtgtcatgagagggacctggagcaaggtaataaaatcatgtggggcaggtttttcccatgctgttctcatgatagtgaataaatctcatgagatctgatggctttataaagggcagatcccctacacatgctctcttgcatgctgccatgtaagacatgcctttgctcttccttcatcttctgccatgattgtgagggctccacagccatgaggaactatcagtccattaaacctatttttctttataaagtaactacaacagtataggtgatttcttcatagtggtatgaaaatgtactaatacagtaaattagtactggtagagtggggtactgctataaggatacccaaaaatgtggaagtgactttgaaactgaggaacaggcagattggaacagtttggagggctcagaaaaaagaaaaaaaaaaactaaaaacaaacaaacaaacaaaaaacaggaaaatgtgggaaagtttggaacttcctagagacttagagtgctcagaagacaggaagatgtgggaaagtttagaatttcctaaagacttgttgaatggctttgaccaaaatgctgatagtaatatggtcaatgaagtccaggctgaggtggtctcagatggagatgaggaatagttggaatttggagtaaaggtcactcttgctatacaaagagactggtagcaccttgcatgtaactctagcaacaataataacaagaaggccaggtgcagtagctcatgcctgtaatgccagcactttgggagacagaggcaggacgattgcttgagcccaggaaaaggagaccatcctgggcaatatagtgtgaccccatctctacaaaaagtttgaaaattagccaagcacggcagtgtgtgcctgtagtcccagctactcacgaggttgaggcagaaagactgcttgagcctaggagactgaggctgcagtgtgctgtgatcatgccattgcactccagcctaggcaacagagtgagatcctgtctaaaaaaataataataattaagtaaaagaataacaagaaaaataacaatatcttaagtaaaatagcttatttctctcataaaaggaacctaaaagtaggcagtccagggaagggatggcagctccattgtcaccaggttttttgtaccattgctgccaccaaatccttagcagactgattcaagatccagtatggctgttggagctccagctctcatatccacattccaggcaacaagagaaaaaggcgacaccttgtaactttattcattatgtgtgcttacatattggccagaacttgatcacaagtaattgcaaaggagcctggaaaatgacatctcttaaacgggctacaaggtgactgatacagtttggctatgtccccacccaaatgtcatcttgaactgtagttcttataattcccatgtgtcatgggagggaactggtgggaggtaagtgaatcatggaggtggttacctccatgctattctcatgatagtgagcgagttctcatgagatctgatggttttataataggctttcccccacttccctctgcacttctccttgcagccaccttgagaagaagagcatgtttgttccccttccgccctgcttgtaagtttcctgaggcctcctagccctgtggaactgtgaatcaattaaacctctctcctttataaattacccagtctcacgtatgtctttattagcagcatgagaatggactaatacagtaaactggtacccatagagtggggtgctgctataacgatacgcaaaaatgtgaacttgactttggaactgggtaacaggcagaggttggaatagttcagaggggtcagaagacaggaaaatgtgggaaagtttggaacttcctagagacttcgggggctcagaagacaagaaaatgtaggaaagtttggagcttcctagagacttgttgaatggctttgaccaaaatgctgatagtgatatggacaataaagtccaggctgaggtggtctcagatggagataaggaacctgttggaagctggagtaaaggtcactcttactatacaaagaaactggtggcattttgcccctgccctagagatctgtggaactttgaacttgagagagatgatttagggaatctggtggaagaaatctctaagtagcaaagtgttcaagaggaagcagaacataaaagtttggaaaactagctgcctgatgatataatagaaaagaaaaagaaaagaaaaactgattttctggggagaaagtcaagcctgttgcaaaaatttgcccaagtaacatggagcccaatgttaatcaccaagacaatggggtaaatgtctccagggcatatcagataccttcccagcagtccctcccatcataggcccagaggcctggaaggaaaaaatggttttgtggacctggcccagtgaccctttgctgtgtgccacctagggacttggtgccctgtgtcccagctgctccagccacagctaaaggaccaaggtatagcttgggttgtggcctcacggggtgcaagccccaagccttggcagcttctgtgtggtgttgagcctgtgggtgcacagaagtcaagaattgaggtttgggacttttgaattaatgctgaaatgagttaagactctggggactgttgggaaggcatgattagttttaaaatgtgacgacatgaaacttgggagggaccaggggtggaatgatacagtttggctgtgtccccacccaaatctcatcttgaattgtagatccccacatgtcatgggagggacctggtaggaagtaattgaatcatggcagtgggtttttcccatgctcttcttgtgatagtgaataagtcccacaagatctgatggtttcactaagggcagtccctctgcacacactctcttgtctgccaccacgtaagatgtaccttcgcttctcctttgccttctgctgtgattgtgaggcctccccagccatgtggaactgtgagtccattaaacctatttttttttataaattatccagtcttgggtatttcctcttagcagtatgaaaatggactaatacaccaaccaaccacagaatctcagtgcacacaacaataagcctttgttcccacactttaggtgggacagctctacttcaggctgcaggccaactagggtgactattctactggtctcattttggatcaggtgcaaagagtggaagctagcaagacattcttcttgtggtggaggtcagcagctctcagggaaccaagcccaaccatatagcacatttcaagcctctgctcatatcatacccacagacatttcattggataaagcaagtcaaaaggccaagctcaaatctgccctctcaaaaagggcagaaaaataaattctgcccagagtggacaagaaagagagtgagcatttgctgaacaataatctaaactacaatactcatccataatatagaactgagtatagacttcttggttcacaaactttgtttcccccctttctaatagtacttcaacatcttcgaaagttgaatgtcacagcaagcaaagcccactgcaggaaatcacgattctcacaggtagaatccattgatgagtcttccaagggacttcattttgttgtcctatgctctgtcctccccctctccctatcatgctccaatatcttgctactatatacctatggactatttacttctggatgagtcccatccattgacttcctaggtagccattccttgcctgtgttgaatcaaagaccagtcagctctgatgggcatttctcttattctctctgttgcagaaatgctaaaaaattcctcaaagtctcaggctacttggtggcatccttccatgttgccattttctaatttttatgtaatttttggttctttccataattttaggagaaaagaggtatgtagtctcaacttatcctgaaatcagaggtccaaaagagagactatattttttaaaatcttatttctgtacacatataattttacataaaaatataaatataatcacaatcatgattctttaccatgtgcacttgttttcttttctgcttgattccattgaaggtcctttactgaacttctgtatactgagtcttctaactaacccagagcaacatccccctctctgcaactgctaacaactgatgatacaactttgaatattttgctccatactcataattctagagatataaatatgcatccaactatataaattacaataaaataatttttaatcacagctactgtttttaaaaaggtgggaaattaccctgcctttgttagactatacatctaatattaatacctccaggaaccaccaccaccaccctgtcccatcaataatccgatttagcccattctgggtttgtttgtttgtttggagacagggtcttcctctatctagagtgcagcctcaacctccagggctcaagtctcagcctcacaaatagctgagactacatgtgtgtgtctccacaccactaatttttattattttttattttttgagagagagagtctcactatgctgcccagctggtctctaactcctgggcacaagcagttcttccacctcagcctcccaaagtgttagccgttcttttaagggctgtataatagtatatggtatgtggctgcaccacgatttacactctattccctctgacagcgtttatattggttttggttttatgtgactacaaacaatgcaaaaatcactcttacacatgtattcttatttaaggctgcttttattctatgggattaagtttcatatgtgggagtgctgagtcaaagtgtagaggcatttaatttcaatacattttgacaaaacactttgtagaaaatcatatataagaatactttcttaccacactcatgattattaattaatactttcttaccacactcatgactaaaatactattaatctgatggacagaaagtaacctttgttgttactttaatttgaatcttttcataaacttgttgatcatttcaatttgttgtcctttgaactatttttggtttttacccattatcctattaaaatatcttttccttatttattataagaggattttccatgcaattgctataaatactttgccatctacattacatatacaaggggattattattgtcttagcctattgaacttgtttatagcctcttctgccattcaaaagacttatttgacaaactcaaatattttctctttcacagtttgtgtttctactagcccctaaatccaagattctgtcttatttttaatttgtcttatcccatttatacttcactgtattgtaatacataagagatttcacatttatttccttcaactgctaacaactgatgatacaactttgaatattttgttccatactcataattccagagatacaaatatgcaacactcataaataatgtatcctttcttaatctatccttttcctaatcaattgtcaccatcatgttcagttctattatatacaagaatatatttctaaattttatttcactgacctacttatttttaatactatattgattgtaatgaatttacactgttttatttagaaaatctgatttgagtaaccaatttatccctcagtaaattttctttcttaggcatttaatcttccacataacctttataatttttccatcctatttcaaaaataaccacggtgaaatatgaaataaaaaggctttaattctgtctatttattttgggtgtcttgacatttacatgctactgaatctttcatctaaggacatgaaatgtcaatccatttgttcagattttatgacagaaaaattttagttttcatcacataggtcttatgcttatcttgctgaatttctcactattttacagttgtatcatattattctaaataattatttacattttcatttctaaatgcttagtgtgagaataaagaaaagctattgatattgtgtatttaccttatatctagcaaccttagcaaatttccataattctactttttaaaaaaattagactccttgggattttcagggacaaaataacacattagtaagagggataatctcctcttgccatgtctttgtggctattttgctaatccatttgctaaaatcttcatagaattgttaaataacagtatagttcagtatcctgctcattactgaaacaccagtagcaaatctttattctaaatgttaaaaattggcttttaagcctgggcaacatggtgaaaccccatctctacaacaacaacaacaaaaattagcacggtgtagtgatgcatgtctgcggtcccagctactcaggatgctaaggtgggagaatcatttgaaccagggatgttgaggctgcagtgaggcatgttcatgccattgcactccaccctgggtgacagagtgagaccctgtctcagcaacaacaacaacaacaacaaaaaattgagttttaatttccttctttgcttagtcttcattggaaatgatagataaaattatagcacatcaacagatactaagaaagtatttggtcatctgaaccaaatgtactgatacatggattttctgttttagtcacattttattattttttaatattttagctgatatgttgtttggtacatccatattttaaaacttatctttaaagtaaatttgccttttatttctactcagtattcctttttatactatttctccttttcttatattgactctattgaatgactcattttgcatttcccagtattatttatatgcatttctgtatttcaaacgttcttataaactcactaatgacaaaacaataaacagcatatatcctagctaacacagtgaatccccattgctactaaaaatacaaaaaattagccgggcgtggtggtgggcgggcgcctgtggtcccagctactcgggaggctgaggcaggagaatggcgtgaacctgggagggggagcttgcagtgagccgagaggcgacaaagcgagactccatctcaaaaaaaaaaaaaaacaaaaacaaaaaaaccagcatatagctaggtttacttttgtaacccagtctgatatctggcttgtaattttgttattcaatctgtttgtatttaatataataactattgtggttgattttattccttccatcttactttgtgtttattagtcattttatattgtttcttgttccttttccttatgtttgaggggctgatcaagttactatttttcctgccgcagcgttcctcacatggggcaccaactgtggtagcactcctctcacaggagcaccagctgtgggggtgtctgtcccttgcagacccttgacctggtgatggatgaataatgtacactgacacacagatattctgttttgccagtccagctgagagtgtctgtccacgctgcttacagactccttgctgagtgttgtaaacagttgctaccacggccccaatcagctagtgagacccacatttattcagtaagattaattaacaaaggcttgagtcaaaaccattagaggataattgacattgtggactttccgagtaaaaaccacttaagcaactgaggtacatcaaaggttagccttaagaccacatgagtaagtgagctacctaggtaaactactccgccttcctttgtaccaactttaagctatttactaaaggtaaggattaggatgccttcgaccatatctattaccgatgttatgcaaactctcaggccttccaagagggcttgcggctattactataactatctttaatatttttcccactaacctgattgaacccgaacattttccctcactaaattggaaattttgtgtagtgtttcattccattagtagtcacgtctatttaattcttcttaaaattaaatggtatgactctattctttgaaaataagattataacttccattaaaattatttttcccaccatgacccactatttatcatctcacatcccctaataagctcagttttttaaaatattgtttattttcactatctcatcctcctccctaagatctttttagaatgtttctacttctctattcaccattcccaactttcaggtcgttgggtactgtttacttttagatttttgaggaagtttaatatatctttactttgcatttaaattacaaatcccaaaacagctatctccatccatgtactttctaaatacatacgcactcatgtgttaagatttactgtgcttatttcctcttcatgttttcccaccttgaagtctctattctggttcatttactgtttgattcacatctactcttggatacaatatgtgggtgatactttctgaatgattacatatctctcaagtccttttcttaatctaggcaggaaaatgatataagttgaaagtaagattcttggattgtggtctatttctctcagtagtgtgtggatgccccatcttcctaacttgcagatgagaaaaccagtgccaggttggttctcacacttcatccttttcttaaggtaactttagtattttttttttctggagccatctgtatatatcattagagaatttgagaattttatcagaatgtgtctggacatgggtcttttctcatcaggtgagtctagaccttattaagcctttttactttgcgggccaaaatctttctttagctcaggtcaagaatattgtctattatataattattacctttcctatttcctatttatgttcctttttcaccttgttgaacatcaattattttcatttcaggtccctggaatcaaatctccaagactcttatttttcccctcaagatttctaacttttaatcatattttcatatttatgctctgggatttgagatgtgttttacatttgatcaaccagaacagtaaatcaggtctcagcagctaccctttttcccttgtgttacttaattaggaatcatgcttaaaatgttgtaggtgctacagttgaatctccctaggtattatacttttatttttactttttcaaatgttcacgtctcctccaacattgctacttcacatcacacttgttctgactgtctggtgttcctctatttgcctgcaggacaaagagattgtatgattttgtatacttatgtagattgtcattttgtggaggctaaagtctgattgttagttctctaatttggcttcatattagaatcacttggggagttgttctgtggtttatttagtttaaactgataatgcccagaaccagtttgataagagtctctggaggaggtacccaggcattagtacttatgtaaataccccaggtgaattttgaactagagccctaaagggtctgaatcttacttgtgtgagatgtgtaaaaacgagaagctatttccccttcagaaatagcagtggaaagcctttttgctctcaggtctccctgccctcctcttgggctcaaggacatggataatcctatctacccattgaggtcctttcttgggttttgtgggggttagggagactctcatatccctacccccaggaatcttctgatctttgaagaccaggctctagaatctacccctctggagctctttatcctgaggttccaacactattctctcactagggctcagaccatttagaggaagccctcccacctcaagccccacacaccatttcctctcccgaaagcccacacagcacaagggttccctgagatcagttgcctataggtcctctggctcagaagatgcaggtaatgtggttctaaaagaagaaataaaccacatgcagatcttcaaattataacttctagtagtcatgtctatttcattaacttctagaagggataatatggacttttattttccacattccacttttattgttaccacattcagatcttctaactataacttctagtagtctcgtctatttcatataacttctagaagggataacacggacttttattttcttatttctggtctttataataaacatctaaatacaacttttgttcatgtaaatggcaaattagcatcatcgggaaaatggatgagaagccatgaagaatggttgttctcctcataatgagcattagaatgtaaatagcaagattcaaaggagaggaggcagaattaagcacagtcaagacactgggataaaggactgatcagataatgtctggagcaaatcaaaatgatttacagatataaacaaatacataagcagtacatttataaattatagatgttcagctggaggagggtgaatagagagtggcatccttctttctcttctaccatttgtcaatattaggaaatatgacctgtaagaatttatgaagaactttgatattataaatttaacattgagtgtgttgtagccattggtgagataaatatatggcacaacctttgtggataattttgcctttcaattttgagatgtaaatttttttactactgttacgagtttcgtgtttaagacaggaatacaactactactttcagagccctctccattatatgagaattgagtcgaggacaataaagcaccaccatatccccatttttttttctataagagtggttttcagacttatttggtcgtgctttgttcaaaagagagcttaactaaatgctcacactggaaaaaaagatgtgtgtggaactgaacctacttgtgacccatcctcccagccctaagcatcttcccactagaaaccaggttccatgagaacaggtcatggatgtagcatttctcacagctacatcctcagtgctagaaaatgccaggcaggtagtaggccttgctcaagatttaagaaacgaaccttgtaacagtatgcaggactgtttggaaaccactattttcaaccctttcatttaaatattatctagagaagccactccagaaggaatacaaactttaagcaatgaggaacagctaatgtgcatatcagctgaatgatttgagcgtagatatctaaacaccctgcacctcaatctcatgagggttttataaagtgcctctatacacccccaaccccaagaaaaagctgaaaattttatcacttgtgttttatgtcatttgacagcaatgtaaaagtatcatgaacttttgcatatatatgtattccttggagaattcagaagggaccacagaaaccacaggtctaccagctagttacttgttatcaattataaaactttctggatgatactctcattctatctttctcttcaagtccagacatatttcactgcaaagcccaaattctagatgactgaagaattattcaacttcaaagggaagttaggaatggtcagttagccaacagagtttatttacctttactctaatactacagtacactgcaatgatttgcttccatatccatctccgccaatagacagctggttcctggaagatgaaaaccacattgtattcaccttagtaattaatgtaagtgcctagtgcaatgcaaagcacattgtagcctcccacttctgagtgtggggcagggacaaggaagaattcaaacgtaataaagtaactgaattccaggatacttggtattagctgttagagtagccttcaggaacatccttctttactcacaaaagtccaccacattcagggagtgaagcaaagtattatcaaccatctgattcttcatcctcattaaataggctcccaaggtccagccaccagcttaaaaaactggaaaggcttttaggcagtatttacatggtccaactagagagaggaaaggaagatcctgacaaatagaactcaaagactagctgacaataaacatcccccctgtgagaataagagcacactatgggagactgagaaagtagaagttaactcagacaaagaatgtaaaaatctgcccagccatcaggctggagaataacagaaacagagccagcttcagggttaataggaaacaatacttttttcaaggacattctgctactataaagtgtcttaacaacccctttctttgtctactagtagttttctgactcactgggaaactttgtgctctaaaatcaccagaaactctgctgtttgaaattatagtactcagaatgaagcatttcatttttgtctggaggatctaagttactctgacacaaagaaatggcctcgatttatcacctagagctttagaaaagggagttctggacatggcatttcacatcactcttaactttgtagtttgcaagcaaacaggaccctggtccacattgcagtgatattgatgcaaattgtgtgacccattgacacacaagccctgctttgccttaaacttaccaaaaattgctttgtttatatttcacttaaactccgcccttctcaaaaaatcctatgactcttttcctttgattattgagcagctttataagtggtttctctgctgtagagtctacctcattgtcataagtcaacaatcctgccttcgttggactatagctttgaacctgatggctttaggctgattgcactatgccaagacttaaatcttggtatccacctttccatgattgagtttaggttcaagcaaagctttatacaataaaactgttctcctggaggtcatagagctccactttgttccttgcgttcatttgggcctaagtgaacttgtcctcctcagggcttaagtcctcaactagccaccagcactgaggaaaggcctgcttcagcaatgaaaacagttcatcatttcccttttactaacccttgatttcaacacttagaacaccttggctcctgttggatgctgatcacaagaggaagcagtacttgacctctgtaactcttggtcccagaatttaagatgctcagagtccttatgtcctcagtgatgggtggcagaggaaatggtaatggtttttcttggtcctcggcttgggtgcactgattacccctaggaggcaggagcatgaagaggtgaagggaatgtcagcagaggagtagatttcatttatcagaaaatcatgcaaactagggaggtgcagaatgccaactacagcagcccagaatagtctattcagggctcagtgtttttatactcttcagaaaggaagcttactgccttcctatcctatctcccccaaggccagcacattgcaaggaaggattggcctttaactggttcgtttaccacaaaggcccagtaattagtagtaagagctgctatttaattccctcaactactttgtcttgctttgaaaagcattcagaagagcaagagtcttgcaagggatatctgttaaggaatataaaaagctcagctattcactataagcattacactctaacctcaaaacatctttagttcccaaacctagaggacacaaatacaaattttccccctaccacacacactaacaaaataaccacaatatgttttaagaaagtaaatacagttaaaaacgtctacagataaatatgtacatttaacaaatgctttcaaaagttatttgtagataaatcccagatgccaaaagggaaacactaataatttgactacataaaactttaaaacttgtttacagaaaccaaaaataaaacataacacactgtttagaaaggcaaaaactatgtgtggaaaaaatctgccattctgagagatgaagagctagtttcttaaacataggagcaatgctgatcagggatacaaataagcatgtcatagaaaatgaaataaaaatacccctcatccattttcttagaaaaacgaactataaagacagagtactaagggaaagaaacataagaaattctacatgttcacataagaataggcaaacaaatattaagtgttttttttttttttttttgaaaagagaaacagaggtctttgtatcaaagtttgcaaagataagattgtgaattaaaaatagaaaaaggccaggagcaatggctcatgcctgtcatcccagcaatttggtaggccaaggcaggaggattgcttgaagacaggagtttgaggccagcctgggcaacaaaaggagtccctgtgtctacagaaaaattttaaaaattagccaggtgcagtgatgtgcgcttgtattcctagctactcaagaggctaaagcaggaggatcccttgggcccagacattcacagctgcagtgaggtatgattgcgtcactgcatgacagccaaggggacagccagacagcgtttctaaaaaaaaaaaaaaaaaaagaaaagaattaagtttctgagtgaatttacttcaaatgggattttattaatgttcctataatccaagaaaatgtttctaatcaccacctacccctggccaatttaattgttgcaaataaagactgtatagtaataaatttaaaacaggaactacaggacttaaaaatatcaaggcatataaagatcaaaccagctcttatgaataaaacatccaacttaatccatatgaaatgtttttttcttcaaagtgcctaaatctagtactcatagcctcagtcattcttcaaattatagctcatgaataccatccaggtctgaaatttgttttaagatagctcttaaagatactgcaatgcatgactagttctgcctaattgatctaccacttgaaaattcacagtcataaaatccaagctgctgtacagccaagctctcccaagagcccatcattataatttttcctatagccaccacgtctcaacactaatggatgtaggaatattaactatgatcaggtacataaagaaatggtagcacccaaaatacgaaagcaaagggacaaatcatttttatctcagatttcaatatgcagtgtgcccatagagtatgcacaggcacatcaattcccctagctgtctgaatgtctgttcttaaacgttgtgggccatgctgactaccagaacaaaataaagttgtataagattgtatcaacggcgcgaggaaaagtacaataaaactatttgtaatgcatgagattcacatgctgaagttctcatttagacatcacagtcttatataataaattattctccctcctaggtatgaaataatattgtttaatgttcagattttaaactacagaaagaaatactaaggaaaccacggatggtatgagatgaagctcttttgaaagatacacacacacacttcttaaaccttgctactcttttttttttctttcaaatattctaatcttccatgggtcattttctttgattctcaatataaactaaatcttgactttttctttcctgaactcagcaaaggataagaaagtcaagcatactgaaacataccagcatagcaactcataatagctgcccattaacagtagtttttcaaacacaatctggagaaagactatacaggatgccatcaacaagtgtattgtgatttaatgactttatcaacatatttatttcattgctatttaataacactaaccatggcaacacaggataaaagaatttttacaaaacagcctatcttagaagtttttcaatttgagcttaaaattttaaagaatgaacttgatctaattataaaccacaatttaaaatgttagttcaaaattaaaggcctatcagaaattaccaataaaaaaggttgactaaatcacaaataaatacattttatctcaattatctcatctacataaccattaaaaacagtctgatttgtaggaatccaattattttgaaaaatcatcaatggtaaagaaaatacattttatgttaatttttgatgtcctaagggaaccaagttaaatggctaaatcagtttgtagacaacagatcaattcccagatagcccatttgctttcccctgaatacagtaatggaaggaacctcaaaggcaaactcagtattgccaatcaagccataaccttgtaccaagcaaaatgtgttgtgaaatgctccctttggtaaacagaggataccacagttattctgctaacatcctgagaaaagctaatccataaaacatttcattttaaactccctgctatggtctgaatgtttgtgtcctcccccaaaattcatgtgttgaaatcctaactcccaaagtgacggtatttggaggtgggctcttaagaggtgattagttcatgaatggagcactaatgaataggattagtacccttataaaggaggctctaggccccagagagaccccatccctctttcagccatgtgaggttatactgaaataacagccacctataaaccaggaagcacggcctcacgagaggtgaaatcttcagtaccttgaccttggaccttccagcctccagaactgttagaaataaagttctgttgtttataagctacccagtttatggtatcttgttgttgcagcttgaacagactaagacactattttaaaaaatgcaacagactttagagatacacctataagattaacaaacttatttagtagtatgtcattatagatttcaagtacattagatttgctgatctttccaatagtgtattttctttataaagcaaagcaaagaaatttaaccaattataagatattcactgttaaacatgaatacagtgaacaaagaaaggtacactgctcaccctaggccaagaaacagctaacagcaaagcatctggtctctccagactaactgctcacctaatagcactatgcttctggcaacttctagttcaatatatactgaataggatttgtgcaactctaatttaattcaccaccaactacatatttgtacaaattaaagcattcatattggatctttgttcaaagagtcctgagtgcaaatgaaaaaattaaaatgctgtacctttcagccatatcattacatgcactaaaagcctttctaaaagaaacactgatttgttatatcaaatgtgtaaaaggaccattcaggtcctcctttactgttgtttctcttcatttttcatttccattgattgaaactccttggtgcatccctccagcccctatttttgaacataattccttttttgaagatcagaccccaattttcattataatatcttcaaaaatgtttacaactgtgtgggagtctaagtctcttgagaaattctaagaacttgctttatgaatctgggtgcttccatgctgggtgcatatacatttaagatagtgagagcttcttgctgaattgagccctgtaacaattatgtaatgcccttctttatctttttaaatctttgttggtttaaagtctgttttgtctgaaactaggatcacaatccctgcttatttctgttttccatttgcctggtagatttttctccatccttttattttgagcttatgtgtgtcactgcatgtgagatgggtcccttaaagacagcatatcaatgggtcttgcttttttatccagcttaacatggtgtgtcttttaattgggacatttaacccatttacattcaaggttagtattgatacgtgtgaatttgatcctatcctcatgatgttagctggttattttgcagacttgtttatgtggttgcttcatagcgtcactggtctatgtacttcagtgtgtttttgtagtggctggtaatgatctttcctttccagacttagtgcttccttcaggagctcttgtaaggcatgtctggtggtaatggactcccttagcatttgcctttctgaaaaagatcttatttcctcttcacttatgaggcttactttgcctgaaaacaaactctaggttggaatttcttttctttaagaatgttgagtattgacccccaatctcttctggtttgtagggtttctgctgagaggtctgctgttagtctgacgggcttctctttgtaggcgtcctgacctttctagctgtcatgaacattttttctttcatttcagcctagagaatctgacgattacatgtcttgtggatgatcttcttgcttcatttcctaaacctgaatgttggccactctaggtagattggggaagttctcatggatgatatcctaaaatatgtttaccaagttgataccattctccctatctcttttggggacaccaatgagtcatagatttagtctccttatataatcccatatttctcggaggttttgttcatttccttctcatttttttctgtactcttgtctaattgtcttatttcagaaagccagacttcaagctctgagattctttcctccacctggtctgttttgatattaatgcttgtaattgcattataaaattcttgtagtgtgtttttcagctctatcaagttgtttacattcttttctatactggctattttgtctatcagacttcaactcccacgcaataatagtgggagagcttgacatcccactgacaatattaaatcatcaagacagaaaactaacaaagatattcaggacctgagctcagtactggatcaaagggacctgatagatagctacagaactctcaatcccaaaacaacacaatatacattgttcttatcaccacatggcacatcctctaaaatcaatcacataatcagaagtaaaacactcctcagcaaaagaactgaaatcattttaaaaaaaaaaaaaaaccctttctgacaacagcataatcaaattggaaatcaagactaagaaattcactcaaaaccatacaattagatggaaattgaatcaactgctcctgaatgaattgggggaaataatgaaattaagggacatatcaagaagttctttgaaactaatgagaacaaagatacaacataccagaatctctgggacacagctaaggccatgttaagagggaaatttgtagcgctaaatgcccacatcagaaagttacaaagatctcaagttaataacctcacatcacaactgaaagaactagagaaccaagagcaaacaaatcccaaagctagcagaagacaataaataactaaaatcagatctgaactgaaggagattgagacataaaaaaaaaaattcaaaagatcaacaaatccaggagcaatttttttgaaaaaattaatagatcactagctagactaataaagaatagagaagattcaaataaacaaaatcagaaacaacaagggggatattaccactgaccccatagaaatacaaacaaccatcagagaatatcatgaacacttccgtgcacataaactagaaaatctagaagaaatggataaattcctggacacatacaccctcccaagactcaaccaggaaaatgtgaacccctgaacagaccaataatgagctctaaaattgaatccttaatgaacagcctaaaagcaaactgaatccggcatcacttcaagaagcttatccaccatgatcaagccagctttttccctaggatgcaaagttggttcaacatacacaagtcaataaatatgatttatcacaaacagaactaaagacaaaaaccacatgagaatctcaatctatgtagaaaaaactttcgataaaattcaacacctattcatgttaaaaactatcaataaactagatattgaaggactatacctcaaaataagagccatctatgacatacccaccacaaacatcatactgaatgggcaaaagctggaagcattccccttgaaaaccagcaaaagacaaggatgccctctctcaccactcctattcaacacagtatgggaagtcctggccagggctgtcaggcaagagaaagcaatatagggcatccaaataggaagagagaaagtcaaactatccttgtttgcagacaacatgatcctatatctagaaaaccccatagcatcagcccataagctccttaagttgataagcaacttcagtaaagtctcaggatacaaaatcaatgagaaaaaaatcactaacattcctatacaccaaaaacagttaagccgagagccaaatcaagaacacagtcccattcacaattgccacaaaaagaacaaaatacctaggaatacaactagccagggaggtgaaatatctccacaaggataactacacaactgctcaaagctatcagagatgacacaaacaaataggaaaacattccatgctcatggataggaagactcaatattgttaaattggccatactgcccaaagcaatttataattcaatgctcttccattaaacttccattgacattcttcacagaacttgaaaaaaactattttaaaattcatatggaactaaaattcatatggagcccaaatagccaaggcaaccttaagcaaaatgaacaaaggtggaggcatcacactacccaacttcaaactatactacagggctacagtaaccaaaacagcatggtgctggtataaaaacagatacataaaccaatggaacagcatacagagcccagaaataaggctgcacacctacaactatcagatcttcaacaaacctgacaaaacaagctaggaggaaaggattccctattcaataaatggtgctgttattactggctacccatatgcagaagactgaaactggactccttccttataccatatacaaaaattaactcaagatggaaaaaagacttacatgtaaaatccaaaactgaaaaaaaaaaccctggaagacaatctaggcaataccattccggaaagagcaatgggcaatgatttcatggtgaagacaccaaaagcaatcgcaacaaaaacaaaaactgatgaatgggatctaactcaactaaacagcctctgcacagcaaactatcaacagagtgaacagacaacctacaaaataggagacaatttttgcaaactatgcatctgacaaaagtctaacatccagcgtctataaagaacttaaatttacaagaaaaaaaaacattaaaaagcaggcaaacgacataaatagacacttttcaaaagaagatatacatgtggataacaatcatatgaaaaaaaaagctcaacatcacctatcattagagacacgcaaatcaaaccacaacgagatatcatcttatatcagtcaaatggctattattaaaaagtcaaataacagatgatggtgatgttgcagaaaaaggaatgcttatacactgttggtgggagtgtaaattagttcaaccattgtggaacacagtgtggcaatttctcaatgacctaaaaacagaactatcatttgactcagcaatcccattaccaggtatatacccaaaggaatataaatcattctattaaagacacacatgcacgtgtgtgttcactgcagcactattcacaataacaaacacatggaatcaaactaaatgtccatcaatggtggaatggatagagaaaatgtggtacatataccccatggaacagtatgcaccataaaaaagaacaagatcacattctttgcagagacatagatggagctggaggccattatccttagcaaactaatgcaggaatggaaaactaaataccacgttatcatttataagtgggagctaaatgatgagaacacatggacacctagaggggaatgatggacacagacgggaacaacagacaccagagcttattgcagggtggaggcagggaggagggagaggataaggaaaaataactaacaggtactaggaataatacccggtttgacaaaataatctgtacaacaaacctccatgacacaattacctatataacaaacctgctcatgtacccctgaacttaaaagttaaattaaaaaataaataaaaatatttcatcatatgaatgtatgattttaactcattctctaattcatagagatttgcattattttgagttatacatgtttatttaatatttgtgtcaagtttttttgtgcaggttttttttttcaatgttatatatcaaggagtaaaactgctttgtcacagagcaagttcaattttatgcaaaactgaataacagttttccaatgcagttgttgcattaaaaaaaaactctataaaacattttaacaccacaatacaattcttaccaatgaggtttccctttccttccctaactccttattctatcaaaaggaaaaaacaagagaggaaaaggtgctgtgatcgtccctaaacacatcctcctccttgacccaaacatcaatacttgtccagggctgcagttcacccagcccctagaccaaggtaaaatgccactctccctaatgaatgttcaaaataagtgtataaacttcaccacagtctaactaggccatctaaagtctgaagtattaactgaaacaatattaagctccctatttaaactggaaccaggactacccagaggacatttgtttatagcctctgcagctacatcaatgtatatagatgtcctatattatcccaaatgctacaaagccaacaaaaggttagttttgcaaagcttacttttattttactcgatatgtaatattacagggaaatctttctgacaaaagtctcaatgagggccccttactgaaattgctgtaggaaactctaccattgcctccatcacaagcaatttttttgtagacttaattatattgaaactctagagaaacttctgttttactataaactctacttcatcaagaacttgttccagaaggaaaataaaagagttacactatgaaagtaatgtttgagttttcctgagctcacagaaaatacttatgtacacttgcctcaacttctgcttgatttttgcaagacagggagtcaggaggggaagaaatcttcctttgtagaaggctctcattaacacagttaccttggacagctagatgttcacctgatgaaagacagccttatccctgtgacaaggaggacaagtgcaatcatttgttcaggtgtgcctcccatttagagaaatggtcttccaatcgtaaaaatgctgtcacattttcatacagtcacaagataaataagaaagtgccttataaacaaatcttaaatagattcaagtttgtagtctttgcaccattcaaaaatatggccatttcctttaaataccagctctcacatttggccaattgccttggcaataatattgccttaaaatgtagtgactaactaatgccagaaaaaacagaacacagatacagtattattcttttctttctagattgagagaagacagaagcatatttttaagaagtatagctatgtagggctgggcgcggtggctcacgcctgtagtcccagcactttgggaggccaaggcgggtggatcacgaggtcaggagatcgagaccatcctggctaacacagtgaaaccccgtctctactaaaaatacaaaaacaaaattagccgggcgtggtggtgggcgcctgtagtcccagctacttgggaggctgaggcgggagaatggcgtgaaccccgggaggtggagcttgcagtaagcagagatcgcaccactgcactccagcctgggtgacagagccagattccatctcaaaaaaaaaaaaaaaaagaaaagaagtatagctatctagaatgcaattaacctaaataatttaaatggaatcaaatgcaagattataatctatgtgtcaaaaggagtctgaacaaggagattaaaatgttaacactggcactcatattagtcaaaatacacctagcaattaaaagttttttaaatgttcaactgttcactttctatcatagagagtttgttcaatgtctcatattcatacttctttcagtcaacacatctatcggcattgaggaaaggccactgaaactcaaatcaggtggtgtaaatttatattctcacttggccacttacaagctatgtgactgttgaaagcctgcctctggcagctcttcagaaaaaaagatatgtaacctctactactcggttatcctgggtagaaaaccacatcatatgcaaacactacatatggcataaattgtatttaacaagtggaaaagtagcatttacataaaagatattattttactatctactagcaagttcagtgcctggactatattaaacattgaataaaataacatgcaaaaacatccacggttataatactagttttattcctactcaacatttattggttcacaatataaaatttatgagaaatattttgatatatgtagaatcatactggaaaatttaacatctccttcagatttctcaaaataaaaagcacatagaggttcaacacgacaacttgccaaaatacattattagagagaaaattttacctcataaacagataagcttttaaaataaaaacactgttgtaatctataagctttacaaaaactgatcaagttccagagcagtgacttctaaacattaaaattcataggaataccctgggatcttcttaaaattgagattctaaagtagtagatgtaggttgggggctgagaatttgccttaatgctgttaactgcctgggaactacattttgaatagcagggtcctagatcatgaagtaaaaaaaaggaaccacattatatgaggcttcaataatagagctagtatagtaaaataagaatttacaactaaaggaggaaaagagcaaacaaaaaattcagctgggtgtggtggctcacgtctgtaatcccagcactttgggaggccaaggcaggcagatcactttcgaagtcaggagttcgcaaccagcctgaccaacatggtaaaaccctgtctctactaaaaatacaaaaattagccgggcgtggtggcacatgcctgtaatcccagctacttgggaggctgaggcaggagaatcacttggactcaggaggtggagatttttggtgagccaagattgtgccactgtactccagcctgtgcgacagagcgagactctgcctcaaaaaaaaaaaaaaaaagaaaattcaagtgaacttcttaccttggggtaattaagaaaaacactatttgggctaaagagaaaattaaaatgaaaattgtacataaaaactgggcaaagaaagcacatttaaaactagaaatgctataagccaaagcaatactcaaaaatatgtacatatagggagagatagagaccaaaacagaatgttcaactgtaagactaacataatccactaaccaaaatcagacaaagacagcaccaaaagccaatgtacgttataagaaatgctgcaaaaatcctaaacctactaatgtttataccagatatgcttaagtggtccaatatgtattaaaaaaactcctaaagaaatctgttacattaacagattaaaggacaaaacccatgtgatcatatcagtaagtgcttgaaagattttgatctaagtaattcatcactttgctaacaaaatgtattagcaagcaaggaacagtattcaaggtccttcatttaataaaaaatatctagcacaaatcaccacatgtaatagtgaagaaatattacacatgttcccattagatcaggaaaaagacaaggatacctattatcattgctactataaagttacataatggaactttcagtaaatgcaatgagaaaagaaaatgttaaccaaaaagaagcatatgtaggaaagaaaaaaatgtaaaaattgtctttcctgaacaaattatataactacatgaaaatgaaaaagccaagagaatctttttttttaatttttatttattttttttttctggagacatggtctcactatataccccaggctctatcaatccaaccaactcagcctcccaaagtgctgggattacaggcgtgagccactctgcgcaggtgagaatcactttttaaaaaactattagaattgataagactctggtaaagattcaaatataaaatcaacattcaaataattaaaaagtattacttaaaaatctctcataatagaaaagctacaagatgtctaaacagtatcacagcatgtataaaatctatttagaaaagctataagatgtctaaacagtgtcacagcatgtataaaatctatttataaaagcaaattactgaaggacattaaaaaaactcaaataagtaaagagttttcatacttctattttggaggactctatactgtaaatgtgtgaaatatccccctgattaccctacaaatgcacccaaaaaagctcagctcttaaaaactgacatgcatttacaattcattttcaatgagaaaaaaagaaataccagagaacctacgattattcccttcttagaacaagctgtgctgtttcctgcctcaggccctgcctaatgcacttcctgttccctctgcgtcacatgctgtgtacctccactcttcggtaatcgctggtcagtctcactcattggatctcagcccccaaaaatccgttcttggacttctttatttaaggtaggcaagcacatacaggtccataatacaccctaggtgtgatctatccaatcatccacttcaaactgtgaccatctcatctatgagatgtttatcctctaaacaactaaacaatgcttaccctctagcactcccatcagaactatgttccaagagctcagaaatcatgtctctcttgtcatttccagatagctggtatcacaatgactgacacatgagcttattgttcttaaaattcttaaagcacgtgtctactttcaccattagcagcaatctaaaaacctacagagccaaagaattacacataaatacaatggaataatatacagccattaaactgatgttgctgaagaacaattagggacaggaattaaagcaaatggaacgtagagcacaattccatttttgtagtcaaatttatgtgcacaaaagacatatatggatgcacataatacaacaattacctccactcatatattttaaatgactttatttgtatttaatgttttattttcacattttctaaaaaaatatgaattatatttaaaggaagaaaaactcaatataggtttgttattgtatgcataggtatgtgttttaagaaaacaggcctcttcacttcctccaactcccttattacctttgtcacaacatatataaactcagaaaaaaacattcaaaattataaccttgaactcaacaagccacactggaaatacactcagtgctgctcatagaaacccacttaatccctgtcctgctgctttaaaaaatgcaaaatcttaagtgaaaaaaggtaaatgttgccagcatttgttctgtaaagggaaatcacaattcagaaagactcattttttccctttgaagttaggaacaagaacaaaacctccctaaattctcaccctgctgctgcaagaggaagaacagaagagagaatgttctgtgatggaatctcattttggagtctgaaagaacgctacattgctgcctctgtgacacagagcttgccattttctatggtgttttctatcagaatcacatgaaaatgtgacaaagccataaatcacaggaaactttcaccactagatggtgagcttgtggcttggcagctcatgcctctgatcattggtctcttcaaccaaaacatttaagaaatcagatatccatttgattcattttaaaaatttatagtattctttgatggtagtttgtatgtctgtgggatcggtggtgataaaaatttaatgaagaaaacaagtactttgcaactaagcatgatacaagtcaaatgcagatagctatcaaaacatttttaaaataaccaaagtgattacacttaagtcctgttaagtcctggttttcctaatacacatcttatattcaaatttctctaggggatgggttacttaataaagtgagaattcctgtacttaggatccctagttttgacctgctgcttatcctgtctttttaaaaccaggcttgaatggaaaaaaaaaaaaaaaaaaaaaaaacactgcaaagcacactctgaagcttttgcttaagggacagctctcctttggccagttcactgtggtcactcattcccagctaccacactgctctcttatctctggttcctgactgacctgcactctagtttgttcagaaaagtctagaggtgaagctttaatcctagcccacttagtttcctttccccgcatcagtgccaaggcattagcagaaccagtatttctccataagggaaaactaatgaattcattttaaaccaacttcttataagccaagacaaggcattagctatcagtcatgacttcaaatagatacaactgctgaggactagcacgttgcatttttccagccacaggtataacctgtgcatttaggttattttatttttctttcaggaaaatactcaatataattaaacatctgctctctaacatcctatacaaatgaatggctgatgattttagaatcactgacagtttggtttaaagacagaagatcatttaatttattgtttttaatagaaaatttcttaaatgacattttaaggaaatgtcaagaatgttggtagaactagagtgtgtagtgtaagaaaaagatgcgaaatttaagcctttcttaaactgcggaattatcttatgaatggcaattatactcaatattgtgatacagagacacctcaggacccaatgcatcataaagggtcagtgttcctatatcaaatgatgctggattgccatccttttcaaattcttatatgctctgtaagatttcctatgtcttgccttgaagtcaactgtcatttttcatggtaattcactatgctgcctatagaaattcttatcctcatttgtttgctatttctaataccatatacttaaaaattaaataggcttactaaaattgtacatgaaacaatgaataagctctggggattggtaaatagaattcttatctatcacaaccttgtgtacttcagtgagagaactctgttatactcatttagagatacattatttaataataattgtgtatgtatcttgtgttcctttattaactacaagtttcttaagaacaagagccacatgaatcacctttgtaaccccatagctaacccccagcaaggtaccctgataaatgctgaaagcattttcaatcattattattattattattgttattgagaaggattcttgctctgtcgccaggctggagtgcagtggcactatctcggctcactgcaacctctgcctccagggttcaagtgattctcctgcctcagcctccctagtagctgggactacaggcacttgccaccacgcctagctaatttttgaatttttagtagagatgggttttcagcatgttggccaggatggtctcaatctcctgacctagtgatccgcctgccttggcctcccaaagtgctgagattacaggagtgagccaccacacccggtcttcaattatttttattgtttacttcccttatattttagatagtttaggtccagatgagtaaggttctagtaattttaacagtggaaccaaagatcaaaactctctatacttatcagcttacagcctaagttgtggtccttccaaaattgccttctctttaattcagacatgtcacataatcaccattcctggttatgagtcaagcaaccaggtatcaggagaagccacagcagagggtctctgaatgtcaagggctggtgaaaggccaatgctggtagtatacacaaaggcaccagttagataccaggaaatacgtgccctataactcacaagagagacttctctcccaaaaggaagaaaaaatgcacatggatacctttaatttgctacagccctgtgaatgcttaaatttggatagggcagcaaaatgaggcacacagctgtaacattagctcttcatggatgttttaaatatttttaaacttgccaacaaaatagccctttctctgttaagtaggaggtatggatttttatatgtattaatatttatattagagcactgaatgtgcaaacctttgttttatgatcatttctgaaaatataaataagaagtactagccctgatttcttgaggcttttggattttcttaatgtggcagtcacaatagatgagactcacattgttagaagctattcataagcaatttacaaaattataaattcaagttaggaaagttgactatctaaatgtttccttatatctctgaggatgtggaagattagtgttcactttagaatgaataaatcagtattgtgatgatctcagttctacaatgaaataaaagtgtttagaactggtaataatcataatttgatctatgtcatttttttctactactgtacccacagaactaaaaacaaatctaacgaaatgtgattgggaaataagggccagaatctacaatttattgcccaattaattatctctttagttacttcactatattggcatggacaattaatgggtttacaacaccaatgctgctttaacactgacttaaatattttaagatgtctaaaaaacaaattgacaatcagagtcctgccatctattaacaacaacccgaatgattttatctttctctcacagcttaacattaatgcagtccaggaaatattctaacatagtaattgcaacaaataatacagattatctaaaccatgagtgatgaagttagtgctaagaatttcccccagacctaccacttaggtaatcttttcttctatgattacttaataatattcaaatatagaaatctgttagcttattatctaaggacagattatattaaaactaaaataagttgttgcaaaatttgtttttgtttcatgatttccaaacagccttaaagactgtgttaatctatgggacaggggagaatacatgtgacaactatcaatctattgcctcttagcaccaaatccactgtttattttctaaaaagagagctgaacactagaagtaagcattcctcctttgcagtgaaaatgatgctaagttttgtcattaggggatactgtaaggacagagcaagaggaaggggctttctttcctcgttccagcacatttgtatttgcttctttatgctcctgccaccctgctacaagcagtgcatgcagggggcatgtgctggtggcctaccccagcggtatgccccaacccacagacccttggtaagttcatagccagcccaactctggcccagtgaacatgtcaccatggccctcccaacacagacactgcaggctccaagactcacatcacttagccagtgatcatatccccagtgcctgaatccctccatgtgtccatccaccaggctgggcccacctgaacccatgagaggtgttccaggcctgccagcctcaagttgcctataatctggagagaaattttctgctccactggaaagtatggaccaactctggcctggacaactcagcaaacttctctgacatccaataggccacaatcataatgtctacaatgaggtctgaaacccagcctcgggaggcggctccccttccaagtttgttccttttggggttgctattaatataacaaaatgccacagactgggtggcttaagcaacagaaatttatttcctcacagttctagaggctggaagtccaagatcaaagtgttggcaggtccggtttcttctgaggcctcctccactgacttgcaaatggataccctcttgctatatcctcacatggcctttcctctgtgtgcacatacaatcttggcatggggggcattgggggaaggtggtctgtttcccaagtttccttttcttagaaggataccagtaagaccagattagggatcaccaaaaaggcctcattttaatgtaatcacctctgtaaagaccttatctccaaatatggttacattctgaggtactagggattaagacttcaacaaatgacgtagatataaagttttcactgtagatgtaaaacaaatccagttcagatagctctaaacagaggcacagtacccttccaacatattctgaagcctcagcacttgccacaataacattctacttcaatacaactaatatactgaataaatttatggaaagcagtatttcagaacgtcaagtcttggtactaggagtgctcacgattaccagattggttattgcttctatgtgtcttctgtagaaaaaaaagctaggaaatatgggctttctgatatgtattaatggtgcagtgtgttgttaaactgcttccctggcaacattctatgttcatgtttttacaacattagtatttctgcagttcgtacccttgtgatttagaattaagaaagtaaaatgtggttttgcaatatcaaagtatagcccagttacattctctgccacttattaatcttaactactgtgacaactttgttgatcaagaacatgaagtcctgtggtataacattaatacacaagataacagtttcattaccttctgctggagtgataaaacataaaccacttgcttggtctaagacagcccacacagacacttaaaagtgttgctttgaggcaaggaagttagatgtcaaactgtctacttcttatacataaattgaagttttccttgtaaatgtaaaacaaatccagttcagatatctctgaacagaggtatagtacccttatggctttttctgaaatcccagcagttgccacaataatgttctgcttcaatacaaccaagatattgaatgaatttctggaaagccttatttcaggacttttatcttggtcctaggaatgctcactatcactagattggttactgtttctacagattttcagtacaaaaagaaaagatctaggaaatataagcttatttatctttcattttatatatgtatggtaaatatgcatgatatatgtatgtatataaaagttcagattgtcatactaataattttcattaaatgtaggactatatgttccttatattcttaacaggaggggacacttacaggctcctggagtacttggcaaggctctgtatccccttgttaccaaaacaaggatgtttgcctttagtaactcattatgcttcatatctgcttcatgtggttttctgtatatacattgtataaatattgtttcatataacaatgttttaaaataccaaaatggcaaagttaaaaatatggcaagggtctaagacaaaagtgtgctccctcacctcctagtgtgaatcagctttgtgatatggtatctctttaaatctacaatcatccatagactgcctcagccgggcgcagtggctcacgcctataatcccagcactttgggaggccgaggcgggtggatcatgagatcaagagttcaagaccagcctggccaagatggtgaaaccccatctctactaaaaaaaaaaaaaagaaaaaaaaaatttaggcaggcatggtggtgggtgcctgtaatcccagctactcgggaggctgaggcagagaattgcttgaacccgggaagcagacgttgcagtgcgctgagatcgtgccattgcactccagcctgggcaatagagagagacactgtctcaaaaaaaaaaaaaaaagactgcctcatactaggaattcaagatgatgttccccagttaaatattttggtctaatttggcaattttataatggtccaaggaaagactaattataagaagtcaaatactaacaactcctgtgggaaataatgtctcctcctgtcttgttattctcgggatatacagaacctggaatgtataagttcatgcaagtgtccagtccaccctcatagggtaagagcttgttgcctatatatacaactctaaagacaacagattctctcgtctttccacgtgtcaacctctaagccagaatttccaaaatttcagtcattcaaaggtactaatggcaggtgctaatggttattacacacatatacacatatgcacacatgttctatgtcaaatgagctggaaaacagttcatggtgtattctacttgaagacccaagctctgagatctcagctataccttgcagtagaggacctgattaaatttgtttactctagcttttgcccaagtaagtttacatctagcatccgtctgtccttgaaactaggtttggaaaatgttgtaccaagtaatggctttgcttcacctctaaaaataatttaggaagaagcatatgatttcttccttccccagaactcttcagattccctagtaagtgggaaggtaagtaaggaggtaaataaggaagcttgtggctcctattgacctacttccaccccttggaagatccatttgcatttagtgcacacagaatttgtcatggtctcagaccagaaggtgaaactggtgtatgtcttccaggtcatatgtatgatttttatattgctcatagcacaacttgtcatttctctatgaaattctcaagaaactggttgaggaattttggagaccacagtaatcagggattctcaaactttaaagtaaaaagaatcaccttaagtccttaagtcctatttaaaacgtagattccaggagctgattcccaacaggctatgtaataatgtaataatgtttaagaaagcaatataaccatttattcgcaggattttatctatattgttagataggtctggggctcaggaatttgcttttttagctcaagtgatccttctgcctcagcttcatgagtagctgggactacaggcacacaccacagtgcctggctaatttttaaaaattttttgatagagatgaggtctcactatgttgcctaggctggtatcaaactcctggcttcaagtgattctcctgccctggcctctcaaagttctgggattatgggaatgagccaccatgcccagcctaaaaaaatattgcttaatactgatttagctgtttgtatccatcttgcctcctacttctgttaatgtgttagatgttggcaactaatatattctagtgcttgtataaactacatatgaaagcaagatccctttggtaaactagagtatgtcacgttctgataaacacatggaatgagggaagaaaagcattttctaataaataatagctatttttaactttgacaagataggcaaatgaaccaccattttctgaacatatgctgtccacaggcaatgtgctacccatataatctcattcaattcttctagtaacaccctgtaaatgattgctttcccattcagctgatgagaaaagtaaggacaaataaattacaaaggtcctttagatagtaagtagcatatggctgccttccaagttaatctggaggggtgattaacttttctgtccctatttcctaatcagcaaaataacacagctataaaattatctttggatatgttgatgaacatctagcatgattttctagagtccaaaatgtagctgcttctagtaaattgaatatctggataattttggactttcaaaataatttttcatgtttttacatattatgccatttatttttaaagtaatttaaactatttgcattttagtatttaactaagattaagataatatacctgccagcagaaaggttttcagtcaccaataattgaaaacccatgtatctataatatagctattaaatctgaatattttaaaacaaaaaaagggacgacagacatgtataatggtaatttttaaaaacaaattatggtctttggtgcatattagataaaagtaccttgttctcctatgtcatagttacctaagtacgtcaacatatttctttgatatccttcccagataaaagtggcttcttagacacggagataaagaatcagtttttttcaaggacattttattacatgacactgtgctaaacagaactactgattagacagatcatttgctaagtggaagaaactctctttcatttaattatccactcaatcacttatttactgttctcttcctcctttagaatttcagtattctcagtcctcagttaatctgggaattcacctatttttttttttcactcctctatatttcctttcatagaacttagcagatagaagtcccaaaggactaaagattctacttgtcctaatgtcttccccagggattcctgaagcaaatcaattccccatctataagatggaaaattagtatattcatggaggttatatatgttggtaaagaactgttctaaaagagtttcatgacccattgatagaaaactgaagtaaaaaaaaataagtagcacttattctggttagctataatgttgtaaaactttgaacaatgctaaagctaaaaagtctattagatgataaatgtagaaaacaaatataaaaaaatttaaatgtctttttaaggtggaaatcataaccattaaaaacacttgtttggaaaaaaaaaaaagagagagagagagagagcaagcaaagaaagaaagaaaaaaagaaagtagaggctctggcccagcagctagcccaggacctgtcatgaattaggtgggaataactgtaggatcgaacagaattcctaggtaatggcttgaattttattttcaaaaataggtactggaattcatttttcaaataataagtcttctattttttctcctaaaaaatgtgtgtatattggtgggacagggggagaggagagtttgctttctttatgataggaccaatgtcttatttatcttcagactctctccaccgtgctcccaacacatgatggttattcattcaacaaataatacagcccctaccaccttccaggtattatggcagaccagatgctaaagataaaacctagttctattactaccattacagccatttttaaagtaactacagtgcactagtacaaacttactctacagaaccaacattactgtttgatgcacactgaaaacacatcggatgtttttagttcattctctatgggctgtttgccaattgggccttggaccccaaaatctagtaatcagattatttggtgatatatccaatatgggacacagcaggaaaagcctcaataacaggactgaggccctatcactttccattcttcttcctctgctcaatcagatttcaaagcagcacaggtacggaaaaaaaagtttttaaaaagttggtgttattatcctagagaaaactgcaagctaattatgtccatcagtaccaagcttctttgaccctccctgcaagaagtaagtcaatacctacattttacatatttttcttctttcccactcccaattaagaaaacatacttaaagcaaaatcatgaaaaggaacaaacactttaattttctatacaagtccaatttttagatttaattatatgaacaacctacagtaattatattttttaattatgctaatttgtaataattacatttaagtctctttgctaaaacgttactgtgaaattacataactcatcatttcaaattgtttattaccatcaacggagtgtttatagttctctagtcaaaaaccattcaaaactactgtcactcgtaaattacctcacttttttatgctgagtctttcaaatgcagaaatgttcttaaaagcagaactttattatcaagttggacttaagtaaacgcctggaaatgcatggaggctgcaaaggggcattctgacaatttcattgcataaaaaccgcattattctaaggaaaagccttatcccaattattttttgaggctttatatggtaacatcatttttagtagagcacaataaaagacagtggatattggaaaatacttaatgaatagattatatttatttttaaaccatatatgtactaacttcccattttttcaaatatcttcccttaaattaatgctgaacaaataaataagtcccataaaatgttaaccagagagatgtgagggctgagtgaaagttttaaggtaatattgactatccattctagattcaattctttgatttaaaaattacttcgtcaatgtgtatacaaggacgtaagggcaaagctagtcatgttatccccattttatagctaagtaaactgagtctgagaaaaatttcagtaacttggcccagatagcatacctgggtatgtggaagctgacttcaaagttcttaactaaaccaagctattctggttcctatatgataacatggtaagaatttggaagggaaaaaaaaaaatcaagcagaggttttgatggtaataacgtgactagtaaaatcttaacagaaataaccaaattaaggagacttatactaagcagaccacttaagcaaaatgatgacatgatatcttcttaacttagtgaagctcaaaacaaacagatttttgatacatcaaatggattactcagagaagcatctgaatcacaccactagatccataacatggttggtaaaaataataaattctatattctggaggtcagcaaactggttttgtgtgtcctgaaagctaagaatatcttcacatgtttaaatggctaaaaagaaaaaagataattattcatgacatgtcaaaattataagaaattaaaattgtagtgtctataaactaagttttattggaacacagccgtactcattcatttgtgtacaatttattgctgcttttgtactacaacagcagagttgaactgtcaagacagagacaatctgatccataaagcataaaatatttaccatgtggccctttacaaaaaaagatttgctaacccctaatctaacacatacattaaattgaatccgttgttttcattacatggaattgaaaataaacagcatttcgctattttattgagaagaattactatgaatcaagaaactatgatgtcaaccatcaaatggaatgtacattgtttcattaaatttgccatattctgggtaagtagaaacttcctttagacaatttggattcaggctctgtttactataacaagctgtgtggaattattcctaggtcggccccagaactcttgcacaaagaacccaacttagaaggcagaaaggctaaaaacaaaaacaagcagcagcatgcagttttatatgccaatgccaagaaggagttaagatctaaagaaaagaggtttaacaaaacagagacttccatatagactgcaacatagctacaataaagaaagtggtttgagcgtgttactcctgcacatcattaaaatttcattctacacataatgtaaggtttgtttcctctagttaaactgttaagtcagtctgcaaagctcatctactagagatgcactcctaaccaaaacaaaaatgttagctaatttgcttctggcaagaaatgtgcctaggtcccaaggaatactcaagagctataaagttattcaaatgatactgcttttatcccacatctggaaaagccgataacagctaatttcacaaagccttacctcagaaaagttcatccacaatttgtaacaaaagatcaaaacattaaccctcatttagaagtcaatgaaaacaagtataagttttccctgtctcactcaagaaggcagacatgctctaagagggaaaaacagaaacacaatagcaatagacctggaggaaaaaaaaaatccatgggtaataatgaaatacaaaaaaaattcaaaatatattgcagcgaaacgttagacatcgacaaagctgatagagcataaatccatataaatttctacatcattataaagccacatccattattaccactaaactagcagtcactgatagaagaagttgtttccattttactgtcagaaagcagctccaactgaaatcattttgctaaagaattaaccaaattagcagaaagaaaagacaaggaagttctgctttctcgaaggttaatttaaaaaaaaattaaaagttttattgatacctaatagttgtacatatttaggagtacatgtgaaattttgatacaagcatacaatgttaattatcaaatgagggtaattaggatatccatcatctcaggtatttatcattttttgtgctaggaatattccaattccactgttttagttatgttgaaatatacaataaattattattaactacagtcaccttatcatgctactgaacattagatcttatcctttcttcctatttttttaaccactagccaactcttctttatctttccccacccccacccaccccttacccactatctttcccagcctcttctaaccattattctactctctatctccacgagatcaatttattttttagatttttttagctcccaaatatgagaacatgcaaaatttgtctttctgtgtctggcttatttcacttaacataatgtcttccagtgccatctgggttgttgcaaatgacaagatttcattcttttttatggctgaataatatccctgtgggtacatgtgcacattttctttatccattcatcagtggacatttacgttgattccatatcttggctattgtgaatagtgctgcaataaacctgaaagtacaggtagctcttaaatattatgatctcctttcttttggacatacagcagtggaattgctggatcatacagtagttctatttttagtttttggaggaacctccatactgttttccataatagctttgtgaatgtacattctcagttacactgtaggaagagttcccctttctccatgtcttcggcagcatccattattgcctgtcttttttgtaaaagtcatttttgtcaggcctctgagcccaagccaagccatcgcatcccctgtgacttgcacgtatatgcccagatggcctgaagtaactgaagaatcataaaagaagtgaatatgccctgccccaccttaactgatgacattccaccacaaaagaagtgtaaatggccgatccttgccttaaatgatggcattaccttgtgaaagtccttttcctggctcatcctggctcaaaaagcacccccactgaacaccttgcgacccccactcctgcccgccagagaacccccctttgactgtaattttcctttacctactcaaatcctataaaacggccccacccatatctcccttcgctaactctcttttcagactcagcccgcctgcacccaggtgaaataagcagccatgttgctcacacaaagcctgtttggtggtctcttcaaacggacgcacatgaaatttggtgctgtgactcggatggggggacctcccttgggagatcaatcccctgtcctcctgttctttgctccatgagaaagatccacctacaacctcaggtcctcagactgaccagcccaaggaacatctcaccaattttaaatcaggtaagcggcctcttcttattctcttctccaacctctctcatcactgtccctcaaccactttctcctttccactcttcaatctctcccttctcttaatttcaattcctttcattttctgggagagacaaaggcgacacgttttatccgtggacccaaaactctggcgccggtcacagactgggaaggcagccttcccttggtgtttaatcattgcagggacgcctctctgattattcacccacgtttcaaaggtgtcagaccacccagggatgcctgccttggtccttcacccttagtggcaagtcctgcttttctgggaaaggggcaagtaccccaatcccttctctccttgtctctaccccttctctgcttttctgcgggaggggcaagtacccctcaaccccttctccttcactcttagcggcaagtcctgcttttctagaggggcaattaccccaacctcgtatctctgcgccccaatcccttatttccatgccccaacctcttatatctctgcaccccaatcccttatttccatgccccgacctcttatctctgcgccccaatcccttatctctgtgccccaatcccttatttccgtgccccaaccccttatttctgtgccccgaccctttatttccgtgccctgaccccttatttccatgccccgaccccttatttctgcaccccatcccttatttctgtgccccatcccttatttccatgccccaacctcttatctctgcaccccaaccccttttcctacttttctggaaggtaagaacccccgaaccccttccctccatttctctactccctcttttctctaggcttgcttccttcactatgggcaaccttccaccctccattcctccttctactcccttggcctctgttctcaaaaacttaaaacctcttcaactcacacctgacctaaaacctaaatgccttattttcttctgcaatgccacttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacgtcagtcccttcctagtctctgtgcccagtgcaactcgtcccaaatcttccttctttccctcccgcctgtcccctcagtaccaaccccaagcatcactgagtctttctaatcttccttttctacagacccatctgacctctcccttcctccccaggctgctccttgccaggccgagctaggtcccaattcttcctcagcatctgctcctccaccctataatctttttatcacctcccctcctcacacctggtccagcttacagttttgttccctgactagccctccccatcctgcccagcaatttactcttaaaaaggtggctggagctaaaggcatagtcaaggttaatgctcctttttctttatcccaaatcagacagcatttaggcactttttcaacaaatataaaaatccagcccagctcatgacttgtttggcagcaaccctgagacgctttacagccctagaccctaaaaggtcaaaaggccgtcttattctcaaaatacattttattacccaatctgctcccgacattaaataaaactccaaaaattaaattccagccctcaaaccccacaacaggatttaattaacctcgccttcaaggtgaacaataatagaaaaaagttgcaattccttgcctccactgtgagacaaaccccagccacatctccagcacacaagaacttccaaacgcctgaactgcagcagccaggcattcctccagaacctcctcccacaggagcttgctacatgtgccagatatttggccactgggccaaggaatgcccgcagcccaggattcctcctaagccacgtcccatctgtgtgggaccccactgaaaatcggactgttcaactcacctggcagccactcccagagcccctggaactctggcccaaggctctctgtctgactccttcccagatcttctcggcttagcggctgaagactgacactgcccgatcgccttggaagccccctagaccatcacggacgccaagcttcgggtaactctcacaatggaaggtaagccccgtccccttcttaatcagtacagaggctacccactccacattaccttcttttcaagggcctgtttcccttgcctccataactgttgtgggtattgacagccaggcttctaaacctcttaaaactccccaactctggtgccaacttagacagtactcttttaagcactcctttttagttatccccacctgcccagttcccttattaggctgagacactttaactaaattatctgcttccctgactattcctggactacagctatatctcatcgccacccttcttcccaatccaaagcctcctttgcatcctcctcttgtatccccccaccttaattcacaagtataagatacctctactccctccttggcatgatcatgcaccccttaccatctcattaaaacctaatcacccttaccccactcaacgccaatatcccatcctgcagcatgctttaaaaagattaaagcctgttatcactagcctgctacagcatggcctttataaagcctataaactctccttacaattcccccattttacctgtcctaaaaccagacaagccttacaagttagttcaggatctgtgcctaatcaaccaaattgttttgcctatccaccctgtggtgccaaacccatatactctcctatcctcaatacctgcctctacaacccattattctgttctagatctcaaatatgctttctttactattcctttgcacccttaatcccagcctctcttcactttcacttggactgaccctgacagccaacaagctcagcaaattacctaggctgcactgccacaaagcttcacagatagcccccattacttcaatcaagcccaaatttcttcctcatctgttacctatcttggcataattctcataaaaacacacgtgctctccctgccaattgcatccgactgatctctcaaaccccagcaccttctacaaaacaacaactcctttccttcctaggcatggttagtgtggtcagaattcttacacaagagccaggaccacaccctgtagcctttctgtccaaacaacttgaccttactgttttttgttttttgtttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccgaccttactgttttagcctagccctcatgtctgcatgcagtggctgccactgcattaatacttttagaggccctcaaaatcacaaactatgctcaactcactctctacagttctcataacttccaaaatctattttcttcctcatacctgacgcatatactttctgcttcctggctccttcagctatactcactctttgttgagtctcccacaattactgttgttcctggcccagacttcaatccagcctcccacattattcctgataccacacctgacccccatgactgtatctctctgatccaccttacattcaccccatttccccaaatttgcttctttcctgttcctcaccctgatcatgcttgatttattgatggcggttccaccaggcctaatcaccacacaccagcaaaggcaggttatgctatatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcaaggatttgccccacccaggactggcaaattagctttactcaacatgccctgagtcaggtaactaaaataccttttaatctaggtagatactttcactggataggtagaggcctttcctacagggtctgagatggccaccgcagtcatttcttccgttctgtcagacataattccccagtttagccttcccacctcaatacagtctgataacaggtgagcctttattagtcaaatcagccaagcagtttttcaggctcttagtattctgtgaaacctttatatcccttaaggtcctccatcttcaagaaaagtagaatggactaaaggtcttttaaaaatacacctcaccaagctcagccaccaacttaaaaaggactggacaatacttttaccactttcccttctcagaattcaggcctgtcctcggaatgctacagggtacagcccatttaagctcctgtatagatgctcctttttattaggccccagtctcattccagacaccagaccaacttagactgtgccccaaaaaacttgtcatccctactatcttctgtctagtcatactcctattcaccgttctcaactactcatacacgccctgctcttgtttacactgccggtttacactgtttttccaagccatcacagctgatatctcctggtgctatccccaaactgccactcttaactcttgaagtaaataaataatctttgagggcaggactatgctgaatctccttaggcactctctaatcagatatcctgagtcgtcccaattcttagaccttttatacctgtttttctccttctgttattccatttaatttctcaattcatccaaaaccgtatccaggccatcaccaatcattctataagacaaatgtttcttctaatatccccacaatatcaccccttaccacaagacctcccttcagcttaatctctcccactctaggttcccacaccgcccctaatcctgcttgaagcaaccctgagaaacatcgcccattctctctccataccaccccccaaaaattttcgccaccccaacacttcaacactattttgttttatttttcttattaatataagaaggcagaaatgtcaggcctctgagcccaagccaagccatcgcatcccctgtgacttgcacgtatatgcccagatggcctgaagtaactgaagaatcataaaagaagtgaatatgccctgccccaccttaactgatgacattccaccacaaaaaaagtgtaaatggccgatccttgccttaagtgatgacattaccttgtgaaagtccttttcctggctcatcctggctcaaaaagcacccccactgaacaccttgcgacccccactcctgcccgccagagaacccccctttgactgtaattttcctttacctacccaaatcctataaaatggccccacccctatctcccttcgctgactctcttttcggactcaccccgcctgcacccaggtgaaataaacagccatgttgctcacacaaagcctgtttggtggtctcttcacatggacacgcatgaaaattttcactaggtgagatgatatctcattatagttttgatttgtatttctctgataattagtgatgttgaacattttttcatatacctctgggacatttgcatgtcttctttttgagaaaagtctattcagatcttttgtacattttaaatctgattatctgtaacagaattatagcaaggagtatactccaaaaaaattcaatctttatcattaaagaaacatctaatggtcatctcatagtaatttctcaattgcacaatgccattctattttagggggaaaaaatcttccttttgccttggtttccacctctatgaaatgtatagatccgagtctatctcctaaatgtaagatatttagtgcataatatgtatacagtgtttaacataagtgaatctctctcctgctcccctcccccttgtttactttaccccctgcccccagacaggtttactataagagtattggctatgaaatgcctctcatatgatttaatgtgcatagaagtctcttggagagcgtgcttataggcagattctaattcagtaggcttgggggtgggactagagaatcagaatttctaacaatctttagtaaagctgatcttgcctgtccgtagactttcagtagcaaggctctataattaactatgaatggagaacggatgcaattagaaggaatattttcattgcaagtaacagagacttcactgagagttaactcagaaaatttaagaaaatatatgacttggaatagacctaactccgaaaccaagtatctggaagtctctctcctccacttggcacctgttcacccttctcttctgcccagattcctcaccatctattccagtaggtaagcatcagactcaggggttgtgcaggagggtgttccttgtttttttaaaaaaaagctcactgggagttctactgtactgcctcagtagagagctccatttccacactccaatcttccaaccccagtaacttacacatgcaaaagacattggcttgtactttcccagtctcagactcaaaatatcattttgtccctttgatctgcagttaatggcttactctacatttcctaatcccttaaaaattatcacccaacatttaaaagaaataaagttgaaaaaaatatagataatacagtaaactgagtgtttgcttatatcatttgattctcacagcaatcacccaagataaatatttttatgattgcccatttcattgatgaaaagactaaaactgagggaggataaggatcttgtgcaaggtcacatggctagtaagagctaaggtccatctcaatataaggtccatgcttttaaccattaccgccaacacaactctcatataggcactggtgaatttgaactcataggcaatgtctaaaagtatttgttttcttgaagctctgccagcaacaaatattaaacttctggattcttgacaatctgatatctcattacagtttaatttttttgagaattaagtatattttcatatgataaagggccatttgtatttagttttcttttaactgtctgttcatatcctttgctctttatttagttattacatcttcctaattttttgaagttctttacaaataaatacttttagtcctttagctatgataggctgcatgttttttccaaaatttgtcagagtattttaatcctgcttatgaggttttctgccatgtcagtgtattaagattttttaattgtttctcagttttgaatcatatacaggagagtttcctccactcctaagtgcttgcatgattttattttttatatttagaagttacccggaatttggaatttgttctagtatatcatgtgaggaacacatctagttttatctttctccatatggctatctggttgttccaacactatttattaaaaagtccatctttttctcactgatctgactgagatgctatcattttcatatactaaatttttggccaaggaaacgaaaaaagtaacagagacattatccaatagccaaaaactaaaaacaatccacatgtctttcaaaggttgaataaagagttcaaggttgaaaaataaatagcaaaaatagctagaaaaagtgcagtaactggatgaggagggaggttgtctagccctaacagatattaaatgttataaagtctccacaattaaaaattgtggcaaagttacaaatatgtttactgttgattcagaaatcccatctgtagtatttcccaaaatacactttgtaaaatagaaaataacccaagcatgaggatatcatgccatcaattgtaaaagcaaataaactgtgattcatccattcaaggcaatgaggaaaagctctagatctctcatacagagtgatctcaaggaaaacaactaaatgaaaaagcatggtgcaaataatgtttcaatataataccttccttatgagtgggagggagagataaaattaaaatgggaaaaacaacaacaaaaaaaggattgccaaaagaagcaatagaaagattgaccaaaagtggttaatatgattacttacagaagcagagaaagaacaaggtaaaggaaacagggctgaaagatttttgtgaatatatcttattatatattgttttgactctgaaaacaaacatttttccttaatttttatctttacattctttaactttttttaattaaaatttttactgagataattgcagaataatatgcagttgtaagaaataacacaaagacattcaatgtcagcatgccccaatgttaatgttttgcaatactacagtataatattacaaccagtatattgactttgatacaatccatctaactaattcaagtttgcccacgtcccctccaggccagccaaggtcaagtgggagcgtagaattctgctctggagagaatttcaaaaggtgcctaacattaataccagggtggtgtaagaacgccaagtagcaagctacaactatggtgcacactgggtaacaagatcctaccacctcctgtgtccatggagacaacatggggagcttaacttcaggtcccatacagcaaggcagcacccttccatttccactgaagtggtgacagagtaggcctagtggagagtagcgactttcatcatcacccagtgggaataccatggcatctgtagataggagacaggcagaaatcccaccccaacccaggagtgataaagagccccatccccatgccaactagggctgagtgaggaacctgcacttctacctccatttggacttaagaaggcagtgttctcctttctcatggaaaatgctgctggagcagtatccaaaactaccagttaaaacacaaagtttaaacaacatcccaagtctcataacataatacaaaaatagctaggtttcagcagaaagtcacttatcataaccaaaaccaagaagatctcaaactaaatgaaaagagataatcaacagaaatgacagaaatgttagatttatctgacaaagattttaaggtggccataataaaaaataaacaatcataaatatgcttaaaataaatgaatataaaatagaaagcctcagcaaaggaaaagaacatctcagcaaggcaacagaatttatgaagaaaaaaaaataagaaattttagaaatgcagtatacaataatcaaaataaaaatgcattggttggactcagtggcagaatagatgggacaggggaaaagatcactgaaatggaaaacaggacagaagaaaatcccagcacattaaaacttgtggaacacagctaaaacattactgaaaggaaaatttgtagcattaaatgcatagattagaaaaaaaaatgtctacaataacctaatctctcacgttaagaacccagaaaaagaataaattcaaagcaagcaaaaggaaggaaataataaacataagaacgtaaatcaatgaaattaaaaataggaaaacaacaaaggaaaatcaaacaaaagctggatcttggggagaaaaacaactggtaaacctccagcaacagtaacaaaaaaagagacaataataagaagacacaaaacaccaatgtcaagaatgagatgggtgctatcactataaatcttatagccagtaaaatatgagagactactatgaacaacttgatgctcaaaaatatgacagcttacagaaaaatgtaccaattcctgaagaaacacaatcttctgcagatcactcaatataaaaatgatcatttcaatagccctctcactactaaggaaattgaaatttaaaattgtgatttaaaaatatccaaaaaagaaaatctccagccctagatggtttcaaagaaaattctagtaaatatttaaagaattagctataattggccaggtgtggtggctcacacatgtaatcccagcactttgggaggttgggagtttgcgaccagcctgaccaacatggagaaacactgtctctactaaaaataaaaaattagctgggcctggtggtgcacacatataatcccagctacttgggaggctgaggcaggagaatcgtttgaacctgggaggcggaggttctggtgagccaagatcgtgccattgcactccagcctgggcaacatgagcgaaattccatctcaaaaaaaaaaaagaaatgaaaagaaaaaagaattagctacaattctaaacaatttttccaggataaaaggtaggagagaatacttcctaactcattttatgaaggtggcattatcctgatatcaacatcagacaaaaacagtacaaaaaaaaaatacagacaagtatcactcatgtctataattgcaaaactccttaaaaaatatcaacaaaaagaattcagcaacacataaaaagaattctacactatggtgaagtggaatttatttcagcaaggcaggttcaatattcagtggtggtttgtgttgtttacattttctatgaccttgctgatttttgtctagtagttctatcaacactggcttgagaggggaatgcttaagtccctgccaataactgtggatgtctgattttcctttcagttctattaatgttcacttcattttgaggcactgttgtttgatacatatccatttaggatcatcatgtctctgtggtaggtttaccctgtcatcttatgttgcctctaataacttcttgtctagaactagtatctctaataattttattttctttgaagcctaaattatcaggtgttgatataaccatttctactattttttatcatttacatggtataattattctcttctactttcaacttacctgtcattgaatttgaagggagtttcctgtaagcaacatataatgggttccttttttttttatccactctatctctgttttttgtaagcttagaactttcatttttaagataattattgagatgttcatattaagtctgtgatgtgtgttttctacttgtttcctctggaaatctcactttcacttagttctctttgccttcatcactttaaaatatcattgtcttgagtattatatggcactacaatttttgtttcaataaatcaaatataatttataaaagtcacggagacaagtttagcctattgtatgtactcatatttaagttatctgttccttccttcttcctggttctctaagatttattctatgatttcctttctttttgaagaactttagccaacttttaagcaaaagtctgttagcaacaagttctttgccttctttcatctgagactgttttttccccttttactttcctggataatagctttactggatacaacacctgcagctgatagctctgttctagcacttgataatattctaagccatgggtcaagaaatgctaggtcagggtggacttctgttgagtctgggggaacagaatgtatcctaccactgtgctgtcccaagctgcctcaccttcttaccacattttagacttctcctttggttatctcttataccatcttttctggacctcatgtgtgcgaatgttttaaatcattttaaaagcattatatatttaaaagtttcatctctaaatgaacattctaaaatacaaaatcagataccaaaaatatgatgatgttattctgtttttccttaagaaggaacaggtccattattgtcagggtgtgctcagcctgaggtcagtaataatagaacctaggtattatcttcatcatcaaaaagcactgtcctccactctcaccaaccttctactcaccacattttaaagtaatatataaaatttatactactggcactaataaattcaaacatgccatatttttccttcaacattaggatgaagcagagaatccaaaaggattagaaatgctctccccttcacactttgaaggaaacatcgctggatcaatttagttcacaaatgtgttttacaaggagaaatgagtcttatatataggtaattataagaccaactcctcagattcctactcttgtgtgcaaaagccacactcaaatcaacttttatttatcctatggaaaaaaaggtaaatgttaaactaaatttaaactatcttttaaaatatatcgtgaaaaatgcatacaaaaagcttgtgacatagttcaacagttacacagtctacttcacttttaacttccagccatcagcttccatcatttcatgtattaagtgtgttttagaaccactgtaaaaatataatttgaaaggtgtcttttaagaaaacattcagaagtaaaaataaaacctctatgttataatatttatttttagaagtcttcattaattacaatatccttctatggtgccttaaagatggtgttgtatctcaaaagtcaccaatcaaataatttatttaagccaagctaattcaaaatagcaaatgggcagccacttttccaaacattgtgatgtccagtaagaagagcaagagagatgagatacctatttatgtataaaatgaggtgtactatataactattcattatgccttataccacaatatcatattaaaaaaaaaaacagtacaagtagggaccattatcactgtttcaaggagagaaaactttggacacagaaaggttaactggcttgcccaaggtgacacggcaagtaacaggcagaaccgctattcaaacccaggtagtctgtctccaaggtctctggatcttaaccaaacaccacaatgcagagagacttcagccctaggaaatcaccaaaggagtgcatgtctggctgcaagataaaaaggcaaaataaatgtcaaatctttaaaacaaggattctattttaagagaaataaggacaaaacaaatggcattccattcattgacactgcaacaaatacagcataaaatcagttaaatattcttattctgacactgctaaaaaaaaaaaatcaaaggatgcaaatctcactgatctcaaaaggtctgcaaagaagtgaaatactcctgaataacatgcaacaattttaaaataagcaaacagtagttatcaaaataaactaaaaggaaatttaattgctcccatatatagcgcattagcaaaggataatgaatatttttcaacaatttgcatatttcaatttgtaacaaatgcaaaaacattggatttcaatgctgaggcgtcttcaattttctatctcataggttattctgagaacaaacatgaaaagcaaaaagtctcatcataaagcaaacaatctgtggactgcaaaattaaaagaaggtttaagatagtttcaagtccaataacaaaatatctcttttagctattaaacgatctcattctatttaataaacagaatcacttaatgctttccatctgcaaatctctggtataaaaccatgaaactacaaataaagtacttataaaatgtcctcattataaaaaagcaatcagatctgtcaccactcagaacttaaaaacaaatagaaaaactagaggatttgagtggaaacaggaagaaaagtccaacatcagaatattgttttattaaatttaatggagaaattaaaatttaggggccctactattaggctactgaaagagaaagagaagtttagaagttgtgctagaagaagcactaccatgcaaaactcaatgacctacaagaaagtcagcctccttttccttctttctcttgaacataatcaactggggttattattattattcaactcctgtccttactgtaaaagggaaaccaagtccaacatcacaccatcaagaaaggtgtaagcaactagtcctataatacaccactatctcaagcaacaaaatgactgttcattactggtgctgtcatttgggtgttttcgctcaactggaaatgtaaccctatgtcatttgtaccataaaaaagaaaaacattctagtcttcaaaaaccatcagtatcttcaattatggaaattcccatcagaacttataatcacacttgtatttcaattggagacatgtaaataaaactcatttttaaagtaaaaggacctgaattatatccccaaatggggaagtacttcaataattcttcctggaggagggaaagaattgctgtttcacattaagtccctggaattcctgccaatagaatttcaaccgcctgaacctcacttctagctttccatctcagcacaggccaaagcctgtacttgtgaaaaattcatcactctcccaataaagcaattttgccaaaaactgtagatccctttttactctgagtgctgtaagaggggaccatacagaagaaaggcatacactgagatggctactgcagctccactctcaaatataacaatgaaagactggtttgtgataaattataatattcttgccatgctagaaaactaatgaaagtctgtctttaaaaagggaagcaccaatctagagagaaaaaaactatatttcaatactccaaagagaagagtggatgctgtcatcctggttatatgaatgcaacataaattatgctataatatactctcactttaggtgtatagttatggtttatgtacatgtatatatttcactctaaaaccattcaaaaatatctaatgattaccaattatgtatcaagcattgtcaagatacatggatgaaaaatcagttctgcccttaatgaaattctagtctcatggtgaacaaacatttaaataaatactgtaatcccctcaaaaccatcagcaggttactttctttaaagtattttggcaaaattacagttttcaagatcaaggtcttaggtaaaacagagaaaaaaaactggagatagacaaatacaaaaagtgtgtaaaaaaaaaaaaaacccacccatgtgtgcacacacacaatagtaagtaaaacttttaaaaagtgtgagcttagagacctggtcttctaagtgacccttttcttgtatcaactgtgcaagaaaaatgtggtgacattcaaaaagcctaagttaatcttacgcagccatctctgtccagcggtcatttggagatataagcgcatatttccctgggtctagtcttccatctgcattaaataatggtagaatacaactagacctcctctgcctgtgctaccagagacctaccagcatatctgtgggagtggatggcagtaatgttgtctggctttaccactgaaaggtaacaaaagtaaacatcacatatgttaaactgagcagatgttaaaatgctggttacaaatataaactgaagtaattcaaaaatgtgtctgacaaaactttaatagtggagaaatcacagtacaatatgggaactgccataagatagtaagatccatgcaagtatcacccaaattcccctttttctatgaaatgaagcaatttttatactgagaatgagagactgctggcttttttttaaaaaagacagcttaattataatgaaatagtgcatttctcttcacttttgtttcccttcccagattatgtgaatacatttctcgtctttaactgcagaacagcaatatggcattctaacatctatttcctatgaaaaattgtgagaaacaatcatctagggaggaaaaaagatagattcactatccatgcacaactactactaacatcttcatatttccttccagcctttgttctgtctgtaacatgtttgttttacctaattttgatcacatgagacactattttcatggcaacatgacaggtgattacagaattcaaaactttgtctaatctaatagatggaaatggtatttagttgtttgcgctgttttaagtactactaaaattgaccatttttcaccatattgttattgtaaatcaattcaagaaagaattaataaattgatatgtaccatgctttatttatttattttattttatttttgagatggagtctcgctctgttgcccgggctggagtacagtggcacaatctcagctcactgcaacctttgcctcccgggttcgagcaattctcttgcctcagccctcagcctcccaagtagcttggattacaagtgcccccgtcctcccaccacacccagctttgtttttttttgtttgtttgttttgttttgtttttttgtaattttagtagagatggggtttcaccatgttggccaggctggtctcgaactcctgacctcaagtgatctgcccacctcggcctccgaaagtgctggggttacagacatgagccaccacgcctggcctttatgtttaaatactaaggctgaagaaagagaagtggttaagtaacaaaatattcttaaaaggtaaaagataagagtatatttctacttctcaatgttcaacatgtacccaaagacggcacccttaaaaaattcacctcaatagcattaaagaagttttttaaagcacagtttaaattaacaataaaagtctttgattaattggaacatgacataacaattgctataagaattcaaaaaatatatatcagattggggtgccctggaaaggttttagatgagaaacagatttgagctggttcttaagcaagcctgcagcctgggtggaaaaaaagacggacatacagaaaccagagaacaacttaaaaaacaggtttggttaaagtaaacttataaactgttcaggaaggtgtgccctttaagttaacaagcaagacagacctggaagagtggagatgacagctaacatgatggtagaaggtaatatggtagaaagtaagaaaatagcaaacttcaatggaaaataactaaaattcaaagcctaacctttgggaaattaccctaaatacagagttgaagaaatctgaaatgctaaataagaaaaagaagagccaggcagttccaagatggctgaataggaacagctccagtctacagctcccagcgtgagcgacacgggtaatttctgcatttccaactgaggtaccgggttcatctcactgaggtgtgtcaaacagtgggtgcaggacagcgggtgcagcccactgagcgagatccgaagcagggtgaggcaatgcctcacccggggagcacaaggggtaagggaattccctttcctagccaaggaaagccgtgacagacagcacctggaaaactgggtcactcccaccctaatactgcacttttccaagggtcttagcaaacagcataccaggagattatatacggcgcctggcttggagggtcccacacccacggagccttgctcactgctagcacagcagtctgagatcaaactgcaaggcggcagcgaggctgggggaggggcacctgccatcgctgaggctcgagtaggtaaacaaagcagcctggaagctcgaactgggtggagcccaccgcagctcaaggaggcctgcctgcctctgtagactccacctctgggggcagggcatagctgaacaaaggcagcagaaacctctgcacatttaaatgtccctgtctgacagctttgaagtgagtagtgtttctcccagcacagagtttgagaactgagaacggacagactgcctcctcaagtgggtccctgacgcccgagtagcctaatggggaggcaccccccaggagggacagacagacacctcacatgtttgggtacccctctgagacaaagcttccagaggaatgatcaggcagcaacatttgctgttcagcaatattcgatgttctgcagcctctgctgctgatacccaggcaaaatgggtctggagtagaccttccacaaactccaacagacctgcagctgaaggtcctgactgttagaaggaaaactaacaaacagaaaggacatccacaccaaaaccccacctgtacatcaccatcatcaaagaccaaaggtagataaaaccacaaagatggggaaaaagcagagcagaaaagctgaaaattctaaaaatcagagcacctctccccctccaaaggaacgcagctcctcgccagcaatggaacaaagctggatggagaatgactttgacgagttgagagaagaaggcttcagataatcaaacttctctgagctaaaggcagaagttcgaacccaacgcaaagaagctaaaaaccttgaaaaaagattagacgaacggataactagaatacccagtgtagagaagtccttaaatgacctgatggaactgaaaaccatggcatgagaactacgtgatgaatgtacaagcttcagtagccgattcaatcaactggaagaaagggtatcagtgatggaagatcaaataaatgaaatgaagtgagaagtttagagaaaaaagggtaaaaataaatgaacaaagcctccaagaaatatgggactatatgaaaagaccaaacctatgtctgattggtgcacctgaaagtgacggggagaatggaaccaagttggaaaacactctgaaggatattatccgggagaacttccccaatctagcaaggcaggccaacattcaaactcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcacatcagactaacagtggatctctcagcagaaactctacaagccagaagagagtgggggccaatattcaacattcttaaagaaaacaattttcaacccagaatttcatatgcagccaaactaagcttcataagtgaaggagaaataaaatcctttacagacaagcaaatgataagagattttgtcaccaccaggcctgccctaaaagagctcctgaaggaagcactaaacatggaaaggaacaaacagcaccagccactgcaaaaacatgccaaattgtaaagaccaccgaggctgggaagaaactgcatcaactaacaagcaaaatagccagctaacatcataatgacaggatcaaattcacacataacaatattaaccttaaatgtaaatgggctaaatcctccaattaaatgacacagactggcaaattggattaagagtcaagacccatcagtgtgctgtcttcaggagacacatctcacgtgcagagacacacataggctcaaaataaagggatggaggaagatctaccaagcaaatggaacaaaaaaaggaaggggttgcaatcctagtctctgataaaacagactttaaaccaacaaagatcaaaagagacaaagaaggccattacataatggtaaagggatcaattcaacaagaagagctaactatcttaaatatatatgcacccaatacaggagcacccagattcataaagcaaggccttagagatctacagagagacttagactctcacacaataataatgggagactttaacaccccactgtcaacattagacagatcaacgagacagaaagttaacaaggatatccaggaattgaactcagctctgcaccaagcggacctaatagacatctacagaacgctccaccccaaatcaacagaatatacattcttctcagcaccatatcttgcttattccaaaattgaccacacagttggaagtaaagcactcctcagcaaatgtaaaagaacataaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaatatagatgttctttgaaaccaatgaaaacaaagacacaacacaccagaatctctgggacacatttaaagcagtgggtagagggaaatttatagcactaaatgcccacaagagaaagcaggaaagatctaaaattgaaaccctaacatcacaattaaaagaactagagaagcaagagcaaacacattcaaaagctagcagaaggcaagaaataactaagatcagagcacaactgaaggcgacagagacacaaaaaacccttccaaaaatcagtgaatccaggaactggttttttgaagagatcaacaaaattgatagaccactagcaagactaataaagaagaaaagagagaagaatcaaatagacgcaataaaaaatgataaagaggatatcaccaccgatcccacagaaatacaaactaccatcagagaatactataaacacctctatgcaaataaactagaaaatctacaagaaatggataaattcctggacacatacactctcccaacaataaaccaggaagaagttgaatccctgaatagaccaataacaggctctgaaattgaggcaataattaatagcctaccaaccaataaaagtccagcaccacagggattcacagctgaattctaacagaggtacaaggaggagctggtaccattccttctgaaactattccaatcaacagaaaaagagggaatcctccctaactcattttatgaggccagcatcatcctgataccaaagcctggcagagacacaacaaaaaaagagaattttagacgaatatgcctgatgaatattgatgcaaaaatcctcaataaaatactggcaaactgaatccagcagcacatcaaaaagcttatccaccatgatcaagtgggcttcatccctgggatgcaaggctggttcaacatatacaaatcaataaatgtaatccagcatataaacagaaccaaagacaaaaaccacatgattatctcaacagatgcagaaaaggcctttgacaaaattcaacagcccttcatgctaaaaactctcaataaattcggcattgatgggacatatctcaaaataataagagctatttatgacaaacccacagccaatattatactgaatgggcaaaaactggaagaattccctttgaaaactggcacaaacagggatgccctctctcaccattcctattcaacatagtgttggaagttctggccagggcaattaggcaggaggaagaaagaaagggtactcaattaggaaaagggaagtcaaattgtccctgtttgcagatgacatgattgtatatccagaaaaccccattgtctcagccccaaatctccttaagctgataagcaacttcagcaaagtctcaggatacaaaatcaatgtgcaaaaatcacaagcattcttataaaccaataacagacaaacagagagtcaaatcatgagtgaactcccattcacaattgcttcaaagagaataaaatacctaggaatccaacttacaagggatatgaaggacctcttcaaggagaactacaaaccactgctcaacgaaataaaagagaacacaaacaaatggaagaaaattccatgctcatggataggaagaatcaatatcgtgaaaacggtcatactgcccaaggtaatttatagattcaatgccctccccatcaagttaccaaagactttcttcacagaattggaaaaaactactttaaagttcatatggaaccaaaaaagagcctgtattgccaagacaatcctaagccaaaagaacaaagctggaggcatcatgctacctcacttcaaaccatactacaaggctacagtcaccaaaacagcacggtgctggtaccaaaacagagatatagaccaatggaacagaacagagccctcagaaataataccacacatctataaccatctgatctttgagaaacctgacaaaaacaagaaatggggaaaggattccctatttaataaatggtgctgggaaaactggctagccttatgtagacagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaactaaactaaagaacttctgcacagcaaaagaaactaccatcagagtgaacagacaacctacagaatgggagaacatttttgcaatctactcatctgacaaagggctaatatccagaatctacaaagaactcaaacaaatttacaggaaaaaaacaaacaaccccatcaaaaagtgggcaaaggatatgaacagacacttctcaaaagaagacatttatgcagccaacagacacatgagaaaatgctcatcaccactggtcatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactggttcaaccattgtggaagacagtgtggcaattcctcaaggatctaaaactagaaataccatttgacccagccatcccattactgggtgtatacccaaaggattataaatcatacctctataaagagacatgcacacatatgtttattgcggcactattcacaatagcaaagacttggaaccaacccaaatgtccatcaatgatagactggattaagaaaatgaggcacatatacaccatggaatactatgcagccaaaaaaaggatgagttcatgtcctttgtagggacatggatgaagctggaaaccatcgttctgagcaaactatcacaaggacagaaaaccaaataccgcatgttctcactcataggtgggaattgaacagtgagaacacttggacacaggaaggggaacatcacacaccagggcctgttgtggggtggggggaggaggaagggatagcattaggagatatacctaatgtaaatgatgagttaatgggtgcagcacaccaacatggcacatgtatacatatgtaacaaacctgcacgttttgcacatgtaccctagaacttaaagtataatttaaaaaaagaaaaaaaatgcacacaaacatgaaatcagaatgtagactcacatatatcctttcaaaatctcattaaataaattgtgaattattttttaattaaacactttctatttttaaatgcaaaaaaaaaaaaaaagaaaagccatcaaatcagcaagaaaaaacttagggtaggccgaattaccaaaatgtagccaggagaggcaggcatggtggtatgcacctgtagtcccaggtactccagaggctgaggcaggaagatatcctgagcccagaaacttgagactagtctgagtaacacaaggagatgctgtctcaaaaaagaagcccactatcaccattaatattctttaaaaatttttgaatgtgatatgaaacagagtaatactatattttgcagaaataataaatatctacagaaaatttattaacaatgtttagtaaagaagccatgtacataataaaaaattgcagtctcttatactaacaactaggtaaaaattaacacaagaagaaagcccataagaacaacaaaagttataaaatgcttaaactgagcaagagtttatgtaacaaaactgttttacaatactgtaatttaacaaattgatcaatataagaaatcactcaaataaatggaggaagaacatgtttccttatgaaataggtaaatatggcaaaaatgtcaattcctttttagttaatgcctatatttcttggaatattagtcaaactatcaaatttgttgacaaaataaatcaaaacttaatctcaaagaatatgttgtcaaataccctaaaaaagaaacatggaagagacaaggcattgttgcctttcttgacatacttattacaaagtaccaatcattaaaaccctagtgtattatcacgaatttagaaaaggaaattgatgtaaaaagtaggagccccagaaaaaaaactaattatatggagtttaacatatgctaaattagatatcaccaagccaaaagattgggaagaattacttgaaaaataattagggatcaccataggatactttcaacttaaacctataccttactgtataaaatatgctatagtagtgataaattttaaaaccaacttatcaaagtagagacagaaatgaaaactgagcatttcttaggtttctgtaaagatactaattttcctcaagctttgccgcaagagtaggagaaaacacaaagctgaaaaagagaagatccaaagatctgaatatgcaaaaaatgtagaaaatctccacacaccattaaataactaaagaaaacgaagagttgccttaaattttcagctgttctttataaaaccattctaagaaggaagaactgaagaccatcagcctgagtcaatacaataaaagtttagtactgtattttttttaccctaactcctattagaggtagtatccagaattttccactctaaggaaagttccagcgtgaccactcaataggaaagagatgggatactcaaaatgggataacatggagggtttctttacagaaggatgatttacaaggtgtgggtgaagagaaaccattagggatgggaagcaggcctgggttagcagcagctgagttgttacctcctaggctggaaaaggagagatgaggagcagctcctgaaaccccaggaatagtcacacatgtggttgctttatggggagcatgagctttggctcaggaacacggcccacttcagatgcccctgcaagggaagagccaggggaatgaacattttgacttctctttcctccctctgcttctgtcaggctctccatggaccaaactcgactacagccatccacaggggaaagcctctagagcagaaagcaggacggaggagggtggaaaatgggtctagaaaagcaaatgaaaaaaatctggtacaatgggataagctcattgtgtgtccatcctcatgaacgctttctgcccaatttctggtttgcagctgtgttcttgccagtttcaaccctgccctgaaatccagtaacaggaccttgataatctgatgccttctcctatttcctctttaaccaccacaaagactttgatgcttaatatcaaaaaccaaaaattcaagaacaatccaagtgaccaacaatatgataatacagaaatgatcattaagctactataaaggccaatgtagaaaatgcttacagtattgtataagaaaaacaaatgtcatatttttattatgttagagttataagcatgtgaacaatatatgggttgaataaaaaatagaaagttgatagtaaaaattggtatattttaatatatactagaaatacaaagataattatgccacaaaatatagctagaaggtgtaaaggagggaggaagaagacaagaaaggaaaagaaaacccttgcctacactatccactaagggcccaagcaatgcttaggttgaggacaacatgattttgctctaaggaaaattaaaggaaataagctagggagccttcaaagcctttcagtgaccacaatactaggaaaatgtttttaagaaggaactataatgagggcagaaatcaaaacaaactatcatatttgaatgtggaagaagacacaagggaaaaaatgctttaatctcatataattaaagtacttaagagattgtgttgatttttcagaattagcttaggataccgaagctggaaaaacaaaagccttcattaaaaggagcaatgctttctgtgaataccagataactctcatttttgaatgaatgctagacaaaagcatgtactcaatcacacatcataagagttgcttttttttttggctttcctaatgtaatcacatagtagatgaaatttctcctcaacaatatataaggatggagatagaaagctacaggacttaattacacttatatctgccacagtggaaaaaaggtatcaaaacagcatcaaaatgataagtttaggacgactgactgaccaactactttgacctatggggtgtcactgtctgtcaaaaagctataaccagcttttggcatgaggggatatttgaaacaaatagtgagatcacaacttaagatatactagtacttaatgataatggacggtaaccccagcacagcaaacaatgcatgtgtgagttctcaaacaatgagtccagttctttaggaagctatgacattatatgccagattgtgacatttgacaaaagaaaggtaatttcaccataaaactgagcagtctgacaagagagactggggaatgcttgacttgaaattgcacactgatgagaacacaagagctagaaaaaaggagagctgactaatgaagagatggtaaagagggccatgggtctagcagcagatctgaaatgggcagatgagtctacatgatgaaatggcaggcaagggtcaacaggaggcaaaagtgtaaagtgaagaaaggatccaggtgaggaccagcatgcttagaaggcattatgagcagagaggcccaacaaaaagggaagcaaagaattcgagatgagtacctattgaggctgaaaggaaactgggataaccagcagagacaggatcatagacgagttagttaggaatccagtttccaggcaactgggcaccaaggtgagcacaggaccaaacacaagccccagccacagtgagtctgtagccttctgcttccagaagctcctcacacggccccactagggacaggacgagcctcacctggaggtgagactgaagttacaggttggggttaactgttacaaggcaagaggcaaagaactaggggaacaggaacacaatccagatgtaactaagttggatttcacatttgtatgaaactttatcctttaaaattagtggtaatcacgccctttcatagttttaaagttaaaaaaacatcccgcttgcccttgactccaaatgagatactcaatgttatgttaaaaatcaggattctttgttcactactacaactctcatttccaggagatgaatcacctaaacgacatatcttttcaatcactttttataagagtttccttctcaaagaacatctataatattcaaactgtgagaggaattaaaaatatcatgggatatcctgttttatcacattaatgcacaggaaatattttagaagactggcactcaaatattagcacagaaaacaatattgcttaactaaatagaaaagtctttttaaaaatacatctatagtaatgtatcctaagttacatagtttatgctcaggggctcaggtataatgtatacaatcaagagtttatccaaagtcacatcagataaaggacaggaaatccaggaagtctgatgtgattaaaaaggtcaggcaaatatttaagtttcagagacaaagtgagtggggaggattcacataaggctgaagagattgagcaaaccttggatgtaaagatagacatgtggcttaaaacaacatcaaaatgaaaaaaggtaaaaaaaaaaaatcattttattctaaggctccttttttgcatttttccccctagtttttaatcatcctataagcttatagtacaggcaagatcaagatgcttttgagagacttaaaacttcaaataaggcttcctagtcactattccctgctgataagccaaataaataacctacattctctatcacaaatcccagaaatgagggagaagaggggatactgtcatcagtcagaagcaggataataaacataaaagatctgaagtaataaatacttttctctcatgtccagtaagtggtggctcagcaaattgcccccacccatctttgggcccaggtttgtgtgtgctaagatgtgacccctgaagaagggacccaggacttattctaagagcaacctcacacaaagcagcttcttgcctagcatgagatggtctcaaaagaaaatgggtaaaggtttgatgtcagataaaaaacaaccacaagcgtggcactgccagcaacacaaagccagagttggatgctctcaggaagaaatcttccaaaaatgatggcaatgaaaactggaaaacatccacacaagagagttaattttaaactcttgccaaccccggagtatgaaaatgccatatggcatcagtctttcttgagtggcactgccctttctccattctcctcgctacatcccctcaggagtcacacaccaggccagcaagcttgggttgaaaagccctccacatcaactatcccactgcaggcttccagcctagagcaggttcacatgcacaggggagagtcttcaactttaaatgcagtttgggcttttaactatgacatagcacaggacatgaattattgaaatagtcttttgggggctacaagcaacaggaaaacttgataaattgtccatgttattacccaagcaaagttatggcaccaatctgagattccatccaaaggggaaggttggtcaaaaagtactaaaagggatagagagggaaacacaaaatagcgttatgattgctcgccaacacggtggtccctcattcaacacaatggttaaaatcacatcaaagaggaaaactgaagcatctatgtattctaaaaattaaggagtaagaaaatatgatgagttctggctgtttatctgtaagatttcacagttaaaattctaaaacatttattgtaatgcagggtactaaatggcaaacattgcatcttacatattccatttagccatattaaaattaaagtgctaaggatgttcaaatattaagtgataaaggtattacaaaatctagtaagcaaggtttattcatctctactccaaggaataaaaagatataaaactgatttaacaacccagtgcaagaaaaatagctgtaaagattgtacactaaattgcaaactaaagcaaaaggtataaatctctgatataacaagaaaatcactgtaaatactttacaaattttgcaagtttttatgagtgtgctttgtacatttcaaaagtaaactttaggctgaatttggttagctacaaaagtggtgttacacaggcaaactaaagccaagaatgaggtatttgaaatgccacctcagattatttaattgaactatatatttatattcagattcagcattaaaattaatatacagataaaggaattgcaatattagttataaagcagaagactatgttgtggcaactctttaaatataggagccaataattttaaggaagaggctgcccagttatttacatctcgataaggagcaaggaagagtgaataggctgagcacacaaaaatgaggtcccaggaaacaaaacacaaaagtactaaagctgattaagtggtaaggacaataacagctctctttcacttcctgagatgatcttcaagctggcaccactcccttatagaagtatgccatgctgtgcatgaccctgcagcaaatctctaccaaaagtttcttagtatggccagtagccaaagctggagtgcttattaaaatgcagattcctaggcctcataccaaacctactgacccagtatgcccggcagcagatccaggaacatgcattttaaaggactccactggtgactttacacatgttagagtttgaaagccactgctctaatcacctcaattgtctcccttctccattattcttcacattcatacctttttttttcttttttgaaatggagtcttgctgtgttgtccaggctggagtgcagtggcgcaatctcagctcactgcaacctccgcctcctgggttcaagcaattctcctatcttggcctctcaagtagctgggactacaggctcatgccaccatacccagctaacttttgtatttttactagagacagggttttgccatgttggccaggctggtctagaactcctgagctcaagcaatcctccctcctccgcctcccagagtgctaggattacaggtgtgagccaccgtgcccagccggtattcatctcttctaatctagctcaacactcaactcctgttagaaatctgtgattaaactcctttcaactctgatgagtcttttactttcttcaataattatgtgttcagctctgtgtctttggccattttattgtattgttctcataccattagtttgttatataaaaatggccaaaacatacaaagcctttgctgtagctacttagatttttttttttcttgtcatcattaacaacagttctatgggaaagatactaagcttatggcgtgggaaaacttagattttccaaagtaaatttgccttagctcacatttctagaacattgtgaagattcagtgcaaacccacatagtcttactggttactgctccgaactcatacttacttagattttaatctccttaatgcaaattgtttcacatatggaaaggaacaaaaaatacaataggagtagctgtggttagaatggttgatagcatgtattaaagtacttgttaaacaaatgtggttgaaagcaatacggtagcaaagccagtaaaacatcatcctatatgaaaacagcaataataggtgggaacaaaagaaaactaatcttctagagcaactgcatggtgatttgccaggacagaaggtttgaacctgatctcattagaacactcaactctttgcctatggctaagtttcatcatcatatgcaatattttgcctatagctaatgtcttaatcttattagaatactcaacattttgcctttagctaaggtcttgtagttttaggaatgtctctgataaaagcaatgctcttactctcaagcctagcaaccagcataactaagagaggagtacccagtaaggcagtgttgcaggaagacaaacccttcctctgcgacagagcccacagaggtcactgctggaacaatggggaaaggagaaactgaatctctcctcaatttcaaaggaaagattcaagaggaaatagggccctccttaaattggcaaacacttgcacagcctcctagggaagagcccatttatctacaggctaccatggccaggtctaggctgaacgttctcacagtagaggagccaggacccccaaaggctctaaaatattcaagatcagatgctatcagtatctgtccctggttggtgaaaaataaagaacttttataaagctaaaaaggatcagatactagaaagaggcaaaactgcgattcaaacatatgccacagcctcaaatgcctgttttttccccattatactgtgtttcattctctcattcagaggttacttcaggttaaaataagtatttccatgttaatggactgtattagtatcttgcatctgtgtgtaaaatgccatgacgtctctgactttttccccaagagtttcagacacctaagtaaccggcagcttcaagcaactcacataaaataaggaagatgggaaagggagaggaactacatctaggaacctggggatttacacagaaaagctatctttctgaagactttactaagaaaaaaaatgctcctgaagtattttggaacagcttttcatattctattaagagttttcatgcaaaggcatgaaaccagctttccaaagtcccaggcaggttaatgaacaattactaaacctttcaatcttctgattctaaagtttccatttgaagactaagggcaaaattcaacctaaacttagtctccttactaaactatacacggacaactcagaaatttgcatttatatcaaagattagcttaattaagcatgttggttgcccactatttttcataaacacaaacctgactgatgtttatcaaaaaattttaagctttgtttacaaagaacgttggaacattctgaagctctcctcaatctgtaaaatatctggaggaaactattttttcacttatatttaatttgcttagtcaaaaatcaccaaaaaacattttaatttgcattttaccaagcctcttttaaaatattcttagggcatagaagaattctgaaagcttggttatttgtactcaggacatcagaaatgccactgccatagatttccaaggacgtttccttggtaaagtcacaaagttcataaactatggagcttctcagtctctgcggtccccagctgtccgcaacatctttatcacctattcacactttccaagcaaagtgaaaacagagtctgtgcgttaaggaatgttgatttaacaaattgttattaagcatttatatgtttactactgtagccagctgctatggctgctataaaagaggcatttgattgggtctttgcattcaaggagctttcaatttaaaaagccaatactatttctcagtagaagctccaacaatggccagtaaaaactgtccccaagccagcccccagccctctccctttacatcatccctcagcaccatcaactatgatgagtttcccactatggtgtttccttctgggcagatctcaagccaggcctcagctttggccccagcccctgccccaaccatggcatcagctctggcccaggccccagctcctggcccagtactagccccaggctttcctcaagctatgggcccacctgcccccaagcctgcctaggctggggaaggaacagaaggccctgctgcatctgcagtttgatgatgaagacctgggggccttgcttggcaacagcacagacccagctgtgttcacagacctggcatccatcaacaactccgagttttagcaactgctgaacagggcgtatctgtggcttcccacacaactaagcccatgctgatagagtaccctgaggctataactcgccaagtgacagggacccagaggccccctgacccagctcctgctccactgggggccccaggactccccagcagcctcctttcaggggatgaagacttctcctccaatgcagacatggacttctcagccctgctgtgtcagatcaccacctaggggggtgacaccttccctccccagagcactgggttgcagtggattgaatccctcccaaagcacttatggattcttctgaggtgtgctccaactgcctccagctttggagatgtcttccttgtggcaggggggcggggagcacattttattcttttattggcaatatctgtatctctccctctttttggaggtgcttaagcagaagtattaacttgtctggaaagaagggagctggggaaactcaaactctttcttcccctatcctgatggtcagctcccttctctgtagggaactctgggggtcccccatccccatcctccagcttctagtactctcctagagagaagagcaggctggagctaaggccttttagtccacaaagccttattatcaagtgtcttccatcatggattcattacaccttgatcaaaataatgccccagttaccagctcctctatggcactggcattgtccctgtggctaacaccagcatttaaggggctggccctcctgctttgcaacccagtttagtagatgttctctgttcaccctagcaatattcttaccctgcccagcatatggcagctggtaagcactggccaagtatctctctactcccactaagaccagctaagttgtatgcctacaatgagatagttgtgtctcccaactcacatatgtcacttatcactgtaatgagttataattactaatatttcaatatcatgtgcattcatttgggttgccaagaagcaaacactacacaaaattaaacatgcaaaagacatcttgcagtagggaacaggagaaggcagggagcactctcagaacaaggtgcaggtgtgatgtctacagaaggaaagagggaagatatgagaattggactacagtgcagtccccagggatgttcaactgggccactgaggagtccttgagcttaaagtcactcaatagaggacaggaatgggtctagctgtcccttctgtgcccaatcactggctcaggaaagtccacagaaaccatggcctcagagtgaaggtggactcagaggagcagcagttcagctatcaattatgcttcccacagcaggaagcctgaggggtgcattcttccttgttgcagcatgtaaaccagtactaaaaataatagctaagacttaatgaacctgtattagtctgctctcatgctgctaataaagacatacccaagactgggtaatttatcagtaagaagaggtttgatgaactcacagttccatgtggctggggaggccacacaatcatggcggaagaggaagaaagagcaaagggacaacttatatggcaacagtcaagagagtgtgtgcagggaaactcctctttataaaaccatcagatctcatgagacttattcactatcatgagaacagcatgggaaagacccaaccccgtgattcaattacctcccactagatccctcccacaacacatgggaattatgggagctacaactcaagatgagatttgggtgggaacacagccaagccatatcagagcccttactgtatagactatttaaagcatctttcatgcatcaatgtaatactcatagccacacagacatgggtactattatcacccctatatacaaaccaggaaactgaggcataagccatggtcaaacagctagtaagcggcagaactgtaatttgaatccagaagtctttactgactcaaaaatttaagtgaaaaagtttttttctattaaaaatgaagttaaacattttggaaagactcactaaaagcaagctgataaattattgctgtcacattaaatataattaacacaactgaaaaagattaggggaatgaaatcttaagaatctaggaaggactctacctaggagatctaggaactcattcaatggtacctgaattcaactgttcattcaactacaacatgtgctagacattgttctatgaacaaaactgacaggagaatttttaaaaatctctgccctcatgcagcttacatttatgtgtgtcaagggggaagataatgaatgtgttgtatagtatattaagaggtaattagtgcaaaacagggaaggaaagtagaaagcttacagatgggtagaagtgtatgtgggtggggcagggtgtggtagcaactttaaatagggaggccagggaaagcctcattgagttaatggttgagcaaaggcaaaggaggtgagggagagatgcctggggaaggaactttcaggtacagagaacagtaagaatgaaggcaaaggtaggaacatgctggcagttccacgaacagcaaagaggcaagttttagctggagcagagagagcaagggggagaggtgggaggacagatcatgtagggtctggtgtgccactataaacacttacgcttttactgggagtgagatggaacccactggaggtcatgaacagagaagcaatccgacttctgttataacggaatccctctgactacatatagagaacagataagggttggggatggtaaggatggaagcagaaaaacaaatttaggaggctactgcagaatcctacatgcagactgctttgcaatctccacttcgaaaatccaccataaaaaaatctaaaatgttaatgatagaaagtgcattagggaagtgacttgcattaggaaaataatgcatgactataatcataggaaccacagttaaggaaaaggccttggcctcagtgccagtcctctgtttggtctcccatctattctcctccctcctatttcacatgactgaaccctataaactacagtcctagacagctggcttctgatgtcaatagacaaatgagatactagcaggagatcagataaacgaggaagaaaaaggtcagggtatttctccccctgcctcctctactccatgtggcatttgcagagtggccacatcctccattattccagccccctgtggggtacaccctccatggttccaattacccctgggtggcccagatcccgggttctgctctcaccaagcagctcctgtgctgtagctgagttcgcaccaggcagctcccttgttggctctgataacaactcctccctttgttgctttagcccaaagggtggtaatggctacctgcagttggtaacctctggaatatataacagatccctatttgttcttttagctttttcaatacctttgtaattagctccctataccaaatccccctattgaaccacttggtgatgttttgtttttctgactagatcctgactaatatacccttacatcaagagtcacaaatgaatgtacatgtatgtaactgtttaaatcttgaagatatgcatacattgttctgtatgatccataatattcatatcaaatccttcccaggggaattaggctggaggagtgacaggagagatggaagaagagaggggaagcaggagcgaaaagcggatgtggggaagggagcaggagaaaaggtagaggggcatgtagtacatgccaaagcttcagcgctttgcaagcattctcttacttggcgcccaaggcaaagtcccagaagctccttctactgtggggaggagtccctgatagaaaacgccagccctgtccttccttcaaagagcctacagcaattcgttaacaccaacagactccaggccatagtaactgctggagcgatgtcctcggagctgccagaaatgaaggtcttagctgggcgtggtggctcatgcctacattctcagcattttgggaggctgaggcgggtggataacttgaggccaggagtttgacaccagcctaggtaacgtggcgaaacctggtctccacaaaaaatacaaaaattggccaagagtggtgggtgactcgtgcctgtagtcccagcttcccagctacttgggaagcaagatggaagaatcacttgagccctggaggttgaggctgtagtgagccatgatcatgccgctgcgctccagcctgggtgacacagtgaagtcctgtctcagaaaaaaaagaaatgaaggtcttgcgttcactgccttctactcacagtattcaataatgagaaagtcaaagaagaggaagcagatgaacagaaaaggcagtagagagaaacttgagccactgaggtgtcaactcaaagacaccatcctaatttacaatagaatatcaccaaacatcacaccaggtatcatgttgcctagctgtgccagaacaaggtgtgctgcacacatgcaaggacaagagaggctcccgtgagcaacctcaggactaatgctttttattgttgcaggtaagtaatatgcattaacaatcatagacaatttagcttcaagtgtgagcagccagcaaaagcttccatacaaaaacacaaaaggtgatagtcttccaaaagtgtttggtataaaggaaatgctgaatcaacccgaggaacaggtactctcactgacatgaaaacactgtttcagcactataggtattagatactacttagtttaattcaaaaaggaatcatgcccttcaaaatcataatataaaaggacatcactatatttgtgtaagacctaaaaaattagataatgtttactgatttgttatatatatgaaaatataacccatacaaatataacccataaaagccttcaaattacttaaaagcctttctccctggagaggaagtagtttgtggcagagactgaaagctttttaaagtgtgactttgatccccatctgctgtagtcagggtgggagaagaacactgatgggacaaaaagcaagaccctagaaaagagggttgctattttcctggagggatcatttctttagtatagtagtagtattcattagcagtattctgcctggaagccagttcttcctatatcaaattgtggacacgaagaaaggaagggagcagccactgaaagtgagaggtactatacacacattaatttatttatcctaatagcaatccattacctgatacaataaggtacatacagagaaaggttgaaaaatgtggttattgtcatacttctaataatatagtctggaattcaacttccaaacacaaataaagtgtccttccattcacactataagcacacccaagaaaattctaagggcaatttaaaaaataacagtggcaaatttgcccaggatggtaggatgtcatggggagtctgaccctgtggctggtaggggcaaagtatggtcttgaaagaagaatgtgaaataagacataatgaatgaaatttggaaaacaagagatgccatggaaacagcaggaaaagcctagaaacaggaatttttaagtcctttagacatacgactgaatatgaaaagaatgcagactgcttctacatctatctcgagccctgacaacttcttttaaattctaggcactattttccattgcagaagtctcttccacaaacatggtcaaaattaaatttattatctgcctccttgtttgcatatttttggtgacttaactctcattccaaatcccttctcctctcttttcctccaggacagagactggtcatgcaaatattaataccccagtcttcctacagctacagtttgcctgcaagatgtaaaaagaagttgaggtggggaggggtgctccctgtccataagaaagtgtctctgtgatggagcccatggccccttcccccttccttctgcctggaacatagatacctttgcaggcagttgtaatcatggaagcaaaagcctcatgctagggatggaagagcaggaaaacaggcagaagctgctttatgatggtgtcactgagccaacatcccactccctgtgttcttgtgaagtaagcccagtggtttaagttactattagacatgctttctgttcagagccaacataagcctcattggaatatccccaaatctttttcttctcatgtgcttcacatcttggtagtggtatccccatcccaccagtggcatcagcaaaatccaaggaatcatctctaaatcctactcattcagtcttgcttgcttctcactctatttctgaaatgtctcttccaacccttctctttcttctcttcttgttcatctttaccttcaccacctcattcatgctgtagttccctacactactaaaatgtcaccaaactcctcttcctgccactaatcttcctggaacacacaaacctctacttacaggttttcacacacctcaaaccttgaagtcttggctcccagcttgcttcacaagagccctcacaatactggggccagcaatggctaaaaaaatatgccaagtgtacattttaactgacattaaaaaaacaagtagatacaaagtaaaacaagatatcttttgtgttcatgaaatatataaagacatctaacaatctctataaaacatagtaagcactgcatacattttggttaaaaaatgaaacaagccaacaataaaagacatctttaatatgatttcaagattagcaatgctgcactgaggtgaatattcttacaaactattcttagtactatatatatcagctcacttgttccagagaattattcaatatatgttacaagtctcaaaaagtatacacttctaatataatatttccagtccaggaatattgtgaaacccagccctcctctccccataaggtttttgcagatattcatcatggcacaaattatgatttgtatgtatgaggaaagaatatataaccattgaaatattagagtttttgaacagaaaaatattcaggatacaatgctaagggaaaagcaagatacaaaattgtttttatggcatcattaaccgaggaaaataggcatggaaacgataatgataaggatgaactgctcagcactcattattatggctggtcatatcacacatttctccccctctatttcttttttatgtttctgtactttccaaatactttactataggcgtatattatttcttcattcagaaaaacatatgacaggtctggagatgtatgagtaataaagaaacaaaaaatagtaaaaactgaaaaagtaaaagagaaattcaggttgagttacatattaaatgatggtaacttgctataccagatccaatgttactttggggaaaggagtgggaagccctgagtatgcagcacctaagggcagggacttgcaatcaagatcaataaccacctgggcatttaggcagagtctattacagcttatgtgcattcagaattccaattatgaggtcctgacattttaagatttcctattcaaacaagtttcccaaacaattctaaatagctccctttataaagccgctgtggaagatgacaaaaatactcaagtcacttcatgtcagcctttaactgtgtgtgttaatgagtccagagtttcttccttctggtgggttcgtggtctcgctgacttcaagaatgaagccgctgacattctcagtgagtgttacagttcttaaggatggtgtgtccagagtttgttctttcagatatgtctggagcttcttccttgcagtgggttcgtggtcttgctgacttcaagaatgaagccaacgacctttgtggtgagtgttacagctcttaaaggtggtgcagacccaaagactgagcagtagcaacatttatcgtgaagagcgaaagaacaaagcttccacagtgtggaaggggaccctagcaggttgctgctactggctggaatgcccaggttttagtcccttatttgtccccgcccacatccttctgatgggtccattttacagagtgccgattggtccattttacatagtgccaattggtccatttaacagagtgctgattggtgcattttacaatcctcttgtaagacagaaaagttctccaagtccccaccctacccagaagtccagctggcttcacctctcattaatgcttcagtgcccaagatttgtcctgcaatatacccacaaactctcgaattcagtgtaatctaacaaaatggttttaaatagagcttttatacaagaaacaaagttcttattttgtaagaaaaaagacactttgagaaacacctgaggtaaagatctaaggatttagaggcacaaaagcctcagttcaaacaccatcatttataaactgtatgaccttactcagattgtttacattctctgagcaaatacagaaatagaaaaagataagctccagcttctaagacttcaagtgtcagttaatcacactcacttcttttaaaagccatatgtgtttcatcgcttgcttttaaccttcattctctaaagaacaacatctcagaacctgataaaagcattaatatttgaaacacgttatatatagttgacattttaaactaaatattttcatgacattatagagactgttctgctgtgtggccactggacatcaatatgtaactctaaaataaatgaaaacattgggggcatagtgaggtccctggtaagaacaagtaaaaagtgtggtatttaagcaaatatgctacatacagctatctttaatgagaaaaaaaataagttgccagtaaaatgttaatatgcatttggcccttggggaacagatggtgctacctactgcaagaattacatattgatttggtcagggaacagggcctgagggccaggcatataaaaaaaaattaggtaacttctgtcagaaagtttctaatagaattcaggtctctttcaacctcaacacatacctcaaaagttacttttcagaatacattcctgattccccttcttactcttggtttcttgttttgctcctaaaactgcttaatattttcaatttcactgggtcttaattaattgaaagtttatattatgttaaagaaaaatatcccaaaagactttcttaaaagtttaaagttttatagatgattgactgaatatgggagtcatctgttgaaaagaattggataattaattagatgacatccttctaattttttattcctgtcttaatgtatataatacctggttatgcctctaggcaaaaatatgccacagaatgagttataagtttcttttgaaatcgctttctccagtcaattgtgtatttcatcatatcaaggtcattttagaaccttggtcatttagaacctataggtcttattatagttaatggctccagtaatacataggggagtcaaagataaaactattaagtcactcaaaaacaaaatgaaaaacataagaaaaatagagaatattttaattacacacatatgactacactattatagtcatcctttgttatccatgagggataggttccaggacccccatgaataccaaaatccatggatgcttggggcccttatataaaatggcatagtatttacatacggtattctcctgtatactttaaatcttctccaggttacttataatacctaacacaatataaatgttatataaaccattattatactattttttgtttatttgtaattttatttgtaattttttcccaagtatcttcaatctgcagttggttgaatccttggaccccatggatgtggagggccaactgtataatgattctccagagcaaacttcatacctctgtatatctccagtaaagttgaaatgcagataaaaacatccctttgtcaatgacaaacagtcttaaaaggatgatcagaaaattcatccaaatagaacgttctgggatttataagtgcactaataaaaactgtaggatgacttcaaggagctgcctcaccccaaagaaaagaaaaccccactctttacctcccaacttcctcccaagttcacaaaaaataagagactagccaaaggttggaaggatgtgctcctatctctagattgtaaccaacaagtacctgacacaacattttttttttaagacagggtatcactctgttacccaggctggagtgcagaagtgtaatcatagctcactgcagattccaacttccggttcaagtgatcacctacctcggttttccaattagctgggtctacaggcatgtgccaccacacctggctaaattttttactttttatctttttgtagaggcagggtctcactttgttggccaggcttgtctcaaactcctggcctcaagcaattctcctgtcatcctcccaaagtgctgtgattaccagtgtgagccactgtgcccagccataatatattttttttaaagataaaggtaattgcaacattttagaacccccaaggataaagaacattaaaacatttaagaaagaaaaaacaggttattttaaaatgaatgaatatagccactctactatgcaatagaatatcaggatttctcttataaaactgtaattttatacctgctgaccaacctctctaaacccctgtacccaatacttttcccagcccttggtaaccactattatactctctacttctatgagatcaacttttttaggttccatatgcatgagatcatgcagtatttgtccctctatgcttggtttatttcacttaacataacatcctctaggttcatccatgttgtcacaaatgacagaatttcattctttttaatagtaaaatagtaatctttttatagttaaatagtaatggtatgagtatatataccatatttgctttatccagtcatccaatgatagacatttaagtagatttccatgtcttgactattgtgtacagtactgtagtaaacatgggaatacatatatgtcttgacatatgaatttcatttcctttgaatagatacccagtagttgattattggatcacatggtagtcctatttttaatttttttgtgggactcccattctgttttccataatggctgtgccaatttacattcccaccagcagtgtttaagagttcacctttccccacatctttcccagcatttgttgtcttttgtctatttgataatagccattctaacttgggtgagatgatagttcactgtggttttgatttgcatttccccgataattagtgatattgagcattttttcatatatctgttgaccatttgtatatcttcttttgagaaatgtctattcagattgcttgcccatttttaaattggattatttgtttgttattgaattgttggagttccttgcatattctggatattaaacccttgtcagatgcacagtttataatttctctcattctgtaagtcttctcttcactctgttgtttcctttgctgtgcagaagctttttagtttgatgtaatcctatttgtctatttttgccatagtcaacaataatgtattgtatatttcaaaacaactagaatagaggatttttaattttctcaccacaaagaaataacaagtttcaggtgacggatatactaattgctcagattcgatcattacgcactatgcgtatatattgaaacatcataatgtatcccataaatatgtaccattatctgtccattcaaaacaaaataaaacatatttaaaaataaacaaaaccagactgcatgcttttcattagcaacactagaagctagaagatagtggagtaataccttcaaagttctgagggagaatgatttcaacctggaattctatgcgcagccaatttccctgttaaaatgaggaaaattttagacctccatagaatcagaaaatttctcacacactatttcctacaaagatggcagatcagaaaacagaggctccaattcaaaagaattatgaagaaataatgacaactctcagcctgctgtccaaacactagttcagactgaagcaagctataggaaggctacaggaaggacatatctgcagagagaggtaaaagtggagagattactgctgtactttggaatagtgattctcaaactaaatcagacaaaacatcccagtctggatattcttcctttgtcctcaaattcaccgtctattctctgctctgtgccttgggaggctaaggaaccctaacagcttacatttttgcttttcagattctcttttggtttccctttttgtgaaatgtcatcacataatccaaggaaagaagagaaagaagacaggagatttatccctagcctccctccttgccacagaaggtgggacagtgaccagaggcctcactaaaaaccacagcttccatcagaaggcctctctctctcatggctatagttcccacccagttctggccacagctcccttctgcccactgagccttaagaggagtaagggcttccctccatagtcaatccctgaatgactcactcatccctaaatcctgcccaaccctctgtaatttgtgaattgccctttagagtgtgacaactattttttgctggaccctaactcaataatgatcaataagctccattttgttttttttaaaaaaaaaagaataaccctttttgctatccagaaatgaaatgtattgctaaattatctgcacaattccaaataaataaatacatgatcctaactggaatagaaataataaaataactgaaataacgtgtatttcagtatgtaaacacttagatataactagtcaagaagataaagtagatgtgtacacccacttatataataaagaagtctgggtttaggggaagttaagcaatatttaactgaatgctgtcaacactattctctttttttgacattttgaaataagggcttaatagtttttgcatatagccttaaaatcaagaaaaatgtgacaactgaaaatgaaggctgatacaagcatcctgtattgataatacaaatatcacaaccattattgctgctggtgacattgtttttcaaaatggtgagcaattctcagaaaagttgctaacaagaaaagttcagtcttccctcaatttacctgggtgtcttctacatatctgcgaaaacttgctatatattaaaatcatataaaatacactttatattttataagtaaataattatttctaggctcaaataattatgaacaagtttttgcctacataatgtttaagagaacactgagatgtgatgtaggatgaagaacaattattcatcatgcatttcagaatttctagaatccctagaccctacccactaaataccgtagcaatgcccaatcacagagaaaattcaaaaacacccccacaaatgttttaaatgtctactagggagtattaatattcccactgagaaccagggtttataatctggaacaacttaaggaggcaacaaaggaagacaagatgggtagagaagaaaaataaagttaaaattacaaaaaaagttcaaatgaatgaaatggtaatcaacatatatgtagctgtgcagacaaatgtagttgatcttgatcatgtaaacaccattaggaggttttcaatttgtagaatcaacaacttaaagtgtagataagccaggtgcagtggctcatgcctataatcccagcactttgaaaggctgaggcatgcagatcacctgaggtcaggcatttgagaacagcctggccaacatggcaaaaccccatctctactaaaaatacaaaaattagctgggcgtagtggcaggtgcctgtaatcctagctactcgggaggctgaggcaggagaactgcttgaacccagaaggcagaggttgcagtgagctgaaatcacgccactgcactccagcctgggtgacagggcgagattccgtctcaaaaaaaataataaataaagtgtagatagagatcttcatgaggattacagaacataaaataatcaaccttaggaggattatagaacataaaacaatcaacctccagaaaaaataagtttggaatgcagatgctgttggcaatggtttcagactctcttatgtctgagtcagtacctctgaaattcccttagtattttccccagagtcataatatgattgctacagctccagacatgggatggaggcagcaaggctaaaaatgtgttatctgtcatacaccaaaaatacaaaaaaaataaaattagccaggggtggtggcatgtgcccatggttccagctacttgggaggctgggtcaggaggattgtttgagcccaggaggtcaaggcttcagtaagtcatgaaattgccactgcactcgagcctgggcaacaaagtgaaactctgtctcaaaaaacaaaaaaacaaaccaaaaaaacttatgtcacatggccacttgtagctctcaggaaagctagaaaagcaagtaccttacctagggctggaactattacagcaagaaagaaataaggaaaatgaccgtcaagtaggcaattaatattgtcagcaagaaatgcagggccataatgtctatacctaaaggaacaagacataaagggataagtatattaattaaattacaaagagatatgtatactatttaaattacaaagcaaactgtagttaagatatgggccctagactccttccaacttgtagctctgttatcctcaataagtagcaacatcaatttggccaaatggctgctctaactcctaccacactgacattgacattccagccagtaagaagggggaagagaccagagagaaccatttcttccctttcagaaaatggcccataggtttgtactcatcacttctgtttgtatgtttgtccccaccaaccctcatattgaaatttgatcccaatgttggaagtaggggcctaatgggaggtgtttgggtgatgggggtggacacctcatgattaatgccctccctgtggtgggtggtgagggagttctcactctgttagtttccgtgagggatggttgttaaaatgagtctggcatctcctctctcacactctctcgtttcttctctcaccatgtaatctctgcatacactagcaacactttgccttccacatacgttgaattagcctgagactctcaccagttgccagcgccttgccagcaccatgcttcttgtatggtctgcagaatctcttacctttataaattgcccagcctcaggtatttctttacagcaacactaaacagattaagacatcccactagactgaacttaagtcttggctatagctgcaatggaagagatgctgtgacacatgtgagaccctgactgttccacagccagctactgacagatttttgaggcaacaattctaagccaattcttgctcctattgcagcaaaacttactttctactctcctcagagaagtatcagcagtctctggcttgtatctgacttctgtacaaacattgcctctgcaattcctcattaagactgatgatcttatgggacctggtcctatttcgcatggtagaaataacaaagctggtgtttcccacagttgtgttattgacccacattctctatagacaatcatggtctgtcccattgttaatgaaagggggaaaaggaaaatgagaaatgtagacttcaaccacacagcatttatccaactaaaaattctgttgcttataagaatgtgagaacatcttggaggtccactagcagtagataaccatattccaagtggaagaaaggggagccacatgtctgtgtgagtgagctaaatcttccccacccagcaccctctgcaggaagtactgtaaagactaaagtctaagaagaatgaatgaaggaaagtggtgtaggcatcttattttgatgttggaagtattttcccaaagaattaaaaacattaatagttaaaagaatttcttctgggaatgtgactgggaatgggaaaaagtggggcaggggactgctgctttctattttaagttctgcaaggcttatttaaccacataaacatatttattattttaataaaatagcttaaacatttttaaccatgttataatctcaaaatagcacagtttcaccctactgcatttataaacttaaataatattgagtaaatactttcaggctatattctatattacctctcaggctaccacctattcaaactttaaccattgctatagtctccaaattggtctttcttcttctactcttgcccctacaatctattctcaagactgtacaactctaagagggtgccttaaattccatcttaacaaagtctctggtggccgggtgcagtggctcagaccttgtaatcccagcaatttgggaggtcgaggtgggtggatcacctgaggtcaggagttccagatcagcctagccaacatggtgaaaccccatctctactaaaaatacaaaaattagccagatgtagtggcacgcacctgtagtcccagctactcgagatgctgaagcaggagaattgcttgaacccggcaggtagaggttgcagtgagttgagattgtgccactgcactacagcctgggcaaaagggcaagactgtctcaaaccaaaacaaacaaaaatacccctgaagctgtgccatgtagtggcactgtctattctcagatcagacaaagagatgtttttagaatcttaatcagatcatttcctgaaacttttgaaaaccttccaacagcttcccagcacacctaaattccgaacatcttaccacggcctaaaaaattcatataagctagcctctgcatacctctccagatgcaattcttcccactttcctcttctcacatcatgctagccaccctgcacaactttgctgctttttataggaaaagcttattctattccaccacaggactttttattcttgctttagtgctatattggatactctttcctcctctgtttccaaggggctcagtccttcacttaattaatcctgatcaactgctacctgcttctacaagaggcttgccctgaccaccctatctaaaataaccactgacaccaaaccccctcccacagttactctcccttaagaggaatatacatatatgtatctgttgcttaatccatctcctctactagaatataagcttcaaaagggctttcttgagcaacatgataaaatagggggctcctgactgtccctcctctcacacactgagaaatcaattctctccaagagaaataatccagttgaaagactcctgtgtaccagacaactgaggaaatacccttgtcaaaatgggtagaaaaagctgagatatacttgcacactaactccaccctgagcacccaagaaggaaatatcaactcccagcttattcttgaagggtaatagtcttgtacaacatataccctgcccaacttttagagtccctgctgaagggctttgctcttaaatcaccatgcctgaggaatggcagggagagggcatcagatgatttctctcaagcacaaagaacaaagggagttttgactgcatggtcattcccagcagttgtagcccccaggatcagcccaacttctataaacctgcatagcaaataaagaataaacttatctgagcctaaatgggaaacatggcactccctttgccccagggacaattccagacccatggaaaatctctctgtggaaagagatgggaggcctctgccaacaacaatgaaagagaaagcactccctaagccttctttcctggcttgcttttgagatatagtcctgcaatctcacattggaaggaagctggggaatgggcctcttcatacctgaaggggaaagtgagcaccctctgtgcctttctccctggttcatttcagtgataactcccaactagaaatctcttcctgctagaagggtgtgagacttctgcttgccttaatgccagagtgagcacttcttgatctttcttctctgacttgcttcagcaataaatctatatctgcagactctccctggaagtagtttctgcatgcatcgagtgctccaacttttacagccttcacttgagtgactggctcctaaatcacctagctctggaagttgatggagctctacactgctggtctcccagaccacagagaacaaaagtgacttttaaacttgcaaaccttcagcaactatctccccaggttaaaagtgagcactctgaccaagagtacaagattcttcctcagactctcactttagtgtagggcagaatgagtgggggataaattccagctctccacttctcaaagaaggaacagaaatatatatttaacattctaacctctccagctacatctcaagaggctgtcttctctcacctctctcaaggcaatatcatgacttgacactctaatttcctaggagccactaagaacaaagacagcaggttggacaaacacaaagagcttagaatatagaatccctgattggaaagaaagatcttttacgcaagaccactccaacaagacaggaaggggtggttctcttatctaatgcacagaaaccaacacagagagtcaaggaaaattaactaacagaaagatgttccaaataaaagaacaagatacatctcctgaagcttatgctaatgaatggagatatgtttctgaccagacaaggaattcaaaaggacagtaataaagatgctcgctaaagtaaggagaacaatacaagaacaaactgataatttcaacgaagagatagaacatattaaaaactactaaacagaaatcattgagctgaagactataataactgagctcaaaaattcaacagacaggttgaatagcagcctaagtcaagaggaagagaagattagcaaatttaaagacaaaatcattggaaatcatcgaatctgaggagctaaatgaaaaaagaatgaaaaagactgaagataacctaagggaattatggaacaccatcaagtgaataaactatgcattatcagagtaccagagggagaaaagaaaaaggaatacaaaccatatttaaagaaataatgacagaaaactgcccaagtctagggaagaaattagaaatccagatccaagaacctcattggacacctaatatgatgaatccagagacccacaataagacacattataatcaaattgttataaataagttaaaatattgtttctaaagtgaaaacaaagagaaaatattgaaaaatctgcataagaaagtgacttgttacatacaaaggaacttctataacactactagcagatttttccaagagaaaccctgaagaccagaagtaaatgggataatatattcaaagagctaaaagaaaaataacaaaactgccaatagtattatacccagcaaacctgtccttcaaaaatgtaggggagataaaactttctcagacacacaaaagctaaaggaattcatcaccactagacctgctttacaaaaaaaaaatgctaaaatgtgtcattcaagctaaaggagaagatcactaaggagcaacacaaaaatatcaaactcaccggtaaaagtagttatgtaataaaacacagaacacacttatactgtaatggagttgtgaataccaaatatatctctagtatgaagattaaaagccaaactattaaaagctagagctttaataatttgctaactgacacaaacagtaaaagatacaaaatatgtcatgaataataaattgtgaatgggaaaagagtaaaagtatagagtttgtgcaagcgatcaaagttattatcagctttaaacagcctgttattagtataaaatgttttatggtagcctcatggtaaccacaaggcaaaaacccttagtagatacacaaaaagaaagcattcaaagcataccatagagaaatcctcaaaccacaaaggaacacagcaaaagaagagaggaacaaaggatctacatattaaccagaaaataattaacaaaatttaatagtaaatccttacctatcaataatgactttgaaaataaatgggttaacttttctgatcaaaagacatcaaacagcttagtggattaaaaaaagaagatgcaactacccaactatatgcttccaaaaagagactagtttcatctctaaggacacattcagattcaaagtgaagggaagaaaaaagatattccacacaaatgaaaactaagagtgcaggggtagctatacatatcaggcaaaatagactttaaatcaaaaactgtaaaaagagacaaagaaggtcattatataataataaaggggtcaattcatcaaaaagttataataattgtaaatatatgtgcatagaaacagagtagaaagatagccaccagaggctggagggagtgggagggatggagaaaggagagatgttgatcaaagggtacaacatttcagttgaactggaagaataaattttagtgatctactgcattgcatggtgactgaccacagttaataattatgtattgtatatttcaaaattggtacacaaatagatttttaacaacctcaccacaaaaagaagataagttggtgaggtgatggatatgttaattagattgaatcattatacaatgtatacatagattaaagcatcacattgtaccagacatacacaattatttgtcacccaaaaagagattaaaagcgctatcttgtccatgtctatattccagtgtctgaaatagttcctaccacatgaaatctgttcaaatattgcctcaatatttgttgataaatgcaatatgctttatagcagggaacatttttccctgaatgtaaattattacaaaatgttaacaggaaactttttgaagatatagtccaggtcagacactgaactaagtgcttttcagaaattattttatgtatcttcccaccatctcactgaagcaaatattaatcactttattgatgaagatacagcaatttagaaaggacaaagaagagtagatctttactgcagatagggtcctaagatagaaaactgaaaatggaaaagtcaaacaaaggaagacaggggacaacggaggaggggagagattgccacagtgctgggaaaaaaaaaaaaattacaccctggtttcatcccactttttgacttatgtattccagcattttcacatgttgagttttctcttttcattctcaaatgaaatgaaaaacaaccaatcttaagtactcaatatcaaggattttctatttgcaggatacttcatgatcttgatctcagttgtaccacattcaaaatatatgcttatcactgacaatttttaattattataaaacaaaagcacaacaaatacatgcatatgtacatttatatttatacagtattcccccccacaaaaaaaaaacaggatataaaaacacaacactgttgaagcttaactgttgagcagcaaagccaccaagtaataactcaagctgttcctctgctaaagaaagaaaggctagattcagcatacaaaatacggtttaggaatgtcaatgtctgaaaacgtggcttgtgtgaaatagaacctaaaatgagttccctgggtcaccaatgttaagggtaatctccatattgcaaaatccaattaacattttcaatctccatcttacttgatcattcagtagcacctgacattgttttctactcatcctgttaagtagctctttcattagtttctgtgacatggaccatcctagttttcttctaatacatctggctacttcttctccatttccttctccagctcagccttctttccagtcttaaatccagtagttctttaagaccagtccttaaaatcttctccttgctagactctcttttcttgggcttccttatccaaacccatggttccaatcaccatacatatgacaacactcaaatttaactcttgtgcccaaatctctcccctgagctccaaacaactgacttgtaaaaatctctctttatttgaaggatcacaaagttaacatcttacctattagatttcagcttcttataccaagatctgtggtggattaatctgtatagccccacattgcttatctcttacatagttttaaggtgatttaaaggaaagaaaaaggataaagttcaaagcctaggactctaagatatggtgatcaaactttatagggattcttacagtgttgcacaatttaatcatgtaactttaaattttcataattacttgaacattttggcctccctctctgtcatttcaggtgttccagttaaaaacaatgagattcattataggaacctttgttttgtcaaagaaagctttatacaaaagcttataatataaaacacgtcaaaacacagtggacctaaagcaaggacgagggaacaagaatgggctttatctcaatctccctacttactactgcttgagaatatatgcaatccttctgagtcagaaaagaagagcttcaaaagtgtaggctaaagttgtcttgttatatttcagaattttttcttatgatattcagcattttgtaagcctttttaactaagcagtatttttagttttagtttttctagagaaccaaattaaggctctcatctctttaaataaaatttggaatgcattttcctaaatatgttaaactagtaagaatacaagtttcatggcagcagaatttatttttcccatattctaataaaaaattccatgcagatccagaaaaaaaatttaaatagggtaacaactttgtaaactaaagttaaaactgtaatccaatttccagaggaatgtccacggactcacaacccaagaacaaaactggagacacagcctcttaaaatacatgtgtcctgccctttgaatcagaatagtaagcacaaacataaggaaggcgaaggaagagttatattgtttcaccctatctgtccctagctccaggaaaggagtacagaaatgcccttaaacacagggagccaaatgcctccctaaggaaaatgatctttggagaaagtaaaacccacctactgtacttggcatttcgttttccagatatatattttttaaatggagtccatatagcaaaaggcacaaaacaaaaatttttttaatattttaagttctgggatacatgtgcagaatgtgcaggttacataggcatacacatgccatagtggtttcctgcaccactatgtcatctacattaggtatttctcataatgctctccctcctctagccccccaacccaataggccctggtgtgtgatgtttccctccctgtgtccacatgttctcattgttcaactcccacttatgagtgagaacatgcagtgtttggttttctattcctgtgttagtttgctgaggatgatggttttcagcttcatccatgcccctgcaaaggacatgaactcatcctttgttatggctgcatagtattccgtggtgtatatgtgccacattttctttatccagtctatgattgatgggcatttttggtggttccaagtctttgctattgtaaatagtgctacagtaaacgtacgtgtgcatgtgtccttatagtataatgatttataatcctttgggtatatacccaataatgagattgctgggtcaaatggtatttctggttctagatcccagaggaatcatcacactgtgttccacaatagttaaactaatttacactcccaccaacagtataaaagcattcccgtttctccacatcctctccaacatctattgtttcctttttaattatcgccattctaactggcatgagatgatatctcgttgtggttttgatttgcatttctctaatgaccagtgatgatgagcttttcatatgtttgttggctgcataaatgtattattttgagaagtgtctgttcatatccttcacccactttttgatgggttttttttttcttgtaaatttgtttaagttctttgtagattctggatattagccctttgtcagatggatagattgcaaaatttttctcccattctgtaggttgcctgttcactctgatgatagtttcttttgctgtgcagaaactctttagttcttttacatcccatttatcagttttggctgttgttgacattgcttttggtgttttagtcataaagtctgcccttgcctatgtcctgacagagagccaaatcatgagtgaactcccactcacaattgctacaaagagaataaaacatctaggaatacaacttacaagggatgtgaaggacctcttcaaggagaactacaaaccactgctcaaagaaataagagaggacacaaacaaatggaaaaacattccatgctcatggataggaagaatcaataccatgaaaatggccacactacccaaagtaatttatagattcaatgctatctccatcaagctaccattgactttcttcacagaattagaaaaaactactttaaatttcatatggaaccaaaagagctcgtatagccaagacaaccataagcaaaaagaacaaagttggagccatcatgctgactgacttcaaactatactttgaggctacagcaaccaaaacagcatggtactggtactgaaacagatatatagactagtgaaacagaacagaggcctcagaaataatgccacacatctacaaccatctgatctttgacaaacctgacaaaaacaagcaatggagaaaggatttcctatttaataaatggtgttgggaaaactggctagccatatgcaggaaactgaaactggaccccttccttataccttatacaaaaattaactcaagatggattaaggacctgaatgtgagacctaaaaccataaaaaccctagaagaaaacctaggcaacaaacttctttaaaaaagaaacagaaaacactgaacaaaacagaaaataagattaaacatatcagtggtaactaataaaatgtttaaaccctcttattaaagcatgggactaggcataaattgttgcataattttcctcaatacaaagcaatccagaaatgtgagtgtgtatacgtttgcagatgtgtacacgtttgcagatgtgtacatacgtgtttacattagacgcataactaggtgaatatgagtgtaggtgtatacgtattatggatacttttcaatctctctgataaactccaccaaaagaaagtaaaatcagtgttaaatctgaacaaagtagaatccttgtcccatatacacagtaagtggatcaaacgaagttaattttcagtgattgtaagcatatactcatgaatctttacacaactaagagactggaatcaaaacatatgaattaaatatggctggaaatgcaaaataaattaatacaactaataagataatttagtcaaagaagacaaaaataagataggaatgattactataataatgctaattattagatatatagcaaactttttatcttaaaatcagtatattaatttgtgatgaaaaacttaaattacatacaacaatgctaagtaccataagcaacattctctgtcaacctaaaattggaaatctattactaaagagaaaacaaatttttcaactgcaatttctaaattactcttctgattaaatatgtaaatactggttcaaggaaaaaagtaaaatctgaaaagagaatatttaaataaaaatgctttataacataaggactgaggccaaactgcacttagagataaattcatagctttcatatattctcattatcttattacaaaaccaaaaataaagtaatcctaaaagagaagctagatgagagaaccactctctcacgtctctctcccattcccttggtcctctttaaaagcaacaacaaaagacaaccctaagggaaacacaaagaaaggatacaaactattgatttctaaaatagcagaacttataaagttaacagatataacttaaaaaaaaaatggaatctggccaggtacagtggctcatgcctgtaatcccagcactttgggaggctgaggcgggtggatcacttgaggtcaggagctcaagaccagcctggccaacatggcaaaacaccatctctactaaaacacaaaaattagccgggtgtggtggtgcacacctgtaatcccagctacttgggaggctgaggcaggagaatcacttgaacctgggaagcagaggttgcagtgggtcaggatcgtgtcactgcactgcagcctgggccacagagcaagactttgtgtcaaaaaataaaataaaataagggaatccagcaaatctaattttatatttattttttcttttgagacagggtctcactttgtcacccaggctggagtgcagtggtgcaatcacagatcattgtagccttgacctcttgggctcatgtgatcctcctaccacagcctcctgagtagctgggaacacaggcatgagtcgccatgcttgactaattttttctattttttgtgcagactgagtctcactgtgtagcctaggctgttctccaactcctgggcttaagtgatccttctaccccagcctcccaaaatgctgggattacatgtattagccactgcactccaccattttatatatatacatgtatatttttaggaagaatataatctaaaataagacttatagctaacataaaggatattggaaaaataagtgaaaaattatgttatatctgaaaatagccacttttctgaaatcgtgcaattatcatattttaattttgaataagaagaaaaagcaataggctaaaaaaaacagggtctggatgcaggtaatttcacgagtgaattctttcaaaacttcatgtatcagatgatttacataccaaaaacaaaacaaaaaaactattctagagcacatataaaggtaaaatgtttctcagttaacacctttctgatagacctttctcttatgaacatacatgtaaaaattaaaagtacaggaaactcagactcaaaggtgtattaaaaaaaacagtcataatcaggtagaaattacccgagaaatgcaaatatgctttaataacaggaaacctagtaatctgatctgtcacatcagtaaaacaaaactaggcattcacctctattaatacaaaaaaaggaatttgataacattcagtatcaattcttgatgtattttattttcttaatgtaatttttgaaaaaggataaacaaagaataccagaattctatccaagaatcctaaccaacagtatattcactagtaaagcaccaaaaacatttcccagtgaataatggatcaaaacaagggctttggcaacaagtacaaatactgttctattctaaagagtatggtgacatatgaaacaaaagaggtatagctattggacaggaccagacaaaagccatcactatcaacagatgcttcaactgcctacctagaaaatctaaaaggatcaacactgaagacaacaattaagtaacatcaatgaccagttaattacaaaaaaaagcttcccatttatccataatgagatttaaaaagatgtcacaataaaaatataaaatataaaaattaacttgattataaatgcaagagatctatatgatgaaaccttcaaaaagttacagagtcttgactaattgaagatatcgtatgctcctagaaggctgaatatagtaaaaatatcattgtttcccaaacaggtttaattaacaactagaaacgatagcgtctaatcaggagcatgtactttataggcatctcatttcgtcacaacagaaatcctatgatttttaaattatcaacattttactgaaggagtagttaggtcccagaaagacgaagtgccttgttcacacggtgagtgagtgagaagatgaagtccaggccctctgaagccagtgctttcctaacaaagacgctatactactgcactatttttaaaaagtggcactttgggaggccgaggcggtggatcatgaggtcaagagatcaagaccatccaggccaacatggtgaaaccccgtctttactaaaaatacaaaaattagctgggcgtggtggtacgtgcctgtaatcccagctagctactcggggggctgagacaggagaatcacttgaatctgggaggtggaggttgcagtgagccgagatcgcgccactgcactccagcctggcgacagagcgaaactccgtctcaagaaaaaaaaaaaaaaaaagtgggaagggaaagacgaatgatacaagtaaaaaatttctgacacattagagagggaaataaccacaccagaaattaaaacgcaatgttgtcggccgggcgcggtggctcacgcctgtaatcccagcactttgggaggccgaggtgggcggatcacaacgtcaggagatcgagaccatggtgaaaccccgtctctactaaaaatacaaaaaattagccgggtgcagtggcgggtgcctgtagtcccagctactcaggaggctgaggtaggagaatggcgtgaacccaggaggtggagcttgcagtgagccaagatcctgccactgcactccagcctgggcgacagagcaagactctgtctcaaataaataaataaataaataaataaataaataaataaataaataaatacaaagttgtcataagttaaaattacatgaaaatttgaaaaaagaattaaattaataaacttatagacatacaacctgtaattattgaacattagcccacaaggggattatttgcttgttttattttcttactatatcctcggaacatattggatagtgttaaattcacataatagggactcaataaatagtttaccaaggaaataattaaattgggccataacacttagtaatgaaagtagagattcatcaaaagtcgggctgcaggccgggcatcttgactcacacttgcaatcccagctttttgggaggctgaggcgggcagatcacctgaggccaggagtttgagaccagcctggccaacatggaaaaaccccatctctactaaaaatacaaaaaattagctgggcatggtggtgcacacctgtaatcccagctactcgagaggccgaggcacaagaatcagttgaacgcgggaggcagaggttgcagtgagccaacatggcaccactgcactctggcctgggcaacagagtgatactctgcctcaaaaaaaaaaaaaaaaaaggaccaggtgcagtggctcatgcaggtaatcctagcactttgggaggccaaggtgggcagatcacaaggtcaggagttcgagaccagcctggccaatatggtgaaaccccgtctctaccaaaaatacaaaaattagccagacacggtggcacgtgcctgtagtcccagctactagggaggctgagtcaggagaatcacttgaaccaggaggcagaggttgcagtgagccaagatcacaccactgcactctagcctgggcaacagagcaagactccatctcaaaaataaaaaataaaaataaaaaaagaaaagaaaagaaaagaaatggggaaaaggacactagcttacaaatactcatcctcacaagcaatcagaaagaagcaaattaaatatcttagctattagattgacaaagacaggctttaaattttcaggccctttgccccagtaatattttcattataaaaatccatcactaacttgaaggtataaaatgaaagtactgaaaccacaacatctacaaagtggtataaaagtttcaagaagcaagcagagcattcatgatgctgtacaaagtaaaaggctcccaaatgcaaaccaacaacgtacctttttaataagatttgaggaaaatagaagcttttccttactgtccacctaatgttataattttggacatagcagaacttaaacaagtcattttaattaataaacaagtcattttaattactttaattactttaataagtcatttaattactttaataattatgttagaatgacttctaaagtttactttttggaaaacctgtacgcattactactacatacactgaggaaacagtttgcccactaacggttttgtaggacctttgtgaactgtactgttcagttaggaattactgagtgtcagctccaacttggagatttcactgtattcttcttcccagttcattctggaatggaaagcaacactcacacttaccctaagcattcaatatatactttctgttgctaatgtggtgatttatctacagttgtacaatgaataaaagacagtactgtgaatataatttaaaagcctccagcatatcacctagacaccttttataagtctaaataaatatgcactagcctctccactgtatcgactgcacaaactctagaatattatttgagtgttttttgttccttgcttcgagtatccccattaccttttcctgcacatggaataccagcttttattagtaatctcacttgttattgccaatactttcatttttcctaggtgaaaataagccatttttctatatcttctctttagaacagcggttctcaaccttgactgtacactgaaatcaattgggaagttttaacactataccccctgagactgatttaattaccttggggtacaacctggataatgagattgtttttaaagctctccaggtgattctaatgtgcagttaagataagaatcgcacttctttttccttaaggaaatcatatcaaaacatttaggtaactgaaacacagtgaacataaaatgatatattacagattttggacaacaattccataatctgatgtttaaatgctcttcaaaccctagaaaatatgccatttgtcccactgatatgtccactatttaattattaggtctttcctaggctaaaaactgaaacagcaatgtcacataactatgcaatccacctcttccttcacaaaggtctcaattaatttgaaataaatataaagtagcacaatcagtcaaaagtggtctacctcactagcaaatgataaagaattttccattcagaattcccagactttataatctggcagtcagctttcctattttgttttgaaagtctttaatgaccttacaaactgtgtttactttgtaaaagtatgaatgaagagagctgtttccattaaaggcaaacaaaacgaaactgaaaagggaaaacacaccattaaaatattttattcacctaataagcagtcattatatatcaaaatcgcagctgatttcatttttgaaggaaagaagcaaatgacaacgtcacttaatctgtctgagttctcattagcacaactcattccaccaaattaagtgctgtggtctcaggataccctgtggaaggttaaaagaatcagctgaagcaacaagcaattttccctgagatactgttttaagtccagtgtgaggttttactttaatacgtggtttccaactcactcccaacagggcaaggtattccctataattaaaagcagcaaatatcacaacccatctcttctgtacttggaccataatgcatcaaagccaaaggagcacaaaaaaatgaatcaccctatctccctaagagtatggcatttttggactatcatcagatctgctggaaaactgcaggccagaaagaaaggcatactatggggcttcaacactgctaacttgtctctggggcttgctagaaacatcaggaaagtgttactttgaattcactagttttacaccaacaggtattaccatttttatggctttctttaggggaataaggtgagtttcagaggtctcaaaacatgtttaggaacactagttcccactttcccacagaaaagtaaaagaccctttcacattgcctttatattatctttactccatcctattcctcactaattctttgaggcatggactgaatctgagacttacatgtacacagcagacaccaaagtagtcagaagatgaaaacaaaataaaacctggaaagtaccactatgtccaaagggagataaaagtggccactttatagtagttacaacattcaaatgagcgagttggaggtatattatttcacccaatactatttccccaaatgttcttctccagatcaattttacctgtttacttccccaccatctgcaatttcacagtattatttacatacatttctcaaacttagaattatcacagaaaattatgcaaagtggtaggagtgattatacaaaatggtttaataaggcacaatttagtgtggttacagtggagacacacactgaaacataaaaatataggtatatgaattatatggaaggttagtaggttctattttaataccctcttatttctagttaaaaaatacataaaaactcaaataatgaaaagagcagtgactagaaacctatggattctaatcaaaactaccagcactttaagccatatacatcttaaatattgttacgaatttagacctgaagtctgtgaactcacatttatgagtaaaggtacttaatctcttctatgttggtcattatgcttatcaggatctctctaactttcaaaccaccaaggaaccctttttttttttttttttactttctcctccgaggtctcaatgtttttcataagtctaacaaattgcctttattaattagtacctgatttgtattattgtttttctagtttcaacactgactctacctttaactgaagatctagaaccatccaaagttaatcatcattgttagcactggggtggtgcaaaggtaatcagggtaaatcagcattagaggctcaagcactatcactactgacatcactttcaatcactgtttattagttcatactcatatcatgtgtgaacccctggatatgttcatttaggaggtgtagcacctggaaaggcactctgtcacagtgtgtagcccatatgcacccccagaattttctgtaaaaccatcagtggtcaatcagagggcttgaatgtcataaactgaccactattattcctcaaaattgaaatagtctagacaaaagcaaagaaattcatgtgttcgttaactgtgtttaatgctactaagctttctcaaatagctcatagacacaacctcttactaactttgtggaccattttagccaagtgaaaaaaataaataaataacactgctgctcagttctggttcatagaaactcaccagctctaatagtgaacgggctttgactaaagagaaacctgactcctggcctcctgggtaaagatcttatctttgtgattaattttcttcataaaatgaggaccctttcagatctcaatttctgggtctctaaattcttgaagttgagagaagtgagtaagcagcaatattcatttcaatgacaacaatttcagctattaaatctttttactggatgcctgactacttgaagatacagaataaaataaacaacggattagtgattttgcaattaccttgttacttcttttagataatctaactgtataatgcaagacttcaagtaagttttggcattacttattagcttgtgcatcaaattcacataaacatagttaaattcccatttcattttgccctaagaggaaaccagactgccaaaagttgctccagctccctttagtaagcagcacattttttaaaaggtgggggagggttgagtaaagtaaatacttaggctatttggcatccatcttaataaaaaataaaagtaattcacaaaagttaacctgtgctcaatgctctaagcatttagaatgtggaaattcctaaggattctattttttttcatagaatatatgttgtattttgctttttttgtagtttgaaattatctttggtaatgcctggataaggttataacaatagtctccccagtagtattgtgaatgcacctgcttgccaattcaaataattttgaacaaatatttaaacagaaggagtcagagaaaaatgcactatttgaacagctaagggagggtccacttcattaacaaaatgcaacaagtattcacagtataaatcaactcatagtaaatttgcaaaagcatcttcaaggataatattccaaggagaaaatagtctcttaattttaccaaacattatttttacactttaatcattaaaaataggcttaaatgcaatatgaatggtaaaactagagactggatgatatgaactcataccacaacatatacaaaaaatagttttaacaatgactattgaagctgacagtcgcttgactagaattgagaagaggccacgggtgactgcctcagaacagactcaattagagcagctgattaggaagtatgggattcatacaggagtggagcagcaggctcataaaaacaccgcggggcattcaaaacttacctgagtaatggtggttttaactgtgccaatttgtttgggattgggaaatgctattatgacctatttctcttctccaacatgaggagtctccctaccattctgtgactgaatacctagggttaggttacctgaaggatctgttattaatctccagctgtaaggaaatattccataaggattcccagagaataaatgattccaaaatagttgctcagtttgtgtgtgttttaaaaagttgggtaagaccacttaaaatttttttctaagaggatagatcttaagcatacaatagtgttaactataggtgtgtacttatccccatgatacttatacacctatgaaaccaccaatagttagggtggagtggtatgcacagctttttacatgtcaattatacctcaaaaaataaaggttatctaaatgggggtaggagaatgtagggagactgaatttactctgaactacagttatagttgaagtcaactcaaaacctctccaaatttctaaaaatgcctcacacactgaagttaatatttcagaaaactaataaatgtctgtgcatgtaggtatgccttgagcagactacaatctctctggatctctaggtcttgtcacaaactgagggaactgttaccgatttctacagaaccttccaggttcagcattctattaaaaagatttcctagagtttgtattgtaaacatttaaccacttaggacaatttgagtcattactcgtgtctggtacagaacatcaggcccctggggtcttgttttgaaactcaagttggccagcctttcacctgaaacaaacttcttaccttttgggggagaataagcattttgttccccaaaaaagcatttggaaagcatttgttatgaagtgatcatgcaccaatcctttatctttcatcagtaatagtatatttcattaatcaggcctgcccagaccagaaattacttacccacaaacactttacaaagctgcatgccttctcggtgtttggatttgatgtcctggttgtatgacaatataggaaacgtattaatttaacttttttattcactgaggaaaatttctacccctcttaagtgaagacttcactctagctaagagaagtactcgggctccacctgtttcgcctagctacaacactcattcagaccctcggcaaacccagctctagcaatatcacgccaggctaggtggacaggaatgcaccagtgctgttggaaattaaagttgatgggagttgcattctaatccggccagagctgcgcctgccgggtgcaaccgcggcgcggccggcgctgtcggtctctgtctcacggatggtgagctgacagctcctgccagcccaggcggggaggaggagaagaggtgtccgctgcagccgcatacccggcgggtgaaagcaccgtcttgtccccaaagattcctctgccctcagagactaacaaaaatacggtgtcctgcgtttcgcagaaggacgggaggcgtcccagagctctcccgggagaaaaacccagggagaagtggtggtaggaggcgcccggtcccgcaactcaccttctgctgcctccgggccatgtcggtgggctgcttggcgttgaaggggtacgcgatgcacctcacgacgaagacgtagagctgcaggcggatcctccgctcctgctcatcgtccagctgccgctggggctcgtctcgcccctcgctgagcacagaggggctcgggctcacagatctggccgcgccgccgccgcccgcgcgccccggcgcgtcccgccgcccttcccgagtcggggctggaggagctcgctgcgagctgccggctgccaccagcacatcgcggctttcctcttccagcccctcgtccgactcctcttcgctggaagacgggtccagcatggtgctcggggatccccgccgctcggcccgcggtccccaagcgcctcacccccggcggctgcgcccgcgggtctgagggagccgcggggctggctgcagcggccgcagaacgaaaggaaaactggccagggctttccggacacgtcgagttagattcaggagtgtttcctaccaccagggcgaaaggggcgggcaggagccgggaggaggattgggaggggggagagggggagccgccgggactgaataggcggagttagcgttgggggtgagcttgggcgcctcaggaattgctccgccagccccgggcgcgccgacccagcggttccccagagcccgccggcagaggcggagccgcccgagcgcccggacgcaggtggggaacctgtggcgcctacaacaagcaacacgtggaattgaat

SEQ ID NO: 1678 - DNA, 568337 bp, Homo sapiens; identical to SEQ ID NO: 1677

SEQ ID NO: 1679 - DNA, 568337 bp, Homo sapiens; identical to SEQ ID NO: 1677

SEQ ID NO: 1680 - DNA, 62616 bp, Homo sapiens
tttcaacaaggaaatgtatttattttttctttagaatttggctcagaacagtaacaaaaatatttacattaaaataaattaacatgcaattacttaaccatatgtaataatttacgttggaatatattagccttcccatgagtttaataaaaactaatatttggttttagattcaataccatcctttcaaatatttggtatgaaacttggtagcaatgcaattgtctgatgtacagagcagatttcaccatgagagattacaccaaagaacagatgtcccttcccagaacattatctcaccccagactcagaaactgagcagccaagcttccttcccaggaatcaccatggaatgtctgaacaataaccaggccctggagattactgcagggctggcagagttttaggaatcagccaaactctttttcacactaacccactaggaaggatatagttcaaatgtaatgttgagtccttcagtttatttgaacactgaaacaatatgttgtagaaaccttcattttcccaaaatagaaatctgaaagatatatgcacatgatttcttagatcatctaaaagtacccataaaaacctgtcactagggccaggtgtgatggcttacacctgtaatcccagcactttgggaggcagaggcgggcggatcacctgaggtcaggagttcaagaccagcctggccaacatggtgaaaccctgtctactaaaaatacaaaaaaaaatcagccgggcgtggtgcatgtgcctgtaatcccagctactcaagaggctgaggcaggagaatcacttgaacttggggggcagaggttgcattgagccactgcactccagcctgggtgacagagtgagacccgtctcaaaaaaatagaacacctgtcactagaccaaatactatactggtaaaatttcacagcagagaggaatatttcattaaattcagctgatagggtcaaggatacattaagtcatttacaaatcagatattagtattaaagtttttggtggcctagagtgaattagaatatgttagcattttgaaagtgtttttgaaatgagaggttgtgtggctcagcagcaaaagcacagagggacctgggatcaaaccctctctctagccccatagcttaacagtcaaacacaccaagttctataaaataaaaattaaaacacctacctcatatgttgagataatttaggataatgtatatgaagcacctagttcagagcctggcacacagtaggcacttaataagtggtggcagttagtatttcttccaagttaacaattcatagccagaactttggcttttgtattttgacaccaatgaaaacacgaatcatgtagacagaatcctgattcatggctctgggctctaggtaaaactcaaaactttaatggacaccctagggtgttactcaacacagtatgaaaggctactgaaggaagaagtgtctgctggtcagtagcaaagatccttttgggacagttaatctccttttaaaggctctaagtcccagtggcttctcagctgtcctaagaagataaggacaaggtcactaaggccactgtaatttagatccctggtctaaagtctcttgtaagttcagctagagtaataacatctttcaacaaatggtatccaggattaggggggatatctgagatgggggagtgatagatatgtccagtgtcttgattgtggtgatgctttcacaggtatacatatgtcaaggcttatcaaattgtaggctttaaaaacaataaagctgttttaaaaaaaagtgtacttaagcccttcctggtaagatttccctctgttctctgactggatcaccttctgtgatcttagtttggggttagaggaggaaggatgtgtgtgtgtgtgtgtgtgtgtgtgtagacggagtctcgctctgtcacccagggtggagtgcagtggcatgatctcggctcactgcaacctccgcctcccgggttcaagcaattctcctgcctcagcctcccgagtagctgggactacaggcacatgccaccacgcccggctaatttttgtattttagtagagatggggtttcaccatgttggccaggctggtcttgaactcctgacctcaggtgatccgcccatctcggcctcccaaaatgttgggattacaggcgtgagccactgcgcccagctggaaggattattattattattattattattattattatttattattattatttttgagatggagtcttgctctgtcacccaggctggagtgcagtggtgcggtctcagttcactgccagctccgcctccctggttcatgccattctcctgcctcagcctcccgagtagctgggacccgccaccacacccagctaattttttgtatttttagtagagacggggtttcaccatgtttcaccatgttagccagggcggtctcgatctcctgacctcgtgatccgcccgcctcggcctcccaaagtgctgggattacaggcgtgagccactgtgcccggcctggaaggattattaatgcaaacttcaggatgaagtgatatcccaggcaaggcctgaaggtctcagtggtattaatacattagtaagcagagttctaagaaggcttcctctctattattgtagctgctttggcacagaaaattgtgactgtaacttacagggtttgagctaaaatgacccctagtaagaagacatcagaaagaatagcatctacaaaaataggagtggggaaaggtgactctggaagaggagaccaaaagtgaaaacatttctctgccaaagtcacctgcagttcaataccagatttgattgttaagaaacggtcatcctaaagacaagaacttgattccactcaggagctctggagagaaggtccatgtctgttcctggaggtctagtagatcctgcgtgttgtgtagtccagaaccatgctggcagcacccagcagggcggggtcaaccaaatccgaaaccaccacatccacgtcctgcacggaggacaaggcctgctggcgaatgacgtctttgacaatgtggatatagtgactggccaggactccggagaggatcacaagggagggattcatggtatggaggatgttcacaaccccaagacccaaagctgttccagctatagggagacaaaaattaaaatgagtttctgagagaagccaaaatcaaaataccaaagaggaaggcagaaaagagccagcagcagaaatgttaaagaacatccacggcatgcagtgggaggcagtgttttaaaagcagttcacggttgattcttaatatgagaaaatgatcatgtgacagcctcaagtggaaaaagccgggtgtaccacatgatctccactaggcaaaaaaatgaatagaaagactcgaaggaaatgttaatagttgatacctccaaatgggaaaactaagtgatattttttcttacaactgtcctatatttctctaaatttcctgtaaaatgaaaggagcatttttatagttgtcaaaccaaaccaaccacctgctgaaaaaggcaatgctgccaaataccttgaatccaattccctttttacctctgagtaattaggaaagaaacctctgaacagacactgcaaagcacctgtccctagggaagcagggtctcttctggggccgggctgggccatatgatatctgaggccaccccctgcagcacagccacctgcagccacatgctcacctgttcttaggatgctctgggccttcgcattgccaagtttcgcagcttggatgagatggagcgcacccacagcctcatcttttggcactgacatcccttccaccaagagcaggtcctctgaacagagtgagaaggaaaagcagtcactaatgagctgtggggaggccaagctcaccactgggcctgtggaaagcaagcccctacatgggaagacggtgttttcttttcacaattgcaaagcttatcgttcacaaacatctctatacactgcccctaaagcctttgctaccctcttgctaattggttgtacataacccagaacctatcttcctggaaaaacctcaagtctgacgacagcctcctacccctctggctccctcacttctcacttccagtagcagacagtctttgaagtgttcttttctccaaattatcaccctcctcccacattcactccttccttactcatcccagacacaatgctgtgccatctgccagcgccacgcgttctatggcagcgaggcacagtggctgaggaacagacacaggcctggggtcagtgccagctctgccactcccagctgcatgaccccatgcctgtcacctcacctgtacacattcctccttcctagaagatgagaccagtagtgcctcccctggcagggttatttgaggaacggaatgagatcatggacataaagtatttagttaagtgctggccacagtaaatgctcagtaagcagcaggtatttctgtggttatctgtagtccttgtcttctgcccgtcaccaactcagatcaatctgcctcctactaatctgctagaatatctggaccctgaaggagaaaaatccccagctgtgcaaactgcaacctagacatcaactggtggtctcctgtctcccctgggccctcacagctctcacccattctctctgactgcgcttttctataccttcaccaccttcccagtccttctacccccactgccaacagacgagcatacttcttacctctctcatagggggcaccaccaggcagtgatcccctacctttttgcttcctgtcccatacacccatcatctcggctcgccatgccctctcgtggaccctctgcctggctttgcagctcatctcttcccacctcttcagaaccctactgtagggctctatacacttctctcctgcactctcggcctccactccccatctcttttccttcagcatatgctcacaaattggttttgggggccaaaaatctacactgtttttatgtatgaagcacagatatactacacatacagtgcatgtatgtgtgatatatacataacatgttttgtccatttatttcttcattaaaatgtgtattaagtaccctccctgtgatactggctgagaaaacaaaactgaaggaaatcttccctgctgtcttggaactctagacctctgtccaccaccacccctggggaggaagagtggcaatatgggtcagccaagaagactgtgcagttttagtgcgagggagccctgctctttccctaagaagtgaaaagggggaaacttctggcttcagtgttcagctgtctttggaatttccactttgaagtacttgtctactatttggttacttaattcctcgagagagggacaccaaccatcatggagcttttttgcctccctctgcaaggccattccagaggcgtatgcttcaatgcacccatggcttccacaggaacaatcaggcccatccagagacacaacaaggtggcccagttctgcagcacagaaggagcttccgtggatcaattcatgctgatggataattccaccaccgattcctacagcgagggatagaaatcactgagggtgctttacctgaaacagaaaactatgatatcacaacgcctcatctatttagcagagctttggcatgtgagggtctatagatacttctttagacagctgaagcccactaggcatcaaagcattctctggcagcattttggatggaaatgtttttagcagatcctctgatgccctgtgacccatctgcttgggtcactgtgatttcaaacacagctgtggggacagtgcagcaaaaatgcatgcccaccttgtgggtagcagaccccctggcccagcacacactgtccatctttctgcaccaaggctttctctaacactgaagcaagagcctactcagccacgcaggcacagcacccaggggcaacctgcaaccgaggcaaggcaggagccggcagatccacaggacaattctggatgctgttctgcaggcttcttaggaggtgctagtggagttcagccccctttgccctcaagtcaacttcaataatgttaatatatccttaatggctttcttcctgctctgtttcattcttcccactcaccctcctgcttcttgtggtcacctccaaaaaaccatacctgtacctaaatccttgtctcaggctctgctctgaggaatacccaagataagtcttttaaaatgtatcacacactacctgcttcctgaagcagaaaatatgaaataatgattttgccttttttgatgctgccatgtctaaaaatctgtgattcaataattataaatatcagtgactgtcttttgttatggcgtttagcagttacaaaggagtaaagggtattgtgcctgagaaggctctgcttttaagggttgtcttgccatctgtcacttcttgggcacttattcctcaacccctagccctctgatttacagcttagtcactgctctgagccaggaaatggtatccaagtttgctaaaactgtgtctggaactaaaagaggatgagcatgagctaaagtacatgagcttaggctgggtgtggtggctcacccctgtaatcccagcactttgggaggctgaggcgggcagatcacctgaagccagaagttcaagaccagcctgaccaacgtggtgaaaccttgtctctactaaaaatacagaaattagccgggtgtggtggcacattcctgtaatctcagccatttgggaggctgaggcaggggaatcacttgaatctgggaggcagtgagctgagattgtgcgactgcactccagcctgggtgacagagtgagactcactctttaaataaataaataaataagtacatgagcttaaagggatagtggtgtaatgtagagtttaagcacatacaagttttgaagttagacatatctgtatcagatgctggcttaaccgcttattagctaagtctgtttcctcatttaaaaatcaagttatacacttaaaatatatacaacaaaaataaaatagagtaaaaaaacaaaagtaacaaattgggatgtcataaaaaaatgacagagcagggaactccaaaggtccattctgccactaaagtgaggaaaaaactggtaaaaatgtcagaatcaacctttttggaactctggaaactaaccaaagtttgcaacaaacagaggaatgcttaatttaaaaaagaaaaacaaaaaccagggccaggtgcagtgggtcatgcctgtaatcccagcactttgggagaccaaggcaggaggatccctcgagcccagcagtttaagaccagcctgggcaacatggtgagaccctgtctaaaaacaaaacaaaaccagctgaatcttgataagagaactttctggtgttgtaacctaccctggtcccatcacccactctccagcttggtggtgaccttgaacaacagtccacactcccagtactggtgtacagaaacagtactggataccagtacctgacggggcaggacgaacttattttcaaaaaattgtggttgtttgttttgacctgcctgtcacctccctggaggaccacctcaaagggcctgctttcatcttaactaactaggaactatcctagtgctgagggggttacatgaaggatgtttatcaaaaacatttcggccgggcgcggtggctcacgcctgtaatcccagcactttgggaggccgaggcgggcggatcacgaggtcaggagatcgagaccatcccggctaaaacggtgaaaccccgtctctactaaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaacatttcaaggtaaaatgtattagtctgtgctgtctagggcaaaggataacagctggggcatccaacacactaaccaaaaagactgggaggaaaagctgggaaatgagaagctctgggaaataagagctttgaatagctctgacaagttcctggaatttagaaggccacaggcatgtctaaggctgggcacatgctcagaaaaggccacatgtggctcaccttcaggctctagtcatgcaggaagtgaaggctaaggcagagttgtaaccacctgaccatgttgaagacatgctccaatatacattctagctcctgaaccaacctccccctacccctcttacctgtgcctgtgataagtgtaacaaagttttccagtccctttccttggccaaatttcctttccgccagggcagcacagttgccatcattgtctacccacacagggagatgcaaagtgtcagaaaggggggtcctaaggtccacagagttccactcttggatcagtttggttgaatgcagcacaattccttcccgaggatttacacggccacctgtggaaatgcctgcgctccaccacaaacacaaggaaataatgctgatgagcaatctcaggaaagtatgctgactttcttgtcttaagaacacagattcattcaccccagatctcctaagacaaacgttaccaaggactgcaaggaaatattagacagttgtgaattaaagccatagcaccttaaagatttctagaactgtcagtgcttctctcctaatgcttgttggtgtcccaggaagtccccatgcttggggcccacagacagcacctagagccatctatgcacagggcagacactgacttgatgctcaggcatgcatcacaagttagtaaattttgtacattaaaatgagcatttcttggatttataatttacaatcttacctactcccaaaattctgcagttcagttttacagcttctgctgcagcttccacacacatctgtaggattaaattaatcctctcttcataggttttaggattgaactgagtatacttcttaactatttcaccctaaaagagaaaacaacaagttccgtcttactggtcttagctaagcagcatattgtgagtgttgtgatctttttcatgacaaattagacactgctataggatggccccgcagtcttagatgactgcttggggaaggacccactgcctggtctgggccagccctggggtaagctcaagtagttcctgtaatctgtcctaatatggggctgttgaagcaatgacaactccacaggcagcaagatgggcccctctcttttttttttttttgagatggcctctcgctctgttgcccaggctggagcgctatggcgcgatctcagctcactgcaacctccacctcccaggttcaggcgattctccttcctcagcttcccaggtagctgggattacaggtgcctgccaccacgcccggctaatttttgtatttttagtagagatggggtttcaccatgctgcccaggctggtctcaaactcctgacctcaagcaatccgcctgcctcggcctcccaaagtgctgggattacaggcgtgagccactgcccccggccgggcccctttcttaagcttaagttcaatgttcgctaatttgagcctagttcattaaaagaccatagtttactctttcaggttgacaaaactttcttgcttactgaggtgaccgggcatagtggctcacgcctgtaatcccggcactttgggaggccaaggcgggagaatcgcttgggcccaggagtttaaaaccagcctgggaggtacagtgagacctcctctctacaaaaaattagccaggcatgttggcacatgcctgtagtcccaactacttgggaggctaagctgggaggatttcttgagcctgggaagttcaggctgcggtgagctgagatcacgccactgcactccagcctgggcaacagagtgagaccctttctcaaaaacaaaaacaaaaaaacactgaggcaactaagtagctgagctttaatcatctcctgtaactgaattcagtgatggtctggatactctatttccttagggtaaatttccatcctggctggcagaaataccacattgtttaaattattatatggccggccgtggtggctcacgcctgtaatcccagcactttgagaggccgaggcaggtagatcactttgacctcaggagttcaagaccagcctgcgcaataagaggaaatcccatctctataaaaaatacaaaaattagctgggcgtggtggcacacgcctgtagtctcagctacttgagaggctgaggctggagaatcgcttgaacccaggaagcagaggttgcagtaagccgagatcataccactgcactccagtctgggcgacagagtgaaaccctgtctcaaaaaaataaaacacattactgtgctttttgatatgttttaataccaaacagggatagtccctcctgattacttgtctttatcttttttctttgcacaactgacttttgtacttttaatgttaaactttgagaaattccactgtgatttacaataattttactaaatgtaaaacaaataccattgaaatatttactagattatgttgatcttataaatcaaattgggaaaacactgacatcttaaaaataatcagcacttccatccagggcatttttttcaagactttatgtcttacagtaaagttttagaattttctttatatagattacatcgttcctggtttcagttattcttaggagtttttgttgttgttctgaataagatctctctttccatttatattattttgttattagtggatttttatatctcaaatatagggttagagctgtcactaggattgtcattaaaaataaatctaggtcaggcacggtcgctcacacctgtaatcccagcactttgggaggtcgaggctggcagatcccttgagcccaggagttcaagaccagcctgggcaacatggtgaaccactgtctctacaaaaaatacaaaaattagccaggcatgctggcataagcctgtagtcccatctactcaggaggctgaagcacaaaaatcacttgagcccgggaggcagaggttgcagtgagccgagatcacgccactgcactccagcctgggcgacagagcaagactcagtctcaaaaaacaaaaatacatctagagctgggcacagtggcatgtgcctgtggtcctagctattatacttgggaggctgaggcagaggaccatttaagcccaggaccttgagtccagtctgggaaacataggaagaccttgtctctaaaaaaaaatttttttaaattaagagaataaaaaatctagagtagtgcttctcaatcttcgctgtgcatcagaatcacctggacagcttttaacgaagagcgatgcctggcccccatccccagagactctaatttaaccagtccagggtgggagccaagcatttttttgtctattaataatgttttttgttttaccctatcaataatctccatttttgctattccttcctttattccctcataacttccaaaattatgtgagataatgctgcacaaaacatctttcttttcttcttgatttcaatgggaatgcctctagaatttcaccattgaaaaagatgttggcctttcatatggaataaatcatctttctgttaagaaactattcttctattagtttttgttttgttttttgagatggagtctcactctgttgcccaggctggagtgcagtggtgcgatcttggctcactgtaatctccacctcctgggttcaagcgattctcctgcctcagcctcccaagtagctgggattacaggtgcctgccaccatgcccagctaattttttttttttttttgtatttttagtagaaacagggtttcaccatgttgtccaagctggtctgaaactcctgaccttaagtgatctgcccacctggacttcccaaagtgctgggattacaggcgtaagccactgcatccagccttctattagtttttaaaagagtatttataagggaggcctcttggcttttcttgagaaaattatgttttgttttgctttccttatttgacctaatggtattaataaatttcctacaactttacatttaaaatctttgctatttctcatcgtctctggaagctttatacactcacactatttcaaaccaagatttttctagtaggtttattctaagtcattagagatcactttaacatgaacagtttgttatttttatgaatgttctctcacctgtcaacactgggtgatggtttggttaacagattgaaggtatgctgtactcaataaagagcagaactgtaaaaatgcaaaatggaaaatccacacaactgatcacattctagagaagaggcagctcccttcaccatttgctgatacccctcacctgggcagtgatagtaatcagcatactccacactccaagctgttaccaagtatagaatttcaggtcttttgggtggcaaaagcccgatctgatgcctaaaggggtcttcccactgtcaagtctaccgtcttggattcccaaagaatttacttctttgaaatgttaatgatcagtaaaatagtgagacaaacattgtaaaggatccacaagtcaatactatcagcaaatgattacaagctcttgtgtatgtttctagtcttaccttccaactatatatacttaaaaaaaaaatcaatcgctcatatgggatataaagttaggagtttaggagttattttaccttcatgctgactattgcaactcggaggttcgtcccgccaagatcaacggccaaggcacttagagtttcaagaatatggtcaatatcttgagagatattctccttcacaggaggaaagcagaatttcttttgcagtggctcttgaagatcgatagatttgagaaacttcaaaatccttggaacagcatttccatccccatatatctttgaactgcaatatacaaaaagtcaattaaattatatgcttctgccatacatgttaagtggtagtgagggtataatgtaatggaaactgagacttcaggtaaaaataattcatgcttcttcctaaagtgacatcttcctgccgtgcacagtggctcacacctgtaatcccagcactttggggggctgaggcaggaagattgcttgagcccaagagtttgagaccagcctgggcaacacagacatagcaactctatctctacaaaaagtaattttaaaaatcatgtttaaagaaataaataggctgggtgcagtggctcatacctgtaatcctagcactttgggaggtcgaggctggcggatcacctgaagtcaggagttcaagatcagcctggccaacacggtgaaaccccatctctactaaaaacacaaaaattagccaggcgttgtgggtgcctgtaatcccagctactcaggaggttgaggcaggagaactgcttgaacccgggaagcggaggttgcagtgagtcgagatcgcaccactgcactccagcctggatgacagagcaagactccgtctcaaaaaaaaaaaaaaaaaaacaaccaacaataacaaaaaagaaataaaataacatctccacaagatatacatacttcagaacatcatgttgtacacaataaatacatacaattttatctgtcaattaaaagttaaaaactataaatcataattatacagaactaaaaaaattttatataaaataatatctagatctcttcagcaacattgtaactaagtgcctgtatttttttgctttttttagtttttatctttatatttctgagaaaacaaaattattttcagaaagaaatattcaaatacagggaaatctcatcgatttgaaacagaaaggagggtggtcaaaattaattaaaaagctgaactagactttttaaaaaaaatcagttacattattttctaatatttatagaaagccaaagaaggttaaataagtgtagcaaaagtgttgtattaattaagagaaacaaataaaataaggctgggcgcagtgactcacacctgtaatcccagcgctttgggaggctgaggcaggcggatcacctgaggtcaggagttttgagaccagcttgcccaacatggtgaaaccccatctctactaaaaatacaaaaattagccaggcgtggtggtgcgcacctgtaatcccagctacttgggaggctgagacaggagaattgcttgaacccaggaggcggaggttgcagtgagctgagatggcgccactgcactctatcctgggcaacagatcaagagtccatctcaaaaaaaaaaaaaaaaaaaagaaataaaatatgtattctacattggaacctttggaacagtaataatgggtatgatattagcaatccctgtctccccagcaactaggggcccgtaggcataagaaggaaagctctgttaggatgattaaacagtgattgtagctttaaaatggtactgaaggtagctccccttttaaatcactcaacaaagaatgttttatactcaccaagggtactgtttaccaaactgaaggtgcagtgcttgcaatattttgtcttgggtgtcagcatcccggacatgaagaacattctcccctaggtaaaaccagtgacacattacaaggatttggaagtgggaatatccaaagaataaagaaattatcagtgtactatgctcataattagacctgaaatccagctgacttcaggttaagtcttttgttagggaaaattcaacttttctactttataccttttaaagtactcttggcaagatttcagtacatcaaacacttaagggccctagggtcctttattcccaaggagaacaaatcaagtttttgtttattaaaataaataaggtagaccaacctggcatccacttaccatttgcctagtcatctatgagattcactctctttcaacctgccctgccttccatctactcagccagtggttcacttggctggtcaggcagtcactttccctccagacatttcctgaccaatatgagggagtaaatctagcgaaaatggccacactgttcaatgggtttggctaagaagagaagagtggacgagtaacatctggagagaggtgtggggtcaagaaaggagttgttttgtgttgtttgtttttaagatgtgagaggcttaggcatgtttaaatgatgaggaggttaaataaagaaggatgagaaaagatcactcatggataggtccctgagaaggcaggagtggttgggattgaaaacacaggtagaaggatgggcagtagacaggcaggagagacacccacacccacacccatgcccacaccctgctataaaaaaggtaagaaggaaaggatggatgggcatgcacatttatatacgtttatttaagtgtagtggcaaaaagtacagagaccatgttggcatatggttcaattctcctttcacttttttttttttgagacaaagtcttgctctgttgcccaggctgaagtgcagtggcacaatctcagctcactgcaacctctacctcccaggttcaaacgattctcctgcctcagcctcctgagtagctgggattgcaggcgtgtaccaccacgcttggctaatttttgtatttttagagatggcgtttcaccatgttagccaggctggcttgaactcctgacctcaagtgatccacctgccttggcctcccaaagtgctaggattacaggcgtgagccactgtgcatggctgtcctttcacatcttaaatgaactcagcagtatccaccaccccatccttaaaacattttattttgggggctttatagatagcacactctccttgtttccctccaacctcactggtgttcctcttcagtcttccttgctggcccttccctcttcaccagaactctaaagattgaagggctccagaggttggtcctgggctccattctctgccctatttacaagtctttttttttttgagacggagtcttgctctgtcaccctggctggagtgtagtggcacgatcatagctcactgtaacaaactcctgggctcaagtgatcctcccgcctcagcctcctgagtaactaggaccacaggcgcatgctaccaggtccacctaattttaaaatttttttgtagagagaaaatatcactatctttttttttttttttttgagacggagtctcgctctgttgcccaggctggagtgcagtggcgcgatcttggctcactgcaagttccgcctcctgggttcacgctaaaatttttttgcagagataaaatatcactatcttgacccaagctagggtcgaactcccagcctcaagcaatcatcccaccttggcctcccaaagcactgggattataggtgttgagccaccacacctggcctgggttttaaatactatctatggctggtgccattatcttcaatatcttttcttcatactagaaacagaatttttagccaggcatctgatccccagccaaagattatattctggctggtgtttacaactaattgatcacaaccagttcctcctcccccagcactgcttcactaaaaaaaaaaaaaaaaaagaaagaaagagagagagagaaagagaaagaaagaaagacaatgaaagaaggaaggaaggaaggaaaagaaagaaggaaagaaaacaaacaaaacacagactgggcacaatggctcacatccataattccaggactttgtgaggccaaggtaggaaggatcacttgagaccaggagtttaagacaagcctggacaacaaagcaagaccctgtctctacaaaacattttgtaaaaacattagccaggcatggctgaggaggctaaagtgagaggataacttgagcccaggaattcaaggttacgatgagctatgaatacaccactgcactccagcctgagcaacagaacagtatcatttcagacaaaaacaaaacaaacaaacaaacaaaaaagactatattcttcagcttgccttgcagccagatgtggccatgtgactaagttctgatggatgtgagaagaaagatttgcaactttcaggtcttgcctttaaagtgaaaggcatcttctcttttccttcttccaaaggctaaaacagagacttgcaagcaatagctagagcaaccactaagaaaatagatgggggctaagtctgatgattgtggagctgccatccactgagaaagaaagaacatttaacttatttcagccactattatttagggtctctgttatagcagccaaactgacaaccaattatgcatcatctctataccaatgactctcaaatttctatctccaactctaactcttcctggaactatctagctgtttactagccatgtctgctttgatatctaataggcatctcaaacttcacatagctataagagaactcttaattcaatccctccccaaatctgttcctccctcagtgtccccatatcgctgcccaatcagaaatctaggctgtaatggaaaagtgtgtatcattaaaggaaaaagaactggactagaaccaaggagattagttctagctctgctctttctccaattcttcataattgccacctttctgttatatttacatcttcttcccttctcattcccagcatatcactgcccaatcagaaatctaggcttccttgttgattcctttcacctccgcatccaagcatcagcaagtactataacaagacccaaatctaacttttttccatctctaatacttcatcaaagccactatcatctctcatctgagcaactgaatcagcccccttactggtctccctgcttttattcttgcccccccgccccccctcccgacattccattctgtatattagcaaccggagtgatctttccaaaatgcaactcttgtcatgtcattccttcccattacacttagaaaaaattccaaatgacttaccctggcttacatgcatctgtttccttctctaacatcacctgtatcactctgcctcttgctcactactctacagccacaatagcgcttccatttctcaaatacaccaagttcacctcccggccctcacactggctgttgccactgcctctccctgatcctcacatagctgactccttgtcattcagatttcagcttaggtgtcatctccttaaagaggccttcctttaaccaatctaatggagtccatcatataccttgtgttacagcaggcacagcatatagaattcctgatatttttcttatttcttttgtgtatgtctatcatctatctcctctcccactagaatgtaagttacacgagagcccagctcttcttggtctagtttattgccaaatcccagtgcctagtacatggtaggtgtttactaaatattttctaaataaatgaattgaggaatttgaaagaatttccatctcatggcttccattttctctatgaagtggggagtaaagtaatatgctgggaatgagaagggaagaagatctaaatataacagaaaggtggcaattatgaagaactggagaaagagcagagctagaactcatctccttggttctagtccagttctttttcctttaatgatacacacttttccattacagcttccattaaattccactgcatgtaaacaggattagaacttgaactaatgttaataacaggacctagctcagttagcaaattcattaataataatcctacttatacttaaggggcactttacttagaactaccatactctaaagtactgactgaagggattctacattaggcccagaaaataaaagactagcattcatatattcatgaaacattcaaccacattctctcttaaacacagccatgaaagaccataattaaaaaccacttaggctgggcgcggtggctcacgcctgtaatcccagcactttgggaggccgaggtgggcggatcacgaggtcaggagattgagaccatcctggctaacaaagtgaaaccccgtctctactaaaaaatacaaaaaattagccgggcttggtggctgacgcctgtagtcccagctacttgggagcctgaggcaggagaatggcgtgaacctgggaggcggagcttgcagtgagccgagatcacgctactgcaccccagcctgggcgacagagcgagactccatctcaaaaaaaaaaaaagaaagaaccacttagtgctaattgatattacaaagacaataaaatgtaagtagagatctaaaatatttggtaatcactgtgtgctatttatcgactatagattttaggcttcaactggttattaacctcattcactcacttgttcacaaaatatatgctcagtactgatatatgcataccttataacaactcacgtatgtataaagcctagtcagttgaagtatgagcaaaggtaaatacctgtttctcttccaatctgacgtgttcccaggttgatcacaggtgttccaaaagctccaacttctcgaaccccacagctgctgttcccaatcatacagccagcatgggcaaccaactgtataaactggtcaaatgggacgtgtttaactgcacgaaagttgggatgatgctcaatgcccttcttccgcatcactcgaaccatctctttgctccctatgaaaatgaaaagaaccaattggtaaatggtttgtgagataaagaaaccattttcattggcaagtatagcccacgtaaagaaatctccctaaaaaaacctcacatcagttattagggaaatagtaattttaactactggctttttcatgaatgatggatatctaaaatgtcctctgcttcactcatctaggaactcaaaaagcagcagttgggacttttcaaacagaactaggcaaagcaaataacttttatcaatgccctagtaaaagcctttaccttaaacaacaattaagaggctaaagacaggccaacagcctgtatctcttaacctgagagttcccaaatggaaccctctcaggctccacacaccaagctgatgagagagcctctgcccagctacactcacctttacactaacaagaactcggtgggatagcactcccatttatatgaactaaactccaagaaaatacacatagattctgataactgtggcttctattttaactgcatgacttaataaaaatttaaagatacatgaaggggaggcaatatttaatgtccctctgcttgcctctcaactgaccccctcctaactaccccatacctagggaggaaaattgctaacctgactggttagaaggcagaggtctgaccacaccatgcttaccactgggcaggtgccactcatttaaccaaagctgtgcatgcatggttctcaatttttttaacttttattgtgttgcaaggtaggtaaatggactcagggtctaattccctggagaaggcctggccacttctctctatatacagtcttgccagagcatcatctgtaattattgtacaggttgagcatcccttattcgacatggttgggaccagaaatattttgggtttcaagtttttttggattttgaaatatttgttattctgtaatacttaccagatcagcatccccaatctgaacatccaaaatccaactgctccaataaacgcttcctttgagcgtcatattggtgctcaaaaagtttgagattttggagcatttcagattccagattttttgattagggatactcaaactgtagtacatggcacaccagaaggcaccactactattccaagattcaggtttcgattcagttgaaagcccctctttggcttaaggcttcgataatccattttccggagggagtcctgtactggggaacagggcactaagccagataatgataaagtgatgccttgattcttattttcctattgttccctgtgtatagcttatcaaaaaccctgtggagggtagaggcaagtggcagccatgacttagatatacctgggaccctttactttcatagaaaaaaaatacctctaattctaaagtatatacagccaggaaagtgtattataaacagaatatatcattgacaatgaatgctgaacgagaatgatacatagttacattacacatatttataaaaaatttaaaggtcagaaaagaataaatattaacatttttgaaatattgatacattacctggaaaaaatctgggttgggtattcttaaatttttttccaactaatatcctactttgttctccctaacagaaaagattcttcaagggaatactaagacaggggttctttcagagtaagttggtgatatcttgacattgcagagaatgggttctgcctcctttaccaaaaaaaagcctaagaactcaacaatgagtggtgtcagctaaagataaccagtgtttggaaattcttcagtgttaggctatgttctgacatttctcattaatatctcacacccccattaactcgcctaaggtctcagcagtaccaaaatctatagtaccatccactggtaagcaagtgatcagccagggcaggcttgaggatgaaccggttgggactggctggggactccagatttaaactgcttcagctcaagattactttaaggtatagctaacataaatatgaaagaaagcaagaaaaaatattagtggctattttactgtggatagtggaatcactacttttctagagattctttcacttcaacttttttttttttgagatggagtctcactctgtcactgagactagtgtgcagtggcatgatctcggctcactgcaacctccaccttccaggttcaagtgattctcctgcctcagcctcctgaatagctgggactacaggtgcccaccactgtggctggctaattattgtattttagcagagacagggtttcaccatcttggccaggctggtctcgaactcctgacctcaagtgttctgcctgcctcggcctcccaaagtgctgggattacaggcatgagccaccgtgcccgaccatctttcacttcaacttctaagatttatgtctcttggcttctgcagtttcttaactggtggaaactggagggaaaatattagtactaaacatgagactaaagtagacagtagacagactttttattattaagtttctactggacttggcaaaaacattacaaactttttgagttatagcaaaattggtaatcctttgaaaattggaatgcatttcagaatagagtgcccttcaatgataagatgagcaagataggaaggcagttaaaagaagtaatagaaacataaaattgggaaaagtaggtggcataatttcattttcaagttcaattacctgcgtcaatatttggaaacaggactagggtccgcttgttaaatgagataagtgcatccaatgttaattcaaacatttttatggaatgcttaatgtcagtggtcacagggtgctgtagtgcaacaatgtaatctttagattttacatcatcacctgtttaaagaaaatcaaaccacattgcttcattagttaagaatcttaaaagagaaagaagcaaattctgaaagcaagactctaagtctgtgcttttaaaaattctacgatagaaacagtttgtcaaattgtgaacagggcatccaaattagagtcaaatgataagaatttacagcaacaaatccaagtattcagcaaacttaacattttacaaagacatgctgccacaaacataactttaaatagcaggcactagaaattcactgttttaaaacccaaactattccaaagcactcaaaaaatgtgactcttcccaatttctaactaatgtttttagtgaatattcagcaatatcaatgaataataatatgttgcatatcagggcattttgaggctgaacaagcattaaacatatttcctagaatgcacaggagctttcctgtactatcacctaccagattcaacaagtggcaagtgtttctaactctgttaaaggactaggagagtttcgctcatccctaggctgggatcccaaggacggttcctcagcaaaaatttaaaaggtaaaaagtttagattgacagtgctatgtcaaacaacgcaaggtatttaccaatagggcctatattatcccataaaactgaaagtgagctccacttacttttttttttaattaagtttatttatttttccataagttattggggtattaggtggtatttggttacatgagttagttctttggtggtgatttgtgagattttggtgcacccatcacctgagcagtatactctgtaccatatttgtagtcttctatccctcgccccctcctactcttccccccaagtccccaaagtccactgtatcattcttaggcctttgcatcctcatagcttagcttccacatatcagtgagagcatacaatgtttggttttccattcctgagttacttcacttagaataatagtgtccagtctcatctaggtcactgcaaatgctgttaattcattcctttttatggctgcatagtattccatcatagatacagatatagatgtagatatatagatgtagatatatatagatacacacacacacatagatatatagatgtagatataaatagatatatatagatacacacacacacacacacacacatatatatacacaccaccgtttctttatccaatcattgattaatgggcatttggttggttccatgactttgcaattgtgaattgtgctgctataaacatgcgtgtgcaagtatctttttcaaataatgacttcttttcctctgggtagatacccagtagtggaattgctggatcaaatggtagttttccatagcggctgtactagtttacattcacaccagcagtgtagaagtgttcctgatcaccacatccacgccagcatctactgttttttgattttttgattatggccattcttacaggagtaaggcggcatcgcattatggttttgatttgcatttccctgatcattagtgatgttcagcattttttcatatgtttgttggccatttgtatattttcttttgagaattgtctattcatgtccttagcccacttttttatgggactttttcttactgatttgtttgagttcattgtagattctggatattagtcttttgtcagatgtatagattgtgaagattttctcccactctgtggttgtctgtttactctgctattccttttgctgtgcaaaagctctttagtttaattaggtccaggctatttatctttgttttatcgtatttgcttttgggttcttggtcatgaaatccttgcctaagccaatgtctagaaggggttttcccatgtaatcttctagaatttttatagtttcagatcttaaagtccttaatccatcttgagttgatttttgtataaggtgagagatgaggatccagtttcattctcctacatgtggccagcgaattatcccagcaccatttgttgaaaaaggtgtccattccccactttatatttttgtttgatttgtcgaagatcagttggctgtaagtatttgggtttatttctgggttctctattctgttccattggtctatatgcctatttttgtaccagtaacatgctgttttggtgactatggccttatagtatagtttgaaatcaggtagtgtgatgcctccagatttgttctttttgcttactcttgctttggctatatgggctcttttttggttccacatgaattttagaattatttttttaattctgtgaagaataatggtggtattttgatggggattgcattgaatctgtagattgcttttggcagtatggtcattctcgcaatatcaactctacccatccatgagtatgggatgtgtttcgcagtatcagctctacccatccatgagcatgggatgtgtttccatttgttcatgttgtctatgatttctttctttctatctttctttctttttctctcttttttttttctttttgatgtagtctcactcttgttgctcaggctgcagtgcaatggtgcgatctcggctcactgcaacttccgcctcccaggttcaagcgattctcctgcctcggcctcccaagtatctgggactacaggtgcacatcaccatgcccagctaatttttgtatttttagtagagtcagggtttcaccatgttggccaggctagtctcaaactcctgaactcaaatgatctgcccgccttggcctcccaaattgctgggattacaggtgtgagccactgcacccagcctatgatttctttcagcagtgttttgtaatatcccttgtagaggtcttttgactccttggttaggtatattcctaagtattttattttattttatatttcattttattattttattttacttattttattttattttaatttaattttgcagctgttgtaataggggttgagttcttggtttgattctccgcttggtcgctgttggtgtatagaagagctactgatttgtgtacattaatcttgtatccagaaactttgctgaattcttttataagttctaggagctttctggaggtgtccttaggattttcaaggtaaataatcatattgtcagcaaagagtgacggtttgacttcctctttactgatttggatgcccttttcttctcttgtctgattgctctggctaagacttccagtaccatgttgaagaggagtggtgagagtgggcatccttgtcttgttccaattctcagagggaatgctttcaacttttccccattcagtattacattagctgtgggtttgtcatagatggcttttattacattaaggtatgtcccttgtatgctgattttgctgagagttttaatcataaagggatgctggattttgtttaatgctttttctgcatctactgaaatgatcatgtgatttttaattctgtttatgtggtccatcacatttactgacttgtatacattaaaccatccctgcatccctggtatgaaacccacttgatcatggaggattatctttttgatatgttgttggatttgattagctagtattttgttaaggattttagcatctatgttcatcaaggatattggcctgttgttttttttgttatgtcctttcctggttttggtattagggtcatgggggcttcacagaataaattagggagggttccttcttcctctatcttgtagaatagtgtcaaaaggattggtaccaattcttctttgaatgtctggtagaattctgctgtgaatccatctggtcatggaattttttttgttggtaatttttaaattaccatttccatcttgctgcttgttattgacctgttcagggtatgtaattcttcctgatttaagctagtagggttgtatttttccaggaatttgtccatctcttctaggttttctagtttatgtgtgtcaaggtgttcatagtagccttgaatgatcttttgtatttcagtagtgtcagttgtaatatctcctgtttcatttcttagtgaggttatttggattttctcccttcttttcttggttaatcttgccaatggtctaacagttttatttatcttttcaaagaaccagctttttgtttcatttacttttttttttttttaagacagagtctcactctgtcgcccaggttggagtgcagtggcacgatcttggctcactacaacctccaccttgtgggttcaagcaattctcctgcctcagcctcctgagtagctgggactacaggcctatgccactacgcctagctaatctttgtattttttagtagagatggggtttcaccatgttggccaggatggtctctatctcctgaccttgtgatctgcccgcctcggcctcccaaagtgctgggattacaggcgcgagccactgtgcccagcaacagtttctttatgaaagaaggatggcaaagtagcaaaaactagaagtctttttagaccagggaaaagtaaaacgcaagacaatgagccagagcaactcatccctggcaagaatacatttcatacaaagtttgcacctgcttctccacctggcacttctgatattattaccagtctttgtatctatccataattcagcagcctcagccctttcataaatcctttccataaaggcattttgttttctgttgtaaagtcctatatttactgtgatatgcctttcattattaggaatttaacatgcctttttaacattgctaattttaaaattaagattgttatatattaacactctggttacaaagctgcaatgttatatatggcctacccaaccctatcttcctgtaagcagagtgatagcatgagaagttccatattaaggccaggtgcggtagctcatgcctataatcccagcagtttggagggctgaggagggcggatcacctgaggtcaggagttcgagacgaacttggcgaacatgatgaagccccatctctactaaaaatacaaaaattagccaggtgtggtggtgtgcgcctgtagtcccagctactcaggaggctgaggcaggagtattgcttaaacctgggaggcagaggttgcagtgagtcgagactgcgctaatgcactccagcctaggtgacagaactccagccttggcaacagagcaagactctgtctcaaaaaaaagaaaaaaaaaaagaagttgcatatcaagaagcaggaacaggttttatataaaatgtattactgcccagtggtggatggctctgcctcattgtcttgagttttctttttcactggtttaaagaccaaaaaaaaaaaaagcaattttagctgttctgttgtccttctttccataaagaactgcttaaattgtcccaaataggactttaagccctacaagtacaattcaattttgctacattctgctttctaatggttatttgctgttttttgttttgagacggagtctcgctctgttgccagattggagtgcagtggcgcgatctcggctcactgcagcctccgcctcctgggtttcatgcaattcttctgcctcagcctcccaagtacctgggactacaggtgtgcgccaccatgctcagctaatttttgtatttttagtagagatggggtttcaccatgttggccaggatggtctcaatctcttgacctcatgatctgcccgccgtggcctcccaaagtgctgggattacaggtgtgagccaccgcatctggcctgggttttatgcttgtttttttttttttttttttttttgagatggagtctcgcttcttcacccaggctggagtgtggagtgcagtggtgcaatctcggctcacagcaacctccctgggttcaagcaattctcctgcctcagcctcctgagtagctgggagtacaggcatgtgccagcacacctggctaatttttgtatttttactagaaatggggtttcaccatgttggccaggctggtctccaactcctgacctcaagtgatccacctgcctgggcctcccaaagtgctagggtcacaggcatgagccactggcacctggccaaaactagtgttttgtttttttgagacagggtcttattctgtcaccgaggctggagtgcagtggcacaatcatggctcacttcagtcttgaactcccagactcaagcaatcctcccacttcagcctccggagtagctgggactacaggcacacaccatcacacccggctgatttttgtattttttgtaaagacagagtttcaccacgttgcccaggctgttctcaaacccctaggctcaagtgatctgcccactttggcctctcaaagtacagagattacaggcatgtgccaccacatctggcacattattattttctattcattacaagtttttcagtgatacaagttttccagaatacctagagagctaatggtataattagaacagaatccaagagtgtttcatcggaagcatactaaaaggagagactgaagagacagaaggttgttccaccagcattatctagacgatcccttgataattacaaatctgtccaagcataagaaatatttagaatgggccaggtgcggtggctcatgcctataaacccagcagtttgggaggccgaggcaggaggattgcttgagcctaggaattcatgactagcctgggcaaaatagtgagaccccatctctacaaaaaaattttaaaaattagctgggcatggtggtacatgcctgtagtcccagctactcaggaggctgaggtggtaggatcacttgagcccaggaggacaagactgcaccactgcactccagactgaacaacagaaatatgtagaatggagtacgttatatagcaggaaagcccaattcctttcctgatgtaatgtaatctagattaaaaatatacaaaatctctttgcttattcaattttctttttctttctgtgttttttttttgttattgttttttgtttttttttgttttgttttgtttgagacagggtcttactctgtcacccaggctagagtgcagcagtgtaatcacagatcactgtagcctcaactactcaggctcaagtgaccctcccatcccagcctcccaggtaactaggactacatgcacacagcaccacgcccagctaattttcttattttttgtagagacagcgtcttgctatgttgcccaggctggccttgtaactcctaggctcaagcaatactcccacttcagcctcccaaagtgctgggattacagggtgagccaccatacctgacccaaccaaatcaattttctgttcattaattttataattcaatagatctgcctcttagaaatgaaaggtcctaaatagattattagtcctaatttgtcccctaggtagtactcttactataaattaaccaactgacattctgtttgtaaacttggatttttttacctctgattagcaaaagataatttctaggaagctagagcactgaacaataaaaattttggaacatagggcttatttacaaagatatactctaaggctacaactatgacttttgctttttaataatcatcataatcccttatattaataagtacttatggcttactgcttccaacattcataatctgagtattccaacaattctataagaaaagcattaaaaataaaaatgagccaggcgcggtggctcatgcctgtaatctcagcactttgggaggccgaggtgggcggattatgaggtcaggagtttgagaccagcctgaccaacatagtgaaaccccgtctctactaaaaatacaaaaaaaaattagccaggtgtggtggtgtgcgcctgtaaccccagctactcaggaggctgaggcaggagaatcgcttgaacccgggaagtggaggttgcagtgagccgagactgagccactgcactacaggctaggcaacagagtaagactccatctcaaaaaaaaaaaaaaaatgaccattttgccaatgtagtaaaaaatttcagaaaatcaggccaggcacggtggctcacgcttgtaatcccagcactttgggaggctgaggtgggcggatcacctgaggtcaggagttcgagaccagcctggccaacatggaaaaaccctgtctttactaaaaatatgaaattagccaggcatagtaatcccagccactcgggaggttgaggcaggagaatcgcttgaacctgggaggtggaggttgcagtgagccgagattgtgccactgcactccaacctggatgacagagcaagactctgtctcaaaaaacaaaaaaaaaattcagaaaatcaaacataaaaacacccataatcccacaccagaaataaatataataaatgacttggtgtacatacttcctaaccattccattattacagtttttagtaaaatggcagattacagctgggtgcagtggctcacacctgtaatcccagcactttgggagcccaaggtgggcggatcacttgaggtcaggagttcgagaccagcctggccaacgtggtgaaattaaaaatagaaaaattagccggtcatggtggtccacgcttgcaatcccacatacttgggaggctgaggcaggagcatcacttgaacctgggaggcagaggatgcagtgagccaagatcacaccactgcactccagcctaggcaacagagcaagactccatctcaaaaaataaaataaataaaataaaatgaaatggcatattacacttataattttatagctcccccttttgacatattaggatcgttcttataactaatatatttaatggattaaaagcattccattctataaatatagcagagatttttaaaactcaatccactaagcctattttacagaaaaggtaaacctcagagaggtaaagtcataccacagggcaaggtctatgaactaaaaccttggccttctcattgctaacagagtattctatccataatagtttccaaaaggattgaaatagacggaacattttctgacaaaaacagccattagactgactaaagtctgagatacgtacctagccacatgcgaatgatgctcatgtagtctttgttcttggctgagagaagtttgtcataggaagggcagcctgccaaaaggatgcgatcatggtcctcacacatggatatcaggtgctgctctgcactgcgggtgcagcacacatgataatgagccagttttgttatggcatgtctgatagagtcatcaatggtcccactgacttccccaccttcaatgtgaaggattcggatgttcatcaaggcagcagatgtggccagagccagggcatcaaacctgtctccatgaacaatcatgatatcaggcttcaggcgattaaggacatctggcagcttcactagggccaggcctactgactccaccatggctgcctcatcttctcccctcacaattgtgtgtagcctggtgttaatgtcaaagtcatcttgttcaatcattcgatatgtatttctaaagccggggagaaataaagatataagaacatgttcttaaacacagagccgtaacatgcaagaaaagcaatctaacaccaactctgaagtgagaaacattaaaataaataaattgaagtataacttacaaacataaaaagcatagaccataagtgtaaacagcctgattaagattcttttttttttttttttttttttttttgagatgaagtcttgctctgttgcccaggctggagtgcagtagcgcgatctaggctcactgcaacttctgcctcccgggttcaagcgattctcctgcctcagcctcctgcgtagctgggattacaggcatgtaccaccacacccagctaatttttctatttttagtacagatggggttttgccatgttggccaggctggtcttgaactcctgacctcaggtgatccacccaccttgacctaccaaagtgctgggattacacgcgtgagcgactgcacccggccagagaatttttttattaggaagaaagagactaaacttttaacagtggtcagcactttttatatacacttaggggaaaatgttttttacccttttttttatttttttgagacagagtctcgctctgtcgcccaggctggggtgcagtggtgcgatcttgactcactgcaacctccacctcccaggttcaagcgattctcctgcctcagcctcccgagtagctgggactacaggcgtgtgccatcacgcccagctaatttttgtatttttagtagagacagggtttcaccatgttggccaggatggtctcaatctcttgacctcgtgatccgcccgcctcgtcctcccaaagtgctgggattacaggtgtgagccaccgtgcctggccaaaccttttttctttaagaaaacatttcatggtgaaaagtctctcacttttgtctcccagtcatccaattcttctcccaagaagcaaccaatttcttgtgttagaatgtaccttaaacatgcattttcattaagtactagtcaaatttcctatttaacggtctcatcagataaacactattcttccacccttggtaactgtggtaggcagataaaaaacctactaccatttccctgagagcctctcttccactagtcttcctgtcaaagctttctcagagcagtaaaagaacccactcaaactttcatctcaggctctagctaaaatttctgttctactgagaggatgctcctaaatagccagaattcattttatattaaaaaaaaatctggacggacgcagtggctcacacctgtaatcccagcactttgggaggcggaggcaggtggatcacctgaggttgggagtttgagaccagcctgaccaacatggagaaaccccgtctctactaaaaatacaaaattagccgggcatggtggcgcatgcctgtaatcccagctactcggaaggctaaggcaggagaatcacttgaacccgggaggtggaagttgcagtgagccgagatcacgccactgcactccagcctgggcaacaagagcaaaactccgtctcaaaaaaaaaaaaaaaaaaaaaaatctgtggatccctgagctatccattaagtttcttctctactctttaagtatttcctagtagcgaattcccaccttgtttttaaagaatagtctgaaaaggacaattttattttaacgcaaggttctttcagatacagtattgtatttgtgatcctctttggagactgcattaatatattcatgccacaagggtgcactaaatgactttttattacatacatcaagatgtatgtaatacgccttgttctctcagattattcaacctttgctttttttttttttgagacggagtctcactcttgttgcccaggctggagtgcagtggtgtgatctcagctcattgcaacctccgcctcccgggttcaagtgattctcctgcctcagcctcccgagtagctaggactacgggcatgcgccaccacaactggctaattttttttttttttgtatttttcgtagagatagggtttcaccatgttggccaggctggtctcaaattcctgacctcaggtgatccacccacctcagccccccagagtgctgggattataggcatgtgccaccgtgcccggcccaactttcactttttaaatgtagcctgtgattaataacaaacctaatgtcagcaaaataaatgtcaatggtgacagtaatgtaactctctactttaccttgcagattagatttttaaaatcttgttccatatctactactttatatgctgttggcctataaaccagttttaaagattgccattacagctcacaaaacagtttacatggaatcacattattatactcatacaatatgtatttataagtggcatttgtttgaatgtaacaactaataacaaacagtaatattatttatagctaccatttatcaatcatctactaagcggcatcattgtgatggatgctctatatcatgatctccattcctcacaataatttacaatataagttttcactacattatataatgaggaaactgaggctcagagatgctaagtgactactctaaggccacataaaaactaagcagcagaacaggaatttgaagctgggcccatatggctacaaaacccaagctccttctagcacactgttgcaatgaagaataagaaaatgctttcatcttacccatagtcatctatcaggtgagagccaagtaccacaacatcaagttcaaagaactcaggttcggttttaatgccaaacatgatcggggcaagtttagaataatctgcacggttacaagtagcaacacaaacccgcagctttcggttatttccattcttctccatgatttgcttgtttcgttttgagaggttcttaaaatagagttcctgaaattgccaaaataaaaactttataatcagaataactcctagatataactaaactttaaacttctctaaatcagaaatagaaattttcagtttcaagtccttaaccactatttagtacagtgattcttaatctttttttgcacctccacttatgtgtgactctcccattggtatatccagagttaagaaactccaaggctgggagtggtggcttacgcctgtaatcccagcactttgggaggccgaggtgggcagatcacgaggtcaggagatcaagaccatcctggctaacgtggtgaaaccccgtctctactaaaaaatacaaaaaaaaaaattagctgggcgtggtggcgggtacctgtagtcccagctactcgggaggttgaggcagaagaatggcgtgaacccaggaggcggagcttgcagtgagctgagatcgcaccaccacactccagcctgggtgacagagcgagactccatctcaaaaaaaaaaaaagaagaagaaactccagcaaactaactgtaacaccaccccatcctctcacactcaagaaaacacactggaatgccattaagaaggagtgatataaatcagctcttgtttaaaaggtgaggaaatatcagctctttattattaaaaattacttgccataactcacagatgagcccaacatagtaggttgttgcaaaatcagttgttgagaaccactgatctagttcaactccatcactttatagaaagggaaacacaggtcttgagagggaaaattactgccccaacattccagatcatgtctcataaggaacacaggctattcactctcacactatacacttcctaaatacaaggtattgtgattaatgctgggcaggagaaagatgagtaagataaaaacctgaccttcaagccctcattagtacctacacaccagtgccaacaaaactgacaactccaaatgcctatcagatatctcctgctgtatgtcctataaacaccttaaagtcagtgtcccaaactgaactcattttcttttcggaagctgttcctcctcaattgttctctgagttatgcaatttcattcatccaaatgccttcaaatccttgtcttttctgttcttcaccccatatctccaaaatgctgtcaattccaccccctaaatatctttcaaatctatctcctcctcttcatccatacaaggacttcccctagtccagtccctcattttaggtctggacgatcttaacagctgtcaagtggtttgcctgtctcctataaactttcttacttatttatttagagacaaagtctcactctgtcgcccaggttggagtgcagtggcacgagcttggctcactactacctccgcctcccagattcaagcaattctcctgcctcagcctcccgagtagctgggattataggtgcccaccaccatgcccagctaatttttgtatttttagtagagatggggttttgccatgttggccaggctggtcttgaactcctggcctcaagtgatccacccacctcggcctcccaaagtgctgggattacaggcaagagccattgcgcccggcctcctacaaactttcaaagtgatcttcctttccaccatctcttccctgcctaaaattacccttctctgtgccaaagtgccagccataccaaactgcctccagttcaactagtgaatctccgtatatctatacctttatagatgccacctactttttcctaaaacttcctttcctccttgctggtcttctactcatccttcaaaactccatctaagtgtcatcctttctggaaaggcttcacacaaacctcaggtcctcctcccccacgtttctcagttgctgcctcgctctgagcgttatggccctcccattcacagatatactgttgctcagctccactgctcgctcatccctccctgccatgctataccctccattcaaaaagtaaaatcaggggcaaggaataagagatttgttttatggaattttttaaaaagtttttacatttttggagatgggatcttgctatgttgcccaagctagagtgcagtagctattcacaagcacgatcatagctcattgcagcctggaactcctgggctcaagcaacccccccacctcagcctcctaagtagctggaactacaggcatacaccactgagccagacttggaacatgttaaacttctctaaatcaacataaaatttcacctcatggactctgatctcaatgttcatgtttcagtaagtgtatcaatatttagaacttgtaatcaggaatccagagacacttcagtaaggattccaattctaggggtgccatcctttagatgagggtaaactctgaaattcactggaaattccatcagtagccctctgctgttggtacctcaacactctcttaggctaaaattctgtgaccatgcaaacggtcccatcattaggtccactctgaatttataatccccagtaaaagctaatttcacccaatggcaaacacttacaatataacgaaacgggcattccaccaagagagttatattcagaagacccaagcactatctgatctttttttttttttttttgagacagagtcttgctctgccacccaggctggagtgcagtggtgcaatctcggctcactgcgacctccgcctcctgggttcaagcaattctcctgcctcagcctcccgagtagctgggattacatgcatgtgccaccatgctgggctaattttttctatttttagtagacatggggtttcaccatgctagccagactggtctcgaactcctgacctcatgatccacccgcctcggcctcccaaagtgctgggattacaggcatgagccaccgcacgtggccgcactatctaatctttaaagagacaaaaatattcttccaaaaatggttgtcgtaagtgttcttgtatataatccttcttccagtgatcaaatttgagctgaaaaaattgttggtaatatttaatttgctgaggcaaaacaaatcattcatggtttgtcaatttgtatttattttacaaagaacagtaaatgttccatctggcagtactaaaatgcttatttaccaggttactcaaaggttattctacctaaactgagagcaagctggccatataaataaatggtgaaaaatacaacaatgttacctagaaacctaaaaaaccttaaaaagtcaaagctttttcaaggaaagaagttaaatcttaaaaataaaattaaggtaaaatgcctttttaaggggaggttttaaaaaataattttaattaactaaatttttgatcaggtagtatattcacatggtttaaaattgaaaagtcacaagaggttaagtagcaataagtcttttcatctgtgttccccagctagctagttcttttccctggaagcagttactggtttcctatctgtccttccatggataaactatgataatataaataaatatatggctcacgcctgtaatcccaacactttgggaggccgagctgggtggatcacgagaggtcaggaattcaagaacagcctggccaacatggtgaaaccccatctctactaaacatacaaaaaaaattagccaggtgttgtggcacacacctatagtcccagctacttgggaggctgaggcaggagaatcacttgaacacatgaggcggagcttgcggtgagccaagatggtgccactgcactccaacctgggcaacagaataagtctctatctaaatatatatatatatgatgtgtatatatatgatgtatgtatgtgtatacatacacacatacacaacgtatattacaaaattggtaacatattctataaactgttggggcaaagcttacttttttttttttttaaaatacagtctccctctgttgcccaggctagagtgcagtgacatgaccttggctcactgcaacttccacctccccagttcaagagattcttgtgcctcagcctcctgagtagctgggattacaggtgcccgccaccacacccaccaaatttttttgtatttttagcagagacggggtttcaccatgttgtccaggccagtctcaaactcctgacctcacatgatccacccacctcggcctcccaacgtgctaggattacaggcatgagccaccgcgcccagccacaaatcttactttttaaaatgcttttaattatgactcaaatggtagaatgagaacatttaaagatattggaaatatcaaatctaaaagtgcaaaattttggaaattgctggccatcagcttttcaaatatacaaagagttataagagccctaaaatttagcaaaaacattcaactttggctgggcacagtggctcatgcctgtaatcccagcactttgggaggctgaggtgggcggatcacctgaggtcacgagttggagaccagcctggccaacatggtgaaaccccatctctactaaaaatacaaaacttagcagggtgtggtggcgtgcacctgcaatcccagcactgaggaggctgtggcaggagagttgcttgaacctgggaggcggaggttgcagtgagccgagattacaccattgcattccagcctgggagactgatcgagactccatttcaaaaaaagaaaaagaaaaattagccaggcatggtagcgcgtgcctgtaatcccagctgcttgggaggctgaggcacaagaatcgcttgaacccaggaggcagaggttgcagtgagctgagatcgcaccactgcactccagcctgggcaaaagagtgagactttgtctcaaaataaataaataaataaataaataaaaacaagaaatctggctggacatggtggctcatgcctgtaatcccagcactttgggaggctgaggcaagaaggactccttgaagtcaggagttcaagaccagcctgggcaacatagcaagactcctgtctctacaaacaaattttttttaattagctgagtgtggttgtgcacacctgcggtcctagctatttgggaggctgaggcaggaagatcactttagcccaggagtttgaggctgtagtgagttatgatcatgccaccgcactccagcctgaaagactgagcaagaccctatctttaaaaaaattaaaatttaaatccagcctggggcaagtaaatttccttttgtaaggaggcaatcacttttcatcagtacttacaatggacagtcttgagttgagagaatgcaaaaagctgctttcaagaattgagtttcggccgggcgcagtggctcacgcctgtaatcccagcactttgggaggacgaggcgggcggatcacctgaggccaggagttcaagacctgcctggctaacatggcaaaaccccatctctactaaaaatacaaaaattagccaggcatggtggcaggcgcctgtaatcccagctactggggaggctgaggcaggagaatcacttgaacccgggaggcggaggttgcagtgagccgagatcctgccactgcactccagcctgggcaacaagagtgagattccatctcaaaaaaaaataattgggtttctcagattgccagtgagttcaagatgaaggcaagcttgtctataaacctggccttaggtaacattgttctatttttcagtttactcatatggccagcttgctctcagtttaggtagaataacctttgagtaactggtaagtacgaggcattttagtactgccagatggaacatttactgttctttgtaaaataaatataaattgacaaaccatgaatgatttgttttgcctcacagtatttttcttttttcttgagacggagtgtcactctgttgcccaggctggagtgcagtggtgcgacctcagctcactgtaacctccacctcccgggttcaatcaattctcctgcctcagcctcccaagtagctgggattacaggcgcacgccaccatgcctggctaatttttgtatttttttagttgagacgcggtttcaactaaaccaggctgttctcgaactcttgacctcaagtcatctgccttggccttgcctcacaaaaattaaaaatgtaaattaaaagccacaagaggctaaatagcaaaaagtcttctcatatgtgttccccagctatataattcttttccctgaaagaaactatagtacgaattggaaaaggaccactgcactccagcctgggtgacagagtgagaccctatctttaaaaaattaaaatttaaataaaaaaataaaaacaagcaatcttttaaatgaacattatgaagtaggtgcattgtccagcacagagctcagaaagtcagaaggtgggactgaatacttgcatccatttcactcttcaattctataattgtacctgagccaccaaaagaaagacagaaaaacaaataataggtgacagatggatggatgatagatgttagacagatagatgatagttttcggacaagtttgccttcatcttgaactcactggcaatcgctgaaaaacccaattcttgtttgtttttgtttttgagacagggtctcactctgttgcccaggctggagtgcagtgacatgatctcagctcactgcaacctccacctcccaggttgaagcgattctcctgcctcagcctcccaagtagctgggattacaggcatgtgacaccatgcccagctaatttttttgtatttttagtagaggtggggtttcaccatgttggccaggctggtctcgatctcctgacctcaggtgatccgccgcctggcctcccaaagtgcttggattacaggcatgagccaccatacccagccagagaaacccaattctttttttttttttttttttttttttttgagacagacagcctgtcgcccaggctggagtgcagtggtgcaatctcggctcactgcaacctccgcttcctgggttcaagcgatactcctatctcagcctcctgagtagctgggatcacaggcgcctgccaccacatcgagctaatttttgtatttttagtagagatgaggtttcatcatgttggccaggctggtcttgaactcctgacctcaggtgatccgcctgcattggcctcccaaagtgctgggattacaagcgtgagccaccacgcccggcagaaacccaaattcttaaagactactttctgcattctctcaactcaagaccgtccattataaatgctgacaaaaggtgattaaccctttccagaaaaataatgccccactcaaccgtggaaagagttctttgtgaagagaatatttttaaggctatcaaataaaaataatgaacacttgggtcaagcagtcactgaacagaggaaacaacagtaaacatttgctgagcgcttctgaagtgccaaacattgtgctaataggtttcttcacatgtattaactcatttcatcctcacagccctcgtattagccgcgttttacagacaggaagcacagagaaaataatttacttgccccaaatcactgtttaatagttcatcattggccaggcgcggtggctgacgcctgtaaccccagcactttgggaagccgagatgggcggatcacttgatgtctgttcaagtccagcctgaccaacatggtgaaaccccgtctctactaaaaatacaaaaattaaccgagcatggtggcaggcgcctgtaatcccagctacttgggaggctgaggcaggagaattacttgaacccaagttcatcattgagagaaccgaaaatcaaacccttgtctgaatgacttcagcgctcagaacactgtcccacacccagtgtttgccttgtgtctgttcattccataaacatccatgagtacaaatcttcctcgaaaacatgataaatcgccctttcatcagtgcaatgaggatgggactcaaaggaataagaaggaaagagctatataaagctgtctgaaagtcagggccccattccgacgctataattcggtttggcttcaactgcggcgctcctacagttgggttaacgagttacctatactgcgaaactgtaccccacccctcctaccagagtagtaaaaaatacgttcttgtgttctaacaattttacaagcgtaaaactggggggaggggccgggcgcggtggctcacgcctgtaatcccagcactttgggaggccgaggtgggcggatcacgaggtcaggagatcgagaccatcctggctaacatggtgaaaccccgtctctactaaaaatacaaaaaattagccgggcgtggtggtgggcgcctgtagtcccagctactcgggaggctgaggcaggagaatggcgtgaacctgggaggcggagcttgcagtgagccgagatcgcgccactgcactccagcctgggcgacagagcgagactcagtctcaaaaaaaaaaaaaaaaaaaaaaaaaaaaaaaaaaattggggtgagggcggggaattaacgtttctcaaatatacaaggaagcccagactcagaatgtagactcagagcagggaggggaccttttagcccagccttttcacgccaggacagctcgcctgccaggcagttctccaccctctctcgccccgccccgctcctaacgggacagtcagcatcccccctgattggacagcactgttccaggggacaagtcaacctgggcctccctctacatcccctcccctgctcatcagggcccaccccgagccacacggcggagccctgaattgggccaaagaggtgccctatggtgaggcctgcaggacattgggcgagagccgggtccagtgtgggcctcggggcgcggtggggtggaaagcggccggggaggggaggcctggggcaggaggccgggggaggcggccctgggggtgggcaggatgctctcccggagtcccacgccgccgcgcggctctcaccagacgccgtcagaggctccctcccacgccgccaccgcgctcctcgggcgagggacgaaccaagcgccacgaagcaggcagagcgcgagcctgcccctcggtttccgcgctcgggcgcgcgggtagacgactcgtcgctcgaccttgtccccactcctcgctcgcccagccacgcccacccggagtgccgaatccgcgatcgcgccctgacgccacccgagagagctcgcgtgattggctgctcccgtccccgtcccccaccttcccggcggtattttgaggcgcaggcagggtgctgaccagcggaccatcttccatggcctctgccgcgctggagctgctgcggggctgtcctgccagcttgtgctcccgccccgaagcgtcctcctccactggcgacacacgcactgaagcccgagtcttcccgctgggtagttgttttggtcttgcacccaaggagggatttcttgcgcctcttgttccctcagttatttcataaaccaggaccgcaactatactgtcgtgtagcgcggccaccccacagcggtccctgacgttaacccttgccgtgactgctagaagacactggtggagtgtgaattgatgaccaaggcatggcagagcctctctcatctttataatcagttcagcggcggcctccactacagggaactcccagccagtcccgaggcctagggacatccagggagaaacgtggcggtggtaaagggcttgcgcagctcctgaagataaataagactttgggttgctgttgtttttgagacaagggtctcactatgttgtccaggcagcactcgagctcctggcctcaagccatcttttctggcttcagccttctgagtagctgggactacaggaccatgccaccgaatcaggctttaagactttttaatgaccctttcaaatttctgagtcactcccagcattttaggaagccaagtgagaaggctagcttgaggccaggagttcgagaccaacctgggcaacagattcctgagtcaccattgacaagaaactttgaatgaagttgatgatacaaaatattaacatctttttttttttacaaccattaaaaatttaccacaggtgaaactaagtctaacagttcattgagatttcttgctgtacagcaaatttcaaatctcatcaaactgcagtttgtgatgcatttcaattaataatgaagctctaatttgtaaaatacttatgaactcttagttctcctgtggctagcttggagccacgaaaaggtcacattagccacaaaagaaaagacattaagggatttttgcaaggaagtgctatcagatttcttttttgtttgtttgtttgtttttgagacagggtcccactctatcgcccaggctggagtacagtggtacgatctcagctcactgaaacctccacctcccaggttcaagcaattctcctgccttagcctcccgagtagctgggattacaggcacacaccaccatgcccggctaatttttgtatttttagtagagacgggggtttcaccatgttggccagactggtctcaaactcccgaccttaggtgatccgcccactttggcctcccaaagtgctaggattacagacatgagccaccacaccaggcccagatttcttttttaaatcacactggctgctctgtggagaatggattggtagcagtgaaactcaactgaagtggatggatatgatgtttattttggaagtaaaattgatgagacttaattataggttagatataaggggatgacagggaaaaagactcaagaatgacctccgggccaggtgtggtggctcacacctgcagtcccagcactttggaaggcagaggtgggaggatcgcttgtgctcaggagttccaggcaacagtgagctcgatcaaaccactgcactccagcctgggtgctggatcgagacctcatctcttaaaaaaaaaaaaaaaaagaaagaaagaaagaaatgacttccaggtttctgccattaggaattgggtggttggttgtgtgctaagatgagaaaggctgggagagtgacctggtttgggaagaaaaaagtaaagttttaatttagggcatgttatgattgagatgcctgtgagccacatgaagctattaaatgtgcagtgagatatatgaatctgaagacagactcaccagactataaatggtgtattagtttcacatatgctgtaacaaattaccacaaaattagggtctttaaaacaacacaaattggccaggcgcggtggctcacgcctgtaatcctagcactttgggaggccgaggcgggcggatcacaaggtgaggagatcgagaccatcctggctaacatggtgaaaccccatctctactaaaaatacaaaacattagccgggcgtggtggcgggcgcctgtagtcccagctactcgggaggctgaggcaggagaatggcgtgaacctgggaggcggagcttgcagtgagccgagatcgcaccactgcactccagcctgggcaacagagcgagactctatctcaaaaaaaaaaaaaaaaaaaaaaaaaaaaaaaacccacaaatgtattatcctacagttttggacgttaaggatccaaaatgggtttcaagggaccaaaatcaaggtgtcagttgggttgccttcctactggaggctgccagggagaattcattttcttcccccttccagattctagaggctgcccacattccttggcacatggcacctctgacttctgcctcccttgccacatcttttgtgactctactgccttcctctctcacttaaaaagaccccggtgattacattgggtccactcaatagtccaagataattttccctctcaaagtcctggtcacatctgcaaagtccctcttgccaagtaaggaaacatggtcacaggttcagggattaagatgtggatatctaggccaggcacggtggctcactcctgtaatcccagcactttgggaggctgaggtgggcggatcacgacgtcaggagatcgagaccagcctggccaacatggtgacaccccgtctctactaaagcaaaattagccggggatggtggcgcacgcctgtagtcccggctacttgggaggccgaggcaggagaataaatggaacccaggaggcagaggttgcagtgagccgagatcgtgccactgcactccagcctgggcgacagagtgagactccgtctcaaaaaaaaaaaaaaaaagatgtggatatctttggggagctatttattctgcctaccacaagaggtattgaaagtcacttgaagtcaggtcaggcgtggtggctcaagcttgtaatcccagcactttgggaggccgaggcgggtggatcacgaggtcaggagatcaagaccatcctggcgaacacttgtgaaaacccgtctctactaaaaatacaaaaaaaattagccgagtgtggtggcaggcgcctgtagtcccagctacgcgggaggctgaggcaggagaatggcgtgaacccgggaggcggagcttgcagtgagcggagatcgcgccactgcactccagcctgggcaacagagcgagactcaatctcaaaaaaaaaaaaaaaagaaagtcacttgaagtcaagatgggtatgttgcttttaaagttacatagtgtacctccaaatatgcagaatagaacgttaaatttttcttcctgaaaggtaagaaaaattaacttcaaaaacaatttaaaatctgggtgctgattacataggtgtgtttagtttgtaaaaactcaaattatatacgtaatatatatgtaccttttatgtgtattttactgtaatgtgttttaaaaataatgcttaatatagctagaaaaatataactataaatataaatacctttaacggtagggaatacattttgagaattgtatgcactttctaagccacctgcaagttttgtgtttgaccaacactgagaattttatatttccataatcatttaaccttaaatgaaataatctttttagaattttcttctctgctttcttgagatcaaattgcagcaaggacccttaggaggcattttctcttggctttttgagatcactttcctatgggtaaataatattacatttctggatttctgttactttactgtttaacattgtgaattgacataccaaaaatcgtcactagttaagtttggtttgtatgatttggtttcatttgactttagtctgagaactctacaagttgcaaaaaaattacttatggctttgtagtataataaaatcagatttttctagagattactccataagcataaatataacttcaagcattcagggcataactaggctatcaatgactcctaggctttaagagatcctctaatctaaccttctcatcagagtgggagaccttcctacagcacccctgacagatgcttatctggccactttgggaacatttcttgtaacagacttgtcttattttatttggtgatttaattattttaaagtactctgcctctctgtaaattctacccgtgtatttcgtagcctaaacatttctaaactaaaatagcctaaactattctaaacattgtatctatattcatcagtactcataacaacattaagatgtaaattctgtatataccccctactttacagacaaaaagaccaaaatacagaaggcgaagttgcctgaggttgcacagctgttaaacagaagagcccagcccttgatcccacttgcttagctactaccacccagtgtttcctctctatactaactagagcattgcactttataacagaaacctatctcaaggttcatctcagccatcacttttttttttttttgagacagggtttcactcttgcccaggctggagtgcaatggcgtcatctcggctcactgcaacctctgcctcccgggttcaagcaattctcctgcctcagcctcccgaggagctgggattacagacatgtgtcaccgcgcccggctaatttttgtatttttagtagagatggggtttcaccatgttggccaggctggtctcaaaattctgacctcaaatgatctgcccgcctcggccagggcccggattacaggtatgagccaccgcgcccgacctacagtcatcattttttggttaagttgttccattagttaagagttcacataactcttctattatccagcccacatctctctgaatggctcacatcaaggtcttaagagattttaaaagacatcttctttaaaatcaaggtctaatctctatggcattctcctgatgtattagtttagtgaggctttcaaaaaagaaaaggacattatttggcacaaatttttcctaaagtttttattgaagtgttaataaatacctaagcagcacagttgaatttcaaattttcataaagtaaaaaccgtcactaaatgaaagagagaaaatatcacctgtgcccataggctgcctcctcaagagctgcctattcatgacccatgaaaaaacctggcaccaagcctgtggctagctaatagtgacaatggtaattagctaatgtgcatgttaaagtagctctctgaaacatctggactggggaatacggagaggactggccagttggaaatgaaaggaaaatggggcaccttaaaaacatagtcacagatagctgtgagaggtagcacagggaggccatagggagagaatccaggccctgacttgacttgaatcctgaacaactttctgattttaatctacatgtatccttaaatcatctttttatttatttatttattttattatgttttttttggagacagagtctcactctgtcacccaggcttgagtgcagtggtgctatcttggctcactgcaacctccacctcccaggttcaagtaatttttgtgcctcagcttcccaagtaattgggactacaggcaggcaccacgatgcccggctaagtttttttgtattttttatagagatggggtttcgtcatgttgccaggatggtctccaactcctgagctcaggcaatccgcctgccttggcctaccaaaatgctaggattacaggcatgagccaccgtgcctggcctaaatcctctttttaaaaaagatgccctgttccttgcattcagaagatactaacagtaaaactgtgagccagggagaatccccaaccttatttcgatccccacttccaaccgattgatggtggctgcctggagaactgtgtcaaaaatgactctggggctagagtttactggaaaagagtatgtactgttgagagacaggactagctggatttcctaggccgactaagaatccctaggcctagttaggaaggtgaccgcatccacctttaaacatggggcttgcaacttagctcacacccgaccaatcaggtagtaaagagagctcactaaaatgccaatcagacaaaaacaggaggtaaagaactaaccaatcatctattgcctgagagcacagtgggagggacaatgatcaggatataaagccaggcattccagccggcaacggctaccctctttggctcccctccctttgtatgggagctgtgttttcactctattaaatcttgtaactgcatactcttctggtccgtgtttgtaccgtgtttgttaccgctcaagctaagctttcgctcgttgtccaccactgctgtttgccgcagtcgcagacccgccgctgacttccacccctccggatctggcagggtgtctgctgtgctcctgatccagcgaggcgcccactgctgctcccgatcgggctgaaggcttgccgttgttcctgcacggcaagtgcctgggttcgtcctaattgagatgaacactagtcgctgggttctacggttctcttccatgacccacgtcttccaatagagctataacattcaccgcatggcccaagattccattccttggaatccgtggggccaagaaccccaggtcagagaacgagaggcttgctgccatcttggaagcaacccgccaccatgttgggagctctgggagcaaggacccccggtaacattgtgatgtctgccatgttgttttctagggagatggaagggagtcaaggatgttgccatgtatgtgccatctctgccctaagccaatatcatgaagaaatcaacaagaggtggaataaactgagcaattcatcaccatattaagctggatattcctgtttagtaaatatctttccctagctggtaagtatctcaccccatactgtatctcagccacaacacttttaattaccagagtctctagggcagcggtccccagtctttttggcaccagggactggtttcctggaagacagtttttccatgggaagtgggggtggggatggtttcaggatgaaactgttctacctgagatcatcaggcattaaattctcataaggagcgttcaacctaggtccctagcatgcgccgttcacaataggatttgtgcttctatgagaatctgatgccaccactgttctgacaggaggaggaatgtagacggtaatgcttgcttgcctgccatttatctcctattatgcggcccagttatttttttattttattttatttttttgagacggagtctcactctgtcacccaggctggagtgcagtggcgcaatcttggcttcttggctcactgtaagctccacctcccgagttcaagtgattctcctgcctcagcctcccgagtagctgggattacaggcatgcggtctggctaatttttgtatttttagtagagacggggtttcatcatgttggccaggctggtcgagaactcctgacctcaagtgatccacccacctcagcctcccaaagtgttgcgattacaggcataagccaccgcgcccgacctggcctgcggcccagttcttaacaagacactggccagtaccagtccatggcccaggggttggggaccccctactctagagtatacagaggtaaaacacaccttacaaaccagatatcactgcatacgccagattgtttatagcctccccagaaaagaaaattgctcctgttgcagaatagccttatgaggctacactacatggggaaagcaattcttttctcccaggaaaagcatgtaaggattaagattatattggctgaggccaggagtagtggctcatgcctgtaatcccagcagtttgggaggccgaggcaggtggatcacctgaggtcaggactttgagaccagcctggtcaacacggtgaaatcccgtctctactaaaaatacaaaaattaggctgggtgcggtggctcacgcctgtaatcccagcactttgggaggccgaggcaggcggatcacaaggtcaggagatcgagaccatcctggctaacacagtgaaaccccgtctctactaaaagtacaaaaaattagccgggcgtggtggcgggcgcctgtagtcccagctactcgggaggctgaggcaggagaatggggtgaacccgggaggcggagcttgcagtgagccgagatggcgccagcctgggtgacaaagtaagactccgtctcaaaaaaaaaaaatacaaaaattaaccgggtggtggcccccgcctgtaatctcagctactcgggaggctgaggcaggataattgcttgaacctgggaggcgaaggttacactgagccgagatcgtgccactgcattgcagcctgggcaacagagtgagactcagtctcaaaaaaagagattatattggctgaaaataattcagcaatatcctaaactgtatcagcttaagctttgcaagagcataacattgaaagatacttacaaatgtactgattaagatacttataactggaagataatctttttgaaatttatatttcaggaccatttaatcactatttgtagccccaattacgaatcagtttatcatgccgaccagtcagctttttagagcacctgtggtggtgagccatccctatgctcctttgccaatcatagaagaaaggtacaaattaacataatgactttgtttttgtgaaatattgccttttctcaggattttaaaatatattttttggctgagtgcggtggctcatgcctgtaatcccaacactttgggaggccgaggcaggtggatcacctgaggtcaggagtttgagaccagcctggccaacatggtgaaaccccatctctactaaaatacgaaaattagtcaggcgtggtggcaggtgcctgtaatcctagctactcgggaagcttatgcatgagaatcgcttgaatgcaggaggcagaggttgcagtgagctgagatcacaccactgcactccagcctgggtgacagagtgagactgtctcaaacaaacaaacaaacaaacaaaatatatatatatatgaacattacatatatatatttttctttatgggctatgaaagtatcatactgtagctttgtgcagtggcagtatcgtagccaatgaggtttatccaaggtgcgattattgctaattgaaagtatcatactgtaaaccaggctgagtgcagtggctcatgcctgtcttcccaacacttttgtgatcatttgagtctaggagttcgagaccagcctaggcaacatggcaagaccctgtctctacaaaaaatatttaaaaaatttagctgggcatggtggtgcttgcctgtagtcccagctacccaggaagctgaagcgggaggatcgcctgagcctgggaggtccaggccgcagtgagtcatgatcacaccactgcactccagcctgggcaacagagtgagaccccatctcaaaaaaaaaagtatcatattgtaaaccaataaattatttcttatctggctgcttgggaaatgaagtgagtcagagaatgctcagtcatccctgactaatagaaattcagaaagttaaattggcacagccattccagaagaactggaaatgtgttaaaaactagtttgcctttaactttgactctcttataaaatgttggatcaacacaattatgctctaaacttctcattaaaagttatgtgggaagctgggtgtggtggttcatacctataatcctagcactttaggaggctgagtcgggtggattgctttagcccaggagttcaagaccagcatgggcaatatggtgaaacccaatgtctacaaaaaatacagaaaattagctgggtatcgtggcatgcacctggagtaactagctactcgggaggctgaggtgggaggatcacctgagcctgggaggctgaggctgcagtgagccatgatcatgccactgcatctcagcctgggggacagagtgagacccccatctcaaaaacaaacaaaggtatgtgggaagtatgttcttctggactttaaaggaactagctaagatcaacagcactgaatatcagtaacacgcttctggggaaattttattatttcccaacgtaagctaaggaaacagccaaggtactggtccagaactcctggaactgaagaatagcccacaggccgggcgtggtggctcatacctattatcccagcactttgggaggccaaagtgggtggattacctgaggtcaggagttcaagaccagcctggccaacatggcgaaaccctatctctactaaaaatataaaaattagctgggtgtggtgctgtgtgcctgtaatcccagctacttgggaggctgagacaggagaatcgcttgaacctggaagtcggaggttgcagtgagccaagttcttgccactgcactccagcctgggcaacagagcgagactccgtctcaaaaaaaaaaaaaaaagcctaagcatgaacataaggcctcaacctctctctctcctcatgtttttcatgcccctactctggaatgaatataattctacctttcaaattatttgttttttgtccctactcctcctcttgccccttaacatgaacactctcttatgattagctcctgcccctgcccctctgcgtactcattctttcagaaattggctcactctcaagccttccattatcacttccatgtaggtaattcctaggatacatactccagcctggcctttcttcccagcttgaggcccctatgttcaattgcctactagatagttcctcacttcaaactcaatatatgaaagttcattttatcctgttgactttgctatttcttttaatggtactaacttgacactttcattcagactcaaaatcatggagtcatattttaatcttcgctctctctgactttaacattcaatctttcaaataattcaaaatgttatctcagtttatgttgttgggttttctttcttctttctttttttttttttttgagacggagtctcgctctgtcgcccaggctggagtgcagtggtgtgatcttagctcactgcaacctctgcttcccaggttcaagcgattctcctgcctcagcttcctgagtatctgggattacaggcgcccaccaccacacccagctaatttttgtatttttagtagagacggggtttcaccatattggccaggctggtcttgaactcctgacctcaggtgatccgcccatcttggcctcccaaagtgttgggattacaggcgtgagccaccgcgcccggccggttgttgggttttcttagagacagggtcttgctctctagcccagcttgtagtgcagtggtatggttgtggctcactgcagcctcaaaatcctgggctcaagcgatcctgtgaccccagcatcccaagtagctgggacttaaagcacatgccaccatgcctagctaatttatcaaaacttttgtagagacagggttttgctttgttgcccaggctggtatcgaactcctggcctcaagtgatcctcctgcctctgccttccaaagtgttggtattacagacataagccactgcacctggccttagttcagatcttatcatcttatttccttaattctgagatgctttttttaaatgattttatatacctaaaatcaatatttataatcaatgtaaatatttaatgtagagttttttattatacaaactattatatcaatagtgttttagaatcaagaaaatcgggcatcaaagcccactattaacctgggtgcagtagtgcatgcacgcctgtaatcccagctacttgggaggctgagacaggaggatttctttctttttttttttttttttttgagacggagtctcgctctttcgcccaggccgtactgcagtggcacgatctcggctcactgcaagctccgcctcctgggttcacaccattctcctacctcagcctcccgagtagctgggactgcaggcgcccgccaccgcgcccggctaatgttttgtatttttagtagagacggggtttcaccatgttagccaggatggtctcgatctcctgacctcgtgatccgcccacctcagcctcccaaagtgctgggattacaggcgtgagccaccacgcccggcctgacaggaggatttcttgagcccaggagtttgagtccagcctgggcaacattgtaaggccccatctcttaataataaaataaataagtggaattaacaaagacctggattactctatttcttcttgtccttcctgcctgcattccctcgctcctttcatctatcttgcacattattgcctgattaaatcttcttaaaaggctgctttcatctcgttaagactttaagaaaaacttcagtggtcccccattccctgctagataaagtatgcctaggggaacaagtttgtcatttaaggtcctccacaatttaagggtcctgaccttttgctgatcttaccaacattattcccctcccggatccttctgccccaaagagttctttctctacctttgtatcattcctcaaagttagaaggctcttccttgtctgctgcttacacccaatcaggtttcaaacgccatctctattgtgaaacctaatatgaacaccctatcccaaaataatctgttccttctctgaattcccggagcacttgtctttactcatctcaaactttttgtttcattttgttttgagaccgagtctcgctctgttgcccaggctggagtgcagtggcacgatctcagctcactgaaacctccacctcccgggttcaagcgattctcctgcctcagcctcccaagtagctgggactacaggcgcctgccatcacacctggctaatttctgtatttttactagagacggggtttcaccatgttgtctaggctagtctcgaactcctgacctcaggtgatctgcctgcctcggcctcccaaagtgctgggattacaggcgtgagccaccatgcctgacctcaaacttattattagttatacttatgatgaattacctggtatctttgaatgtatatgtttgtgactgtaatattagacatctgatgtattataaggaacccgagaaaaatcagtcatattagtcacctcactatatatgacctacgtttttaaaatcagatcataaattccttgaagttagccctgtttggtatgcttgtctccctcatagttccttgaatcataccttaggtgagaaacacagtcaataaacattcagtcaaaggaggatcacatcttctaccaaagattcctagccatccttgttcttttctctctggctaggccaaattgcttctactcaactgcctgcaccggtcatcctccaccatctaggctcacgatcgtagtaacacaacactcttgctcaatctttataataagtcaagcataaaacagcatggtgaatttaaaaacaaggtgggaaatttggcggtcttatgagatagatgtgtggaggcagaaagtaactgggagatgcagacaagatgtgagcaaggtcagttcagcaagggccttgcatgatgttatgctaaggaggttagactttccctcactataatcgggagagtttttaattagggaaatggcatgatcagatttgcttaattagagctacagaagatggctgggtgtggtggctcaagcctgtaatcccagcactttgggaggccgaggcaggtggatcacaagttcaggagatcgagaccatcctggctaacacagtgaaaccctgtctctactaaaaatacaaaaaattatctgggcgtggtggcgggcccctgtagtcccagctactagggaggctgaggcaggagaatggtgtgaacccgggaggcggagcttgcagtgagccaagatcgcgccattgcactccagcctgggcgacagagcgagactccgcctcaaaaaaaaaaaaaaaaaaaaaaaaagaactacagaagatggattgggaagaggaggaaggactggaagaagggaaaccagttaggaataatatttcaggacctcaactaaagtggtaataatggaaatagagaatgagaggattggaatcataagaatgtggagaaggggccgggcccagtggctcacatctgtaagcccagcactttgggaggccaaggcgggtagatcacctgaggtcaggagttcaagaccagcctggccaacgtggtggtgaaacctcatctagtaaaaatacaaaaaaaaaaaaaaaaaaaaagctgggcatggtggcgtgcgcctgtagtcccagctactcaggaggctgaggcaggagaattgcttgagtgcaggaggtggaggttgcagtgagccaagattgcaccactgcacttagagaagcaggtttggagatgggctggagtaggtgagaagataatgagctttaattttggatatgttgaatttgtagcacctacagaacatttccatgagattgaggatctggaggaagatatacattggagacacaaatttgtgctagacattatgcactccataaattttttttttttttgagacaatgtctcactctgtggctcaggcagagtgcagtggtgcgatctcggctcactgcaacctccgcctcctgggttcaagcaattcttctgcctcagcctcccaaatagctgggactacaggcacccgccaccacacccagctaatttttgtatttttagtagagacggggtttcgacatgttggccaggctggtctcgaactcctgatctcagatgatccacccacctcagcctcccaaagtgctaggattacaggcatgagccactgcgcctggccacactccataaactttacgtgttttgaaatacactgtttactcttagcccaaagcacccaatgacatttcttaccctacctgtttcaccagatttttctgcccctgactctgttctactgtcactcttggccaatttggaactctttttttttttttttgagacagagtctcactctgttgcccaggctggagtgcaatggtgtgatttcggcttaggttcaggtgattctcctgcctcagcctcccgagtagctggaattacaggcacctgccaccgcacctggctaacttttgtagttttggtagagacagcgtctcaccatcttggccaggctggtcttgaactcctgacgtcgatccacccgcctcggccccccaaagtgctgggattacaggtgtgagccatcgcgtccggccaatttggaactctttaatggtatttttcacataatagctgtctaaatcttagacaactgaatgactgttagacatcactaaatttaatggggcataaaattctgcggaaacccaggtgcttcggtctatggtactgtgtgtgtgtgtgtgtgtgtgtgtgtgtgtgtgtgtgtgtgtgtgtgacagggtcttactctatcacccaggctggagtgcagtggcaggatcatggctcactgcagcctcaacttcctaggttcaagctatcctctcccctcagccacctgagtagctaggactacaggcatgtgccaccatgtccggctaatatttgtaatttttttagaactagggtctcgctatgttgcccaggctgatcttgaactcctggcctcaagcaatcctcctgcctcaacctactgaagtgctggggttagagatgtgagccattgtgtcaggctcttacacctttgttaaatatttagcggtgctttcctggccacgtaccctctttttccaactgcccatgtacctagtcttctctgccctctggcttctcttctcttaaccccttctttttcacactgttggtcactgccttattcttgagatattttacatcctgggcttgcaagacacctgatttcctgcctacttccaacttctctgactcatactttctcaaactcctaaataaaagtattttctagaattctgtagtcttccttatatctcattttagtgtatctccagcatgacttcaaccacttgcatggtttcacattctttttttttttttttctcttgagacggagtctcgctctgtcgcccaggctggagtgccgtggcgcgatctctgttcactgcaagctccgcctcccgggttcacgccattctcctgcctcagcctcccgcgtagctgggactacaggcacccgccatcatgcccggctaattttttttgtatttttagtagagacggggtttcactgtgttagccaggatggtcttgatctcctgacctcgtgatccgccggactcggcctcccaaagtgctgagattacaggcgcgagccaccgcacccggccggtttcacaatcatttaaaatgattcctagatgtgaatttctatcccagtcttctcagtccaaacccaaatattcagctacttataggacatctttatttggatgtgttctacaagcacttcaaatccgcttgtccaaaattgagctttcttcttccttataaacctgggctttctcttccgtcctaattctcagtgaatcgtattatcacctactaggatcttaggaggcattcttgacctctgcacctcctttctgtctcacattcagtgtgccacaaaaccctatcagttttacattttaaaagagtatttcctggaagagagaacatgatgtgattgaagacaataaaatgggcatgagaatagcatacaggggagaccagcctgacaggagaaaggttttactgaggaatattggaaaagataattgaattattaagtggcagagtaacttggaagataacttaaaggccatatagagtatttcagagcttgtgtggccatagaaaccaccaaacattaggcaaatgaatgaaatgattatttcaggccatatttttaaagtcagttatacaaaaaaaatggatggagagatgagtagaacaactattactttcataactagaaacaaccatttctaagcagattttattgatgacacgaggaaaaaaacttacaagttccagctagaagctcagaaagtctgaccttgaatttcaatttaagtgtgctaataaaaaataaaaataataaattctcattgaagaaggcagatagaaagtatgcattggtgatacagctaggagtaaactgtgttggcaataattgcaggaataatatcatctgattgaaaagtttttataaggccaggtacaggggctcaacgcctgtaatctcagcactttgaaaggccaagccaggaacatcacttgagcccaggagttcgagatcagcctgggcagcgcagcaagaccttgtctctacaaaaaatttaaaagtttgccgggtatggtagtctgtgtctgtagtcctgactacttgggaggctgaggcaggaggatcccttgagcccaggagttgaaagctgcagtgagctatgattatgccactacaatccagcctgggtgacagagcaagatcctgtctttaaacacacacacacacacacgtttgtataagccattccttaactatagatgatctttaaattgaatatatattttaatcacctaattgaactgtgatgatgatttcctaaaacatttggatttccatatgcctcaatgaaaaattaggtttaataaactacactatagtatagcacactatatgtcgcatttatatattgataaacatgataatttcctttttatttgacttagatactaattaacttggagtaaatgcacccaccccaatcatgtgatcagtcaatagttaaataactgagggaaaagaagtacaaatcaggcagctctacatgccatgtttcaaaagggaaggaaacaaaatagttaaactttgcatgttttggaaataaactgtatttatgaaacagagatctcaaaaagtaaaaggaaccccactttatctgatgaaagtgccaggaatctggagaaaagagttcaatttcaactttcagtttggagatgcagaaagaccctgaattttggcacagtaactgagaagcaagtagcagccacagaatgactaaactgagttagcagtaaaaaagtctttaaaaatgatggatttgatagatttaaaaccaaagctttcctcttcctctttgtaattttcctttttcccccctttttttctgattgcaatttcaataataaagctctattgaattccgaattacttacatgaggtccttgaaagcatgactccctctgcagataaccataggtttccatcccgaagcacgagctctgtaccctagtgtggtttgaaataatgagcagagcagctgttttcttggtttagctgccacggagcagtcaccaataggcatctgaattccagact

SEQ ID NO: 1681 - DNA, 62616 bp, Homo sapiens; identical to SEQ ID NO: 1680

SEQ ID NO: 1682 - DNA, 33089 bp, Homo sapiens
cgacccacagcctggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggttcggctgcttcctcctcgcgcgatctccccgctttcctcccctccacccctactcgtcgcgggcccctggcctccggctctccggccctctccaggccgcggtcggctccgacggtgtttccctccttccctccgggcgggctgaggcggctcccaggctcccgggacaccgcggaccaacttctagtctctttttctctcctcgaagcgcttatctgcgcgcagccttatctccgagttatctcggcgcaaaggggcgggagccggtagttaggcaggcagagaaacttctttcttgctatctagccaggtctgtgtgtgggcattaattttagtgtggtaatctccgatgagccgaggcgatttggaagagcagcctggaggaggccagcccggctgcatttcacctccctcccccactcgctccgagtctccctgtcattcttcctgctctcccatttggggtcgcctcggctctggggcggtctcacgctcccccctccccagcccgttgcgttccccctccttttctctgctctccgctccaccccgctacgtccgattccggaacggtccggcgtttctgctgctggagatgaccgcggggtgggccgggtggcccggccggcgtgagcgcgcacgctggtggctgcaggcgcgggccgtgtctaaggtgtgcggcgccgcggggacgccggtggggctggcgattcccgccccacaagctctccgcattgcctctgctgggaaggacccagactgctgcccccgccctggcgtcccactttccctgggccgagttgcatttctctctggggctcgcgttcgggctggtcagcgcagtccgggaagctctgggagagccaatataggagaacgcggcggtttcgttttcggggacaggttgccttccttacgcgaagggttttcccgtggggaaccctcaccccgaggcatttcgggagaggggcatccgcagagaggcgggatgcggcggtgccgacacgcacagctacttaaattcttttgtgtgtcatcagcccgggggagacactttagggcggaaggaaagcctcagccagcttctgcagatcacccctgggatctggcgcgcgcacggagaaaggatgcggccgagggggtgggcggggaggacgcggggaccggagcggtgcctttgagggagggctggtatcccagcccttccagggccctgtggcggctgcgcaggctcccttcccctcccttattgatctccacgcccggggcagaaataggatctttgagaagtctcaaatgggatctttgagaagtcagatcccatttgaactagaaaaaggagtggaggcgaggtagcgtgcagcctacgctcttgttaacccgtcgatctcctaccatacccgtctcccccaccccacctcaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcaggtaagggtcgcgcctcaggttcggggtgcgggtccaaagcgctggggcgcacgggggacgtggagcagctgctccactcgggccctgttttcaggactttctcgtccgggtgcgcggaggtcggcctggtcccaggaaggatttgcaggcctgtggctgggtaacccagagtccggtagcgctgaggcgagttgtgccaagacttgagtctgttgtgccaagttcctttccacggatgagactaaatgcacatctgtaccttcgtgccttggggaagctcagggccttgatgagtagtgaatggcatctgctattggggaaaaacgaggctgggagggaactaacagcgcttgagccccatcgcagaccctactttgggtgagtggaagaaattccacgatgggagtaagtttgggagagtggcgggcacttgatccacccccaaacagacacacaagcacatgcaggctcacccagtttaactctccaaagggtgcgtgtttgtgttttcctagagaagggtatttagaagagcacaacagaagaacctagatgttcctagggaagctagttggcgtctcctctcccacaagggagagagggaaagaagagagggcacctggagtggtcagacttgtgacttcatggtgaaggagagctggtggataggcccttgggcttggcatcagctgggccttggtctggggctgctgctcacatggccaggctgcaactcagggatcctggagctggggcacctattctcccttcgaagtttagcccgccaatttttcagtttccaatttgactcattttttcctgtatctgggagccattagggggtaaaccgtgaaaacgctattgtcaaaaatacctggaaatacctcgttttgaaaagtgttttgtttactccagcacaggagtgtgggagccctgttaggctgtttttctcagatgcaacattctgcgtccttggtgctttcaactggcttatcttaccttatatttcacctgtttgataatctttctaaggaaacaacatctttttttattgtagtttgtttgaggggaggtgtgggggaggccccttgagtcacagaggtggcagagtggaggaaggcacattactccaaacagtcctaccccggtgtcttgtgtatcccaggtctgtgcttctcgtgggagcctcgacgctacctttaggacagcaagtcagtcctaggggccaggattccttaggataaaatgggacattcccaaccttgtccgcaaaagacacgctggaaatgcaagtggtctgaaagagagggaaccaatttgaacagctctctgatagcctgagttctttctgtcttcttccaagcgctgcaagacttggtctcaaaattccctctttttagttttgctctgtcgcccagtctggagtgcagtggctcactgtaatctctgtctcccgggttcaagcgattctcctgcctcagcctcccgtgtagctgggattacaggcgcgcgccgccacacctagctaatttttgtatttttagtagtttttgccacgttggtcaggctgtttttgaactcttgacttcaggcgatccattcgcctcagcctcccaaagtactgggattataggcgtgagccaccgcgcccagcgaaattccctctttttgcttctgctgcaaagctggccctggagaccatttttcccctgtgtgtggaatgggatcgggggaccctgttgagatttgcactgttggcttgggacttgagagtcagggctctcatccttacctctgcatagggacccgtgtttggctcccaggagcagagagatggagaggctgggaatctctaaggaggtaatggttgggtgtgaagcttattttgtcagtcggggagttccgtagggaatgtgcaagggtgttgtgagttgggtgaggggtagtatctgcagattgagccagcgcctgcagctctgcctatttcttgacacaccttagcctgatctccaggttcctttcctccaatcttccagcatttcatatggctgagagagtcttttgatgtttacagtaactggtcctgtatgagaaatccttttagaggcagtatggggcagttgtgggcaagttaatatgtttctttttgttttaaatttagcctacacttttcctaattttttcatcttctgggcacaccacagttagaggaattttctgtagacccagaagatttgttatttttttaagtatttttttaagtatgtttaaaaaaatgggaagggatttgggaacacccagcttttgcatagagtctgttaggaaatcaggaagtgactgggaccaagccagtattggggtgaagggtggggagcgagtgaccctaactttgcttgtcctcacaggtattctgaggccagcttcctagctagatttcctgtttcttagatttttttttttttttaaacaaaccgtttttggaggcagacactttaaacaccagagctaaaacctgagtgctgaacttgatcaacccgcacaatttggaggcttctggaaacccacactatgcacctctcgctgactgggtagatggggtgagcttactttggggtgagctcagagtcctcacactcctttatttcctgggtcctacaccctcctaagcgcctgcagaactgtgagtccctgtgtcttggtaccacacacagaaagacaggtggtggtgcccttctcccctgaatctatcactccccaagggcaccgcaaacagccatgttaggagagaaatggtgagttgaaaagggggaacttggtgagcaagcccccagcttttatatcttacagcttttataaagacagcatttttttttcctttttagtcacttacaggattatagctgcctggtgggtttgggaaagaggtagggagggaatgagagagattttattcaactaaaaataagcaagcttcctaggttgtatttatccaaagtggacttttaattaaattttgtctttgggttttcagatgactaaatagttctacctggggagttcacactgtcttctaataggattcttattgttcccagtcataggactgggttttccagggaatgccccactcctctatccagaggggctctgataggtaacattttaaagtcaacaacaaagacaaataccttgtttaacttcagtgtccttgaagacctgagcattttactgattaccgtagtcaatagtggcttttagggcggagaagaataaacctttgtgatgtgttgtaagttgcagtatccccatgacaactttgaactcgggttgtgtaggatgccagtttctttaaaacttaataagaaatgagaaaagagacttgttttgtaaatagtattaatggaattaaagtttttatgctaaagtcatatttaaatatcgttaccacacagttgatagtagacacaagcaataaactgcaaggggatgagaaagaaccaaaaggttcaccagcacataatcttaagctaaaactctgaagtgtaatgtttatttactttaaaaagtgattcaggaatgcttcttcaataatgcagaactaggacatttaaaccttctataatctaaagaaccttaaatggcggtctatacttttttttggtctatacttacaataagtacctttctcatttttagagacatttattcttccatatttaaccttcttgagaagtaataaatgttacatttactcttaattaggatttgtttttattagcaggtttaggttattgtgaattctgaaaactaaccaaagaataataataataaaattatgtaaaataaacacattttaaatcgattgctaactcaaaatgatcactgggaaggtcttggtaattttctcaatcagtaaggtatcaaccttttataaaaattttgcagatagaagcagttggacccacttctaaatcgggattttagcatttgatctttgtggcatgaaaataaaactctgtgcttaacgttagtgcatttttcccctgaaaagatgagagtaatcttctcatttctagtttctaactaacgtaggtgcctaagaatagtacttttaatttcacttgtgtatctttaattggagaagaggcacatatggacgggtggcagatgtagaaaatactttttaaaattacttgagataaaagttaatgaggcagcctcgctgtgtccccggatatttgtgggttgcagcggggctcagtggtcagtatttctgtgtggcttgctcgggtttggcaacgacgtactgtaatgatgatggatttcagtctttaaaagctccgggacagcctgagagtaggggtcaggggactcaagccgacctccccaccgctcatctcggactctgacgtcctctgcttccagcactgtctctttcccggagtctctactggggcgctccgggtgtgcagaagtattggacaaatggtcagtggagcaatagtgacgaaataaccctgctcctggctttgcggccaaggagaaaagctcagccgggaagggcacgggcagggaagccgggcaccggggctgggggccggggtccccggggtgacgcggggagggacgggtccggcgcgcccactcccgccctcacgcaccgctgtcgccgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtggtgagtgtgacccgccctgcccctggctcgcggccggccccgggctctcctggcccggccggccccgccctggctcggcctgccttgggcgtccccctcccaggggacaggtgcggccgctgcggtcccaccctagcggggacccagcggtaccatcctgtcccggctgttccaacgcccacccgctggcgcccaagtagaagttaccccgaaactggcctctgggaagccaagatagcctttccccatgtttacgcgcaggggatgacgtccgtaaatgacaaaaacaaaaacaaacaaaaaaggaaggtgcaaaatgttaccatgttttaagcaaaaaaagaaaaaataatctatatatctctaggtgtacttgccaaagcaccgtaataattctggtaagataggcaagaaattggtgatggtaacccgaggagaaaaacagtagacctaccgaggccgggcgaaggaagacttttttcactgtgtatggtttagattttatgcttgaaaaaccatgctcacttataccattcgtcccccaaatagaatatgccagaaatccacccactcacgcctcctcacagccacattcttttgggtgccgtttactttgtcctttccaccttcttggtcacttctacctcttatcctcaggtgtatccccaaataccatatcttggattgcccttgagcctggtgaaaatttatttgctctaacttttgttatttcaaaatcagagaactttgtagaacttgagtaaaagtgtggtttgtatgttcttaagttgagcattttccccaattcgcacacgttttactgtttttttgttttttttttttttttttttttttttgagacggagtttcactcttgttgcccaggctggagtgcaatggcgcgatctcggctcaccgcagcctccgcctccagggttcaagcgattctcctgcctcagcctcccgagtagctgggattacaggcatgtgccaccacgcccggctcatttttttgtatttttagtagagacagggtttctccatgtaggtcaggctggtctcgaactcccgatctcatgtgatcccgcccgcctcggcctcccgaagtgctaggattacaggcgtgagccaccgcgcccggccaccatgttttaaagtaagggaatcctgatttcagggattaatctcgtattgtcattgttatgtgtgcttcctagccggagagagtatttaccgctgtaatagagaaaataaaggaaagctttcaccagtcccactctaaggttaacatttgtttagcgaagtactcataatctaataaccctttaaagctaaatatgttacagttagatgccagacgtcttaagtatcccagtaatttatttgttatactctaattagcaggaacaaatgctacacatgttgtttgtgttaaatagattagagtgaaattgcatcacaatgtaagtctgacaccttaaagagaagcaattagttttatggttggttttgttttaatgcatttaaaataaagtggccgaggttaatttaatgagtgtatgtgccttaaactcgttacaacctcccacagcttaaaattttctttaaagggtacccttaactgcagtgtgtgactgtgggtttcatgttttcttaaatgcatcatattaaagaagaaaaagtagtaactggaaaatatcccacagaagttccttgttttcatataatagacaacacatgaacaatgaaaccgatttatttttctggaaaggcacattgagctgagtactaactgaactttcaaaggtaacattttctagagattgagcaaaaatttggtggaatagtagtcatttaggttccagttgcattataaatttgatctagtaacatttagatagtgccatttgttttgtgcatgtaccagtaaaaataacttagaaggaaaaaaaagaacagtttttagcatttctgaatcgttagctttctttgtgcttagcaggtgtcttggccataaccaaggtcagcaaatatgctttgtaaatgggttataaatgataccaattgaagggtgtgtcactatcaattaggtctccttgtgggcttcttatttatggttttgatggatctggcttagttctcagaagcagaatgttgaactcaagtttgtttagccagcactatagaaccaatcactgtgaatttgaacttgcaatacattgcaaaataagagatttatggtgtaacttgaattccttgtcagtgaggaatatgactgagatcacttgttacaaggaacttttataacccattcacctgcatttcacatgtttatgaggactggcttcacttatgatctgcagttgacagtcataaagtcctttgttataatggcaaattctgataacaagtttgcttcacattggctccaaattccactggaaactgtcataaatggctggtttataaagtgaaccttcctgtcccttgtttactgatttcacatttatgaagagaaaggaatcctttcctaaaaaattattttcttttaaccacaaagaaagaaaaaagaaaagcctggatgtgtaaagttttgttaatatgttgtcatcattttagcaaagcagtttcccaggtagctctcctgtgagccaagcatactcatttcaactaaaggcaaattgattcttagcactgacttcctagaaatgttgtagtgctaaaaggtttgccagtgtctctgtttataacttctctgtagagtgatgctaagtaatgcaacaggatgtaaaccataaatgcagattttaatttcatcttttaaatttcccagcaaaggttttggaagtctctgtcctgtaatctgtgaatattcgatacatactcaatttacatttctctcttcttcattctttacaattgatcttaacttcccaaattttgtaattttcaacttggtttggtcctgaatctttctctgatttttttttttaactatggaaggcttcacgaatttgggtgtcattcttgcgctggggccatgctaatcttctctgtatccttccaattttagtatatgtgttgctgaagcaagcatccattttttttttaactgaagctatgtcacaatttttaaagtaatttacagcatttgaaaggaaatttaagcttggcaacttaaaaacgagttttatattttgccattctgggtaagaagttatgttagcttattataattaacatgtagtaatctagaggtaataaattccctttaaggctgttatgggcataaagaaaacatggaaatgggagtgacagtggcagacaggtggccttttacctttcctggtaataccaattaaccctttgcatgaacgaaagttgagaataatactgatagggcaaatactgatattagtatcactgcatctaagacagtggcagcattaagattatgccataaaatttgctcgtatcctttgtaaaatagataaaacaaaaatgcaggcagcaggcaatcatgatggtaattatggaatgtattcaaatatatttcttttttttttttaaaaaaaacttttacccctcttctgaaagccatttctaataatgtactttcaaagtttccattaacgtactttcaaagtttctggtttactcctttacatatatctgagaaatagacctggtgatctccggttttcaggggaagtggagactgcccagagccatttagcacattagcaagtggcttgtgattgcatttcacgacctaaatcttagacctgtgactatagtgcacggccaattgctgtccacggtggggggtgggcggcagggaggtggggcactttcatgttaatgtctacttgtgttgttacttctggtgtgttttgagtataactctatttggccaacttttagaaaatcttttaattcccctaaaaaagataccagtagtatctgggaaactctaaattggagaagaaaccagggatgaaactctccttgatatgatgctggtaaaagctttgcatgaagttattggccaactatatgactgctcccgggtattcttgaattcacggagacaggctagctggagaagtaaatcaaatctatagggtccagcatactatgcaaacctcaaatttcttggcccagaaaagtcagtataagtacactgcaattttttttctcaaggaccatttcatttataataaaacagatacatacttgttgatgacagggacaaaataccttaatgtatgtatgtaatatatatatatgtcacttatatttttccacttatgttcttgtactgtttctagccttcatcacggcggcttggattgtcctgtgccaactgtcacaccacaactaccaccttatggcgcagaaacgccgagggtgaacccgtgtgcaatgcttgtggactctacatgaaactccatggggtatgccatgtattctgctcacttgtatatacatttagtatctggtttgtatgtgatatcagttacaaagaatcagcaaatgaaagatactcaagtgaaaaatttgaatgcatataatttattactgaatatgtttaatatattcagtgtacatactgaatatatttattgaattgaaggtgcttttaattataatatgaaatattaccttatgcaccagtaggaaacaaaaaatgctaccagttgaactattgcaaacgttcatttaagacacattccagttttagaaatgtgaaaatgtgaaaagtgtgtattttagaattggtaatatggtagtaactgtttttaaaaatgcacaattaaggaaatcaataaaaaatgcacaatcactagtctatatctcttaaaaattttgaatgtaatcagacatttgtgcaaaagagtaatgcatttaatagttatagtttgaaatatttcatagttcattttaaaggattgcacaaaatataataaacaactcaatcttaaaaagaaaaataaccttgcatctgtaggaggaaggaaatacatgatctctttgaaataatacttcttcaatgaatagctactcatttcaaacaataaacgttaagttgaaggaattaaattctccttggcaaatcatctcattctttctgaaggaatctctgcatttgatgaggaaagtgtagtctttgtgcacttgggatcttgagtgtgtataaaaattggattgaaatttatgccaagttctttttttttttttttttcttgttttgagatggagtctaactcttgttgcccaggctggagtgcagtggtgctatctcggctcactgcaacctccacctcctgggttcaagcgattctcctgccttagcctcccaagtagctgggattacaggcatgcgccaacaagtctggctaatttttgtatatttagtagagacggggtttcgtcatgttggccaggctggtttcgaactcctgacctcaggtgatctgcctgcctcggcctctgaaagtgctgggattagaggcgtgagccactgcactcggccgccaaattcttttaaatgagagcttttagtgccaatgttgggtctttggtttttcttcaatataatattaaatttatggcctatgtgaaaattttttaggtgcccagaccacttgctatgaaaaaagagggaattcaaaccaggaaacgaaaacctaagaacataaataaatcaaagacttgctctggtaaatatactaaaatgacgtttgactgtaaagtatttgccaaccttaacagtagagcatatgtatatttataaggtttattttgactgttgcaggtaatagcaataattccattcccatgactccaacttccacctcttctaactcagatgattgcagcaaaaatacttcccccacaacacaacctacagcctcaggggtaagtattaaaacagcatagactcctaaattactgggctgctctctagtaaattatctcaaattttatcttatctggtagtacaataatctaaaccaacagttcagtttagttagttgatacctaagaatagtttttagaggaaattacatttaaatgtcaacaaaatgacaaacttaagtactttacaaacctcttaattaagatcggtatcatttttttatggttaaattaacccaagtaaaagcaagaagttttggtttaaagtgttttaaattgttttatttccaggtttttatcagagttgctatatatattatatgtgtatatttatgtatttccgatgtagatcataagaactatgaggccagtggtttcatagattacagtgcccataacagttaagtagcttttgtttatcctatcaattccagcctttttttctttttttatcatccacccaaagcaaagctcatcataaagtgttatatgctgctgtattcactatttcctttgcccaattgtgttcttgctgggagagcttgccttcttctaatgtaccttaattgtactggcgtttatttcagctatgacaaaacctaggagtgatttgtgccactgtggacaggagatgcctgggtcttcgtgaggatcacagacttagtttcttataaagctgtgaccaaaactcagtttgcctctagtagagagcattttcccaccctaatgtttcccaaatttacctggaatgcccttctaaaaaatactgggccttccctcagacgtcagtgagctccaaggcagggcctgcggcaagcaggactttaaaatgtgtccttgtgacccttgggactacactgagacaagattaggactaaacaccagcatttaaatgcctatttacttagtaattgttttctacatttagttttctcctgaaattatttggggtactttaaaatactacagattcctgggccccaccctggattttccaagtcagagtctctgggtgtgggacttggatatctatctgttgttgaacaagtgccccaggtgaaattggaactactgccccggaggtgtttgggaaccacagacctggtttctttccactgtatttttactggctttaacaaacaaaaattaaatatttaaaacaaaatgtttaaactgtgcttaaaattatatttgatatttttctttgtcctcctacccaaattcttttgagccttttctgtaaggaaacaaaacgtctttttagagtttcacaagggaagaagccttttagttgtttttttttttgcagactcatggtaaagaatgtttctaggctttataaaggtggactccatgctatggtgttgtgttttacaggcaggttagatgtaactgaggattgaaagtggtaaatagaacatgtttcttgggaaatgaaaagattatttaataataattattttttttttgaggctgagtcttgctgtcaccgaggctggagtgtgcagtggcgcaatctcggctcactgcaacctccacttcccggattcaagcaatcctcccacttcagcctcccgagaagctagaattacaggcatacaccaactcacctggctaatttttttttgtatagttagtagagacggggtttcaccatgttggccagggtggtctcgaactcctgtcctcaagtgatccacctacctcagcctcccaaagtgctaggattacaggcatgagtcaccgcgcctggcctaaaaatatcctttattatgccgtagtcctcaggagcaattatgtagctagaggcaaaacaatttggttttctaaagcagggagggagccgcctctctcctagctgaaatgaggactgctgccagctccaagtcacttttgttggtggtacagtccagcttaaatgtggcaaaaagactaatttgaatgataaattgcactgaggtcgatatatacccaacaatgggcttcggggacttggaaccattgtgggtggagtcttgtgattttgtgacgtaaaatttcaaaatttgctattagcaagtcctatcggttgctgtccagcgaaaggagtgaaaagccagtgaaaagggccatggtctggctagaagaagggccttgggagttccatctctggtcctaggcttattgtcccaggaactctcaccagggacagagcagatggaggtggcttgctggtcaatgcccttcagaggaaagatcagttccccaccagaggccaggaggcaaagcaacaaggatgttaaggatggggttggagagtactagtttcacaccaggtcttcagctgcaagcttccatccctgcggtagtctaggcagcctccacggggactgagaagctgggagtggctggtgtgagctgcagccagggggcatctctccgagctctccagcctctgggctgcgcagcagaaacactgactgccattaccagggcagggggtagggttgctggcctgcctaccaacctccccagttccccagggactgactcttggccttgttccgagggcacacacggctggtgcctgggcttgcagggttttatttcatggatgtctccaaaagcctctacctgctgtggccattgtggggaaacagctactcgtctgctggctgcctttggaagctgtccccctgtaagaatacctgtagtaggcttgagtggtgtccccaggttgttttcatggcgtgcctgcgtataactgtggatcccttcgcactttttgatgtcctctctgggtgggctgagccttcatgtgtatggcatggcccatgtggctgccgagtagctgtgaagagtctgctggaggagccatctgtgagcagctggtagaagcatttctaaaaggtgcctgtgttgacaaaggtgtgtcattttcccattttggtcacagtgcataatgttagagggcagctggctttgtgactgattgcctgtaggattttgtgaaatgctgtgggtgaagaaaatatcagatccacatagcaaggttgtatctggtgtttacaaagtatatgtattacatacacagcaccgaggttggcttggagtttaagcctcctaaggtaatgcgtccaccccacggatctccagtgctccctgtgactgactggtagaaattagtagtgcagggtgaccctcgtttgatggggccacggaactacaaagcaaagggcgatcttaggcaccctcccagcagaaggtggaactgggggccacatatccctccatttagagatgtaagtagcagtatcactgcctttctttaatgactgtgagttatagcaaggaagtaaaaaactgttccagaggcccacatgaaacatgctgtttactttaattccccactgaaaaatcagttgtaggagatcaccggtaggcattcccagcaggcttattgtaagtcctgggacatgacaggaacagggttctgacctgcctttcacgtggccatttaagtgatggcaccaggaccttagcatgacacagagtcctgagctctcttggccaggacgaaaggagccacaggagctgagtattgtggaaggggtctatcgtggttgtctgcttctgggagagggggctccagggctcccctcccctagcaggaatgaaggtgtgggcataattcctagtgcacggcattcttccaggataagttgtcctaatgccacgaaaatttttgtgctgctctgaagcctcatgtcttagctttatatacttgttaatctgtgccttcatgagacctgtgtctgggcaaaaaggagacattccttcagataagagtcagcaagtcgatgaccttgccaccttatgactcagtttctcttggttataggctgtgcatgtgctggaggcacagggagggcagtgtgtttctgtctgaaatcaggaggactcacggtcatacagccctgcttaaaatattgcctatttttttcttttgaaattatttttgtttattaaaaatgtatgttaaacttaaatttttgataaatggttgctttctgtggcaaaaatagtctttctttctggctaagaattttcttatccatgcagatttactaaaaaatgtatatttagttgatctaaatagatatcagtttttctttgggctgggtgcggtggctcacccctttaatcccagcactttgggaggctgaggtgggttgatcacctgaggtcaggagtttgagaccagcctgaccaacatggagaaaccccgtctctactaaaaatacaaacttagccaggcacggtggcgcatgcctgtaatcccagctactctggaggctgaggcaagagaatctcttgaacctgggagttgcaggttgcagtgagctgagattgcaccattgcaccccagcctgggcaacaagagcaaaactctgtctcagaaaaaaaaaaaaattttttttctttggcttttattctctatggattgtaagaatactaaaatcttttttttcttgaattccgtttattgactgaattgtattttatagttttttttggttgttatttaggagagaaacatggtaatgttctgtttctgcaataagatttaataagtagtccacaaatggtcctactcctcctatttctcctcctataactcaaaatttgtaaaactggaggatactttatagctcaatccccaaattttatagataaaaagtttttttcttaatttcttttgtaataggagggattaacttggagatgaaattagcaataatatctgaaaatggcagctacagaaaaaaagaaaaaaaaattagcaataagacaatgtctgagaacaaggagtcactgaacatattttgcctgcctaaaaatagtttctataaataattactttaaaaattaggccaggtgcagtggctcacgcctgtaatcccagttctttgggagactgaggctggaggatcacttgagactaggagtttgagatcagcctgggcaacatagcaagatttctgtctctatttctagtttaaaaaaaaaatgaaaaaaaagtaaaccctatttaagttaatattaaaactaccaatataatattgaaatcatcattaaacataaagtgttgaagttaaatggagagagaaatatatatgaccagcccttgctttactggtctttgttccatttgagtaaaacaaagtgccacatctggaattgtttaaaacatggaggtggtaggggtgggtagagagagacaggtatagatgtagatcttactactggtcagatttggacgtgctttaaaggagtgataactagagttggagatggctccgcagagtagaggaaattaaaattagttaggatttttgcaggggaaaaattgggatagaggtatccaggaaagaagaaggcataggaatctttggagctgaagggaaatagttagttcattgtgactggagtgtagggggtaagaagccaaaggcaggaagtgaggctggtagaacgggtggaaagtagatacttgaaaatatttcaaatcaacgatggactttatttaaatcctgcttcggtgacaaatgtgttttctgtctgtacactggagtccaacaattaggaccttcttactggagcgttctgtattttgataattgatgtaaacaaatgtagcatgctcctgcttgtcaagtttacaagcagagtttcctcctcacaattagggaggaaaaacatctgccagctgattctatgcgctgaccttctttaggcctgtactgtaatttctctgcctccagggatcctgggggcaggatggttggagtggctgcctggctacctcttctaatggaaacatattagacatggtgtattagggataggaaatgtgtttcctcacctttgtggggcattgctggtgatatataacttccacaaagagaggtggacaataggctgagagatagagacttaggttcctcgccagctgcatctgggcctggatgggtgggccttaaccactcttttggtctgtttcttgctagtaaataggcgtcatcgttcccgtcccctgtgtgcttctgggacactgtgtgcttagctagacctatttccctactgtagtcactcctgagctgcgtggtcgtttgaaggagttaagcacccataagtgcttgtggccaacagcagtgatctagagactgactcaagttaagattatttgatgtgctctataaggcctctgaagaaagcttaggcaggtaaatattttaaattgttttcatggattttatttcatatataatatttgcatcctgtggtggaaatagaaaaacaccttagtaggtcctgtagcttactatgcattttccagtgcaggggggttctttattagcagatttacactccactgtctttttcttcaagtaatggaatttttttttgatttactgtgcactatggttggtcacaaaattatagttcctgtgaaagagctgaaaggaacatttgtgaaggacttatgctgtgcttatactgttaagttgctcagaggaaagtatgaaggcgagctctgatgcaagagcctgctggggctggagcagaaaattagtgcttcatttttaacttgaatatgccacagagcttctagaggactcgagagccaaacagtggtggattggtcttcgattttctcatagtgatcttgctttgaggaagtttttccctttcctaatactcactcacttataagatagtgaacatagggaggcaggaaattagtttctatcaggtaccttttatgtgccaggtgttttagatacattttattttttactcctccttctaagtgagatgcagaaggtaaagaacagttccaaggtcacgtgtcaaattgagacgcgtggtttcacgttggccgcaggtctggctgatgcggtcagtgttgttgccactacagcgtgttagattaatatgcgatattagttcatttctttgaaatcttcagagagaagaaagaatgttttcttaaagaaattggactagtttgattaataattttagcatcacatatcctcccactgaaacaggtgggaaaactgtgagaagttatttgctcttgaccaagaatgtatttaagacagttaatgcaaattttcttatcaatgttatacttagaaatcaaatgtgtaatggtactaagaatatggcagttgggtaacattaagttaaaaaaaaagtagtaaaaattacttttgttgacatacctaatgtggttataacaaggttcttttaagagaaacacaagattgccatactgaaatccttctaatgctgcgatttaaatccatacacaaacaaatgctgttttggaacttttcagaatgttaaaattgtcttcaatgaatgtttatgaagaaattactgaaaaagcatttcttaatagtgaagtgcctgttttttttttcagtctatcgtccaaaacactcttttctaaatgagtagcaaaggggttaaaaaatcattaatctcccaaagggtctgtgagagagttatgtggttaggtattattattgcctcatttataaaccaagatccggagtgactccttaaggtcacaaaacaagccagtattgaagccgggactggaaccgacgtctcctgcctcccagtccagggctgttaccactcccagggagttgaccaatcatcacagttattaatatcccacttgccacatgctacaagccatgaacataaatattttgttggcattttatcttcatgctccctatgtgccaggctccctttctttctatgttcacagccccttctaataactcacgttcttgtctgaccacattggcctttgcgtgaaagtcacacgtcaccccggcagggaatgttcaagcatgcggatttgcatactttcattctgatctcaaggctttttctagacttcctttttttttttttttaaatctcgtgtgtgtgtgtgtgtgtgtgtgtgtgtgtgtgtgtgtgtgacagggaggatggtaagaagtagtttaaaaatgcattgtgtgctacatcaatatccaatggctttgtacattaggaaacagtaaagctttaaatagtttgtaacatatgtccacataatttatcacagaattgtggtttatttaataagtgactcattatcactatctgatagccagaatactggataaagaataagtgtgggcagaagttattcaccatttcttatagcctcatcccagaatacagctcttctttgcaaattacagattctttgcagttttctcccacccgcccccccaacgcctctataagaatatacaaaattgtcagaaaacatgaaataatgttacgggaaaacatggccaaatttaagaaatctggcttagattgctctgaaaggttattgctaaatgaatcttcgaagaaaacgaattcctttactggaacaaaagtaatttattatgcatttcatgggtgtctgccagaagagttactagcagtatgaagatccagtggatatgaattaagtacaatctgttagttctgttcatgtttagacctacctgttaattttctctgaaattttaataatttaaaaaagcatctccatagacaggtgttggcaatgtgacaattcaccactcagctacccatcacatcaggcttttttaaaggcccagtactcagaatttgtgagactgagcacaaagacattattttattgacctcatattttaagaatgatttggacaaatacataactaggcattgattctaatgtcctgttggggtcttacgagtaaacggttccaagtcaacatctgacgatgcttaaatcatgatccgacttgatggtgtgctgcctgttttggttgttggcctggcacggtttcaccagagctgggccacatgctgcagaaccatatttttattttattaaacacaagtattttacatttaaagctctcattaaatttagttgcttgattcgtggtgaagcctgaatatggtcaaaagtttattctgggggttcacggattagcagctgggaggaaacagattccagcagccaggcgctagctccagctctgtctgtgtgagtatagcaagctgccaaggttctgtaaagcctctgttttcctccttctactaaaggggaaaagtaattcctaccatctggtccttaggagtattgtgtagagtgagtgggagatgcctggagacctctttgaagtttaagaagaatagcactacttaaatacgggtcttggaagttaatagtaatcagctttatttgcgtggcattttttttcatcccaagatattagaataagatcctcactttcttaatggggaaatttagagacgtagagttattgtgttaagaaagtaaccacattttagagatttgtatttcactgatagcaaattttttattccttctgatacttagtactttcctaatgctttttgtggtttaagtgcattgtaaatgcttcttggtatgttttctgtaattaagatggagagattaagatgctcatccatctcctgaaaagtcagttttgttataaaaattaagatcataattcaccaggttttaaatcttgcctcaggattctgtcccacttaatttgaagattagaatagtgtaattcattctgattcatttagaagataagctttttctttagggtcctcattgacttcaagttgtgggacaaaccctctcccttgcaatttatatttgtacatgagtattttggtgataatcccagagtacttataaagtttggcgcctttcttcaccacaacatgcttgctgttgagtgtgcacagatacataaagcaatttgctcttttgtccagaatagattatgtgcatagaattgctttcgtcttcttgaaaagggcagcatcccttggtgtggctataaccttgcctactcaggcctagaaggggcgagaggggtatgggttggggcagagtgggggagcagccggtgaaatttccagtaaggaatttgtttgccgaattaaatatacaaaactattctgctgaatagttaggtcatcagttgaggtgacggtgactctctctctagagaaaaggtgtccatgttcctttgttttattaagctgttaagaattcgagagtttcattgtgattggttttcacatgtcctggtggagacagaatttgtgtgtgttcatgtgtctttcatgtgtcaccttctaaactattactgtcactttgtatctggtcctctgttacctccagccaaactgaaatgatcgtagtttatatagtggaagttacgatttgcaggaaagcatttcccctttgttggaatttatacaaagtttttaattcctctttggaggaaggcagctataaagcaccacaggagtctaacctagaggttacaaaagcagagaagagctttggcagtgagggacggctggcttcccctcacacaagaaaaagccgtaagcacagtctcactcagatgtgtaggaaggacggatcagaggctgggggagccgacagtctgccttgcagtgaaggaggcatgtgatcaccatcaaagtcttctgctctgggaaggatcacacagtcgtccttcagcctgcctggggcgcagtgttttctttcctcagaccgaaactgcatgaagagagattccagcaaggaagatagagcatgccccgtacactcctctctggttttcttcctcaaaggaaatttatgcatgtaatccacaagccgaagaacccatgtttttctttggaaaaggctacgccctttcagggtttccttttctcggctgtgttgccttcccatcagaagctgtctcttgccctccccattatgggatgtgcgaaatgaaggaaaacagagacactgctgggcatttgtctccatgagttgatccaatcagaaatctttgacttttcagatatgtgtccaaaaatgagtgaaggctcctcacaggaaaaaaaaaaaaaaattctaggtgatctaaagatgaactgtggctacttctcaggctagcggatattttccatgtcccaatctgtagcagcccaagctctccctgaagtcatttactcctttaagagggagttttccagcccagctgctctgcctgtctcccacctaacccggccagctttcagtgctaagcccaggctgggtctggccctgataacacattctttcaacaggaagtgcctccattttcagttgtctgtgggaagggtggagggcaaataagccttgaatggaaacacagagccgatttctgctccaccctccttgcactttgatcagggagagagcagggacctccgcctggcctgtgctgcctgccgaaaggagggaggatggttgagctgtgggcattccggagctctccctcccttttgttcaggaacgtttgtttaggttggtctaggttagtgaagtgcctgcttttgcagggttgtgatgtctgcgatctgaactaaagtcctttgaagggttgaattatttgtgggaaaatatatcaaccaattgaaatttatacgtgtgtttgtatgtgtgtgtattaggtccaggatcatagtatatttttctctgatttcccccctccgcccccccctcccaacacacacacatcgtgttgattctcagtaggcatctcttgactatcatcagtgagggaaagggacttaaaagatgaacaataacaggacaaagccaggcttcttaagaagagtagctgtgccaactctgaacgccttctacttttagaatattggtttagaggccaggcacggtggctcatgcctgtaatcccagtactttgggaggtcgaggcaggcggatcacttgaggtcaggagttcgagatcagcctggccaatatggtgaaaccctaactctactaaaaatacaaaaattagccgagtgtagtggtgggcgcctgtaatcccagctactctggagactgaggcaggagactcacttgaactcgggaggcggaggttgtagtgagccgagataccaccactgcactccagcctgggcgacagagtgagagaatatcggttttgagagctgaagttacgctgatgcatggagctgacgtgttgattgttttaacttgtatagaactgtgagattcacatgtgcgtggctggccaggccctggcctgtgccaggtggcagggagatgatttcaggggcggatgggggcccttctgacccgccctcctgttagtgcctcgactctggttccctcctattttttcaagccactttctgatcccatgaaggttggcttgtccctcaagtgccttgtgtttctggtactcatgtcttctattcatccccaaagttattaggttggtgcaaaagtaattgtgggttttgtcattactttcaatgccaaaaactgcaattactttggcaacaacctaaatagatttactatgcaattcaatttaagtattcaaagaaaaatattcaaagaaaggtatagatggctaatagacttggccctctcagctagtcccctgtttctcccctcctcccaggggacctttgtaatacttacacatgtgcatggataaattgcagttatgacgtgtaattcatatcttgctgtttttcacttaacatggtattacaggattttttccattttgctccatgatcttattatttttaataattgcataatagttcattgagcggatgtgccctgcttttctaaaccgttcccatattattagacattagattgtttctatagtttctactattagaagtaaccttgcaacggttggcttcctttgcggagcctttcccttcttttgaattatttccttataatacatttccagaagtgaaattatagggcgaagtagggtctaaacttctggatggctcttgacattgcagctaactgccttctgtaaggtgggtgtaccagaatttagctccgccagccatgagtgaggggactggtgttaccatgtaagtaacatcagcctttctttgcagtatttcatgtttaaatattattatatgtacacataaaataaggctaccaagcattgggcacaaatacttgccccattttttttctgacaggctcagctattgcttttaattgcaaatgagcagatttatttctaggagtgcatcactcatggaatttgaggtctgtctgccctttgatagcaggactcttggcctgccaaatagcttaacattttgtctgaaaaaaagacaggttattttcgccaattgcttttgggattgttattcaggtgtaagaataacattcagggtgttaacgtttctttaatgtgggttgttgaaaaagagtcagtgagtcaccaggtgtggtagctcgtgcctgtgatcccagcactttgggaggctgaggcaggtggatcccttgagctcaggagtttgagaacagcctaggcaacatggtgaaaccccatctttacaaaaaatacaaaaattagctgggcatggtggcacatgcttgtggtcccagttattcgagaggctgagatgggaggatctcttcagcccaggaggtggaggttgcagtgagccaagatcacacccagtgcactccagcctggatgacagagcaagaccctgtctcaaaaataaaaaataaaataaaaaagagaaagagtcatgagacttttgaatggctacagaacactttgatttatttttgcgaagaactgtcagtgacagtttgaatagggtcattctggaggtggttctctttgagctccaactgtgttccgactgcttctgcccctgcctggtgatggggtaacttgcttgggctgaaggatagaatgaggagaataaattagatccaagcctcttaaccttaacaataataattagataacaagagtagcttatactgacataatctttactgttctcagacactgttacaagggctttacatatattagccaattctttttttttttttttttgagatggagtttcacttttgttgcccagactggagtgcaatggtgcaatctcggctcactgcaacctgcctcagccttctgagtagctgggattacaagcatgctccaccttgctcggctaatttttttgtgtcagtagagatgaggtttcaccatgttggtcaggctggtctcaaactcctgacctaaggtgatccacctgcctcggcctctctaaagtgcagggattgcaggcgtgggccaccgcgcctggcctagccaatttaattcttgcaataatcttatggcataggtgcctctttttatcccactttataggtgtggaaactgaggcacacaaagctgtatgtcaggcttctggtttacctctcccacatggtctgttcactcttttgcttcatccttctgtttttcagctggcttttcttctgaacaggccaggtgaccacctctcttcatccgccctgcctcccattttgaacatccttctctcgccaataacaatagcttccctttacggaatgtttaacatggcaaggcaccttgccttcgcttttacaaacgttagctcatttaattgtcgcaaccatccctgaggtgggaaatgtgaggacccaggcacagaggaggctcaggggggactgcactcagcaggggactgaatcaggacaggacttgagagtccaagctgcttcccctccttctcatactcctgtgtgggctgcctttggttccttgcccaggagtccttgccctctgctattccttttctgactcttggtctaccttcctgtctcagccactcatttgttgttcatgataagcagccaacagtcgactttctaatgtgtatggatcctggctccccacaaagcctgggagctcctggggcagttgactatctttcaggctcctgatctagtgtctggctgtcagttgttgctttgccaatgtttctttttttcttctctttctttctttttttttttttaatttttactttttagagacagggtcttgctctgtcccttaggctggagtgcagtgatgcaatcgtagctcactgcagccttcatcacctagactcaagcaatccttccatctcggctccccaaatagctgggactacatgcccagctaacttttgtattttttgtagagacggggtctcccaatgttgcccaggctggtctcaaattcctgggcttaagtaatcctccctcctcggcttcccaaagtgttgggattaaaggcacgagccaccgtgcccagcctgcttatgcttcttgttgctggctgtggtggtggtgacagatccctctgctgtcttggcacttccctgccatttgagatgggctatttcctgggccagttcaggaaccctctccatttcagaaaataacacttgttgcggtgaagtcagatttagtcagaggcatatgctgatgtgcctgttttcgaataagaaaatcaatgcaaagttggacgtgagatgtatcattataaggaagctcactctaatagttcctttctaaataaataattcttttgtaattgaatatcatccttttgcttatttctttgagggttaaatctggatccacactggatttgcttctggtggagtctctggaattaagggctaaagttaatcactatgtttataagtataaccaagtttatggcattcagtttgttggacaggattattttagctttttcagaattgccacaagaatccatctgaagctttagacatctcactgatttttgtgaaatttgctttttaatgcacctaaaaccctcagtttaagtctttacatttgtgttatataaacaaaagtttgggtgtggggccagtgttgttgctggattttcataaaacctcatttctgctgggaaagggaaggagtggttacctgtggaggggtcgggtttggtctgtctggttgggaggaaggaagtttgggtgcttagactcagagggcttgctcgcctgaagtcctgcctcccagcctcatgcccttatggtgagggttgagagcaaaccagatcttgttggaaaacgagtagagttggacctcattcacttgcaggccgtggaggctcggcacacttcctttctgttccgcctgtgtctggtgccagagaaatgctgttttaaggatttaatgggattatgtatgtaaaaaagaaattctgtgaaaagtacacaatgtcctacctctgtcaaataacaagtatctggtaatttatagaatggagccctgaaagcttggaaggaataagagctcctgaacttttagaaggaaaaaggtgattttaaaaagtacatgattatggcgaaatttttcaaaaagcttctcaaaagcaactttattcaaactgttgtctaaacagattttagttattttggtttgattttactaaattatatgatgtttcctatttggcctttttcatgtgaatgggaggaatgggtggaacagggcaaaggtgaacttgtgcttcaagaaatcattgtggccaggcacagtggctcacgcctgtaatcccagcactctgggaggcccaggcaagcagatcacctgaggtcaggagtttgagaccagcctggccaacatggtgaaaccccgtctctactaaaaatacaaaaattagccaggtgtggtggtgcatgcctgtaatcccagctactcgggaggctgaggcaggagaatcacttgaactcaggagatggaggttgcactgagctgagatcgtgccactgtactccagcctgggagacagtgagactctgtttcaaaaaaaaaaaaaaaaaaaaaaagaaagaaatcattgccatgatcatggcagatagaggatgttagcattttctttataacgtggtctgcttcagacatggactgttcttgtaaagaattaaggtaaatgaggtagattttaaagcctgtatatgcataggtttattttccatgaagtcaatgttcaaaaatttcactgatcagggaatgttgaactgtgcagcttttctaaaaagtctaaaaagactttgccatcactggataagccttgttagagtgtgtgtgtgtgtgtgtgtgtgtgcgcgcgcacgcatgcgtgcgctctgcattttctctttggaaatgatcaggttgtgtgtgcatcattaatgcctattcacccacacagtgaggtttgtttcacagtcagagatcttagagcttggcactttttacaaataggatttcttcagttccccttccttttgtccagctttgcatcttgccagtggctcctgccctgagttctaaagtttcgaaggcttaagtggccagggtcaggtcagtggcactgtgtgcaatgcagggaaaggcccccacttgctgggggcaggggatagtaacgccggcttcatttctcctgccctgggtctgcccaggagcagctctggccctggctgcacagaccccgttcattagctcccatgtatttcactaccaggattgtaaccgcttctcaccttctcgtctctcctctgtgtccccctcttctgccaggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcggtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatgcttaaaaatattccagaaagttcagattttttttctttgtgaatgaaatatattctggcccacgaacagggcgatttcctttcagttttttccttttgcaacgtgccttgaagtctcaaagctcacctgaggttgcagacgttacccccaacagaagataggtagaaatgattccagtggcctctttgtattttcttcattgttgagtagatttcaggaaatcaggaggtgtttcacaatacagaatgatggcctttaactgtg

SEQ ID NO: 1683 - DNA, 68127 bp, Homo sapiens
agacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggtctggaaagtcctggggaactcgcagggcacgggccgctgtcgcggttgggaggcgagggcgcagcgctggggttgtagattccaagacccctgagggtggctgtgttggtttctcgcaggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcaggtagagtatggggtgtggtctgcctatacagaatggcagcccacctgctttcatacccttttttttttctttaggataattcgtaactaatattttgggtgagtgaagtgtgcatgttaagagtacaaaatagttttatgattctatgctggtttaacaactgtctcctcccttcaggcacgtagtttcagaaaacttttatgaaatctctgcttcctaccattttgagacagggacagttttactgctattggttccttcagtgagtgcaagaacacacagagaacttggtcacttctaaattttatcagctctgacaaaatggtgaataggaaagttatctgacttcattgtgacacgtctacctacctctaattgtactttatcagggatgactacatttgcagaagagatatgtttaaaggaaggtacctgaattcctttcttcatgtctgctcttattttatactgtctgcaagctaggacttgcctagcaaggttgcgctcccacctgtgagccagaacgtgggctcttggcagactctaggagcctttctgtttcttcttcttatccttccatgcatccttttctttttttgactaagttctacccttcctcctccccctgccttggagttaggacatcttaggctacacgtattttcactgaactgtaaagaaaagcctggggtttagtggctaattagtaaagaagctaggaagatgggttgcttaatgaaatagaagtgaaatatgaaaaatgatacttatttggtgtaatctaaatggtttatgcagagtcttcttcaatggggaaggaaggtgcggaaagaggaagatccattgcaaggaccataatgaaaatatttaagtattttagattaatagatacataccaataccttgtataaagtttttaaactcacagaacaatatggaaaaatatatttataccctggtgatctctaaggtatagaacttttcaaataacctttatgatataatatttgtatatcaaaccaaagtgagttaggcagtatatggaaaatgggctagcccttcaaggctatcactgttcctagttcttttcagttcaacttgtggtctgataaagtggcaaatgtatactttttcttatttattattattttttattattatactttaagttctagagtacatgtgcacaaagtgcaggtttgttatgtatgtatacatgtgccatgttagtgtgctgcacccattaactcatcatttacattaggtattcctcctaatgctatccctccccactccccccaccccacgacaggccctggtgtgtgatgttccccaccctgtgtccaagtattctcatttttcagttcccacctatgagtgagaacatgtggtgtttggttttctgtccttgtgatagtttgctcagaatgatggtttccagcttcatccatgtccctacaaaggacatgaactcatccttttttatggctgcatggtattccatggtgcatatgtgcctcattttcttaatcaagtctatcattgatggacatttgggttggctccaagtctttgctattgagaaaagtgccgcaataaacatacatgtgtgtgtgtctttatagaggcatgatttagaatcctttgggtatatacccggtaatgggatggctgggtcaaatggtatttctagttctagatccttgaggaatcaccacaccgtcttccacaatggttgaactaatttacactcccaccaacagtgtcaaagtgttcctatttctccacatcctctcccgcacctattgtttcctgactttttaatgatcgccattctaactggtgtgagatggtatctcattgtggttttgatttgcatttctctgatggccagtgatgatgagcattttttcatgtgtctgttggctacataaatgtcttctttggagaagtgtctgttcatatcctttgcccactttttgatggggttgtttgatttttttcttgtaaatttctttaagttctttgtagattctagatattagccatttgtcagatgggtagattgtaaaaattttctcccattctataggttgcctgttcactctgatggcagtttcttttgctgtacagaagctctttagtttaattagatcccatttgtcaattttggcttttgttgccattgcttttggtgttttagacatgaagtccttgcccatgcctatgtcctgaatggtattgcctagattttcttctatggttctaatggttttaggtctaacatttaagtctttaatccatcttgaattaaattttgtataaggtgtaaggaaggtatccagtttcagctttctacatatggctagccagttttcccagcaccatttattaaatagggaatcgtttccccatttcttgtttttgtcaggtttgtcaaagatcagatggctgtagatgtgtggtattatttctgagggctctgttctgctccgttggtctatatctctgttttggtactagtaccatgctgttttggttgctgtagccctgtagtatagtttgaagtcaggtatcgtgatgcctccagctttgctctttttgcttaggattgtcttggcaatgcaggctcttttttggttccgtatgaactttaaagtagttttttccaattctgtgaagaaagtcattggtagcttgatggggatggcattgaatctataagttaccttgggcagtatggccattttcatgatattgattcttcctatccatgggcatggaatgttcttccatttgtttgtgtcctctttttatttcgttgagcagtggtttgtagttctccttgaagaggtccttcacatcccttgtaagttggattcctaggtattttattctctttgtagcaattgtgaatgggagatcactcatgatttggctctctgtttgtctgtttttggtgtaaaggaatgcttgtgatttttgcacattgattttctgtcctgagactgctgaagttgcttatcagcttaaggagattttgggctgagatgctggggttctctaaatatacaatcatgtcatctgcaaacagggacaatttgacttcctcttttcctaattgaataccttttatttctttctcctgcctgattgccctggccagaatttccaacactatgttgaataggagtggtgagagagggcatccctgtcttgtgccagttttcaaagggaatgcttccagtctttgcccattcagtatgatattggctatggatttgtcataaatagctcttattattttgagatacatcccatcaatacctagtttattgagagtttttagcatgaagggctgttgaattttgtcagaggccttttctgcatctattgagataatcatgtggtttttgtctttggttctgtttatatgctggattacgtttattgatttgcatgtgctgaacaagccttgcatcccagggatgaagcccacttgatcatggtggataagctttttgatgttctgctggatttggtttgccagtattttattgaggatttttgcatcagtgttcatcaaggatattggtctaaaattctctttttttgttgtgtctctgccagactttggtatcaggatgatgttggcctcatgaattagggaggattccctctttttctattgattggaatagtttcagaaggaatggtaccaattcctgtttgtacctctggtagaattcgttgtgaacccatcttgtcctgcactttttttggttggtaggctattaattattgcctcaatttcagagcctgttattggtctattcagagattcaacttcttcctggtttagtcttgtgacggtgtatgtgtccaggaatttatccattttttctagattttctagtttatttgcgtagaggtgtttatagtattctctgatggtcgtttgcatttccgtgggatcagtggttgtatcccctttatcattttttattgtgtctatttgactcttctctcttttcttctttattagtcttgctagcagtctaccaattttgttgatcgtttcagaaaaccagctcctggattctttgattttttgaagggttttttatgtctctatctccttcagttctgctctgatcttagttatttcttgccttctgctagcttttgaatgtttttctcttgcttctctagttcttttaattgtgatgttagggtgtcaattttagatctttcctgctttctcttgtgggcatttagtgctataaatttccctctacacactgctttaaatgttttccagagattctgatatgttgtgtcttttttctcattggtttcaaagaacagctttatttctgccttcatttcgttatttacccagtagtcattcaggagcaggttgttcagtttccatgtagttgtgcggttttgagtgagtttcttaaccctgacttctaatttggttgcactatgggctgagagacagtttgctacaatttcttttcttttacatttgctgaggagtgctttacttccaactatgtggtcaattttggaataagtgtgatgtggtgctgagaagaatgtatattctgttgatttggggtggagagttctgtagatgtctgttaggtctgcttggtgcagagctgagttcaattcctttatatccttgttaacttttggtctcattgatctgtctaatattgacagtggggtgttaaagtctcctattattattgtttgggggtctaagtctctttgtagttctctaaggacttgctttatgaatctgggtgttcctgtattgggtgcatatatattcaggatagttagctcttcttgttgaattgatccctttaccattatgtaagggccttctttgtctcttgatctttgttggtttaaagtcttttttatcagagactaggattgcaacccctgctttttgtttttttgttttccatttggttggtcggtcttcctgcatccctttattttgagcctatagtgtgtctctgcacgtgagatgggtctcctgaatacagcacactgatgggtcttgactctttatccaatttgccagtctgtgtcttttctttgggacatttagtccatttacatttaatgctaatattgttatgtgtgagtctgatcctatcattatgattttagctggttattttgctctttagttgatgcagtttctttctagcgtcgatggtctttacaatttggcatgttttagcagtggctggtactggttgttcctttccacatttagtgcttcctttaggagcgcttgtaaggcaggcctggtggtgacaaaatctctcagcatttgcttgtttgtaaaggatattatttctccttcacttatgaagcttagtttggctggatatgaaattctgggttgaaaattgttttctttaagaatgttgaatattggcccccattctcttctggcttgtagagtttctgccaagagatcagctgttagtctgatgggcttccctttgtgggtaacccgacctttctctctggctgcccttaacatttttccttcatttcaactttggtgaatctgacaattatgtgtcttggggttgctcttcttgtggagtatctttgtggcgttgtctgtatttcctgaatttgaatgttggtctgccttgctaggtagggtaagttctcctggataatatcctgaaaagtgttttccaacttggttccattctccccatcactttcatgtacaccaatcaaacgtagatttggtcttttcacatagtcccatatttcttcgaggctttgttttttctttttactcttttttctctaagcttctcttctcgtttcatttcatttcattcatttgatcttcaatcactgataccctttcttccacttaatcaaattggctactgaagcttatgcatgcatcatgcagttctcgtgccatggttttcagctccatcatgtcatttaaagtcctctctatgctgtttattctaattagccattcatctaatcttttttcaaggtttttagcttctttgtgatggtttcgaacatccccctttagctcggagaagtttgttattaccggtcttctgaagcctgcttctgtcacctcatcaaattcattctccatccagttttgttccattgctggcaagtagctgtgatcctttgaaggagaagaggcactctgatttttagaattttcagcttttctgctctggtttcctatctttgtggttttatttacccttggtctttgatgatggtgacctacagatggcgttttcatgtggatgtcctttttgttggtgttgatgctattcctttctgtttattagttttccttctaacagtcaggaccctcagctgcaggtctgttgtagtttgctggaggtccactccagaccccgtttgcctgggtatcaccagcggaggctgcagaacagcaaatgttgctgcctgatccttcctctggaagcttggtctcagaggggcacctgcttgtatgcagtgtcagttggcccctactgggagatgtctcccagttaggctactcgtgggtcagggacccacttgaggaggcagtctgtcggttctcagatttcaaactccctgctgggagaaccactgctctcttcagagctgtcagatggggacgtttaagtctgcagaagtgtctgctgccttttattcagctatgccctgcccccagaggtagagtctacagaggcacacagcccggtttgagctgtggtgggctccacccagttcgatcttccgcactgctttgtttacctagtgaagcctcagcagtggtggactcccctcccctagccttgctgccacctcgcagttcaatctcggactgctgtgctagcagtgagcaaggcttcgtgggtgtgggacccaccaagccaggcacgggatatagtttcctggtgtgctgtttgctaagaccattggaaaagtgcagtattagagtgagagtatcccgagtttccaggtaccgtctgtcacagcttcccttggctgggaaagggaattccctgaccccttgtgtttcccaggtgaggcgatgccctgtcctactttgctcacactctgtgggttgcacccactgtccagcaagtccaaatgagatgaatccggtacctcagttggaaatgcagaaatcacctgtcttctgcgtcgctcacgctaggagctatagactggtgctgttcctattcagctatcttggaacaataaaaacacaaaggtttacttctgagcactcattttaatcttgttttcattacgggaggaaagggtctaggagcaaatgtaaactccaagttttgctaataattgataaggccgtaagttctgtttacaagggccaaccaagagggccacagtgtccctgaaaaaatggagacattccaaagccggtttcctgagagattcgtcttaaagtacataggactggctacttctcaagatagagcattcaggcttttctgttgaccgaattgttgtttaactaggaccaattaattttgcagttttacttgtgccagcttttactttgcttgccaataactaattgcattgttttcttatttttgtttttaacaccaacagtcagttttttgtatttaaaaaagccactttgggatactgaagttttaagccaagactatttagttgattggctcggtaagtaggtcactggagaagtcacccattctttctggcataccttcaaatataaatgagatatatgttttccaaagatggaaaaattctattttgattaacagattttgtaataagatgtagcttagatcatagtcacttttatacttaaaatactgtgttgttggcatctggagtctcatttgtgaacaatataaacatactctttttagcacattaaatttcagatttcttggattctcattggatgtttctgatggtgtactattaaatcattatacccccagggagagtatattgaggtagaaagatgaatcatgtggttcagacggaggtaagccagacagacccaaattccatgtatggtctgccacttcctggctgtatggttaaagataatatcatcagttaccctggatctcactgaacttagttgtaaaatggtgatgataccatctgattcacagtataattctgaggattaaatgacacatcttttgtaaagtggctagctgagtgcctggtatgtactaagtagatcttattgtatttaaatgattgctattatgattatagagtaatcctggggcttttaataagggatctcatttggattttgcagctacaaccttatttgatgttagctagtatatacagtcatgaatcacttaatgacaaggatacttttcttagaaatgtgttagacgggccaggcgtggtggctcacgcctgtaatcccagcactttgggaggctgaggcaggcagatcacctgaggtcaggagtttgagaccagcctggccaacatggcaaaaccccgtctctactaaaaatacaaaaattagccgagtgtggtggcagacactggtaatcccagctacttgggaagctgaggcaggagaatcatttgaacacaggaggcagagattacagtgagctgagatcgtgcaactacactccggtctggggaatagagtgagactccaaaaaacaaaagcaaacaaacaaacaaaagaaatgtgttaggtgattttgttgttgtgtgaacatcatagagtgtacctacacgaacctagatgacatagtttactacacacctaggcgctgtggtatgggttattgctcctaggctacaaacttgtaccaggatattactgtactgaatatcgtaggcaattggaacacaatggtggtaagtatttttaagtgaaaacagaaatggtacagtaaaaacatagtggtatgatcttatgggactactgttgtatatgcagtccctcattgaccaaaatatcattatcattactatgtgttagcagtaagttaatgacagagttaggatttgagcccatgtttacctgatatcatgatgtgtatttctcacattcagacttgccccttctgtaaggaggcatatcctttctttacattatttttgctcctgacagtattcaagcatcattccctttcagtaaatacatgttcaacagatattataaataaaaaccccagagtcagtgcctccatggccagtaaagaagaaaccacgcattatcagtgcttagaacactgccttttctagctactgaaccatgaagccatttaaacttcctattaaaatcaattattttcttttgtaacagaagtaattgttgatctagctgagtctaggaatgaaaaagaaaaaaaaaacaaaaagccaaacagtctattctactaaatacaagtagaaatttagaaatgtcctgaaaagtaaaacagataccatgtatggatatcatagtatgtaggtaagataataaaagttcacatgagctatgtattttatctatcggcatacataacactttctataaaacttaaagggggccagcgcggtggctcatgcctgtaatcccagaactttcagaggccaaggcaggtggatcacctgaggtcaggagttcgagaccagtctgaccaacatggtgaaagcccatctctactaaaaatacaaaatcaaaatcagccaggtttggtggtgcgtgcctataatcccagctactcaggaggctgaggcaggagaatcgcttgaacctgggaggcggagtttgcagtgagctgagatcgtgccattgcactccagcctaggcaacaagaatgaaactccgtctcaaacaaaacaaaacaaaacaaaacaaaaaatccaaaagggcatttatttttcctctgactctttttcttagtctttaaaaaacaattgcctttatggttgaaagtcatttggagaattacaatggcttgattgttaacaagaacatttgttaacaataactacaaactatgcaccatttcagtgtaacagtttactaacagtgcaaggctgcatgcattattttgtgtttatagagaagacacaggatttttacttcttacgaagagaaatctgaaatgcttcaaaatatgttgaacagcaaaatactatcaaatctaaattgaaagagttccgggtaattgaatagttttttaaaggtctctatttataagtataatgatttaatatgtggtgtattaagaaaggatggagaataaaatatataccatatgcaagtaaatctgaagccttgtgggtgcctactatgtctaaagtgctttgtaccttttgggagtgatgattagtaacattgacatcaacacaaccaggaaatcccaaccatatcaccaccctcaaaaccagttaccaaatgaacagtggagagtggacaactttttgcaaaaatatgcgaagtaaattaaaagttagcaagtgttcatgtgtatcatagtttttattatgccattcattcactcattcatccagataataaatacttgttgaatatctcctttgtgctaagtcctgaaaatttagcagtgaacaaaacaaatttcctcagttcaagagtttacaacctagttcttgaactattccttgaggctgcatcaacatctatttgtgaattggcaaagagagctttatgattggagggagtcactgtaaagacacatagagcacctgaggcaggtgaggtcagtggaaaaggtactcaaagtagatggatagagaaaaggtgagagagaaaaggaaaggggtgggggaacaagggagaaaaggagagggaaagggagaagatggagatgagggaatgagcaggaggagaaaggaggaaaaagacaaaggtaagcccttcaggcttttatgatttagcatcagaaaatctgaactctagttcccatgccaccttgcctagatgtatgagcttgagtagagtatttgcccactataaccaggcttccctcgtccttaaaataaggttaatatttacctatcatggctgtaagtgttgatcaccaaaaataatgtataaaaacattttgtaatctatgaagtactttaaaatggcaagtattcttatttatcatcagcagcattataattatgactaaacatgccaaaggatatagagataatagcatacaaattttaaatgatataaaagcaccccaacattgttctgtttgttttaagtaaagagaagagcatagatcagtagatggtaatcttggcagcagataatattagcaatatcagagatgaaaaattgggggaaaggttgaggtttaatctcaaacactttaattttcaataagtttcccagagaaatttgggatgccatttgatatatgttctaatccaaaaatacacagatataagacttctgcaagtatttttgagtcttcagactgtgtgggaaggaaataatagtattataaaaattttaacatttttcttatctgtgtataaaaaacttggtgtcttaatattggtaacttttattttcatattttgtatagcctgaatgtgtattttttcagttacatcaaagtggaattgacagtctcagaaacattggactatatagtatagagaccatgttttgagtctgctctgcaacctactaagctgtgttaccttaaaaaagttacttaatagtttaccatttcagtttctaaaatatagcactttacctgtctcccaaaaccgctgagagtgccttttagttagccttgagtacatggcaaccattatttttgttagtgacaataacaagagtaacatttgcctggtggtttagctgaaatcttttcctttggcttattcctaaagacagttatcagataccagccatgatagaaacttcacctatcacagtgcacattatctggcgtggcctatgaaacctgtttggaattgcttctgtataacttatgaaaaatagagtttttctaaaatgtaccaaaacaatgtgtttaaggttctatttcaaagaaaccacactattatttgaagctacatggaaatgcctgaatacatagttctaggaggtataacttaaaaatagaaggcaaaatcattataaagccaataatagaatgcatacatgatgatggtcccataagattgtaatactctattgtaccttttctaagtttaaatatatttaaatacacaaacacatattactgtgttagaattgcctgcagtgttttcagtacagtaacatggtgtacaggtttgtagcctaggagcgataggctatatatcatacagcctaggtgtgtagtgggctatatcacttaggtttgatcaatgattatcattcagtcttgtgtgaattaaatgtaaagaactcaacagaataccaggatcataaagtatattcaacaaatggatgcaatcattatttttaactgcataatggcagagacagccacccatagtaagaagtcacttttgctcaggtctcttcatttgagatttgttgtatggagggaaacccacgtagtgtgttacacaaccttagtgagttggctttaaacagctttcttgtcctctccagtagcagtacatccataactacttcccaaccctcagtggccaaggttggaatgctctcagacacaagtttggagtgaggtcgttagctcttctctggccaaaaagaagaaggttcttctactgttaataacaaagaggtcatgagggagataaccctgatggggtctgagtcttgcagaaatactaccttagtattcactgcgttttaaaaatatatatatcatttacttactaatgagtctgtctgtagattgctttggtctgcatttactcttctaatttcaccactttcttactgaaaaatagcaagccagatgcaacatgccttcttgtgccatttcagtaataattattcattggcaacaggagatgtgttagaaataacatcaaatgaagtgttcgactttttcttttttgtataattttggttataataatataatgtataaattgtgttattatattataataatattcaatctgctcacctcaaaaatgtgggaacaactgagagtgaaaacacataaacccacttagaaacttgtgtgcatatattcagggcagttaaatcatgtcaggaaaaaatatgttattgcaatagaaagacttgtgcttctgttattcatgagttttgtatttcactcctcgagaactttgctatgttaagtgaggaatgaagcttcaactcaccctgcctggttatgcccttttgggtgggaagaggaagggcatggtctgacttggaaacaaaacaggccagaatcactagaagcacttctcccatgtaaggacctggattcccaatctgttgctctcccttccagggtctatcatctcctcttttcagtcttcaactttctatttaatgagcttgagctcattgtatgtcctcatcatcatcatcatcatcacaaccaacagtagtagtaataacaaccaccaccacagcagacaccatttaaggaggactgattctgggtcaggcaccacaatgaatggtttatatagaccatttaattatctcaacaactgtataagttgtatggagtcacttttcaaaagaggagagggagactcagagaaatgaagtgacttgtccaaggtcacacaactagcaagtgtcagaagcagtgtttgaatccagattctctggctgaaaatcctatactctagggaatcaatccagaattccagtgttttgctgaaaccatatttttttgtttttaagccagtggggtccacagtgtatgttggaacccattcttgggcaataattttgcctacttaatcatcaattttcttagaaaccagagctacccgtgcattatgtgaaaagcctgttgaactgctctacatagtaggatggtaactataaggatgtggcaagatctctaatttcactttgaattctaatgttgctttgcagtatgggaagctaaagttaaccatttgtagctgaataccatattaggtttattagtgcataaaatttaaaagttgaaatgcttaccaatgtattaacaaccataatcaatcaattcccatgccatatctttgaaagtattagcttgttttatgtagaataatgtagtttttagtgcagcataaataatataactcatactaatggcatattagagggatacataaaatttttacccatatattttgcagtctcaaaaatgtgaataagatctaatgttgatgaagaaacaagaaatcaatttgtaaaataaatgctaaaggattttaggcagggattataattaacatttttgtacttgcaaccccacctaatgaagtacattgcatgtgggaggaaaaaaatatgtaatttttgaatgaacatgcttctttgaaaacagaaattaagcctacaatgtagactttgttaaaggtcatagaaaatccagctgtctggctgggcgtggtggctcatgtctataatcccagcactttgggaggccaaggtgggtggatcacctgaggtcaggagctcgagaccagcctggccaacatggtaaaaaccccgtctctactaaaaatacaaaaattagttaggtgtggtggtgggcatctgtaatcccagctacttgggaggctgaggtaggagaatcacttgaacctgggtggcggaggttgtagtgagccgagtttgggccactgcactctagcttggaggacagagtgagactccatctcaaaaaaaaaaaagaaaaaaaaatccagttgtctcattttcctgcagtagtttacgatcaaaatggtacaaatttcagtttctgtaaccagttatctatctagcacctaatggcatgcggccaggtagagtgagcagaaggatggaggagaacacacatcattcttttgagatgcttataattctacaggtatcaatggtaatgcagtgaagcataaatcctcatgagataaagtcatttccttaaagtatttaaacaaatgctattttgtgtcaagacaatattcagaatttactgttaaaggacatgaaaagagtttttttctttcttttcttttctttttttttttgttaagatggagtctcactctgtcccctaagctggagtgcagtggcgtgatcttggctcactgcaacctccgcctcccaggctcaagcgattcacctgcctcagtctcctgagtagctgggattacaggtgcctgccaccacacccagctaatttttgtatttttagtagagacagggtttcaccatgttggccaggctcttctttaactcctgacctcaggtgatccacttgcttcagcctcctaaggtgctgggattacaggcatgagccaccacgcctggccaagattcattttattaagaaagactggcagtgataatgattctttatcccctgcatgactcttctttatcccctacatgactcttttattttaactttctctatcctcacccacatttcctaccactattgaagaaataattttgttacactaaattctatttgagaattctaagcatctcacctaaataaaattaattttaacttatgaaagaagtgacattgtatctcctctgattcctaggaaccttctcactttcttttttcttgctgtaaaaattatcactcttggtaaatactcagtttctttgggctctagaattccaacaaagatttggagccacacttattcatattttaactttcttggcacttatttccccaatttagacatacatatcattaagaacatataaaagtttgtgctgggaatttcttattctagatgagagattttgaaattaaagtaatgagtcagttcagagatttgcacttacaagttcaaaacctgagaaagagtcattacaacaaaatctggaacaaacattaaaaagaaagtctagatcctttgcttatccagtttttcatgtttctaacttgtcactcctcctatcatccttggtgatttttcacattttgccaaagcaatctatatacagcagcatgatgtgtgtgtgttaagtagagctaggcattttccctggattcttatattttacttagatttgttatagaaataaaaattaataagacatcttaaggctatgaaccccactttccaccgcatatcaacttcattataatttctgtgttgccttctattttcatacaggttttatttataaactgcttagtcccacttgacatatttatcttgctgctgctttgtgatcaatctgggttatagatttcatgaaagtaaatcaagagttttcccccaatgtatttcattgtagtagaactaacccaatgactgatagttggccttttgagggaaccagatactgatttatgtttccagggaaatgtttaatgcagaactctgaattcaaactcaaagcagaatatatcttgtgattattttaaaatttttcctgaaaaaattagaaaaaatataattgctttaggtgtaaaggtccacattttcatgtacagaacttgagcattctgatccgggttttttttttttttttttttgagacagagttttgctcttcttgcccaggctggagtacaatggcgtgatctcggctcactgccacctccgcctcctgggttcaagcgattctcctgcctcagcctcctgagtagatgggattacaggcacccatcaccatacctggctattttttttgtattcttagtagagatggggtttcaccatgttggccaggctggtctcgaactcctgacctcaggtgatccacctgcttcggcctcccaaagtgctggaattacaggcatgagccaccgggcctggccaatctgtatctattttacatttagcaccattattttttcttttttgccatttatttcttttatgaggtaattttatagttttagagttagtctatggttagattactaattctaccatccaccaacttgtgagcttgatgtatgagtttcctaaggctgctataatgaagtaccacaaacttggtggcttaaaacaagcgaaatttattttctcacagttctgggggctagacatccaaaataaagctgtcagcagagccatgctccctcagaaggatccaagaattttttcttgtctcttagcttctggtagttgccagtaatgttggacttcccttgcattaactccaaaaggccagtggggtactattgtttaatatccccaaggacgttaatatagattttaagataacctatatagcactcagaaatcccttgaaccttctaaatgtatagcatattatagaaataaggaagtaaaatcagagttgccatgtagaatataaaagttgaacttcatgtcagagatccatgctaaagtaagggagtggtgaatttaaaaagaatttaaataatataaataattgtatgcctgtctactctggagaaaaaaatgatgcttcacttgcttacacaaaagactgtataggaatgatgacattgtttcttttgtatcccacagagtgttggttacctcagtgcttaattatttcctcatcaaggacccagtcccaccttctgtctctcttgttttcaccactactcctctcttgaacagatgatatttttttcctgggttactgggcaaatcaggaaggtctggttaagtttcacagattaactcaacatagtctcacctcaccagttgctcctttgttatccttgtagcagatccttcctaagaaacttgtccctttttctttctgaaccttaaattgccaatcacccaaactgtgaattgtaaacattgtacccaataggtaatttctcagtcttcacctctctctcccaccctcccccattttggagtccccactcacttaacttctggctttggaatgatttctaaaccacaatgatcttgtgatttcagagcagtcggggattctcccaaatgttttgcattacagtggaactgaagagtaacctgcagacagcttttggaataactagctactgagttgtacttcaaggaaaatgtttagtgcagtatcctgaatttagattcagacagagttttaaatagttttatttaaaaattggtggagggaaacccataatttgaataatggagtctcttaaattcagtctgaattggactgcttgcattggtctgtcaggtgataactaaatttccctttcagttggtcctgttgaaacggaaccataaaatgactgtgatattacttatccaacataagaaggaaatcagcattttatttacattttatccctgtttcaatacacaaaagcaactccaaagtgaattgtttgagatttaaggtttgcttaactcttcccaaccctttggcttttagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtatgatccaattcttttgaaggctaaaatgaatgcgagaaatttgcaaagcaacagtgttgggcaaatttctaccatgtgtagtgaccaaccatctgagaatgcatgcttgcaagaagatgtaaggatctcagaggctagaactttccaacttggatggaaagttaattatcttaacttttacttgaaaagtcattgtgttcatttggcatttgtctcatttgacaagattttcttaaagtttggtagtacaaagggcatgggagtatccaaacaccttgatccagtctcattgctcagtgtatgatacttgatacttgattttttgggcaagatctttgttagcttctctgatcctcaaatttctgatatctaaaatgaagaaattagtttaaatagtttctactgattcttttggatttaaaaagtgttttaatgtacttgaaaacagttctctatattcctgtgtaaattattaaatcctaaacataatccaggtataccggcaatttaagcacctgttgctggctctcctgattttggtcagggtaattgaatcatgtgacaaacaggaactcttgaaggcactgcaggtttggactaagatacaaaataaaatcaagtaaataagctttattttaagtaaacaacagcaataacaataataaaactgcctgagaattcaaaagaagggcctggcacagtgactactcacacctgtaatcacacactttggaggccaaggcaggaggattacttgaggccaagtgtttgagaccagcctaggcaacacagtgagacctcatatgtacaaaaaaattaaaaaaaatagccagatgtggtggcatgcacctgtagtaccagctactcaggaggctgaggcagttgaatcattctatcccagaagttcggggttatagtgagctgattgcacctctgcactccagcctgggcaacagagtgagactcagtcttaagaaagaaaagaaagagaattcaaaagaaatgttaaacttaattgatttctaggaaaaactgaatggtattaatggtagcctaaataggctttcattattagtttgaaaatgattgttgatttgacttagacatattaagagtattgttactcatttcttgtgcataggttgtgagcaactattgcatagtaaaatttttcttacattttaaaaatctattcagttcctaattgtaatcccttttagactggagaatataatttttttttacatgattagaacagttttgataaatgaactgaaaagtgctaatatgtgtgtggctactctgtccagactgagggagcttctttctcagattgttcaggctacctaatcaggtctattgaataataacaggtctagaagttggcagattgaacagatacacagtcccttaggacaaaaggaatggaactagagatgacagctacaaaattttagaaaaggaggtgatgactgagtgtggtggcagacaccgcagacccaagaagctgaagcttatggtgaagccttgaagaaaattcatttgcccccaccaaaccccagaaaggctcagaaattgggtaccaggtacctcaaagagtagaaaataaatgtgaaactataagcaggaaactttatgggaagtttgtttaagaaggaactatagtcctggattgcttcttccaccctgatagaagtcctgagacgtaattctggaaaagatgaacttctgaaaataccaggaagaacagaggtttaaaaagtaggggatataaaagaaagtctccctccctataaatatgtatatatgtatatagatagatatacatatatgtatatgttctctttaatatatataacttcttttaatacttgactgttttaatctttgagattcttgtctgaggaatctgaatagcccacatgtaaaaattgaaagacactgatcatgatggattcccccaacagaatgtcctggacagtgaaaccaactagtaaataagtattcttcagacacagagattctagttaatattttgtttgtttattttgtgtttttgtgtctgcacttttaaatataaactgatagtcagtagtctccagatatttgaaaaaaatcctcctgaatatattctagattagattgagaccaatacaaacgaaagataaaaaggatgttggagaaaactgacaagatagagaggagaaattttcaaaaaattattattgttaatattctgaaagatggggacaaaaaagtgtcaataatataaaaataacatactacaaaaagaggaatattcagagaacataattgttggaaaatctctcaaaaagtaaagcaaaaggtaagagaaggaaaacaggataggcaacattaggaaaccagtgattctgtccaggagggctgatcttcagaaaatcaagagttctaaaaatgaaaggatgaacacacaaataaatgtaacagaaaaaagcaatgggcaaaaagaacagaaataaggaaggaaagagaagaatggggtgtgaaaattattttgttttcaaattcaaaaatatctagaactataagacctgagttgttagactgaaaaagcctaaaaatttcccagcgaaatggatagatgagactggtcccagtaaaagtcatcatgatattacagactactgaaaacaaatagaagattccaaaaatgaaaaaaaatagaaataccatgttgcatccaaaggataagaaatcagaaagactgataattgctcaatatatatactggaagtcagaagattatagagcaatgccttcaaagtcctgcgtaaaaatgactacttacctagaattctttacaagcagccattcaagtgtataggtggcaaaaaaagacattttcaggcacataaggactgacaaaaacttacctcccaaatgctctttatcagatagctactgaaaccaaatgtgtgctaccactgtaattaatttctagaatcttagatctatccagaaaggccaacgataaaattacatagcgtttgagatacaggcctacttagcagcctgtcaaaggagcgttgctaaagtcagaatggcctcttttacaaagcagatagactactttgatatattttctgtcaattgctagtgtagttgttatcagtatcatcttctttctgttacttcctttctagttatatgaatatgtatgcatatgtatatgtatgtatgtgtgtatatatatttcctgttcttttcttttcttccaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtaaggctttattttctttttgataagttttcaaaatgtctaataattagaacaagtatttattaacatttgaagctgtatcggtagaatttagagtgattatatgcatattattttattataacacaatatttattttaaaaaaactacacaattttatggcatattcagtgttttcctgaggtgaaaagaacagttttctgaggatttggccatgtggtcggagctggctattggctgggcttctctctccttgtagtcactcaccctcaaacaaactaccccagattcctcaaatgtagtagaaatgttccaagggagtgagtatggaagctgcataaatcttaaggcctagtcttgaaagacacataggttattttaccttcattccattgatcaaagtaagtcatgggccagcctagattcaagattccagggctggagaaacagaagccacctcttgaagggagaaggagcaaatttacactgcaaaagtaagagccctgaagaaattgctgaggccatctttgcgaacagtctgccatagacactcaataaattagttggtagagcttgtgactcagtagattccattcataaacatgcaagattatgtgtcagtttctagacctcacataatatacaaacagtggagatcatttgctacttgtatttgtctaaaatgctgtaatttttagaatagaatatttagaatatgatcaatatccaccataaatgaagatgagatattaaaagacattaaaatcttcagtggacatacattgttgtcaaaattaggttctgcagtcatttaagaacttttttgttagtactatcttgctaattcaaccttactaacagttgacctcaagatatgttgaggtggccgggcgcagtggctcatgcctgtaatcccagcactttgggaggctgaggcaggtggatcacgaggtcaggagattgagaccatcctggctaacacggtgaaaccctgtctctactaaaaatacaaaaaattagccaggtgtggtggcaggcacctgtagtcccagctactcgggaggctgaggcaggagaatagtatgaacctgggaggcagagcttgcagtgagccgagttcgtgccactgcactccagcctggatgacagggtgagactccgtctcaaaaaaaaaaaaaaaaagatatgttgaggctgctttaaggtttaaaaatgaataatatgtatatattccagttcacaagtaagtgaatattcttggcttctatgaagaaggatgactcttatcaatagccatgctctaatactttaactcttttacttattttgactgttgcttttctcctgtgtattgcaaaaagcatattttcagtcaaaatttagaattacaatattttaacagagtttttggacggtaaaaattagtgtttccaaatgagtttgatataaattattgatgatgagttattaaagttttaaaatgagcaaacatgttctagacagagaaacatcattcatgttttatgttcattctgcctttgaatttttttccctagtgcctgtttttgtcttttcttataggtgccacttgtgtgttaaagaagaaattttcagcaagccagttttggagtgactgcaagaagtatgatgtgactgtgtttcagtatattggagaactttgtcgctacctttgcaaacaatctaaggtaggcgtaatcattatcagaaaaaaatatgtcagaaagaataagtattgagatagaaaaggttatttttatttctttgtttatactctacctttgttactggcgggtctttgttcttagagcttccaagatagtggcaggtgctacctagatggtggcgggcagctcccaagatggtggcaagccttgtgttctctgatctggggttcttggcctcacggattccaaggaatggaaccttgggccatgcggtgagtgttatagctctattagaagccatgggtcatggaagagaaccgtggaacccagcgactagtgttcagctggattaggacgaacctgggcacttagccattcaggaacaatggcgagcctctagcccgattgggagcggcaatgggcaccttgctggatcagaagcagagcagacaccctgctggatctggaggggtggaagtcagcagcgggtctgcgatggcggagatcagcagtggtggacggtgagcaaaagctcagcttgagccagaataaacacagaccagaagagtatgcagttgcaagatttaatagagtgaaaacagaactctcatacaacgggaggcgacccaaagcaggttgccactgccggctcaaatgcctgggtttatatctggatctttgtccctccccctgtgctctcaggtgatagatgattgactatttctttacctcctgcttttagcctaattggtattttagtgagctctctttatgacctgattggccgggtgtgagctgagttacaagccccatgtttaaaggtaggtgcagtcaccttccccagctaggcttaggaattcttagtcggcctaggaaatccagctagtcctgtctctcaccttctttcagaacataatttagctgacttacaaagatgcgtgcaataccccaagataaaataagacaagtgaaagaaaataaacagagagctatccaagaatgtactaatgtgctttgtactgtagcaggataggactgacccaaagactgtgtttagactaaaattaaaatttctataaacataacacgcatcagattatgaaattagattcatgctatgtttacagaaagcaattattctaaggttaaaataatcttttaaaatgctgttctttaaaaaaataactactgaccactgacactgattataatttattttctattttttcttttgaataagtgattatattaggatatctttttgttttactttaaattaaaaaaaaaaacccacattgctttgatttgcacttgtctccttaactgaagaagtcatttccacattcgtttgatcaactgccaccatctgaaaaacagataagcagagacagttgcaatagcctgaagtttatctttattggttcatttgtttttttgccctcagaagttattttctttttcctgctttcgtttatctctccaaatgcttcttctttaactttatgattttctaaacattcttgagactataaagaagttactttctttaatcaaatttatttaattctttatattattttattattataaattatttatcttttattatctgattattttaaacatcagatccacatcagccccttcaagaatgacaatagagtaggatattgccctacgtggggtggggcaacagaaccttggcctttgagacccacctttccttgactagaggatctctcaatagagtaggatattgccctacgtggggtggggcaacagaaccttggcctttgagacccacctttccttgactagaggatctctcacttatcacctctgccatcatcacatctgcttaaggcatgaatggtgtgctgggatatcttctcttctctttggctaaaatctggccatgtaatttttcaattaattacccagagcacagctgacactaggctggaggcatttaaataagactttttcattttgagcttggagttcaccaaggagaaacctccagtcgagcttctgacccacctccctgtggcagaagccatccttactcattttttgcctggagtgcttcaaataactatagattccacagattcatagccaagacaaagagttccagataaatgttttacattttttaaatatttttctcttcaaggagaccttgcctcaggtaagggaggtagtcttaatctaaagaaccccaataatacacttagaatgccacaacctcacatattttatcttctagttttcattgtactttttggtaatgtgatatctggactaggttaatttagggaattaatgccctccagtaagattaaggtcaccttcagttgagatttcatgactttagtacagaacacagtaggtgctacctagtgaagctcatctgctttctaaaccatgtgctccaccattcctgtttcctctcatcctttaatagtgacatcagtttgtgtaatgtcattgctcagtaaatatttattgaatggttgaatacatgaatttacttatttctaaaatttaccaacttaatgctgcatttagtatcttcatgcaattgagctaatgtaggttttcagaagtgaatgtaaatagccaaagtatgtggatacttttgcgatttatagaaaatatttctaaattgctgttcaacatggttgaagtgatttagaagctcatgcacattgtaggagtatgcctgttgcacagtgtctgtcagtactgggtgttattaaaaatagtggttttccagttgtgcttcttggaaaattagaagctcttttaagctccctcaaaagtccttgaaacatggtgagtaagagtaaaagcaggccaatttccaaggcccaccctttcaaatatcatgaattaaacccaatttcctgagctcctcaataatgctttgtttgaacaaaggatgcctcagtggtttttaattagaaaaagtaaattcgattatttacttttgtttataattttatagactagaaacaaacatatattaatgtgctctgttaagattactggcaaggtgggacagttttccagctgtatttccctttaaaaatgtctcttttgtgtcttgtactcatttatttgtctggtacataatgttttaccttatccagttgaactcccacttcatataataaaggtattaatagtttttcatattgattacaaatcttttctcagtgtttttctttaaattttttaaagaaatgaaatattctttttaactctctgaatctgtattgcactgatttggaggaaatattatagcttcggagaatttgagagaactgagaattgaaaacagaatgcctgattgctttttaattaatttaatttttaggggtgggcatggtggttcacgcctgtaatcccagcactttgggaggccaaggtgggcagatcacttgaggtcaggagtttgaggtcagcctgatcaatatggggaaaccatctctactaaaaatacaaaattatgtttttgtaaaatacaaaaatacaacatggggaaacgatctgtactaaaaatacaaaaattagccgggcgtggtggcgagcacctgtaatcccagctactcgggaggctgaggcaggagaattgcttaaccccgtgaggtggaggttgtgtgagccgagattgtgccactgcactccagcctgggtgacagagcaagactctgtctcaaaaaaaaaattaatttaatttttaattttaatttttaactaaatctcttcaaagaaaaaatgatgtttatcaaataatctgcaaatgcttacctgaatgcaaactgaggaggaaagaaggaaataaatacagctttacccaaagggaaacttaataatttttttttaagcagagaagcattgtactacctaataccctttgttgaactcacacaaaatgagtacaagctgttcttggcattacaaattaggaaaaggagaaagtcattctgttatgacatcttttcccttcaaggagatcttacatttttgctgtccaatattcctttcaatgacattcccttgaaatgaaggggcagtttctgctgcccagccagtacatcagtggattcaggtagagccagagaatgaacacgtgacatggtccaggtccttaccttcaaagaattaaaattgaatgtctcataagccatggtttgaagccccacagacagttatttaaaagaaagcaaaaccatgtggttttaaaatagattcagatttgttgacaatctcagggtaagtagcatattccaaaggaaatttacctgcaggcagaagtcagaatgtgagttgaatgtttatgtgtagttgcacaaagactccctagggttggctttctatggccagaagcatttatcctttcccatctctcaaacatgcaccctattccccactgcttctctttttcaaaactccagttacaaaagttcttttggcataaacgttagatgtacttctttaaaactgctggcagcagcattgttttcagaaaaagagactgactcctgttagtcatggtgagatgaagttgttcttctcttcccctgagactaggaaagcagctctccctcacttttaatcttccaagttttctatgtcactaaagcaccatcatacaatctgattgggtctagttctatattttcttaatactaatgttgtctttaatattgattggtgaggaatatgttggaactctagacatcagtgatcctctaggggagtcttgctgcagagtttgtcttatataagcaattccacctaacacagtcaacagttagccatatctagggatatatctagggatagaccatatatgtaacatattcatttcctcattcattcattcattcaagtaatattgtaggattagatatacaggacacacaggacaaatcagactgcttctctcttagaatttatactctctttgatgagggggagagaaaataaacccagcaaacacagatgaaaagtaattacagacaatgacaaaggttatgaagaaacaaaacagggtgcggtgatggagaatgatggactgtgggagtaggacattgctaattagatttggtggtcagggatggcttcacagaaatagtaatctatgagccgaggacctgatatgacaagtgggatccaggcacagaaaagctgggaggttgccgtcatgacagaagaaactcaaaaggaagagccccacagaaaacaccacctgaatgtttgaagagaaggagggtatgctgggccatccattgactagatcttgtagggcttgaatctttgtaatcttggaggagaaacttggattttattcccatcagagtagttgaaaaaagatgaaggaaaaactggaaaaaattagaccactttgggatctatcttgaaggaaagctaacaagacttgttagatcaaggataggaagtgaaggaatgggtagaatcaaggataagtcccaggtttttggttcaaacatgtaggcaaattatgaactatttgctgagatgaagaaaactgagattcgaggaattaaaattaatttttttgatctgttaagtttgatatattaggcatccagatgaataagctaaataggcaattggatgtaggaatctgaagctcgaatagtacaaaagacaggacctaattaacaaagcaaggacctatagtgtgatacatgtatgatgcttatttttcaagctactatttgtagtttgacatttaggctatataatttgtctatatatgtcaatgtagaacacccacattttgacattctcaaggcatagtctatacttattaggaatgcattttctaaaaattatatcccctttccttattttgttttcttaaaagctaagaaattccctgggagccagaaaacatccttatgattctgaatacttttggtaaagaatattgaaatttgacaaaatgtcttacacttgactcccattataaaaagagaggtgttttaaagtatcagtgtattcattaagtatttttattcatttttaaactttacaaattgtgttaaatttttcattagtaatgcttagacaatcctgcagtgagcccctaagagtttacaggtttttttttattattttgttttgtttttctgaggctgacaagatgaaaattttggaacacaagaagtgatttatggcagtgtgagagtgtttaagagttcaattagaaaggaaacctgctttcttttctccaaaagaatgtatcattcctttcaagagttttctttgtcatatctagatatgatatggaaatgaagaagattcagtagtgccagagaataaaattccaataaggagagatcgaatgatgctatcttgatcttcgtatcttgaacttgtttgtttgttcatttgtttcgccagttactttttgaatgggaccaaagacggtcataagctaaaatcttggctttactttgtacctggttaagtgcattctatttattcttttttctttattgaaaatgggcatattaaaaatattctctcatcacattttcatgttcttagtttctacataacttcaagtgttttatcatgttttctccttttcatgtcctttaaaagatgtaatcaatcaaagtacatagttttggaaaacttttcccaccacattttagtaactttttaaaaatagcattttaaaattaatgtaaactttaattgttatcaagatattctgatatagtttcattacaattctctgtagctttcaaaacaattgattttgcctgtaagatctagttaaagacatttatatattttttattatttgtattcctcaaatatttgaagcatattatatggttgagaaagtaatctctctttcaaaacccagttttccttaaataagtcaaagatatgtttacattgttataatagatataaaagcatttagagaagttggtaagctgccagaaactcttttcagcttagaaactgtaaatgtagaaatacaaggggctaacataaatagctgttagcagcctgaatgctagtggaattacacaggaatttgtgaatattttggagtgttttagaactatgtgtatatattaaaggctttttataagtgctaattttaatagttaatgattcacatttcataggtagcagtgcatgtaaaatatacacatctttttctatctgtcctttatgccatttatgctaattccattgaggatacatatatcccgtctttgtaaaatttcccaagaaatttagctttatgtaggaaaccatctgatagtgcattggctacggaatctaatgacataggcttaatttcaagctcctgttgtttgactttcagttgctcacttctttaagccataattcttctctttatataaaataagtaacaatacctacttcttctaattggcccttgattctcataatccagttatgagatatatgtgaaaaactgtaaacaaggaagccgaatacaaatggaaggattttaaacaaaatgtaggttgaatgcagtgactcatgcctgtaatcccagcactttgggaaaccaaggcacgaggattgcttgaggccagaaatttgagatcaatttaggcaacatagtgacagtcccatctctacaaaaaaaaaaaaaaaaaaaaaattagccaggggtggtgatgtatgccattagtagtccatgctatgggggaggctgaggtggcaggatcatttgcacccaggagtttgaagctgcagtgagctatgatttcaccactgccctccaacagcttgggtgacagagcaagaccttgtttcaaaataaaaaaagtaatattttacatgaatgtatttataaaattagagtaattttgtagaatgtatttataaaattagagtaattttgtagaatgtatttataaaattagagtaattttgtaggtattgaaaactaattggtctttgactaataaaaattacataatactgattgtaaaattccatataaatagatcatgatcattttaaaataaaactttaataataaaatattaacaattttatagtggcttgtcacaaaaagactaaaaataaaaaaccagaaaccctaaaaatattatgcatatctcctcttagattatgtattcttattgtagatgtggtgtgttagtaagattttcccacatttgatattaatttaacatttaaaaacttatgtccaggattatttctttgagtattcatttgctatttttcacattgactattccttaaattttctattcctgaacttccttgctatgaacacataaagtgaaggtcagaaatggttaatctttgttctgcagtgagggcttatcaggaaatacaagaatattcaacaaatgataaactattagaattctccatgatcacatcatttttattcccagcgggggtaaaacacaatgaattaagatcaaggatttaatgacaacttttctattaatttaccatgtgacatagggcaattcattgaattaatttatttgccccttggagttggggagcctgaaatttaagcctaaccaacaaccatgtcttatgagctttgtgatcttgggctagttcttgttctttcatctatataatgaatgtaataacaattatatccagaggtgataggatgattaatgagttaactcaagtagaaacaggttgactagaacacggggtgctctctggaagaagcttcacaagatttttttattatcatattgaatatgccaaaactgaagatgtagtcttcagccttccaggaccagaactcaatttatcagtacatgtctttaggttggactcatataaaccaggctcaagaatgccagtttatggcttcaaagtctcttcattgctggaccttccctgatcttcttgactaaatgttggcatgcccctgactcactctcaaacctttactctttacgctatattgtcactccatggataggctcctggttgcaaataccgtctacaacttaactctcaaattggtgtctccaatcctgtcttctcccttgatttctagttttttatatctagattcctacctgacatgtccacttagaaatctgacatcttacctcaaaaatagccaaagtccaactttttacaccccgctagtttattccttgtttactccagcctatctgcctccttgcctttccttcagtacaccaggactttcctcccttggactgttccccccctggatattgtatagctcactccctaacccatcaaatacctcctcagagtgggcttctctgacctcaagctccactaatgtctgttgtgttcacactaccaacttgatgggctccctacccaaagtttgggtagactgatgttatacatgcatcaagagaatacaaaaaggttaactactgacagacccttctgaggagagaagcaaagagttccaagcatgtccaaaaatggctggagagcaggggaaaagactggttcaacttttatttgataaaggagcatcactagggtgaaagttcctgggcatttaggcctgtatatgttgatctgaacatacagctggtgcccaaagaaagagcactgggcattctcatcagcttgctgaagaggaaaggatagtggtgcggtgtgaaagctgtgagcagtcacgcatgaagaatggagatggacactggattatgaggtctgtcttcttcatgaaagtgtcttctttcactgctttatgtttcttcctagagcttataattccattacatattttatatataacctctttctttatctctcttaatcttcttccctccactattgcataagttccattatgtattattatatccttagtgcctagaatggtgcctgacacatagtagatcctcaacaaaatttgttaatatttaaacaaaagagagtagcaaatagaacaagtccagttgctgggatacttgtgtgctcatgaccaacataatctttccctagtctcagacctgcaaggaaagctaaattctacagaacgttggtgtttctggaggggacaaagtccaacaagggaatttggataaatcaaagtttctatcgttgcaggcagggagttgggactctgatgcattcaggtcactgcagaaatgaccttgctaatgggaccctgcactttttggaacgtttcattaatgagcgctagtagttgtagctcaggtgacagtttttctgagtttctaggaaaaatcaacctcccttcacatctacgcatccttttcttaggtgatttaacacagttattcaagttagagccaagtcttgcagaccgttggagctagtctttctctacaaggtgcctttgaatgttctgggtctgaggcatttgctttccctccactgttctcccacgtgctgcaggatagaaagcagctattcagagtaagtagtctgtaagtagcagttcctatccctgtactattatgtctggaaaatgagtttgaagtaagccgactttgtgctgtaacacttgaaatcacagaagtcttttcaaactatcttttgtgccttaaaatctttgttaaactgatggctgtcatctctgaaaccacggcccacccaaactcaggcttgagttaaaggcaacattgaaaagattttcaggggcagctggaacctgtgctgtcttgaccttgtaggccactcattttaaatactaccaaatcctttcttaaaagaagtgcatactctctccccacaccactcctttcctgcttcagtaaaagaaaatctgttcttctgccccagtttatgcctatttttctgccccagttctccgacatcctgttcgcatttagtgttacttcttactggctctgcaatagccatttgacttggtgtctatattgtttcagtgtataatattggagtgtctgtgaagaaagcaaactgttggaatgttttatctttcttattattacataaggtgtgttggtgtgacacatgtatatatataattgtgagcaggttttaggaaaaagaagtcttataatccctaacatatgtttatattttaggtgatcttttaggagttagatcatgcttttatgcattaaatggttagttatctaaagctgaaggcagaaatgatttgcttctttgttttcatgatgaatttgtttcttttgtgtctctccacctatcaacaaacattcttttgtttcatgaaaaattaaggttgatataaaattacctgtatttaaacagagcttgagaggttcacttttcttaggcatataaagaggttattcagcctgagtatgttagagattctctaagtaggaataaccacatgttttggaagaaagaggctttgtttttagaaaggcattgttagaggcctgagtatttcgggaaatgaataaataaattcttgaccttgtaggaggtacctacagttcaacttactgtgcagcagctcagcagacactgctgggaaaacatctctcaaataaccttttgaagaaaccagagttttggttcaagttgatgtgactactttattggtatcatcacatcaatttgatgaatggtcctgaaagctagagggaaatatctattgaaatccaagaccttgggatgtctgtattaaaagctctgggccactaagcaagttctcttaaattttaaaaggaattttaagtagttaacgatgaaatgagcattttctacatgtttgaatgtggcttactcaatgtgtgtatgcaaacatataagcatctgacaaataaaactgaaatattccagtactttttcagcttcattgagtaaagaacaaaaccactgaattagaaactcatgttttgatgacttcctattactgaaaccatgggaacaggatcggtaaatagagcatgggcttttgaggctttgtaaagctggtttcctccccactccctccattgttccctctcttgttccttccctctcttgttccttccctctctcgttccttccctctctcgttccctggttccctccctctctcccaccctccctcactccctcccttcctttcttccttcgttccttcgttccttccttccataaatgtgttgtgaacacttcttatgcaccaggtcctattgcaggccatgctctaggtaatgaggtacagcagaggacagagcagacaacaatccctgcctttatagagcttacattttaatgagttcaaattatctctgtatcttatgtgaacttggatctgaacttcatttctccatatgcaaaatgagaataattcttcttcttttatagggttattgtggtgattaacatgagacaatacaatactttgatatgggggctcaagcatgttctctctttgtttcgcctgacctggcagcccacatgggttttgctgctgtcctgcattctctgtatttgtcctctttcttgctgtttctctactttggtttttgagtgtatctgtgggtctcagtgcctttatttctatgtgcacccgagtcttcttatttgtgtgctttggcatgtgtgtctctctcactgtgtctttctttttatatgcctctgtatgtctagtttgtgtctttcttttttgatctgtgtgtgtgcgtgtgcctgtgcacgagagagagagagagcaagagagaatctgtgtgcatacatctctgtctctgcatttttctctcttacagtgtgggtttctctctgtctctgtgaatttgtctaagttttaaaatcaaagttctgtgaaaaggaatttgaaagaaagcaactttattcccgtgaactgtttgcaaactgtaagatacagcctttgctgtgaaacttaggtacattccagagaacaaagggaaggttgagtgtttatagcaacagttcctgctcaggtttccaatcaggtccatttatgcaaatgaaagactcaaacttgctgagttttgattggttgatgtagctgagttctgcttgatcaattcaagccacagcttattggttggttcaggaaaaatgaacaagaagagtcagctatgaaagccttagcagtaggccagtgcagtagctcatgccgataatcccagcactttgggagtttaaggtgggaggatcacttgagctcaggagttcaagaccagcctgggcaatatagtgaggccctgtctctacaaaagtaaaaaattaggtaggcgtggtgacacatgtctgtagtcccagttacttgggaggctgaggcaggaggattgcttgagcccaggggttcaagaccagcctatgcaacatagtgagacctcatctctacaaaagtaaaaaattagctaggtgtggtggtgcatgcctgtagtctcagctacttgggaaggtgaggtgggaggattgcttgagcatgagaggttgaggctgcagtgagctgagattgccccactgtactccagcctgggtgacacagtgagaccctgtctcaaaaaaaaaaaaaaaaaaaaagaacctcaaactcaaagttaagcagatgtgtgtgagctttctgagaactcagagaacgtgtctgacctctagtcaaaaaacagctcattggctctattttatgtttaggcccagttagccactcaggatttatcttgaggaattgtctcattcaggttcatatttggatcggtacatgaatgtgtgtgagtgtctctctatgttcctctcacagtgtgagtccctctgtctctgtgtgtgtcttactgtgtttaggtttctataatgtcagtttgactctgtctttttttctgttttgttcattcatattcttgctcttgcctgccctttctccccttgctccctagctctgactctgtctggctctgtctctcacctttttctcttgttctgtgagtctctcttgctttctttctctctgagtctctcactttcactctctgtctttcctgcttttcgtcagtctttcacgctctctctgtctctttgtcacttcatatctttcacttgtgtgagtgtgtaggtaggtttttgtgtattcatttatttaattgtgctcattatgtttatgcatgtcctctcattcctatcccaatatagcttagatattcggtgatatttaggtagcaatctcatatctcaagaagaataaaaaggaatagagatttattctaaagaagccataaggggatttatggattgagaagtggagttttaaaaattacagatggatattaccaagatttggttgtatcttaggtgacgtaccactaatttcacagtatctcaaaactgtccagtataaaaccaaatataattaacaaccatcaggccctcatctctatgtctagatagtccagggtcactttttaaagctctctttgctgatcttgatgatttttcttcttcaatggttgtcattctgttgagcctgctattctatttccttgactacaatctaggttctcatcatcatcacccacatcatcttttgcctgaactacttcaggtgctatccctggccccgctaactttccatccatcatgccaggtgggggcaggttattgttccatcatctttctctccttgatgccctccactggcttccagttttcttccagggttcaccaatagagtttcacaacataaacagctgtttttttttaaaggctcacctgaccaatattttgcccacctaccactatgcccaatgtgtataggaagccatgcttttgaatgctctgactaggcgattttctccactacaaatattaactcccagttatttctaatgggataaagccctttcctgagaaggaaacataaaaggaaaacacatgggaatctggataaggaaactttataaaccaatatttgtagcaccaatgtattgtccagttaaccagacgatgcttaacttgttttaatactaagaagtttttgctattttgactttgtatcatttaggaaagggttcagcaagatttttctgtaaagcaccaaccaagttagtaaatattttaagctttgtgggttatactgtctttctgacaactatttaattccacccatgtttctcaaaagcagccatagatgatccataaataggtctggttgtattttttttttttttttttttgcgagacagagtctcgctctgtcgctcaggctggagtgcagtggcctgatctcggctcactgcaagctccgcctcctgggttcacgccattctcctgcctcagcctcccgagtagctgggactacaggcgcctgccaccatgcctggctaatttttcctatttttagtggagacggggtttcacggtgttagccaggatggtctcgatctcctgacctcgtgatccgcctgcctcggccccccaaagtgctaggattacaggcgtgagccaccgtggccggcctaggtctggttttgttttaataaaacattatttgcaaaaacgggacatggctcagattgggcccctgcaggctgtagtttgccaatacctaatttagactttatgataatatcttattatgtattccatataggtaaaattttcattcctgtgcacactgtttttttttttttttttttttttttgagacggagtctcgctgtgttgcccagactggagtgcagttgtgtgatcttggctcactgcaagctccacctcctccgttcacgccattctcccgcctcagcctcccgagtagctggcactacaggcgccagccgccgcgccagctgccgtgcccgcctaattttttgtatttttagtagagacggggtttcaccgtgttagccaggatggtctcgatctcctgacctcgtgatctgcccgcctcggtctcccaaagtgctgggattacaggcatgagccaccgcgcccagccactcgttttttaaagctttttttctctctcacctttcatatatgtatatatgcatgagtgtgtgtgtgtgtgtgtgtgtgtgtgtgtgtgtgtgttgtgtgtctgtgtgtgagtgccaaaaatataacttttgggctttctacagggtttcatataatttgtcattattataataaataaaggaatcatattattttcatttacataaaattccatgctcataatttgaatcaagaaaaccaaaacctgaaacatgttactggtaactttcaagaaatatctcaataatctgtaaaataacaacagtaatttatatcacgtattttatgtaaattatgtcatttatgtttaactcttttgtaagtgtcatgtttagattcttagttaccatttaaaacaagattttagagaattgttttaaagtattttgtgtatgtgtgcttactgaatcagcttaaagatgtttgtaaaattttagacttttattaattgaagaccttttatttgtaaatcttatctaaagtgcagttgaatagatttaaaattaaactttcatgaaatctgaattgaccatcattatgtacagcaaaaaatattatatccttgtcataaagttaattctagataaatgtaataggtaaatgtaaagagataagaagaaaataatatatagatttttttgcttataggatgggaaagaaaattttaaatcacatattaatttgaaatattaataagagcagagaatgatccatttaattattaaaaacattgaatgtggctgggcacaatccacctgtaatcccagcactttgggaggccgaggcgggtggatcacaaggtcaggagttcaggaccagcctggccaagatggtgaaaccccatctctactaaaaatacaaaaattagccaggtgtggtggcacgtacctgtaatctcagctacttgggaggctggagcagataattgcttaaacccgggaggcggaggttgcagtgagctgagatcatgccactgcactccagcctgggcgacagagcgagactcagtcttaaaaaaaaaaaaaaaaaaaaaaatataatgttaaaaataaaaatcaaattaaaagaaacaaatgctcgtaactattttaaaaagtgttaatcttcttaatacactattaaatgacaagcattcaacttggttaaaaataaaaagaaattaaacacaatatattttcttatcaaattgtcattttaaattaaatgaaatgtcatatttctaagaattcttcattgaagaggtatccatctccctctcctcaataagatataaatttttagccaacaatttggtaacatatccataaaaatatttacaactattggcttcttccagggatctgtcctaatgagatgcaaaaatttatagataagatattcactctactatctataatgatgaacatttaagaacaatgtagcagttcaaaaacaggtgatgaaggggtaaattgtggtataattatatgataatcaaaagcatggaacatcatatatttgaatgataacaatttggaataatgtccagaatttattaataaattagaatatatggccatattatggtgattataacttttaatgtatatatagatatgttacataatatttatatagtgagattatatattatttcattttttatttttctgtattctctaaatgttgtatgatatgatatgtgtatatttcaacatcaaaagaaatacacattttcttttcccacataacactaaacaatagatcaattgatgtttcctcatacctttcaaagcatggtcttctgggttttctttaaaggaaagaaaaattttttaaaaagagatcttggacattagagaaatgaatttgatattttgggacaaaagtcttgatcctagtttagaaaatgtgattctctgtatcaactgaatttcttaggatgattgtttttatttagtaagcttgtatagctatagcccacacaagttaaagcctgtggaatttggtttataaaccaccttcatattggatttcagagaatgccaaggcatcttataaatgatgatacttgctaaaactcatctcatacctgaaaagcttccaagcattataccatataaaagattgttctctattcaagcaaaataagtcctaagatttgcaatgctgctgtttgacgcaggaaaatggcagtggaaaatccaagagctagttccatgccaggcaggcaaaatctgccatgcccataggaggcgggaactagaacagaactgctgtgggttatatttactgtgagaaaagaaccctctgtcttgaaaggagctgcagatggagtcttttctccatttgcagaataattaccttaaacctcatttatgtaggtctaaggaaatcaacaagtgagagcgtttcacataattccacatcttggctatcttattattttcaattgatttttttttttttttttttttgagatagagtccctctgttacccaggctggagtgcagtggtgcaatcttggctcgttgcaacctcctcctcccgggttcaagcaattctcctgactcagcctcctgagtagctgggactacaggtacccactaccacgcccaactaatttttgtatttttagtggaggcagggtttctccatattggccaggctggtctcatactcctgacctcaggtcatccgcctgccttggcctcccaaagtgctgaggtgtgagccaccatgcccagcctcaattgaatttttaaaaatcaaaacagtacttttacacagttataaaaatgaaatagtactcttaggataagaaatatctctgcattatcagtacttgatctctagaagtaagcatctttaattcttctaggacatttttagttattacttatctccatatttctcagtaaaatatgtattctactatttcttgatttttcagttttaactgtcgtctacctggcttcctactcacatactcactatccacacacatatcttctctctctgtgacaccaataaaattatgatagtttaaaaatatgtttataaccagtttttaaagtattgtaaagaagtgacaatatataaattttattcatagctgagacatactgtatttatttcattacaacttttctcttttcattccttataaataataattgtcccatttttatattttaaatttagctttctaatgtctatcacaaatccatctcaaactccccatcatagctaacatttctttgtgtgtgtgtgtgtgtgtgtgtgtgcctgtgtcactctgttgccccggctggagtgcagtggcgcgatctcggctcactgcaacctccaccccctgggttcaagcaattctcctgcctcagcctcctgagtagctgggactacaggtgcacgctgccatgcctggctaattttttgtattttttagtagagatggggtttcaccttgttgcccaggctggtctctaattcctgatctcaggcaatccacccgcctcagcctcccaaagtactgggattacaggcatgagccactgcacctggcgctaacatttcttaataagatttaataacatgttacgtgtttttaataaatcgtattttttaaaggcgtccctgctaacgtgctgaatcagtgagtcactgtcctcccaaatgtgaacaagattctgatttctcccagtataaattagttttgcttgtttcccaaaaacagaatctaaatgaaattatatatatgcattcttttgaccttgcttctttgactcagtcagcactatgtcaatgagattcatctttgttttgaggtatagcagtagttcattctctctcatcactttagagttatggtaggcaaaaaaaatacaaattacaaattaaaaattaaaaaatggccccttcaaatatgtccatgccctaattcctggaatgcgtgaatatgtgtgcagtagaaacattggcaaaagggattttgcagatgtgattacagttacagagcttaaaataggaagattatcctggtggatacaatataatcgtatcagactttaaagcagatgattttctctggctgcaagcaaggaagactcagcataggggaagttggagatttggaaaatgacaggaactcaatgtgtcatttgttgttctcatatatagaggcctatgtggaagaactggagagaggcctctatgatctaagagcagcccccagctgatagccagcaaagaaaagagagtcttagtcctacaccctccagaaacttgattctgtcaagaacctgcatgagcttggaagcagatacttccaagagtctcagtcctacaccctccagaaacttgattctgtcaagaacctgcatgagcttggaaggagatacttccaagagtctcccaataagaccctagccagtcaacactttcatttcagttttgtgagtcctgaatcacacaaaccagttaagttgatgtggacttttgacctacggacactgtgagatagtaacttgacattgtttgaagggcctaggtttatggaaatttgtatggcagcaatagaaaactaatagaagactattccattatgttactataacacaacatttaaaatatatctattttactattgatggatttggattgctttcaattgagacttaatatgattaatgatgctaggaacattcttatatgtgtcttttggcagatttatgtatttatcttggtagataattaggagtggaatgggtaggttgtattttatgcatatttcagcattagtagatattgctaatcaaagtggcagcagtaataggcactcctgcccatggtctatgacagtcccatttgttccatgtccttgccaacacttgttggaaaatttatagtgctatgctaaagaagaaatcataatgtttgtaaatgtttgttgctacttcatggtgttttgatttgtagttctctgatgatgaatgatgttgagcatattctcatatacttactggatgcttggaggtattctttgagaagtacctgctcaacactttgtcagtcattcaagcagtccataagcaacaccatagctgcttgactggctcaccatatttccataaaactggttagtaaggaaagaatgaacttaaatagatttatgcagcacaaaaagcatcataaccttctgttcacatctcatgtccacaacagttccctctccccacacatcctatggggaatgcagaggtgggcctaggtggatgctacatctgtagcataggtctgtgcctcagctgagaacacggcccttaggagcttcccagtcatttaaggggctactgataaacctgccctttctttatatctgagaaagagttaataaagatatgcaagtaaatcttcttgtatgtaaacaaattttctcccggaagaggagggagactttactatcatggaaggtaaataaattttctctgtgacccaaaaaccatctctagcttccaagcctgtttgccacacaaatacccttgaaaagatacatatagatatagatatatctatatatggttacataaatatacatatattatagtttggtgtaagtatatgcacatacatacgtgtattatataaatatatatcaaactatttatacatatatacttttataatataaaaatacgtatttttactgtattgcttttgctgcatagcataatttttattctgtcttatttttcttatacagttcaaaatactttttaaattttcattgtaatttttttttcttttacccatgggttgtttaaaggtgtattattattatgcaaacatttggagattttctagttttcttttttgtaattgatctgtggtttaattttattgtggtcagagaacatagtttgaatgaagcttaatgctttgaatttggcttagacttgctgtaagactcaacaaatgatcgatctattttgataaatgtttcatggccacttgaaaaaaaatgtgtactcttcagtaccttgttacactgttctgtatacataaattaggtcaagttggttagttttctttaaacttccatgttcttatgatttttttcccgcttattctatcagtaccagagagagaagttaaaaatatctcagtctattttagctctgtccatttttgctttatatatttgactatgttgttaggtaaatagaaatttaaggttgctatccatacagtgaattgacccctttattattattaactatccctctttatctccagaaatgttgctttacttaaggtctactttgtctgatattagtatagttatactagcttcctcttgggtgatgattgtatggcttacctttttccatccaactactttcaattttgggcttatgtaatatttaagatgtatttttcataaacaggatatagttgagttttatatttttatgcattctaaaagtttttttttccatgattacatatttagtccatttacattttatgtacttatgatatatttgcttttatagcttctatcttgctattttttcttgttgtctcatctgttatttgttccctttcccccttaatcttcttttgaaataatatttttattattagttttcagtgattagccctttagttatacatccttttatatttgttttatttatttaagtatttttctttgagtaattacctggaaggatacaagattaattcttaacttaccacattctatcttcaaatagcatattttccacttctttataatgcaagaactttgtaacacttctcttttctggtcctcttcattccttcctgctttttgtttctttgctcctgtataatattgttttctttggtgctaagaactgcctttagtgttccatctgtaccgttctactaaaaacaaaattttccatttttatttgtgtgaaaacatgtttttcctttagttttgaataattctttagctgagtatagaatgctaggttgacaattattttcttgtactagctttaaaatattatattgtcttccaggcttacggtcattgttgaaatgtcagccataaatattcatgttgcccctttggaaatgatgtttctatttctttctggctgcttttaaaattctccctctctttttaatttttatatattttttcttcttagcaattttgccagaaaatgtccaactgtatttccctgctatttaacctgtctgaggttttaggttttatttatttattttttcatggcttcatgtctttctatcacttttggaaaattctcagttaaaatctcttcagaattgcctcttctccattcattttattattctatagggctccacttgtaggtatttttggcatgttctttgcgtctcatatgtcttttacttccttttacatatttttattctttaaaaaattaattctttaatcatcatatttcagaatgaggcactaaatgcctgatggcacatggctgggatttgtcaacaaaaggctcagattctagggtgactaagtgaggatccagacattttattgagatacttccagaagtcagtatcttttctcttggactgaccagtttccttgatagtaactgaacagtttcctgctctggtatatgatttggggtatcggaattctgatactagagcaggaaaagagtttagtgatctcatcttttagtatgtagactttcatttaaccctcctgttttcagtagtgttaacttgaaataaaaattacataatagagatgcatctctaagcaaagagcttatttggaaacaaaaaattgcaattcgggacacatagaccagcgtagcctctaggtgtgtctgaagaacaaaaggaaaggctggggttttattgggaaaatgaacaaagttatgtaagctgttttgaaggaagtttcattggtgatggcagtgtcttatgggagctggcgagttctgagtgtcaacagttaccaggtaagacttaaagttatggttaggtctttgtgcttttgtgtttgaattacaaaaacattttctggaacaggtatgcatgacctgggtgcctttcttcatggcctccaaatccattttagtttggtatgacgtgaaggactctattttgtaaaattaattttcacagtaagttcctcaacccaaactggtgtctgtctggctagacatctccagagattactttccagtctttggccaatgtgtaggaagggcaaactcccagatgctttgtctgtatgtagatattcagttatacaactgcttctgaaacaaatttcctgccaagctttctgctttcctcattctttttgatgcttgcttgacactttcaggaacccttgtcgagtgctaacctgcaggcttggatttcagccttatccattctgctcaatcacatgtccttttatctcttcacttttcagtttccaaaattacctctcaactcacttctctctattcttgagaattcgtagattaaaatcttcactttaaaaccatttaaatggtgtttagagaaactgaaataaataatgtgatccattaatcattttaaattatgggtaccaaagaagccagtttctctattttattgttgttgctgatttattattacatcttgttattttgcattttttggtgatgatggaggtaatcagagcaaataatggatttattgtgactacactgataatatatttttactctaattttaggtgagtgtaaaagttcatgttagttaaaacattacttactagatatagaacaaaatagaatcctgtatcttcctttaattctaaaatatgaatgaaaagtaaaactgtgagaatattgcacattctaaaacaataattacatatagttgccataatatttacaagtcaaatattactttgattctatggcctcaaattgtcgtttactctatgttaagcactgcgtattaactatacactacagtatataaggaagatgggtattattatcttttttaaaatagatgaataaactgagaatcagaggtaggagtcaacatcttgttcagaattgtatagctaattactgctaagcctggacatccaaacttaagtatgtttcatgttatcaaagtaatgatttttttcttcctgaaaaatgctttcttccttacctgacatttacccaaaaaaaaagcctttagtgatctgcaatttagaatgagctgttcccagatatggaaaaacacaaactgtattattcttgaccagtgttactttcattaggatttggacacagttctgcaatagacttatacacatattttaacttcccttctgttattgcacatatgcagtttacgtctatgatatttttcatttaaataataataaagaaagaattagaaactggaactaattacaagtaaaacattttcttctaacagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaagtaagtacagcattttccttattaaagaaatacatcggtgcggtggctcatacctgtaatcccaacactttgggacgccgaggtgggcagatcatgaggtcaggagatcgagaccatcctggccaacacagtgaaaccctgtctctactaaaaatacaaaaacaaaattagacgggtgtagtggcggacacctgtagtcccaactagttgggaggctgaggcaggagaatggcatgaacccaggaggtggagcttgcagtgagcagagattgcgccactgtactccagcctgggcgacagagcgagactctgtctcaaaaaaaaaaaaaaaaaaaaaaaggagcaccttgtggtctgccagcactcttctagatactatgcttgtaaattgtggtaaatattatcacctttttttttttttaagttgagaatttctagaaatagagtagtggcctcagtgtgagagacagtgctataggttatgtgaacctcagttatcttctgtattttctctctcatatcaccataatgatgccttttcttgttctgtttccaaatttaatgatataatttataaatagcaagcataggccctgatatatattgactctttccgtatatattaatttgactctttccattttccttgagtgtttttattccactatttctatttatctttcatcgtttataccactcaattctatacaggcttttaataatttttaaactatattaagatagcactaaaatcttaaaagtagccaaataaaccaactttttaggaggagaagattgacagctgatttctcagtagcaaccacaaaacacaaaagacagtagacatttaccttccactggcttggaaaaaataactgtcaaactggaacttatactcaacaataattttttaagaatgcaggcaaaaataaagatagcagtctcaacctttgtaaagcaaaactggtatagctgcaagagaaaataaatcttcagtaaccttctataataagaaaccactaatcgacatatgaaagaccctgcatctaactactgctgtatatctattttattcaagcacttttgaaacgtttacaaaagttactgggccagttaggtaattccaacaaatttcaaaggattgaatatatataaattatgctctctgaaaacagtttaattgttggtagaaataatttttttaaaagacaactagataacctcctatatatttggaaataaaacatttctaaatatccattcatcaaagaaaaaatcataatagaaattagaagatactatgagctaaatcataaagaaaatgttacattaaaaaacttgtgccttagccaagaatagctgaaaattggatggagctcagtaactatctctataagttaatttttaaaaggacaactaaaataaactcaaaggaaataaaaggaaggaaataataaagagcagaaattaatgacatagaaaaaatgtttggtgatgaatacaaaaataaatagaaatataatttttaaaaagtaaatcgattctgattgatagaaggcacaaataatatcaggaatggaaaagggaacattgctgctgatactttagacattaagacagtaaaagaggatatgttgaataagttcatatcaataaacttgaaattattagatgaattggataaatttctagaaatgtacaacttactagtattgactcaagaattattttatcacactaaatgaaataaattcatactccaacatcttcccttaatttcagatagctttcccactcaggataatgaatattcaaagagcaaataattcctctgttacgaactcttccagataatgcagaaggagaaaaaacttcccaactcattttttgactccaaacctgacgtaatagtgcaagaacgaaagtacttcctacagacatacatgtatgaggaaagcttttggttgataatctctctcctcaggtgtgtttccttagtggcctcacctgttctctgaaagtagcactatcctatagcattgtttttgacatttccagagcaccctactcaagccatatttagaactgcttttgaagagatctttaagaatcccataatgcgaactttggtgcttttttgtcactttcatccctaactgctttagttttttaggtgaaattttctgtataataaactgccatacctcaaagaacacctggaagcaacaaagtatttgcttttctaatccatggtgatttttttcagtatctggaagtaatcggcagacatgtgtttttcatgccacagcagctcactttttcagtctagttgcccattcaaagctggtgtaaatcacagtaatgctctaaaccaaaagaaggtgcaaactatttttataatgcattcttttagaactttgagggtatagttgacatctaagaaatgcactttattctgaacgaaagcattttggggaaagtaagtgctgattttactgagttttacgttccttgcagttaattttctcagttaattgcactggttccattacaaatttggtattgatattgagcccctttgtgaagctgagccattctaaagcaaccaacaagggtatgatgatttgtattttatattactgactttattataattttctaatgctttaaattttctgtcaactgtaataacgtcaatcatataaaaagtcatgattgtcttcaatttatttggaaaacctctgattttcaactcattttagttttctttttcagtttggaaatgaaaaaacaaagttgtgcctaatactttatgacttctagtctgtcttttatcattttattcacatgttgttttgttagatagcaggtaattagaaaaatttggttcaatgattatctcataattaagagaggagatttgataaatgtctgtcaaaaatgctaacctaatggaggctcatgcttattatctgggagggaagcagcctccagagataaaatgttacaagtgaaggagaaagataaggcagcaacacagagttcctataacccattgtctttatgtgctacacttactattttaatgcataaaactgaagagatattgtcccacatattctcccagggcaaactatataaaaaatttagtgacaacatatttgagagacaaactcaagtagaattatgaagtgctttctctttttctgtagtattttcacctggggaaagtaactaggaagagacaaacataaaatacatagataaagcttgaaaaaagggagaaaatgaatctaaataaaaggcagctgaaaaaaatgaatgcacattttatacataggtgaaataaagctcggaaaaaaaaagagaaaatgaatctaaatgaaaggcagctggaaaaaaaaatgaatgcacatcaaaatagtaagttccccaaaacgaccaggaaatgtttagaaaaacaattactcacaggcttgaaaacttgcaataatattctctttaaaaataagagcccagaaaagaaaaaggatcaaggagaaacataaataaacaaaatgaactaaaaagtaagcacgctcagctcaaagaaaaaaatagaggaaaaaatgtaaatattacacaaatgagcatcacataaaataaaaggaatgtaaacgttgttagggagaaagatgagtggaattaaggagtcccacaaacacaataaaaagagcaagcaaatgataatttaaaaattaagaaaaaggattttgaaaacatagacaatgatctgatgtgtccttaattggtgttcctgcagtaaagaacagatcaaagaaaaaaataattatttctaccctaatagaggaaaatttccttaaggtaaaaacttgaatctttagcagaagagtacactatatggggtagaataattatcagaaaaatatatcctggtaaaattatgaaacaaaaagaaccaaaaggagattttgaggtagcaaaagcaaaggatgagcaaaatgtaacacagatgagggtgggaaacatctcaggcattctcaaaataaaacactcaaggctagaaaaaaaggaaagaattggcttcacttaagaatttttgttctggctaagttgcttctcaagtatcaagtcaacaaagaggttttctcaaagttttaagaaatcagaaactataatacctgcatatttataggaatgcaatatttctttgtaaaattcactgaatgaaaaatcatggccaacttgaagataaaccataacttagaaatgaaagaatcaccttcagttaaaatgcctgatggtgaacattggatcaattcacacgtagaagattgaacaactctgaattgtttatacatggaataaaacctgacaatgtaaaaataattataacactaacaaaaatgggagtgggggggaggaaaggaagaaatggttattctcctacctgtcatattggcaaatccatagataacaacagaatttaaaatttaccatctaaacttaaattttaaaataatatatgagattaataaaatggctcatttctttaaccattttcataagctgttttattgccttaaaagtaggtgtcttttagggatgaggaaagttagacaacttcaaaataagagaacagtccccacaagaccactcccatttctgacacaatttcaggagtcccaaagaccactctcaggtttgataatttgctaaaaggactcacaaaactcagcttattacagctaaaggatctagattataatcagcccagggatgtcatatgtaaggcagaatccaggagggtaccaagggtgaagcttccagttatgctgtgttgtggagtcagaacagcattactttcctggaattgtataataatacgcacgaactggtgccaaatggggacgctcataggaggcttgatgtccagtctttctgggggcttggttgtgtaattcgggttgactgctcacatagcttacttccatctcctgccccttgggaggtcaagctgggtgatccaaagcccccggcctacctcacattgttcatgtgcctcagagaccccatttctaaatcatagtgttaccatctagttgcccaaaggttttagacaaaaaaatgtactactctattaagaatgacattccaaggacttagagatcacctcccagaagccaggacctcttttgggggcaaggttaaattctttactacacagggactgatgataactctgttcccgactctactactatttcacttcgtgactttgacaagttacttttctctcagttcagagtttcctcatgtattaatcaaggaaattaactttgcgttccttttccaactcataaatttacaaatctgaatctgcaaagatacgtgggtgtggataaaatctcccagggccaatgcatagagccacataggtgtgtgtgcattgcacagttctgctatgaatgggaccccatgttttgaatgggaccccctgcagctgtgctccagacatgtacacatatacacatacataaacatgtacatttgggagattttaatgtgtggcatctattttttaaatttgtattataatgcagccatttttgtaatatcatgaggacctcttgaaggcaggaaggagaatggaaatatttccagttgagcattaatcctctgctccagagtacttctagaaaatgctgtgatatatttaattgcgtttgaattataaaattattcaatttctgactatcaagtcccctttttctgataacagacacagtaaacagtaatttgctgtggaatgaatctcacccacacacagttgcccaattaatctaaaagaaataacactaaagctgacatcacaagtcactgggcaaattttccaaaaaacaaagcatgttaaaacaggagagaaaagaataagtaatgaacagggctctgtttttgtttggccaagatgataaaggcagtcccggaacttctggactctttctttctactagccattaggcaagtggccaatatcctgttatcccaattacagacaaagaccaacaagatgcaagttcgtattttaataaacagtctttatatctagaataacaatatatttgctttgctgcctctttcattggctctaatcctaaaataggataatattaatttctacatcataggatgttttgatgattacattaaatagaactcttaaacacttagcacagtgtccagcatatagttggtgcccaatcaatattaattgctctcatttatattttaattcaaataatgagttgtgattcaagttacatgcttattttcctaatgctaagaaccagaggtatttgtatttaatctttgatgataaataatactattgcatctatctcaatcatcttatcttttcccacttatttgttctatatttgttcatttctcttctcctgctttccccccattcatctttccttattattattttatctcacttcattttattacattcatgttagtttaccattttctaactgagcttgtttgattgctgagtagaacctcaattttcttacagaataaaaatgaggagggttgggcgaagtggctcacacctgtaagcccagctgcatggagggataaggtggtaggattgcttgagcctgggaggcagaggttgcagtgaaacaagttctcatcactgcactgtagcctgggtgacagagtgagacactgtctcaaaaacaaacaaaacaaaataggaggaggttggactaaaccagtctgcagttctcttccagggtgagaatttaggggacaaatgagcctgcatgatgtgataatatggacatgataggagcagagtagctgaagggatgagaggagacatccaatttttggttcttgatgcgatgggagttttctaataaatttatcatctcacaccaaaagagtgtggagaagcactgaatgttagtttaggagcgttacagtgaaaggctcaggggaaaggcttaggggaaaaggacaaagtggctgtcaagtaaacatactttttaggcatttgatgtgttttgacttttttttttagatactgtgaggaaaaaataacacaatttttgaattaatatgcttccattttagttctattaaaacttttcatttcaagggctattttaaataaatggctgcagaaaatggtccttttgcctgcagttaacagagtatataattgaatgcctggattgtttcagtatcttgattaaaattagtagtgttttgctaagtaaagtgtaccacaaaagaaatgaaagtaaatgccagtaaatgactgctgtttactaatacctttagttttgatttttaaatatttatttaatttgtcttcagtaaaagttgttttaataactccatattccaattatttatttcaattagcatagtctactacagtagactaaattgcttgtacaagtaactaaatgcacaagtaactaaatgcttgtttctatttgtttgatttttttttttgcagcttctttccacttttgacttaataaagtatgactttcagaaagatgaacccatgagaaatgagcagggttggtgtattcatgtgaaaaaaggtaagacttctatttgaagacatctcctcaagcaaagtttctgatctcctgtatacagacatcccttggtatccttgggggattggttccaggaccccgggtagacaccaaaattcatggatgtttgctccttatataaaatgatacagtatttgcctatgaggtgtgcacatcctcctgtatactttaaacaggttgcttataatacataatacaatgtaaatgctacataaatagggtcgtatggtattttttatttatattttttattgttttattattattttatcttttttaccaaatattttctatccaaggttggttgaatccacagatgtgaaaccatggatatggagggcccactgtgattattagtgaatttaaaaaggagaggatgactaggtccactgtataatttaactttggaattttaatgcaggtggaacaattttactattaaatgttaagagccctagagggatcactcagatggtaaattattaaaatacaaaagtggtaactatttggctcatactattcttaatccaccacttgtagtatgaacagtggcaaatttctaatgtcctatattgccaaactataatatagaaattagtgaattaatttatcactctagatataatgtaaagtcaggccaacttggatttaaacgtggtctctgacacttagaaatggtgcaactttagacagattactcaacctaagtcttattttcttcatatgtaaagtagaagtgacaatgtttattaagtgaggttattgtggacgattaaatgggatgtatatatattcctgggggacctggtatgtggcttgttactttcctctcctcagcttctccctctcactcccctcccttctctaccaaggtagactttcttacaattttaggttagaaattttcatgaaagcaagtacttcaattaacttgctgctgcatataatcaaattagaaaataaaatatagagatgtgcacttagaattgtttagagatccagtatggataaatcaagccaaaattaatttgtattgccttaaaatatgttgaaactgcatttcagaagtggcttcctaaatcttttcttcaaatgtgaagataaggtgacaaacctgtttttattttctggtagctgaaagactaaaataaaaaatgcaaactttgtctattaaaaaacaaatctcccaaatctctgaatttcaagcctactggcatttatcaaatatgtttctccaattctaatctgtagacactgcccatgggaaaataatttctgagcagagtgcaaagaacttaagtgcacttttctactgttctatttcttacaattatagtaatatctgatgttaaaacttgaatcccagaactgtgcttatgtaacctcagggtttcttaaaaagctggttgaccccaaatatctgtttttctattttggaattctcattatgagctactcaatattttttccattaaggcattgtgtcttcacaatgtaaattatgcccagacaggaaagatatgaatacactgtgacctatttaaacatttgcaacaattagtttgtcagaaaagaaactgtcacctgtgtcctaaaaaagaaaaaaaaacgtaagttttaagggagatataagagtcttgaaaaattctgaaatacagggaatgtagactgacagaatatatcacagaggtaaggctttggagtcagatgtacctggatatatatatatatatactccgactcctgcatttgacagctgtatgacattgggcaaattcctttttttacgcctcagttttttcaccttaaaatgaagatattatctgggcctttcttataggtttgtgatgagaattaaatggattacatatgtaaaacactcagaatcatgactattatgcaaaaagtgctcaataggtataattgtgatgataatgatggtgatgatgatgatatgatggtgttggtgatatgatgatatgatggtgatgatatgatgatgatgatgatgatgatgctatcagactgctggggcagagaagatttgctttggccagtgacctatgtgcccttgaaagccagaatgcccaggagtgggagaaatgggagtcgagtaaagactgttggctgggtgcggtggctcacgccagtaatcccaacacttttggaggctgaggtgggaggatggcttaagcccaagagttctagatcagctgggcaacctggtgagacctcgtgtctacaaaaaaattacaaaattagctgggcctagtggcatgcatctgcagcccagctacttgggaagttgaggtgggaggatcggttgagtctgggaagtcaaggctgtggtggaccatgatcatgccacttcactccagcctgggtcacagagtgagagttattttttttaagagcattaaaaagacagaaatcactctgtatcatagtttgctggactccaacttcatctagccgcatgaacactgcatcactttacagcaggcatagcaagtggacaatagccttgaagacttccagagcagtgattgctgctgtcctttgtcctctcgtcttctcttagaagtagcttttaccttgcagattgctgagaaaaaccttaattaatttgaataagtttgattggaaaattatttcagataatgtgtctaaacataactgaaactaataagtatcatagaataggaaaccttttcaatgtctcatctctttcccatcaaaaatttccagaatagcatcccagaggaataaactgttttattataataacatgtgtgttggatcagagatagtattatacagaaaccttgccacacaaagtcataaaaacttgaatttgagttataggtccatttatttctctgagcgtggcaactattttacccctctcggtcctagttccttgctggtgaaatagggattatatcaaaggatttctatgcagaataagcaaagtggcatttgcaaagggctcatggtaaatgcccaataaaaaatgctatcattattttattaacactatcactacatttgttatttatataacaaatgtcaatattatctgtggtaacatctacataatccaaaacaaaaatagccgttggtctatccacctgggaagtataagaaatctaatgaggcttttctttccattcaattccctttttattagtttttccaaagtaatttgtatttgtggtaatctatgaaaggatgtgctggatataggcaccaagggtaaatgatgtcaaatacagaaataggttcagaggaagctgagataagcagcattggttgtgctggccagatataatatagatacattcatggtgtgtgtaacaatagttttaatcagatggctgcaaaaatgtcgttctttcttgcaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcaggtatgaaatgttatgggatccatagcttgttctgtaattgtgaaccatgcttctatagaaacatcagagaccacatatgctttagctttcagggcagacagagcccttttatctccatgtctcctcattaaaacatttattggccatctgtttctagactgaaccacaagttaaattttgatgtaaagttttatgattattttagtgaatcagtttagaacaaatcagtgagctcctttttaaggaaataaaactggcagacagatgtaaaatataaatggtagggttaaaacagaaagccagtttggtcaactgtagtctaattcttggcctaatgataaaaattttgaagcagcaaaaatcccctttctcacatttccttttttaattccctaagattattttaggcctatgaaattattttgctttactagtccaatgacttgaatgaataagtaacttcctacatccttgccttcttgtaccatgttataagctcactttatataaaattatttcaattaaaacaaaatattcattcaaaagcattaaaggagtcaaagggggttaacacctagaaatttaagtgggtcagagtcaaaggggttaacacctagaaactgaagtgggtcagtgtcctaaaagacaactagagctttgctttcaattcttaacaccagagaaaaggaatgtttcacacttcattgttattttacaaaataatatttttgtaatgataatccttgtagttattttatttttatgtatattataaaacatagaaggtaatttatacaatgagatataaagtaattttgactaaaagaccaatgctgattttgttgaaataccaacaaagtgctttcttagaaatgcctttcatcttgaaaactacaattatgttggtcagtaggtgcttgcacagtgccaaatgcaagacattaaaactaaaactgggtacctagtttttcaaatacaggtgcactaactggaatttgatttttttcatttagatggaaaggagaaaatgtcgcaaccactgaggttgctgatgttattggaatgttggatttcatacaggaagcaaacgtctatggtgtggctatatcaggtataaatatatttcagattttggaaagattcttagaatagaattgccactattctctagttttgcaacagtcttgctaattcaacattttaatttttgtgtattaagataaagattttattattgtcttggcaagtaatgccccttgaccaagctaacaaagttcatgatcacatcaggggaaaggtaccaactgaattttaatgcctgcgtgtatttttttttttttttagcaaagcttgaaaactctgatcaatgtctcactgcttggaattagttacagctttttattagtctattatttttctttttatgactggtgtttgtacataccactaaacaagaacatgttctattttaaatgtttaaaaatactgacttttagttaagatggctctttataaaaattatttttaaatttggactcattatccttatagttatgcatatgaggattgtctcatgatgttgaaaatgccacagaaaagtgaccaatttgaagtcataagacagccattctccattttttctgcaaatgcttttaggtgcaggagagatcagggatgtgagtgtgtggataggagagcagaagaagggaatgattacttaataaatagccactgagtgttgaagaaagattccaggacattctgacccctgtaaagatccacaggtggcatgataagcattaaatgatttttggaatcaattatggaaatacgagtttctagtttcttaacttaaaaaataagcccttcatattttacattaaagcttaggatatgtatttctgctggaatatagttgcctttaaataaatgttttctttcttaatatttgttttagtgatggtaggatgcaaattcattgtaatttatagtgtttcccattccatgtatttcatttctgtagtataggcaattagagatagactctggccttccctgtccttaaatgatttctagggggtaaatcatatgttcagggaaggatacagactagtttatgctcctgttgtcttattattactgaaatagatttaatgtctccatgtgtgccaattagcatgtacagaattatcttttaaagtttatttggtacttaaaaatgactctatttcaaactttttttcaggttatgaaggaagagcaggaatggcttctattattttaaaaccaaatacatctttagatttggaaaaagtttatgaacaagttgtaacatttctaccagcttatgcttgtccacgatttttaagaattcaggtaattttagtggcggagtttactatcaaatataagacagtaaacaaggaagtagtttaattgcaaaataatattgtatcctttagataacatgtgagttatgtgagaggcgtggcgtgtagagttgatgcagatcgatgccatgtttgaagcctaattataaagggggcatggtgaaatgctaggacgtacctgtctttgtcctaattatagaattgctctcttcctcttcagtcaggacctcagagcaaaatgatggtcccagtgacggtggcaatccaaaaccacatcttacttttatcttgcgaagacatttggtgctatgtgcctagaattgggttccattaaggagacatcaaagagatggcaagatgtgtgcagaacctaaaggcatctggctttaggcaatcctgctttttaatttttattgctgttctgtccaaattccccctcacctggaccttccccatgtgagaaattctgagtttatttattttgagatgaggactttctcttgttagcttactggtataagtacagtaaaaagaaaacaaatttccttaactactgggtaactttacttactcatttattcaaccattcatgtatttaatattttgcctcaaatataatttcccaaaattattactcatcatctcttaacatccaaccacacagatttttttttctgaatacatttgttatttcactaatagactcctagaggagcaataacctgtgtcatattcaggtttcagtatttgccaagcaatcattgcagccaagtcactgcttattcaatgggacacatcctctgaactatcataatacctatttcatctctctttttgattttgagtttttacattgtctcagattattttaacaacaaccctctgaaacactaaaggtaagtaaatatgaaaaaagaagtaatatatttttattgaaattttattgagatagttgtagattgacacgcacttataagaaataataagagagaacttgtatatccttcaccttgtttcccccaaggataacattttgcagatctgttacaaccaggatgttaacataatctacccatcttattaaaaattctgctttacttacacttatatgtgtgcgtatattttctatacagttttatcacctgtgcaacttcatgcattcatgaccatagtaaagatatgaataatttcaaaatctttcccccatgttgtccttttacaaccatagcgagctccctcttgtccctcctcatcctcacccaaccccataagtaatatattttgatggagtagaaagttgacaggacaaataatattttaagagtttttttccaaggcaacataaaattcactttcattaaatagaaaaaatgttttagctcaagactactttagaagattagatcagccttgcacaaatttagaaagtattttaggatccttaagcacctaaaaagaacatggaccatgactgttatgtttattagagtattcactatagttagaaataaagcctgacagcagtcaaatatttgtttaataaatgaatgttagtaataaatgatctcataaaagaaatgcaaaagtaaaagttacttctgacaaaatgagtcaaacaagtattgtattacaaatctatttagcacaaattaaaaaatggaagaagcctttttgccaataattcacaaaaatataatattcagtgtggctgggataaaacgaacttggtcctttcattctgctcatggaaccataaattgttataacctctctagaaaacaatttggtaatatatgatcagactcttaacagtttgcatatattttgacttagtcaaaatgcatcttaggaagtaatcaaagatgtataaagattttaatattctaaaacacattttttatttctagtgttaaaaattttgatattctctaaaagttcatgaataagggcaaagttaattaaaatatgataattaaatgagaccttataaaacaattttctaagttcaattttgaagaaaattacaggacccaggaaaatatactttgtataatattaagcttaaaaatggcagaacactaaattgtataaatacagtgagctgctaatttttaagaaaagagtaaaaggatatgtttgcttgcacagccatatctggctgtgatgacagtgttggatcaggggagatggaggagggaagggagatcagggaagggggttcaaagtgaagttgactcaaatagtccaaaaggataaataaaaatggccaagctactcatagaatgttgtagggtctctacatgtcatctcacttaaacagactgtttatccatgcctgaaattcccacaaagggatacactcttatctcctttaaacaccttgaaacagagattcttaaactttctagactcatggcatctttaatgtctcatagcactcttgggtcaaaacaaatacctaaacatttgtttattcactagttaaggaaaaacagattggtaagtatttaggtctaacaaatgagtagccacctgaaaaataatccatataaataagtaaatgctttcatttcattttcaaataaccacaatcagtcactaaggagatgtaagttgggccacagttcttcagaccttggaattagattggactggacagggagagcctgatttcatgttccatgatgatttttggctgtacttgctttttatcccagcaactaccaaaaacccaattttgcaaagataatgacatcattgaatgtattacaaattactattgaaactgtgaaccttgagctagtagtttgtgactggtgactaacagatgtcactgagtttctcttgaaaacaagatatcctgtgaggaccttggaaattcactgaggtacctcaagttttagaccattcaagtaacccctctgggtatatttaagccatgttttagaacattctgcaccccgtctggctcttatagtattctgctttttatgatagatttgtgtgtacctgtagtagaaattgctgtcttttgtggcttttatctccttagcatcttatggcattctctatacataatgttatattggcattgaattgaagagataacctatgtattttagacataattataatcagtttattatgttcataattcttatatattgaatgagtttatatttaagtaaagtttacaggtaaatcaaactaaagattttaatattctaaaatacattttttatttctagtgttaaattattagaaaatacagagatcactagatataaagtgtcataatttaatattacagtctatagtattaactatatatgtatatattatagttattaaatgattctactcatcctggtaattgctttacaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttactgaaatatttta

SEQ ID NO: 1684 - DNA, 68124 bp, Homo sapiens
cgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggtctggaaagtcctggggaactcgcagggcacgggccgctgtcgcggttgggaggcgagggcgcagcgctggggttgtagattccaagacccctgagggtggctgtgttggtttctcgcaggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcaggtagagtatggggtgtggtctgcctatacagaatggcagcccacctgctttcatacccttttttttttctttaggataattcgtaactaatattttgggtgagtgaagtgtgcatgttaagagtacaaaatagttttatgattctatgctggtttaacaactgtctcctcccttcaggcacgtagtttcagaaaacttttatgaaatctctgcttcctaccattttgagacagggacagttttactgctattggttccttcagtgagtgcaagaacacacagagaacttggtcacttctaaattttatcagctctgacaaaatggtgaataggaaagttatctgacttcattgtgacacgtctacctacctctaattgtactttatcagggatgactacatttgcagaagagatatgtttaaaggaaggtacctgaattcctttcttcatgtctgctcttattttatactgtctgcaagctaggacttgcctagcaaggttgcgctcccacctgtgagccagaacgtgggctcttggcagactctaggagcctttctgtttcttcttcttatccttccatgcatccttttctttttttgactaagttctacccttcctcctccccctgccttggagttaggacatcttaggctacacgtattttcactgaactgtaaagaaaagcctggggtttagtggctaattagtaaagaagctaggaagatgggttgcttaatgaaatagaagtgaaatatgaaaaatgatacttatttggtgtaatctaaatggtttatgcagagtcttcttcaatggggaaggaaggtgcggaaagaggaagatccattgcaaggaccataatgaaaatatttaagtattttagattaatagatacataccaataccttgtataaagtttttaaactcacagaacaatatggaaaaatatatttataccctggtgatctctaaggtatagaacttttcaaataacctttatgatataatatttgtatatcaaaccaaagtgagttaggcagtatatggaaaatgggctagcccttcaaggctatcactgttcctagttcttttcagttcaacttgtggtctgataaagtggcaaatgtatactttttcttatttattattattttttattattatactttaagttctagagtacatgtgcacaaagtgcaggtttgttatgtatgtatacatgtgccatgttagtgtgctgcacccattaactcatcatttacattaggtattcctcctaatgctatccctccccactccccccaccccacgacaggccctggtgtgtgatgttccccaccctgtgtccaagtattctcatttttcagttcccacctatgagtgagaacatgtggtgtttggttttctgtccttgtgatagtttgctcagaatgatggtttccagcttcatccatgtccctacaaaggacatgaactcatccttttttatggctgcatggtattccatggtgcatatgtgcctcattttcttaatcaagtctatcattgatggacatttgggttggctccaagtctttgctattgagaaaagtgccgcaataaacatacatgtgtgtgtgtctttatagaggcatgatttagaatcctttgggtatatacccggtaatgggatggctgggtcaaatggtatttctagttctagatccttgaggaatcaccacaccgtcttccacaatggttgaactaatttacactcccaccaacagtgtcaaagtgttcctatttctccacatcctctcccgcacctattgtttcctgactttttaatgatcgccattctaactggtgtgagatggtatctcattgtggttttgatttgcatttctctgatggccagtgatgatgagcattttttcatgtgtctgttggctacataaatgtcttctttggagaagtgtctgttcatatcctttgcccactttttgatggggttgtttgatttttttcttgtaaatttctttaagttctttgtagattctagatattagccatttgtcagatgggtagattgtaaaaattttctcccattctataggttgcctgttcactctgatggcagtttcttttgctgtacagaagctctttagtttaattagatcccatttgtcaattttggcttttgttgccattgcttttggtgttttagacatgaagtccttgcccatgcctatgtcctgaatggtattgcctagattttcttctatggttctaatggttttaggtctaacatttaagtctttaatccatcttgaattaaattttgtataaggtgtaaggaaggtatccagtttcagctttctacatatggctagccagttttcccagcaccatttattaaatagggaatcgtttccccatttcttgtttttgtcaggtttgtcaaagatcagatggctgtagatgtgtggtattatttctgagggctctgttctgctccgttggtctatatctctgttttggtactagtaccatgctgttttggttgctgtagccctgtagtatagtttgaagtcaggtatcgtgatgcctccagctttgctctttttgcttaggattgtcttggcaatgcaggctcttttttggttccgtatgaactttaaagtagttttttccaattctgtgaagaaagtcattggtagcttgatggggatggcattgaatctataagttaccttgggcagtatggccattttcatgatattgattcttcctatccatgggcatggaatgttcttccatttgtttgtgtcctctttttatttcgttgagcagtggtttgtagttctccttgaagaggtccttcacatcccttgtaagttggattcctaggtattttattctctttgtagcaattgtgaatgggagatcactcatgatttggctctctgtttgtctgtttttggtgtaaaggaatgcttgtgatttttgcacattgattttctgtcctgagactgctgaagttgcttatcagcttaaggagattttgggctgagatgctggggttctctaaatatacaatcatgtcatctgcaaacagggacaatttgacttcctcttttcctaattgaataccttttatttctttctcctgcctgattgccctggccagaatttccaacactatgttgaataggagtggtgagagagggcatccctgtcttgtgccagttttcaaagggaatgcttccagtctttgcccattcagtatgatattggctatggatttgtcataaatagctcttattattttgagatacatcccatcaatacctagtttattgagagtttttagcatgaagggctgttgaattttgtcagaggccttttctgcatctattgagataatcatgtggtttttgtctttggttctgtttatatgctggattacgtttattgatttgcatgtgctgaacaagccttgcatcccagggatgaagcccacttgatcatggtggataagctttttgatgttctgctggatttggtttgccagtattttattgaggatttttgcatcagtgttcatcaaggatattggtctaaaattctctttttttgttgtgtctctgccagactttggtatcaggatgatgttggcctcatgaattagggaggattccctctttttctattgattggaatagtttcagaaggaatggtaccaattcctgtttgtacctctggtagaattcgttgtgaacccatcttgtcctgcactttttttggttggtaggctattaattattgcctcaatttcagagcctgttattggtctattcagagattcaacttcttcctggtttagtcttgtgacggtgtatgtgtccaggaatttatccattttttctagattttctagtttatttgcgtagaggtgtttatagtattctctgatggtcgtttgcatttccgtgggatcagtggttgtatcccctttatcattttttattgtgtctatttgactcttctctcttttcttctttattagtcttgctagcagtctaccaattttgttgatcgtttcagaaaaccagctcctggattctttgattttttgaagggttttttatgtctctatctccttcagttctgctctgatcttagttatttcttgccttctgctagcttttgaatgtttttctcttgcttctctagttcttttaattgtgatgttagggtgtcaattttagatctttcctgctttctcttgtgggcatttagtgctataaatttccctctacacactgctttaaatgttttccagagattctgatatgttgtgtcttttttctcattggtttcaaagaacagctttatttctgccttcatttcgttatttacccagtagtcattcaggagcaggttgttcagtttccatgtagttgtgcggttttgagtgagtttcttaaccctgacttctaatttggttgcactatgggctgagagacagtttgctacaatttcttttcttttacatttgctgaggagtgctttacttccaactatgtggtcaattttggaataagtgtgatgtggtgctgagaagaatgtatattctgttgatttggggtggagagttctgtagatgtctgttaggtctgcttggtgcagagctgagttcaattcctttatatccttgttaacttttggtctcattgatctgtctaatattgacagtggggtgttaaagtctcctattattattgtttgggggtctaagtctctttgtagttctctaaggacttgctttatgaatctgggtgttcctgtattgggtgcatatatattcaggatagttagctcttcttgttgaattgatccctttaccattatgtaagggccttctttgtctcttgatctttgttggtttaaagtcttttttatcagagactaggattgcaacccctgctttttgtttttttgttttccatttggttggtcggtcttcctgcatccctttattttgagcctatagtgtgtctctgcacgtgagatgggtctcctgaatacagcacactgatgggtcttgactctttatccaatttgccagtctgtgtcttttctttgggacatttagtccatttacatttaatgctaatattgttatgtgtgagtctgatcctatcattatgattttagctggttattttgctctttagttgatgcagtttctttctagcgtcgatggtctttacaatttggcatgttttagcagtggctggtactggttgttcctttccacatttagtgcttcctttaggagcgcttgtaaggcaggcctggtggtgacaaaatctctcagcatttgcttgtttgtaaaggatattatttctccttcacttatgaagcttagtttggctggatatgaaattctgggttgaaaattgttttctttaagaatgttgaatattggcccccattctcttctggcttgtagagtttctgccaagagatcagctgttagtctgatgggcttccctttgtgggtaacccgacctttctctctggctgcccttaacatttttccttcatttcaactttggtgaatctgacaattatgtgtcttggggttgctcttcttgtggagtatctttgtggcgttgtctgtatttcctgaatttgaatgttggtctgccttgctaggtagggtaagttctcctggataatatcctgaaaagtgttttccaacttggttccattctccccatcactttcatgtacaccaatcaaacgtagatttggtcttttcacatagtcccatatttcttcgaggctttgttttttctttttactcttttttctctaagcttctcttctcgtttcatttcatttcattcatttgatcttcaatcactgataccctttcttccacttaatcaaattggctactgaagcttatgcatgcatcatgcagttctcgtgccatggttttcagctccatcatgtcatttaaagtcctctctatgctgtttattctaattagccattcatctaatcttttttcaaggtttttagcttctttgtgatggtttcgaacatccccctttagctcggagaagtttgttattaccggtcttctgaagcctgcttctgtcacctcatcaaattcattctccatccagttttgttccattgctggcaagtagctgtgatcctttgaaggagaagaggcactctgatttttagaattttcagcttttctgctctggtttcctatctttgtggttttatttacccttggtctttgatgatggtgacctacagatggcgttttcatgtggatgtcctttttgttggtgttgatgctattcctttctgtttattagttttccttctaacagtcaggaccctcagctgcaggtctgttgtagtttgctggaggtccactccagaccccgtttgcctgggtatcaccagcggaggctgcagaacagcaaatgttgctgcctgatccttcctctggaagcttggtctcagaggggcacctgcttgtatgcagtgtcagttggcccctactgggagatgtctcccagttaggctactcgtgggtcagggacccacttgaggaggcagtctgtcggttctcagatttcaaactccctgctgggagaaccactgctctcttcagagctgtcagatggggacgtttaagtctgcagaagtgtctgctgccttttattcagctatgccctgcccccagaggtagagtctacagaggcacacagcccggtttgagctgtggtgggctccacccagttcgatcttccgcactgctttgtttacctagtgaagcctcagcagtggtggactcccctcccctagccttgctgccacctcgcagttcaatctcggactgctgtgctagcagtgagcaaggcttcgtgggtgtgggacccaccaagccaggcacgggatatagtttcctggtgtgctgtttgctaagaccattggaaaagtgcagtattagagtgagagtatcccgagtttccaggtaccgtctgtcacagcttcccttggctgggaaagggaattccctgaccccttgtgtttcccaggtgaggcgatgccctgtcctactttgctcacactctgtgggttgcacccactgtccagcaagtccaaatgagatgaatccggtacctcagttggaaatgcagaaatcacctgtcttctgcgtcgctcacgctaggagctatagactggtgctgttcctattcagctatcttggaacaataaaaacacaaaggtttacttctgagcactcattttaatcttgttttcattacgggaggaaagggtctaggagcaaatgtaaactccaagttttgctaataattgataaggccgtaagttctgtttacaagggccaaccaagagggccacagtgtccctgaaaaaatggagacattccaaagccggtttcctgagagattcgtcttaaagtacataggactggctacttctcaagatagagcattcaggcttttctgttgaccgaattgttgtttaactaggaccaattaattttgcagttttacttgtgccagcttttactttgcttgccaataactaattgcattgttttcttatttttgtttttaacaccaacagtcagttttttgtatttaaaaaagccactttgggatactgaagttttaagccaagactatttagttgattggctcggtaagtaggtcactggagaagtcacccattctttctggcataccttcaaatataaatgagatatatgttttccaaagatggaaaaattctattttgattaacagattttgtaataagatgtagcttagatcatagtcacttttatacttaaaatactgtgttgttggcatctggagtctcatttgtgaacaatataaacatactctttttagcacattaaatttcagatttcttggattctcattggatgtttctgatggtgtactattaaatcattatacccccagggagagtatattgaggtagaaagatgaatcatgtggttcagacggaggtaagccagacagacccaaattccatgtatggtctgccacttcctggctgtatggttaaagataatatcatcagttaccctggatctcactgaacttagttgtaaaatggtgatgataccatctgattcacagtataattctgaggattaaatgacacatcttttgtaaagtggctagctgagtgcctggtatgtactaagtagatcttattgtatttaaatgattgctattatgattatagagtaatcctggggcttttaataagggatctcatttggattttgcagctacaaccttatttgatgttagctagtatatacagtcatgaatcacttaatgacaaggatacttttcttagaaatgtgttagacgggccaggcgtggtggctcacgcctgtaatcccagcactttgggaggctgaggcaggcagatcacctgaggtcaggagtttgagaccagcctggccaacatggcaaaaccccgtctctactaaaaatacaaaaattagccgagtgtggtggcagacactggtaatcccagctacttgggaagctgaggcaggagaatcatttgaacacaggaggcagagattacagtgagctgagatcgtgcaactacactccggtctggggaatagagtgagactccaaaaaacaaaagcaaacaaacaaacaaaagaaatgtgttaggtgattttgttgttgtgtgaacatcatagagtgtacctacacgaacctagatgacatagtttactacacacctaggcgctgtggtatgggttattgctcctaggctacaaacttgtaccaggatattactgtactgaatatcgtaggcaattggaacacaatggtggtaagtatttttaagtgaaaacagaaatggtacagtaaaaacatagtggtatgatcttatgggactactgttgtatatgcagtccctcattgaccaaaatatcattatcattactatgtgttagcagtaagttaatgacagagttaggatttgagcccatgtttacctgatatcatgatgtgtatttctcacattcagacttgccccttctgtaaggaggcatatcctttctttacattatttttgctcctgacagtattcaagcatcattccctttcagtaaatacatgttcaacagatattataaataaaaaccccagagtcagtgcctccatggccagtaaagaagaaaccacgcattatcagtgcttagaacactgccttttctagctactgaaccatgaagccatttaaacttcctattaaaatcaattattttcttttgtaacagaagtaattgttgatctagctgagtctaggaatgaaaaagaaaaaaaaaacaaaaagccaaacagtctattctactaaatacaagtagaaatttagaaatgtcctgaaaagtaaaacagataccatgtatggatatcatagtatgtaggtaagataataaaagttcacatgagctatgtattttatctatcggcatacataacactttctataaaacttaaagggggccagcgcggtggctcatgcctgtaatcccagaactttcagaggccaaggcaggtggatcacctgaggtcaggagttcgagaccagtctgaccaacatggtgaaagcccatctctactaaaaatacaaaatcaaaatcagccaggtttggtggtgcgtgcctataatcccagctactcaggaggctgaggcaggagaatcgcttgaacctgggaggcggagtttgcagtgagctgagatcgtgccattgcactccagcctaggcaacaagaatgaaactccgtctcaaacaaaacaaaacaaaacaaaacaaaaaatccaaaagggcatttatttttcctctgactctttttcttagtctttaaaaaacaattgcctttatggttgaaagtcatttggagaattacaatggcttgattgttaacaagaacatttgttaacaataactacaaactatgcaccatttcagtgtaacagtttactaacagtgcaaggctgcatgcattattttgtgtttatagagaagacacaggatttttacttcttacgaagagaaatctgaaatgcttcaaaatatgttgaacagcaaaatactatcaaatctaaattgaaagagttccgggtaattgaatagttttttaaaggtctctatttataagtataatgatttaatatgtggtgtattaagaaaggatggagaataaaatatataccatatgcaagtaaatctgaagccttgtgggtgcctactatgtctaaagtgctttgtaccttttgggagtgatgattagtaacattgacatcaacacaaccaggaaatcccaaccatatcaccaccctcaaaaccagttaccaaatgaacagtggagagtggacaactttttgcaaaaatatgcgaagtaaattaaaagttagcaagtgttcatgtgtatcatagtttttattatgccattcattcactcattcatccagataataaatacttgttgaatatctcctttgtgctaagtcctgaaaatttagcagtgaacaaaacaaatttcctcagttcaagagtttacaacctagttcttgaactattccttgaggctgcatcaacatctatttgtgaattggcaaagagagctttatgattggagggagtcactgtaaagacacatagagcacctgaggcaggtgaggtcagtggaaaaggtactcaaagtagatggatagagaaaaggtgagagagaaaaggaaaggggtgggggaacaagggagaaaaggagagggaaagggagaagatggagatgagggaatgagcaggaggagaaaggaggaaaaagacaaaggtaagcccttcaggcttttatgatttagcatcagaaaatctgaactctagttcccatgccaccttgcctagatgtatgagcttgagtagagtatttgcccactataaccaggcttccctcgtccttaaaataaggttaatatttacctatcatggctgtaagtgttgatcaccaaaaataatgtataaaaacattttgtaatctatgaagtactttaaaatggcaagtattcttatttatcatcagcagcattataattatgactaaacatgccaaaggatatagagataatagcatacaaattttaaatgatataaaagcaccccaacattgttctgtttgttttaagtaaagagaagagcatagatcagtagatggtaatcttggcagcagataatattagcaatatcagagatgaaaaattgggggaaaggttgaggtttaatctcaaacactttaattttcaataagtttcccagagaaatttgggatgccatttgatatatgttctaatccaaaaatacacagatataagacttctgcaagtatttttgagtcttcagactgtgtgggaaggaaataatagtattataaaaattttaacatttttcttatctgtgtataaaaaacttggtgtcttaatattggtaacttttattttcatattttgtatagcctgaatgtgtattttttcagttacatcaaagtggaattgacagtctcagaaacattggactatatagtatagagaccatgttttgagtctgctctgcaacctactaagctgtgttaccttaaaaaagttacttaatagtttaccatttcagtttctaaaatatagcactttacctgtctcccaaaaccgctgagagtgccttttagttagccttgagtacatggcaaccattatttttgttagtgacaataacaagagtaacatttgcctggtggtttagctgaaatcttttcctttggcttattcctaaagacagttatcagataccagccatgatagaaacttcacctatcacagtgcacattatctggcgtggcctatgaaacctgtttggaattgcttctgtataacttatgaaaaatagagtttttctaaaatgtaccaaaacaatgtgtttaaggttctatttcaaagaaaccacactattatttgaagctacatggaaatgcctgaatacatagttctaggaggtataacttaaaaatagaaggcaaaatcattataaagccaataatagaatgcatacatgatgatggtcccataagattgtaatactctattgtaccttttctaagtttaaatatatttaaatacacaaacacatattactgtgttagaattgcctgcagtgttttcagtacagtaacatggtgtacaggtttgtagcctaggagcgataggctatatatcatacagcctaggtgtgtagtgggctatatcacttaggtttgatcaatgattatcattcagtcttgtgtgaattaaatgtaaagaactcaacagaataccaggatcataaagtatattcaacaaatggatgcaatcattatttttaactgcataatggcagagacagccacccatagtaagaagtcacttttgctcaggtctcttcatttgagatttgttgtatggagggaaacccacgtagtgtgttacacaaccttagtgagttggctttaaacagctttcttgtcctctccagtagcagtacatccataactacttcccaaccctcagtggccaaggttggaatgctctcagacacaagtttggagtgaggtcgttagctcttctctggccaaaaagaagaaggttcttctactgttaataacaaagaggtcatgagggagataaccctgatggggtctgagtcttgcagaaatactaccttagtattcactgcgttttaaaaatatatatatcatttacttactaatgagtctgtctgtagattgctttggtctgcatttactcttctaatttcaccactttcttactgaaaaatagcaagccagatgcaacatgccttcttgtgccatttcagtaataattattcattggcaacaggagatgtgttagaaataacatcaaatgaagtgttcgactttttcttttttgtataattttggttataataatataatgtataaattgtgttattatattataataatattcaatctgctcacctcaaaaatgtgggaacaactgagagtgaaaacacataaacccacttagaaacttgtgtgcatatattcagggcagttaaatcatgtcaggaaaaaatatgttattgcaatagaaagacttgtgcttctgttattcatgagttttgtatttcactcctcgagaactttgctatgttaagtgaggaatgaagcttcaactcaccctgcctggttatgcccttttgggtgggaagaggaagggcatggtctgacttggaaacaaaacaggccagaatcactagaagcacttctcccatgtaaggacctggattcccaatctgttgctctcccttccagggtctatcatctcctcttttcagtcttcaactttctatttaatgagcttgagctcattgtatgtcctcatcatcatcatcatcatcacaaccaacagtagtagtaataacaaccaccaccacagcagacaccatttaaggaggactgattctgggtcaggcaccacaatgaatggtttatatagaccatttaattatctcaacaactgtataagttgtatggagtcacttttcaaaagaggagagggagactcagagaaatgaagtgacttgtccaaggtcacacaactagcaagtgtcagaagcagtgtttgaatccagattctctggctgaaaatcctatactctagggaatcaatccagaattccagtgttttgctgaaaccatatttttttgtttttaagccagtggggtccacagtgtatgttggaacccattcttgggcaataattttgcctacttaatcatcaattttcttagaaaccagagctacccgtgcattatgtgaaaagcctgttgaactgctctacatagtaggatggtaactataaggatgtggcaagatctctaatttcactttgaattctaatgttgctttgcagtatgggaagctaaagttaaccatttgtagctgaataccatattaggtttattagtgcataaaatttaaaagttgaaatgcttaccaatgtattaacaaccataatcaatcaattcccatgccatatctttgaaagtattagcttgttttatgtagaataatgtagtttttagtgcagcataaataatataactcatactaatggcatattagagggatacataaaatttttacccatatattttgcagtctcaaaaatgtgaataagatctaatgttgatgaagaaacaagaaatcaatttgtaaaataaatgctaaaggattttaggcagggattataattaacatttttgtacttgcaaccccacctaatgaagtacattgcatgtgggaggaaaaaaatatgtaatttttgaatgaacatgcttctttgaaaacagaaattaagcctacaatgtagactttgttaaaggtcatagaaaatccagctgtctggctgggcgtggtggctcatgtctataatcccagcactttgggaggccaaggtgggtggatcacctgaggtcaggagctcgagaccagcctggccaacatggtaaaaaccccgtctctactaaaaatacaaaaattagttaggtgtggtggtgggcatctgtaatcccagctacttgggaggctgaggtaggagaatcacttgaacctgggtggcggaggttgtagtgagccgagtttgggccactgcactctagcttggaggacagagtgagactccatctcaaaaaaaaaaaagaaaaaaaaatccagttgtctcattttcctgcagtagtttacgatcaaaatggtacaaatttcagtttctgtaaccagttatctatctagcacctaatggcatgcggccaggtagagtgagcagaaggatggaggagaacacacatcattcttttgagatgcttataattctacaggtatcaatggtaatgcagtgaagcataaatcctcatgagataaagtcatttccttaaagtatttaaacaaatgctattttgtgtcaagacaatattcagaatttactgttaaaggacatgaaaagagtttttttctttcttttcttttctttttttttttgttaagatggagtctcactctgtcccctaagctggagtgcagtggcgtgatcttggctcactgcaacctccgcctcccaggctcaagcgattcacctgcctcagtctcctgagtagctgggattacaggtgcctgccaccacacccagctaatttttgtatttttagtagagacagggtttcaccatgttggccaggctcttctttaactcctgacctcaggtgatccacttgcttcagcctcctaaggtgctgggattacaggcatgagccaccacgcctggccaagattcattttattaagaaagactggcagtgataatgattctttatcccctgcatgactcttctttatcccctacatgactcttttattttaactttctctatcctcacccacatttcctaccactattgaagaaataattttgttacactaaattctatttgagaattctaagcatctcacctaaataaaattaattttaacttatgaaagaagtgacattgtatctcctctgattcctaggaaccttctcactttcttttttcttgctgtaaaaattatcactcttggtaaatactcagtttctttgggctctagaattccaacaaagatttggagccacacttattcatattttaactttcttggcacttatttccccaatttagacatacatatcattaagaacatataaaagtttgtgctgggaatttcttattctagatgagagattttgaaattaaagtaatgagtcagttcagagatttgcacttacaagttcaaaacctgagaaagagtcattacaacaaaatctggaacaaacattaaaaagaaagtctagatcctttgcttatccagtttttcatgtttctaacttgtcactcctcctatcatccttggtgatttttcacattttgccaaagcaatctatatacagcagcatgatgtgtgtgtgttaagtagagctaggcattttccctggattcttatattttacttagatttgttatagaaataaaaattaataagacatcttaaggctatgaaccccactttccaccgcatatcaacttcattataatttctgtgttgccttctattttcatacaggttttatttataaactgcttagtcccacttgacatatttatcttgctgctgctttgtgatcaatctgggttatagatttcatgaaagtaaatcaagagttttcccccaatgtatttcattgtagtagaactaacccaatgactgatagttggccttttgagggaaccagatactgatttatgtttccagggaaatgtttaatgcagaactctgaattcaaactcaaagcagaatatatcttgtgattattttaaaatttttcctgaaaaaattagaaaaaatataattgctttaggtgtaaaggtccacattttcatgtacagaacttgagcattctgatccgggttttttttttttttttttttgagacagagttttgctcttcttgcccaggctggagtacaatggcgtgatctcggctcactgccacctccgcctcctgggttcaagcgattctcctgcctcagcctcctgagtagatgggattacaggcacccatcaccatacctggctattttttttgtattcttagtagagatggggtttcaccatgttggccaggctggtctcgaactcctgacctcaggtgatccacctgcttcggcctcccaaagtgctggaattacaggcatgagccaccgggcctggccaatctgtatctattttacatttagcaccattattttttcttttttgccatttatttcttttatgaggtaattttatagttttagagttagtctatggttagattactaattctaccatccaccaacttgtgagcttgatgtatgagtttcctaaggctgctataatgaagtaccacaaacttggtggcttaaaacaagcgaaatttattttctcacagttctgggggctagacatccaaaataaagctgtcagcagagccatgctccctcagaaggatccaagaattttttcttgtctcttagcttctggtagttgccagtaatgttggacttcccttgcattaactccaaaaggccagtggggtactattgtttaatatccccaaggacgttaatatagattttaagataacctatatagcactcagaaatcccttgaaccttctaaatgtatagcatattatagaaataaggaagtaaaatcagagttgccatgtagaatataaaagttgaacttcatgtcagagatccatgctaaagtaagggagtggtgaatttaaaaagaatttaaataatataaataattgtatgcctgtctactctggagaaaaaaatgatgcttcacttgcttacacaaaagactgtataggaatgatgacattgtttcttttgtatcccacagagtgttggttacctcagtgcttaattatttcctcatcaaggacccagtcccaccttctgtctctcttgttttcaccactactcctctcttgaacagatgatatttttttcctgggttactgggcaaatcaggaaggtctggttaagtttcacagattaactcaacatagtctcacctcaccagttgctcctttgttatccttgtagcagatccttcctaagaaacttgtccctttttctttctgaaccttaaattgccaatcacccaaactgtgaattgtaaacattgtacccaataggtaatttctcagtcttcacctctctctcccaccctcccccattttggagtccccactcacttaacttctggctttggaatgatttctaaaccacaatgatcttgtgatttcagagcagtcggggattctcccaaatgttttgcattacagtggaactgaagagtaacctgcagacagcttttggaataactagctactgagttgtacttcaaggaaaatgtttagtgcagtatcctgaatttagattcagacagagttttaaatagttttatttaaaaattggtggagggaaacccataatttgaataatggagtctcttaaattcagtctgaattggactgcttgcattggtctgtcaggtgataactaaatttccctttcagttggtcctgttgaaacggaaccataaaatgactgtgatattacttatccaacataagaaggaaatcagcattttatttacattttatccctgtttcaatacacaaaagcaactccaaagtgaattgtttgagatttaaggtttgcttaactcttcccaaccctttggcttttagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtatgatccaattcttttgaaggctaaaatgaatgcgagaaatttgcaaagcaacagtgttgggcaaatttctaccatgtgtagtgaccaaccatctgagaatgcatgcttgcaagaagatgtaaggatctcagaggctagaactttccaacttggatggaaagttaattatcttaacttttacttgaaaagtcattgtgttcatttggcatttgtctcatttgacaagattttcttaaagtttggtagtacaaagggcatgggagtatccaaacaccttgatccagtctcattgctcagtgtatgatacttgatacttgattttttgggcaagatctttgttagcttctctgatcctcaaatttctgatatctaaaatgaagaaattagtttaaatagtttctactgattcttttggatttaaaaagtgttttaatgtacttgaaaacagttctctatattcctgtgtaaattattaaatcctaaacataatccaggtataccggcaatttaagcacctgttgctggctctcctgattttggtcagggtaattgaatcatgtgacaaacaggaactcttgaaggcactgcaggtttggactaagatacaaaataaaatcaagtaaataagctttattttaagtaaacaacagcaataacaataataaaactgcctgagaattcaaaagaagggcctggcacagtgactactcacacctgtaatcacacactttggaggccaaggcaggaggattacttgaggccaagtgtttgagaccagcctaggcaacacagtgagacctcatatgtacaaaaaaattaaaaaaaatagccagatgtggtggcatgcacctgtagtaccagctactcaggaggctgaggcagttgaatcattctatcccagaagttcggggttatagtgagctgattgcacctctgcactccagcctgggcaacagagtgagactcagtcttaagaaagaaaagaaagagaattcaaaagaaatgttaaacttaattgatttctaggaaaaactgaatggtattaatggtagcctaaataggctttcattattagtttgaaaatgattgttgatttgacttagacatattaagagtattgttactcatttcttgtgcataggttgtgagcaactattgcatagtaaaatttttcttacattttaaaaatctattcagttcctaattgtaatcccttttagactggagaatataatttttttttacatgattagaacagttttgataaatgaactgaaaagtgctaatatgtgtgtggctactctgtccagactgagggagcttctttctcagattgttcaggctacctaatcaggtctattgaataataacaggtctagaagttggcagattgaacagatacacagtcccttaggacaaaaggaatggaactagagatgacagctacaaaattttagaaaaggaggtgatgactgagtgtggtggcagacaccgcagacccaagaagctgaagcttatggtgaagccttgaagaaaattcatttgcccccaccaaaccccagaaaggctcagaaattgggtaccaggtacctcaaagagtagaaaataaatgtgaaactataagcaggaaactttatgggaagtttgtttaagaaggaactatagtcctggattgcttcttccaccctgatagaagtcctgagacgtaattctggaaaagatgaacttctgaaaataccaggaagaacagaggtttaaaaagtaggggatataaaagaaagtctccctccctataaatatgtatatatgtatatagatagatatacatatatgtatatgttctctttaatatatataacttcttttaatacttgactgttttaatctttgagattcttgtctgaggaatctgaatagcccacatgtaaaaattgaaagacactgatcatgatggattcccccaacagaatgtcctggacagtgaaaccaactagtaaataagtattcttcagacacagagattctagttaatattttgtttgtttattttgtgtttttgtgtctgcacttttaaatataaactgatagtcagtagtctccagatatttgaaaaaaatcctcctgaatatattctagattagattgagaccaatacaaacgaaagataaaaaggatgttggagaaaactgacaagatagagaggagaaattttcaaaaaattattattgttaatattctgaaagatggggacaaaaaagtgtcaataatataaaaataacatactacaaaaagaggaatattcagagaacataattgttggaaaatctctcaaaaagtaaagcaaaaggtaagagaaggaaaacaggataggcaacattaggaaaccagtgattctgtccaggagggctgatcttcagaaaatcaagagttctaaaaatgaaaggatgaacacacaaataaatgtaacagaaaaaagcaatgggcaaaaagaacagaaataaggaaggaaagagaagaatggggtgtgaaaattattttgttttcaaattcaaaaatatctagaactataagacctgagttgttagactgaaaaagcctaaaaatttcccagcgaaatggatagatgagactggtcccagtaaaagtcatcatgatattacagactactgaaaacaaatagaagattccaaaaatgaaaaaaaatagaaataccatgttgcatccaaaggataagaaatcagaaagactgataattgctcaatatatatactggaagtcagaagattatagagcaatgccttcaaagtcctgcgtaaaaatgactacttacctagaattctttacaagcagccattcaagtgtataggtggcaaaaaaagacattttcaggcacataaggactgacaaaaacttacctcccaaatgctctttatcagatagctactgaaaccaaatgtgtgctaccactgtaattaatttctagaatcttagatctatccagaaaggccaacgataaaattacatagcgtttgagatacaggcctacttagcagcctgtcaaaggagcgttgctaaagtcagaatggcctcttttacaaagcagatagactactttgatatattttctgtcaattgctagtgtagttgttatcagtatcatcttctttctgttacttcctttctagttatatgaatatgtatgcatatgtatatgtatgtatgtgtgtatatatatttcctgttcttttcttttcttccaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtaaggctttattttctttttgataagttttcaaaatgtctaataattagaacaagtatttattaacatttgaagctgtatcggtagaatttagagtgattatatgcatattattttattataacacaatatttattttaaaaaaactacacaattttatggcatattcagtgttttcctgaggtgaaaagaacagttttctgaggatttggccatgtggtcggagctggctattggctgggcttctctctccttgtagtcactcaccctcaaacaaactaccccagattcctcaaatgtagtagaaatgttccaagggagtgagtatggaagctgcataaatcttaaggcctagtcttgaaagacacataggttattttaccttcattccattgatcaaagtaagtcatgggccagcctagattcaagattccagggctggagaaacagaagccacctcttgaagggagaaggagcaaatttacactgcaaaagtaagagccctgaagaaattgctgaggccatctttgcgaacagtctgccatagacactcaataaattagttggtagagcttgtgactcagtagattccattcataaacatgcaagattatgtgtcagtttctagacctcacataatatacaaacagtggagatcatttgctacttgtatttgtctaaaatgctgtaatttttagaatagaatatttagaatatgatcaatatccaccataaatgaagatgagatattaaaagacattaaaatcttcagtggacatacattgttgtcaaaattaggttctgcagtcatttaagaacttttttgttagtactatcttgctaattcaaccttactaacagttgacctcaagatatgttgaggtggccgggcgcagtggctcatgcctgtaatcccagcactttgggaggctgaggcaggtggatcacgaggtcaggagattgagaccatcctggctaacacggtgaaaccctgtctctactaaaaatacaaaaaattagccaggtgtggtggcaggcacctgtagtcccagctactcgggaggctgaggcaggagaatagtatgaacctgggaggcagagcttgcagtgagccgagttcgtgccactgcactccagcctggatgacagggtgagactccgtctcaaaaaaaaaaaaaaaaagatatgttgaggctgctttaaggtttaaaaatgaataatatgtatatattccagttcacaagtaagtgaatattcttggcttctatgaagaaggatgactcttatcaatagccatgctctaatactttaactcttttacttattttgactgttgcttttctcctgtgtattgcaaaaagcatattttcagtcaaaatttagaattacaatattttaacagagtttttggacggtaaaaattagtgtttccaaatgagtttgatataaattattgatgatgagttattaaagttttaaaatgagcaaacatgttctagacagagaaacatcattcatgttttatgttcattctgcctttgaatttttttccctagtgcctgtttttgtcttttcttataggtgccacttgtgtgttaaagaagaaattttcagcaagccagttttggagtgactgcaagaagtatgatgtgactgtgtttcagtatattggagaactttgtcgctacctttgcaaacaatctaaggtaggcgtaatcattatcagaaaaaaatatgtcagaaagaataagtattgagatagaaaaggttatttttatttctttgtttatactctacctttgttactggcgggtctttgttcttagagcttccaagatagtggcaggtgctacctagatggtggcgggcagctcccaagatggtggcaagccttgtgttctctgatctggggttcttggcctcacggattccaaggaatggaaccttgggccatgcggtgagtgttatagctctattagaagccatgggtcatggaagagaaccgtggaacccagcgactagtgttcagctggattaggacgaacctgggcacttagccattcaggaacaatggcgagcctctagcccgattgggagcggcaatgggcaccttgctggatcagaagcagagcagacaccctgctggatctggaggggtggaagtcagcagcgggtctgcgatggcggagatcagcagtggtggacggtgagcaaaagctcagcttgagccagaataaacacagaccagaagagtatgcagttgcaagatttaatagagtgaaaacagaactctcatacaacgggaggcgacccaaagcaggttgccactgccggctcaaatgcctgggtttatatctggatctttgtccctccccctgtgctctcaggtgatagatgattgactatttctttacctcctgcttttagcctaattggtattttagtgagctctctttatgacctgattggccgggtgtgagctgagttacaagccccatgtttaaaggtaggtgcagtcaccttccccagctaggcttaggaattcttagtcggcctaggaaatccagctagtcctgtctctcaccttctttcagaacataatttagctgacttacaaagatgcgtgcaataccccaagataaaataagacaagtgaaagaaaataaacagagagctatccaagaatgtactaatgtgctttgtactgtagcaggataggactgacccaaagactgtgtttagactaaaattaaaatttctataaacataacacgcatcagattatgaaattagattcatgctatgtttacagaaagcaattattctaaggttaaaataatcttttaaaatgctgttctttaaaaaaataactactgaccactgacactgattataatttattttctattttttcttttgaataagtgattatattaggatatctttttgttttactttaaattaaaaaaaaaaacccacattgctttgatttgcacttgtctccttaactgaagaagtcatttccacattcgtttgatcaactgccaccatctgaaaaacagataagcagagacagttgcaatagcctgaagtttatctttattggttcatttgtttttttgccctcagaagttattttctttttcctgctttcgtttatctctccaaatgcttcttctttaactttatgattttctaaacattcttgagactataaagaagttactttctttaatcaaatttatttaattctttatattattttattattataaattatttatcttttattatctgattattttaaacatcagatccacatcagccccttcaagaatgacaatagagtaggatattgccctacgtggggtggggcaacagaaccttggcctttgagacccacctttccttgactagaggatctctcaatagagtaggatattgccctacgtggggtggggcaacagaaccttggcctttgagacccacctttccttgactagaggatctctcacttatcacctctgccatcatcacatctgcttaaggcatgaatggtgtgctgggatatcttctcttctctttggctaaaatctggccatgtaatttttcaattaattacccagagcacagctgacactaggctggaggcatttaaataagactttttcattttgagcttggagttcaccaaggagaaacctccagtcgagcttctgacccacctccctgtggcagaagccatccttactcattttttgcctggagtgcttcaaataactatagattccacagattcatagccaagacaaagagttccagataaatgttttacattttttaaatatttttctcttcaaggagaccttgcctcaggtaagggaggtagtcttaatctaaagaaccccaataatacacttagaatgccacaacctcacatattttatcttctagttttcattgtactttttggtaatgtgatatctggactaggttaatttagggaattaatgccctccagtaagattaaggtcaccttcagttgagatttcatgactttagtacagaacacagtaggtgctacctagtgaagctcatctgctttctaaaccatgtgctccaccattcctgtttcctctcatcctttaatagtgacatcagtttgtgtaatgtcattgctcagtaaatatttattgaatggttgaatacatgaatttacttatttctaaaatttaccaacttaatgctgcatttagtatcttcatgcaattgagctaatgtaggttttcagaagtgaatgtaaatagccaaagtatgtggatacttttgcgatttatagaaaatatttctaaattgctgttcaacatggttgaagtgatttagaagctcatgcacattgtaggagtatgcctgttgcacagtgtctgtcagtactgggtgttattaaaaatagtggttttccagttgtgcttcttggaaaattagaagctcttttaagctccctcaaaagtccttgaaacatggtgagtaagagtaaaagcaggccaatttccaaggcccaccctttcaaatatcatgaattaaacccaatttcctgagctcctcaataatgctttgtttgaacaaaggatgcctcagtggtttttaattagaaaaagtaaattcgattatttacttttgtttataattttatagactagaaacaaacatatattaatgtgctctgttaagattactggcaaggtgggacagttttccagctgtatttccctttaaaaatgtctcttttgtgtcttgtactcatttatttgtctggtacataatgttttaccttatccagttgaactcccacttcatataataaaggtattaatagtttttcatattgattacaaatcttttctcagtgtttttctttaaattttttaaagaaatgaaatattctttttaactctctgaatctgtattgcactgatttggaggaaatattatagcttcggagaatttgagagaactgagaattgaaaacagaatgcctgattgctttttaattaatttaatttttaggggtgggcatggtggttcacgcctgtaatcccagcactttgggaggccaaggtgggcagatcacttgaggtcaggagtttgaggtcagcctgatcaatatggggaaaccatctctactaaaaatacaaaattatgtttttgtaaaatacaaaaatacaacatggggaaacgatctgtactaaaaatacaaaaattagccgggcgtggtggcgagcacctgtaatcccagctactcgggaggctgaggcaggagaattgcttaaccccgtgaggtggaggttgtgtgagccgagattgtgccactgcactccagcctgggtgacagagcaagactctgtctcaaaaaaaaaattaatttaatttttaattttaatttttaactaaatctcttcaaagaaaaaatgatgtttatcaaataatctgcaaatgcttacctgaatgcaaactgaggaggaaagaaggaaataaatacagctttacccaaagggaaacttaataatttttttttaagcagagaagcattgtactacctaataccctttgttgaactcacacaaaatgagtacaagctgttcttggcattacaaattaggaaaaggagaaagtcattctgttatgacatcttttcccttcaaggagatcttacatttttgctgtccaatattcctttcaatgacattcccttgaaatgaaggggcagtttctgctgcccagccagtacatcagtggattcaggtagagccagagaatgaacacgtgacatggtccaggtccttaccttcaaagaattaaaattgaatgtctcataagccatggtttgaagccccacagacagttatttaaaagaaagcaaaaccatgtggttttaaaatagattcagatttgttgacaatctcagggtaagtagcatattccaaaggaaatttacctgcaggcagaagtcagaatgtgagttgaatgtttatgtgtagttgcacaaagactccctagggttggctttctatggccagaagcatttatcctttcccatctctcaaacatgcaccctattccccactgcttctctttttcaaaactccagttacaaaagttcttttggcataaacgttagatgtacttctttaaaactgctggcagcagcattgttttcagaaaaagagactgactcctgttagtcatggtgagatgaagttgttcttctcttcccctgagactaggaaagcagctctccctcacttttaatcttccaagttttctatgtcactaaagcaccatcatacaatctgattgggtctagttctatattttcttaatactaatgttgtctttaatattgattggtgaggaatatgttggaactctagacatcagtgatcctctaggggagtcttgctgcagagtttgtcttatataagcaattccacctaacacagtcaacagttagccatatctagggatatatctagggatagaccatatatgtaacatattcatttcctcattcattcattcattcaagtaatattgtaggattagatatacaggacacacaggacaaatcagactgcttctctcttagaatttatactctctttgatgagggggagagaaaataaacccagcaaacacagatgaaaagtaattacagacaatgacaaaggttatgaagaaacaaaacagggtgcggtgatggagaatgatggactgtgggagtaggacattgctaattagatttggtggtcagggatggcttcacagaaatagtaatctatgagccgaggacctgatatgacaagtgggatccaggcacagaaaagctgggaggttgccgtcatgacagaagaaactcaaaaggaagagccccacagaaaacaccacctgaatgtttgaagagaaggagggtatgctgggccatccattgactagatcttgtagggcttgaatctttgtaatcttggaggagaaacttggattttattcccatcagagtagttgaaaaaagatgaaggaaaaactggaaaaaattagaccactttgggatctatcttgaaggaaagctaacaagacttgttagatcaaggataggaagtgaaggaatgggtagaatcaaggataagtcccaggtttttggttcaaacatgtaggcaaattatgaactatttgctgagatgaagaaaactgagattcgaggaattaaaattaatttttttgatctgttaagtttgatatattaggcatccagatgaataagctaaataggcaattggatgtaggaatctgaagctcgaatagtacaaaagacaggacctaattaacaaagcaaggacctatagtgtgatacatgtatgatgcttatttttcaagctactatttgtagtttgacatttaggctatataatttgtctatatatgtcaatgtagaacacccacattttgacattctcaaggcatagtctatacttattaggaatgcattttctaaaaattatatcccctttccttattttgttttcttaaaagctaagaaattccctgggagccagaaaacatccttatgattctgaatacttttggtaaagaatattgaaatttgacaaaatgtcttacacttgactcccattataaaaagagaggtgttttaaagtatcagtgtattcattaagtatttttattcatttttaaactttacaaattgtgttaaatttttcattagtaatgcttagacaatcctgcagtgagcccctaagagtttacaggtttttttttattattttgttttgtttttctgaggctgacaagatgaaaattttggaacacaagaagtgatttatggcagtgtgagagtgtttaagagttcaattagaaaggaaacctgctttcttttctccaaaagaatgtatcattcctttcaagagttttctttgtcatatctagatatgatatggaaatgaagaagattcagtagtgccagagaataaaattccaataaggagagatcgaatgatgctatcttgatcttcgtatcttgaacttgtttgtttgttcatttgtttcgccagttactttttgaatgggaccaaagacggtcataagctaaaatcttggctttactttgtacctggttaagtgcattctatttattcttttttctttattgaaaatgggcatattaaaaatattctctcatcacattttcatgttcttagtttctacataacttcaagtgttttatcatgttttctccttttcatgtcctttaaaagatgtaatcaatcaaagtacatagttttggaaaacttttcccaccacattttagtaactttttaaaaatagcattttaaaattaatgtaaactttaattgttatcaagatattctgatatagtttcattacaattctctgtagctttcaaaacaattgattttgcctgtaagatctagttaaagacatttatatattttttattatttgtattcctcaaatatttgaagcatattatatggttgagaaagtaatctctctttcaaaacccagttttccttaaataagtcaaagatatgtttacattgttataatagatataaaagcatttagagaagttggtaagctgccagaaactcttttcagcttagaaactgtaaatgtagaaatacaaggggctaacataaatagctgttagcagcctgaatgctagtggaattacacaggaatttgtgaatattttggagtgttttagaactatgtgtatatattaaaggctttttataagtgctaattttaatagttaatgattcacatttcataggtagcagtgcatgtaaaatatacacatctttttctatctgtcctttatgccatttatgctaattccattgaggatacatatatcccgtctttgtaaaatttcccaagaaatttagctttatgtaggaaaccatctgatagtgcattggctacggaatctaatgacataggcttaatttcaagctcctgttgtttgactttcagttgctcacttctttaagccataattcttctctttatataaaataagtaacaatacctacttcttctaattggcccttgattctcataatccagttatgagatatatgtgaaaaactgtaaacaaggaagccgaatacaaatggaaggattttaaacaaaatgtaggttgaatgcagtgactcatgcctgtaatcccagcactttgggaaaccaaggcacgaggattgcttgaggccagaaatttgagatcaatttaggcaacatagtgacagtcccatctctacaaaaaaaaaaaaaaaaaaaaaattagccaggggtggtgatgtatgccattagtagtccatgctatgggggaggctgaggtggcaggatcatttgcacccaggagtttgaagctgcagtgagctatgatttcaccactgccctccaacagcttgggtgacagagcaagaccttgtttcaaaataaaaaaagtaatattttacatgaatgtatttataaaattagagtaattttgtagaatgtatttataaaattagagtaattttgtagaatgtatttataaaattagagtaattttgtaggtattgaaaactaattggtctttgactaataaaaattacataatactgattgtaaaattccatataaatagatcatgatcattttaaaataaaactttaataataaaatattaacaattttatagtggcttgtcacaaaaagactaaaaataaaaaaccagaaaccctaaaaatattatgcatatctcctcttagattatgtattcttattgtagatgtggtgtgttagtaagattttcccacatttgatattaatttaacatttaaaaacttatgtccaggattatttctttgagtattcatttgctatttttcacattgactattccttaaattttctattcctgaacttccttgctatgaacacataaagtgaaggtcagaaatggttaatctttgttctgcagtgagggcttatcaggaaatacaagaatattcaacaaatgataaactattagaattctccatgatcacatcatttttattcccagcgggggtaaaacacaatgaattaagatcaaggatttaatgacaacttttctattaatttaccatgtgacatagggcaattcattgaattaatttatttgccccttggagttggggagcctgaaatttaagcctaaccaacaaccatgtcttatgagctttgtgatcttgggctagttcttgttctttcatctatataatgaatgtaataacaattatatccagaggtgataggatgattaatgagttaactcaagtagaaacaggttgactagaacacggggtgctctctggaagaagcttcacaagatttttttattatcatattgaatatgccaaaactgaagatgtagtcttcagccttccaggaccagaactcaatttatcagtacatgtctttaggttggactcatataaaccaggctcaagaatgccagtttatggcttcaaagtctcttcattgctggaccttccctgatcttcttgactaaatgttggcatgcccctgactcactctcaaacctttactctttacgctatattgtcactccatggataggctcctggttgcaaataccgtctacaacttaactctcaaattggtgtctccaatcctgtcttctcccttgatttctagttttttatatctagattcctacctgacatgtccacttagaaatctgacatcttacctcaaaaatagccaaagtccaactttttacaccccgctagtttattccttgtttactccagcctatctgcctccttgcctttccttcagtacaccaggactttcctcccttggactgttccccccctggatattgtatagctcactccctaacccatcaaatacctcctcagagtgggcttctctgacctcaagctccactaatgtctgttgtgttcacactaccaacttgatgggctccctacccaaagtttgggtagactgatgttatacatgcatcaagagaatacaaaaaggttaactactgacagacccttctgaggagagaagcaaagagttccaagcatgtccaaaaatggctggagagcaggggaaaagactggttcaacttttatttgataaaggagcatcactagggtgaaagttcctgggcatttaggcctgtatatgttgatctgaacatacagctggtgcccaaagaaagagcactgggcattctcatcagcttgctgaagaggaaaggatagtggtgcggtgtgaaagctgtgagcagtcacgcatgaagaatggagatggacactggattatgaggtctgtcttcttcatgaaagtgtcttctttcactgctttatgtttcttcctagagcttataattccattacatattttatatataacctctttctttatctctcttaatcttcttccctccactattgcataagttccattatgtattattatatccttagtgcctagaatggtgcctgacacatagtagatcctcaacaaaatttgttaatatttaaacaaaagagagtagcaaatagaacaagtccagttgctgggatacttgtgtgctcatgaccaacataatctttccctagtctcagacctgcaaggaaagctaaattctacagaacgttggtgtttctggaggggacaaagtccaacaagggaatttggataaatcaaagtttctatcgttgcaggcagggagttgggactctgatgcattcaggtcactgcagaaatgaccttgctaatgggaccctgcactttttggaacgtttcattaatgagcgctagtagttgtagctcaggtgacagtttttctgagtttctaggaaaaatcaacctcccttcacatctacgcatccttttcttaggtgatttaacacagttattcaagttagagccaagtcttgcagaccgttggagctagtctttctctacaaggtgcctttgaatgttctgggtctgaggcatttgctttccctccactgttctcccacgtgctgcaggatagaaagcagctattcagagtaagtagtctgtaagtagcagttcctatccctgtactattatgtctggaaaatgagtttgaagtaagccgactttgtgctgtaacacttgaaatcacagaagtcttttcaaactatcttttgtgccttaaaatctttgttaaactgatggctgtcatctctgaaaccacggcccacccaaactcaggcttgagttaaaggcaacattgaaaagattttcaggggcagctggaacctgtgctgtcttgaccttgtaggccactcattttaaatactaccaaatcctttcttaaaagaagtgcatactctctccccacaccactcctttcctgcttcagtaaaagaaaatctgttcttctgccccagtttatgcctatttttctgccccagttctccgacatcctgttcgcatttagtgttacttcttactggctctgcaatagccatttgacttggtgtctatattgtttcagtgtataatattggagtgtctgtgaagaaagcaaactgttggaatgttttatctttcttattattacataaggtgtgttggtgtgacacatgtatatatataattgtgagcaggttttaggaaaaagaagtcttataatccctaacatatgtttatattttaggtgatcttttaggagttagatcatgcttttatgcattaaatggttagttatctaaagctgaaggcagaaatgatttgcttctttgttttcatgatgaatttgtttcttttgtgtctctccacctatcaacaaacattcttttgtttcatgaaaaattaaggttgatataaaattacctgtatttaaacagagcttgagaggttcacttttcttaggcatataaagaggttattcagcctgagtatgttagagattctctaagtaggaataaccacatgttttggaagaaagaggctttgtttttagaaaggcattgttagaggcctgagtatttcgggaaatgaataaataaattcttgaccttgtaggaggtacctacagttcaacttactgtgcagcagctcagcagacactgctgggaaaacatctctcaaataaccttttgaagaaaccagagttttggttcaagttgatgtgactactttattggtatcatcacatcaatttgatgaatggtcctgaaagctagagggaaatatctattgaaatccaagaccttgggatgtctgtattaaaagctctgggccactaagcaagttctcttaaattttaaaaggaattttaagtagttaacgatgaaatgagcattttctacatgtttgaatgtggcttactcaatgtgtgtatgcaaacatataagcatctgacaaataaaactgaaatattccagtactttttcagcttcattgagtaaagaacaaaaccactgaattagaaactcatgttttgatgacttcctattactgaaaccatgggaacaggatcggtaaatagagcatgggcttttgaggctttgtaaagctggtttcctccccactccctccattgttccctctcttgttccttccctctcttgttccttccctctctcgttccttccctctctcgttccctggttccctccctctctcccaccctccctcactccctcccttcctttcttccttcgttccttcgttccttccttccataaatgtgttgtgaacacttcttatgcaccaggtcctattgcaggccatgctctaggtaatgaggtacagcagaggacagagcagacaacaatccctgcctttatagagcttacattttaatgagttcaaattatctctgtatcttatgtgaacttggatctgaacttcatttctccatatgcaaaatgagaataattcttcttcttttatagggttattgtggtgattaacatgagacaatacaatactttgatatgggggctcaagcatgttctctctttgtttcgcctgacctggcagcccacatgggttttgctgctgtcctgcattctctgtatttgtcctctttcttgctgtttctctactttggtttttgagtgtatctgtgggtctcagtgcctttatttctatgtgcacccgagtcttcttatttgtgtgctttggcatgtgtgtctctctcactgtgtctttctttttatatgcctctgtatgtctagtttgtgtctttcttttttgatctgtgtgtgtgcgtgtgcctgtgcacgagagagagagagagcaagagagaatctgtgtgcatacatctctgtctctgcatttttctctcttacagtgtgggtttctctctgtctctgtgaatttgtctaagttttaaaatcaaagttctgtgaaaaggaatttgaaagaaagcaactttattcccgtgaactgtttgcaaactgtaagatacagcctttgctgtgaaacttaggtacattccagagaacaaagggaaggttgagtgtttatagcaacagttcctgctcaggtttccaatcaggtccatttatgcaaatgaaagactcaaacttgctgagttttgattggttgatgtagctgagttctgcttgatcaattcaagccacagcttattggttggttcaggaaaaatgaacaagaagagtcagctatgaaagccttagcagtaggccagtgcagtagctcatgccgataatcccagcactttgggagtttaaggtgggaggatcacttgagctcaggagttcaagaccagcctgggcaatatagtgaggccctgtctctacaaaagtaaaaaattaggtaggcgtggtgacacatgtctgtagtcccagttacttgggaggctgaggcaggaggattgcttgagcccaggggttcaagaccagcctatgcaacatagtgagacctcatctctacaaaagtaaaaaattagctaggtgtggtggtgcatgcctgtagtctcagctacttgggaaggtgaggtgggaggattgcttgagcatgagaggttgaggctgcagtgagctgagattgccccactgtactccagcctgggtgacacagtgagaccctgtctcaaaaaaaaaaaaaaaaaaaaagaacctcaaactcaaagttaagcagatgtgtgtgagctttctgagaactcagagaacgtgtctgacctctagtcaaaaaacagctcattggctctattttatgtttaggcccagttagccactcaggatttatcttgaggaattgtctcattcaggttcatatttggatcggtacatgaatgtgtgtgagtgtctctctatgttcctctcacagtgtgagtccctctgtctctgtgtgtgtcttactgtgtttaggtttctataatgtcagtttgactctgtctttttttctgttttgttcattcatattcttgctcttgcctgccctttctccccttgctccctagctctgactctgtctggctctgtctctcacctttttctcttgttctgtgagtctctcttgctttctttctctctgagtctctcactttcactctctgtctttcctgcttttcgtcagtctttcacgctctctctgtctctttgtcacttcatatctttcacttgtgtgagtgtgtaggtaggtttttgtgtattcatttatttaattgtgctcattatgtttatgcatgtcctctcattcctatcccaatatagcttagatattcggtgatatttaggtagcaatctcatatctcaagaagaataaaaaggaatagagatttattctaaagaagccataaggggatttatggattgagaagtggagttttaaaaattacagatggatattaccaagatttggttgtatcttaggtgacgtaccactaatttcacagtatctcaaaactgtccagtataaaaccaaatataattaacaaccatcaggccctcatctctatgtctagatagtccagggtcactttttaaagctctctttgctgatcttgatgatttttcttcttcaatggttgtcattctgttgagcctgctattctatttccttgactacaatctaggttctcatcatcatcacccacatcatcttttgcctgaactacttcaggtgctatccctggccccgctaactttccatccatcatgccaggtgggggcaggttattgttccatcatctttctctccttgatgccctccactggcttccagttttcttccagggttcaccaatagagtttcacaacataaacagctgtttttttttaaaggctcacctgaccaatattttgcccacctaccactatgcccaatgtgtataggaagccatgcttttgaatgctctgactaggcgattttctccactacaaatattaactcccagttatttctaatgggataaagccctttcctgagaaggaaacataaaaggaaaacacatgggaatctggataaggaaactttataaaccaatatttgtagcaccaatgtattgtccagttaaccagacgatgcttaacttgttttaatactaagaagtttttgctattttgactttgtatcatttaggaaagggttcagcaagatttttctgtaaagcaccaaccaagttagtaaatattttaagctttgtgggttatactgtctttctgacaactatttaattccacccatgtttctcaaaagcagccatagatgatccataaataggtctggttgtattttttttttttttttttttgcgagacagagtctcgctctgtcgctcaggctggagtgcagtggcctgatctcggctcactgcaagctccgcctcctgggttcacgccattctcctgcctcagcctcccgagtagctgggactacaggcgcctgccaccatgcctggctaatttttcctatttttagtggagacggggtttcacggtgttagccaggatggtctcgatctcctgacctcgtgatccgcctgcctcggccccccaaagtgctaggattacaggcgtgagccaccgtggccggcctaggtctggttttgttttaataaaacattatttgcaaaaacgggacatggctcagattgggcccctgcaggctgtagtttgccaatacctaatttagactttatgataatatcttattatgtattccatataggtaaaattttcattcctgtgcacactgtttttttttttttttttttttttttgagacggagtctcgctgtgttgcccagactggagtgcagttgtgtgatcttggctcactgcaagctccacctcctccgttcacgccattctcccgcctcagcctcccgagtagctggcactacaggcgccagccgccgcgccagctgccgtgcccgcctaattttttgtatttttagtagagacggggtttcaccgtgttagccaggatggtctcgatctcctgacctcgtgatctgcccgcctcggtctcccaaagtgctgggattacaggcatgagccaccgcgcccagccactcgttttttaaagctttttttctctctcacctttcatatatgtatatatgcatgagtgtgtgtgtgtgtgtgtgtgtgtgtgtgtgtgtgtgttgtgtgtctgtgtgtgagtgccaaaaatataacttttgggctttctacagggtttcatataatttgtcattattataataaataaaggaatcatattattttcatttacataaaattccatgctcataatttgaatcaagaaaaccaaaacctgaaacatgttactggtaactttcaagaaatatctcaataatctgtaaaataacaacagtaatttatatcacgtattttatgtaaattatgtcatttatgtttaactcttttgtaagtgtcatgtttagattcttagttaccatttaaaacaagattttagagaattgttttaaagtattttgtgtatgtgtgcttactgaatcagcttaaagatgtttgtaaaattttagacttttattaattgaagaccttttatttgtaaatcttatctaaagtgcagttgaatagatttaaaattaaactttcatgaaatctgaattgaccatcattatgtacagcaaaaaatattatatccttgtcataaagttaattctagataaatgtaataggtaaatgtaaagagataagaagaaaataatatatagatttttttgcttataggatgggaaagaaaattttaaatcacatattaatttgaaatattaataagagcagagaatgatccatttaattattaaaaacattgaatgtggctgggcacaatccacctgtaatcccagcactttgggaggccgaggcgggtggatcacaaggtcaggagttcaggaccagcctggccaagatggtgaaaccccatctctactaaaaatacaaaaattagccaggtgtggtggcacgtacctgtaatctcagctacttgggaggctggagcagataattgcttaaacccgggaggcggaggttgcagtgagctgagatcatgccactgcactccagcctgggcgacagagcgagactcagtcttaaaaaaaaaaaaaaaaaaaaaaatataatgttaaaaataaaaatcaaattaaaagaaacaaatgctcgtaactattttaaaaagtgttaatcttcttaatacactattaaatgacaagcattcaacttggttaaaaataaaaagaaattaaacacaatatattttcttatcaaattgtcattttaaattaaatgaaatgtcatatttctaagaattcttcattgaagaggtatccatctccctctcctcaataagatataaatttttagccaacaatttggtaacatatccataaaaatatttacaactattggcttcttccagggatctgtcctaatgagatgcaaaaatttatagataagatattcactctactatctataatgatgaacatttaagaacaatgtagcagttcaaaaacaggtgatgaaggggtaaattgtggtataattatatgataatcaaaagcatggaacatcatatatttgaatgataacaatttggaataatgtccagaatttattaataaattagaatatatggccatattatggtgattataacttttaatgtatatatagatatgttacataatatttatatagtgagattatatattatttcattttttatttttctgtattctctaaatgttgtatgatatgatatgtgtatatttcaacatcaaaagaaatacacattttcttttcccacataacactaaacaatagatcaattgatgtttcctcatacctttcaaagcatggtcttctgggttttctttaaaggaaagaaaaattttttaaaaagagatcttggacattagagaaatgaatttgatattttgggacaaaagtcttgatcctagtttagaaaatgtgattctctgtatcaactgaatttcttaggatgattgtttttatttagtaagcttgtatagctatagcccacacaagttaaagcctgtggaatttggtttataaaccaccttcatattggatttcagagaatgccaaggcatcttataaatgatgatacttgctaaaactcatctcatacctgaaaagcttccaagcattataccatataaaagattgttctctattcaagcaaaataagtcctaagatttgcaatgctgctgtttgacgcaggaaaatggcagtggaaaatccaagagctagttccatgccaggcaggcaaaatctgccatgcccataggaggcgggaactagaacagaactgctgtgggttatatttactgtgagaaaagaaccctctgtcttgaaaggagctgcagatggagtcttttctccatttgcagaataattaccttaaacctcatttatgtaggtctaaggaaatcaacaagtgagagcgtttcacataattccacatcttggctatcttattattttcaattgatttttttttttttttttttttgagatagagtccctctgttacccaggctggagtgcagtggtgcaatcttggctcgttgcaacctcctcctcccgggttcaagcaattctcctgactcagcctcctgagtagctgggactacaggtacccactaccacgcccaactaatttttgtatttttagtggaggcagggtttctccatattggccaggctggtctcatactcctgacctcaggtcatccgcctgccttggcctcccaaagtgctgaggtgtgagccaccatgcccagcctcaattgaatttttaaaaatcaaaacagtacttttacacagttataaaaatgaaatagtactcttaggataagaaatatctctgcattatcagtacttgatctctagaagtaagcatctttaattcttctaggacatttttagttattacttatctccatatttctcagtaaaatatgtattctactatttcttgatttttcagttttaactgtcgtctacctggcttcctactcacatactcactatccacacacatatcttctctctctgtgacaccaataaaattatgatagtttaaaaatatgtttataaccagtttttaaagtattgtaaagaagtgacaatatataaattttattcatagctgagacatactgtatttatttcattacaacttttctcttttcattccttataaataataattgtcccatttttatattttaaatttagctttctaatgtctatcacaaatccatctcaaactccccatcatagctaacatttctttgtgtgtgtgtgtgtgtgtgtgtgtgcctgtgtcactctgttgccccggctggagtgcagtggcgcgatctcggctcactgcaacctccaccccctgggttcaagcaattctcctgcctcagcctcctgagtagctgggactacaggtgcacgctgccatgcctggctaattttttgtattttttagtagagatggggtttcaccttgttgcccaggctggtctctaattcctgatctcaggcaatccacccgcctcagcctcccaaagtactgggattacaggcatgagccactgcacctggcgctaacatttcttaataagatttaataacatgttacgtgtttttaataaatcgtattttttaaaggcgtccctgctaacgtgctgaatcagtgagtcactgtcctcccaaatgtgaacaagattctgatttctcccagtataaattagttttgcttgtttcccaaaaacagaatctaaatgaaattatatatatgcattcttttgaccttgcttctttgactcagtcagcactatgtcaatgagattcatctttgttttgaggtatagcagtagttcattctctctcatcactttagagttatggtaggcaaaaaaaatacaaattacaaattaaaaattaaaaaatggccccttcaaatatgtccatgccctaattcctggaatgcgtgaatatgtgtgcagtagaaacattggcaaaagggattttgcagatgtgattacagttacagagcttaaaataggaagattatcctggtggatacaatataatcgtatcagactttaaagcagatgattttctctggctgcaagcaaggaagactcagcataggggaagttggagatttggaaaatgacaggaactcaatgtgtcatttgttgttctcatatatagaggcctatgtggaagaactggagagaggcctctatgatctaagagcagcccccagctgatagccagcaaagaaaagagagtcttagtcctacaccctccagaaacttgattctgtcaagaacctgcatgagcttggaagcagatacttccaagagtctcagtcctacaccctccagaaacttgattctgtcaagaacctgcatgagcttggaaggagatacttccaagagtctcccaataagaccctagccagtcaacactttcatttcagttttgtgagtcctgaatcacacaaaccagttaagttgatgtggacttttgacctacggacactgtgagatagtaacttgacattgtttgaagggcctaggtttatggaaatttgtatggcagcaatagaaaactaatagaagactattccattatgttactataacacaacatttaaaatatatctattttactattgatggatttggattgctttcaattgagacttaatatgattaatgatgctaggaacattcttatatgtgtcttttggcagatttatgtatttatcttggtagataattaggagtggaatgggtaggttgtattttatgcatatttcagcattagtagatattgctaatcaaagtggcagcagtaataggcactcctgcccatggtctatgacagtcccatttgttccatgtccttgccaacacttgttggaaaatttatagtgctatgctaaagaagaaatcataatgtttgtaaatgtttgttgctacttcatggtgttttgatttgtagttctctgatgatgaatgatgttgagcatattctcatatacttactggatgcttggaggtattctttgagaagtacctgctcaacactttgtcagtcattcaagcagtccataagcaacaccatagctgcttgactggctcaccatatttccataaaactggttagtaaggaaagaatgaacttaaatagatttatgcagcacaaaaagcatcataaccttctgttcacatctcatgtccacaacagttccctctccccacacatcctatggggaatgcagaggtgggcctaggtggatgctacatctgtagcataggtctgtgcctcagctgagaacacggcccttaggagcttcccagtcatttaaggggctactgataaacctgccctttctttatatctgagaaagagttaataaagatatgcaagtaaatcttcttgtatgtaaacaaattttctcccggaagaggagggagactttactatcatggaaggtaaataaattttctctgtgacccaaaaaccatctctagcttccaagcctgtttgccacacaaatacccttgaaaagatacatatagatatagatatatctatatatggttacataaatatacatatattatagtttggtgtaagtatatgcacatacatacgtgtattatataaatatatatcaaactatttatacatatatacttttataatataaaaatacgtatttttactgtattgcttttgctgcatagcataatttttattctgtcttatttttcttatacagttcaaaatactttttaaattttcattgtaatttttttttcttttacccatgggttgtttaaaggtgtattattattatgcaaacatttggagattttctagttttcttttttgtaattgatctgtggtttaattttattgtggtcagagaacatagtttgaatgaagcttaatgctttgaatttggcttagacttgctgtaagactcaacaaatgatcgatctattttgataaatgtttcatggccacttgaaaaaaaatgtgtactcttcagtaccttgttacactgttctgtatacataaattaggtcaagttggttagttttctttaaacttccatgttcttatgatttttttcccgcttattctatcagtaccagagagagaagttaaaaatatctcagtctattttagctctgtccatttttgctttatatatttgactatgttgttaggtaaatagaaatttaaggttgctatccatacagtgaattgacccctttattattattaactatccctctttatctccagaaatgttgctttacttaaggtctactttgtctgatattagtatagttatactagcttcctcttgggtgatgattgtatggcttacctttttccatccaactactttcaattttgggcttatgtaatatttaagatgtatttttcataaacaggatatagttgagttttatatttttatgcattctaaaagtttttttttccatgattacatatttagtccatttacattttatgtacttatgatatatttgcttttatagcttctatcttgctattttttcttgttgtctcatctgttatttgttccctttcccccttaatcttcttttgaaataatatttttattattagttttcagtgattagccctttagttatacatccttttatatttgttttatttatttaagtatttttctttgagtaattacctggaaggatacaagattaattcttaacttaccacattctatcttcaaatagcatattttccacttctttataatgcaagaactttgtaacacttctcttttctggtcctcttcattccttcctgctttttgtttctttgctcctgtataatattgttttctttggtgctaagaactgcctttagtgttccatctgtaccgttctactaaaaacaaaattttccatttttatttgtgtgaaaacatgtttttcctttagttttgaataattctttagctgagtatagaatgctaggttgacaattattttcttgtactagctttaaaatattatattgtcttccaggcttacggtcattgttgaaatgtcagccataaatattcatgttgcccctttggaaatgatgtttctatttctttctggctgcttttaaaattctccctctctttttaatttttatatattttttcttcttagcaattttgccagaaaatgtccaactgtatttccctgctatttaacctgtctgaggttttaggttttatttatttattttttcatggcttcatgtctttctatcacttttggaaaattctcagttaaaatctcttcagaattgcctcttctccattcattttattattctatagggctccacttgtaggtatttttggcatgttctttgcgtctcatatgtcttttacttccttttacatatttttattctttaaaaaattaattctttaatcatcatatttcagaatgaggcactaaatgcctgatggcacatggctgggatttgtcaacaaaaggctcagattctagggtgactaagtgaggatccagacattttattgagatacttccagaagtcagtatcttttctcttggactgaccagtttccttgatagtaactgaacagtttcctgctctggtatatgatttggggtatcggaattctgatactagagcaggaaaagagtttagtgatctcatcttttagtatgtagactttcatttaaccctcctgttttcagtagtgttaacttgaaataaaaattacataatagagatgcatctctaagcaaagagcttatttggaaacaaaaaattgcaattcgggacacatagaccagcgtagcctctaggtgtgtctgaagaacaaaaggaaaggctggggttttattgggaaaatgaacaaagttatgtaagctgttttgaaggaagtttcattggtgatggcagtgtcttatgggagctggcgagttctgagtgtcaacagttaccaggtaagacttaaagttatggttaggtctttgtgcttttgtgtttgaattacaaaaacattttctggaacaggtatgcatgacctgggtgcctttcttcatggcctccaaatccattttagtttggtatgacgtgaaggactctattttgtaaaattaattttcacagtaagttcctcaacccaaactggtgtctgtctggctagacatctccagagattactttccagtctttggccaatgtgtaggaagggcaaactcccagatgctttgtctgtatgtagatattcagttatacaactgcttctgaaacaaatttcctgccaagctttctgctttcctcattctttttgatgcttgcttgacactttcaggaacccttgtcgagtgctaacctgcaggcttggatttcagccttatccattctgctcaatcacatgtccttttatctcttcacttttcagtttccaaaattacctctcaactcacttctctctattcttgagaattcgtagattaaaatcttcactttaaaaccatttaaatggtgtttagagaaactgaaataaataatgtgatccattaatcattttaaattatgggtaccaaagaagccagtttctctattttattgttgttgctgatttattattacatcttgttattttgcattttttggtgatgatggaggtaatcagagcaaataatggatttattgtgactacactgataatatatttttactctaattttaggtgagtgtaaaagttcatgttagttaaaacattacttactagatatagaacaaaatagaatcctgtatcttcctttaattctaaaatatgaatgaaaagtaaaactgtgagaatattgcacattctaaaacaataattacatatagttgccataatatttacaagtcaaatattactttgattctatggcctcaaattgtcgtttactctatgttaagcactgcgtattaactatacactacagtatataaggaagatgggtattattatcttttttaaaatagatgaataaactgagaatcagaggtaggagtcaacatcttgttcagaattgtatagctaattactgctaagcctggacatccaaacttaagtatgtttcatgttatcaaagtaatgatttttttcttcctgaaaaatgctttcttccttacctgacatttacccaaaaaaaaagcctttagtgatctgcaatttagaatgagctgttcccagatatggaaaaacacaaactgtattattcttgaccagtgttactttcattaggatttggacacagttctgcaatagacttatacacatattttaacttcccttctgttattgcacatatgcagtttacgtctatgatatttttcatttaaataataataaagaaagaattagaaactggaactaattacaagtaaaacattttcttctaacagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaagtaagtacagcattttccttattaaagaaatacatcggtgcggtggctcatacctgtaatcccaacactttgggacgccgaggtgggcagatcatgaggtcaggagatcgagaccatcctggccaacacagtgaaaccctgtctctactaaaaatacaaaaacaaaattagacgggtgtagtggcggacacctgtagtcccaactagttgggaggctgaggcaggagaatggcatgaacccaggaggtggagcttgcagtgagcagagattgcgccactgtactccagcctgggcgacagagcgagactctgtctcaaaaaaaaaaaaaaaaaaaaaaaggagcaccttgtggtctgccagcactcttctagatactatgcttgtaaattgtggtaaatattatcacctttttttttttttaagttgagaatttctagaaatagagtagtggcctcagtgtgagagacagtgctataggttatgtgaacctcagttatcttctgtattttctctctcatatcaccataatgatgccttttcttgttctgtttccaaatttaatgatataatttataaatagcaagcataggccctgatatatattgactctttccgtatatattaatttgactctttccattttccttgagtgtttttattccactatttctatttatctttcatcgtttataccactcaattctatacaggcttttaataatttttaaactatattaagatagcactaaaatcttaaaagtagccaaataaaccaactttttaggaggagaagattgacagctgatttctcagtagcaaccacaaaacacaaaagacagtagacatttaccttccactggcttggaaaaaataactgtcaaactggaacttatactcaacaataattttttaagaatgcaggcaaaaataaagatagcagtctcaacctttgtaaagcaaaactggtatagctgcaagagaaaataaatcttcagtaaccttctataataagaaaccactaatcgacatatgaaagaccctgcatctaactactgctgtatatctattttattcaagcacttttgaaacgtttacaaaagttactgggccagttaggtaattccaacaaatttcaaaggattgaatatatataaattatgctctctgaaaacagtttaattgttggtagaaataatttttttaaaagacaactagataacctcctatatatttggaaataaaacatttctaaatatccattcatcaaagaaaaaatcataatagaaattagaagatactatgagctaaatcataaagaaaatgttacattaaaaaacttgtgccttagccaagaatagctgaaaattggatggagctcagtaactatctctataagttaatttttaaaaggacaactaaaataaactcaaaggaaataaaaggaaggaaataataaagagcagaaattaatgacatagaaaaaatgtttggtgatgaatacaaaaataaatagaaatataatttttaaaaagtaaatcgattctgattgatagaaggcacaaataatatcaggaatggaaaagggaacattgctgctgatactttagacattaagacagtaaaagaggatatgttgaataagttcatatcaataaacttgaaattattagatgaattggataaatttctagaaatgtacaacttactagtattgactcaagaattattttatcacactaaatgaaataaattcatactccaacatcttcccttaatttcagatagctttcccactcaggataatgaatattcaaagagcaaataattcctctgttacgaactcttccagataatgcagaaggagaaaaaacttcccaactcattttttgactccaaacctgacgtaatagtgcaagaacgaaagtacttcctacagacatacatgtatgaggaaagcttttggttgataatctctctcctcaggtgtgtttccttagtggcctcacctgttctctgaaagtagcactatcctatagcattgtttttgacatttccagagcaccctactcaagccatatttagaactgcttttgaagagatctttaagaatcccataatgcgaactttggtgcttttttgtcactttcatccctaactgctttagttttttaggtgaaattttctgtataataaactgccatacctcaaagaacacctggaagcaacaaagtatttgcttttctaatccatggtgatttttttcagtatctggaagtaatcggcagacatgtgtttttcatgccacagcagctcactttttcagtctagttgcccattcaaagctggtgtaaatcacagtaatgctctaaaccaaaagaaggtgcaaactatttttataatgcattcttttagaactttgagggtatagttgacatctaagaaatgcactttattctgaacgaaagcattttggggaaagtaagtgctgattttactgagttttacgttccttgcagttaattttctcagttaattgcactggttccattacaaatttggtattgatattgagcccctttgtgaagctgagccattctaaagcaaccaacaagggtatgatgatttgtattttatattactgactttattataattttctaatgctttaaattttctgtcaactgtaataacgtcaatcatataaaaagtcatgattgtcttcaatttatttggaaaacctctgattttcaactcattttagttttctttttcagtttggaaatgaaaaaacaaagttgtgcctaatactttatgacttctagtctgtcttttatcattttattcacatgttgttttgttagatagcaggtaattagaaaaatttggttcaatgattatctcataattaagagaggagatttgataaatgtctgtcaaaaatgctaacctaatggaggctcatgcttattatctgggagggaagcagcctccagagataaaatgttacaagtgaaggagaaagataaggcagcaacacagagttcctataacccattgtctttatgtgctacacttactattttaatgcataaaactgaagagatattgtcccacatattctcccagggcaaactatataaaaaatttagtgacaacatatttgagagacaaactcaagtagaattatgaagtgctttctctttttctgtagtattttcacctggggaaagtaactaggaagagacaaacataaaatacatagataaagcttgaaaaaagggagaaaatgaatctaaataaaaggcagctgaaaaaaatgaatgcacattttatacataggtgaaataaagctcggaaaaaaaaagagaaaatgaatctaaatgaaaggcagctggaaaaaaaaatgaatgcacatcaaaatagtaagttccccaaaacgaccaggaaatgtttagaaaaacaattactcacaggcttgaaaacttgcaataatattctctttaaaaataagagcccagaaaagaaaaaggatcaaggagaaacataaataaacaaaatgaactaaaaagtaagcacgctcagctcaaagaaaaaaatagaggaaaaaatgtaaatattacacaaatgagcatcacataaaataaaaggaatgtaaacgttgttagggagaaagatgagtggaattaaggagtcccacaaacacaataaaaagagcaagcaaatgataatttaaaaattaagaaaaaggattttgaaaacatagacaatgatctgatgtgtccttaattggtgttcctgcagtaaagaacagatcaaagaaaaaaataattatttctaccctaatagaggaaaatttccttaaggtaaaaacttgaatctttagcagaagagtacactatatggggtagaataattatcagaaaaatatatcctggtaaaattatgaaacaaaaagaaccaaaaggagattttgaggtagcaaaagcaaaggatgagcaaaatgtaacacagatgagggtgggaaacatctcaggcattctcaaaataaaacactcaaggctagaaaaaaaggaaagaattggcttcacttaagaatttttgttctggctaagttgcttctcaagtatcaagtcaacaaagaggttttctcaaagttttaagaaatcagaaactataatacctgcatatttataggaatgcaatatttctttgtaaaattcactgaatgaaaaatcatggccaacttgaagataaaccataacttagaaatgaaagaatcaccttcagttaaaatgcctgatggtgaacattggatcaattcacacgtagaagattgaacaactctgaattgtttatacatggaataaaacctgacaatgtaaaaataattataacactaacaaaaatgggagtgggggggaggaaaggaagaaatggttattctcctacctgtcatattggcaaatccatagataacaacagaatttaaaatttaccatctaaacttaaattttaaaataatatatgagattaataaaatggctcatttctttaaccattttcataagctgttttattgccttaaaagtaggtgtcttttagggatgaggaaagttagacaacttcaaaataagagaacagtccccacaagaccactcccatttctgacacaatttcaggagtcccaaagaccactctcaggtttgataatttgctaaaaggactcacaaaactcagcttattacagctaaaggatctagattataatcagcccagggatgtcatatgtaaggcagaatccaggagggtaccaagggtgaagcttccagttatgctgtgttgtggagtcagaacagcattactttcctggaattgtataataatacgcacgaactggtgccaaatggggacgctcataggaggcttgatgtccagtctttctgggggcttggttgtgtaattcgggttgactgctcacatagcttacttccatctcctgccccttgggaggtcaagctgggtgatccaaagcccccggcctacctcacattgttcatgtgcctcagagaccccatttctaaatcatagtgttaccatctagttgcccaaaggttttagacaaaaaaatgtactactctattaagaatgacattccaaggacttagagatcacctcccagaagccaggacctcttttgggggcaaggttaaattctttactacacagggactgatgataactctgttcccgactctactactatttcacttcgtgactttgacaagttacttttctctcagttcagagtttcctcatgtattaatcaaggaaattaactttgcgttccttttccaactcataaatttacaaatctgaatctgcaaagatacgtgggtgtggataaaatctcccagggccaatgcatagagccacataggtgtgtgtgcattgcacagttctgctatgaatgggaccccatgttttgaatgggaccccctgcagctgtgctccagacatgtacacatatacacatacataaacatgtacatttgggagattttaatgtgtggcatctattttttaaatttgtattataatgcagccatttttgtaatatcatgaggacctcttgaaggcaggaaggagaatggaaatatttccagttgagcattaatcctctgctccagagtacttctagaaaatgctgtgatatatttaattgcgtttgaattataaaattattcaatttctgactatcaagtcccctttttctgataacagacacagtaaacagtaatttgctgtggaatgaatctcacccacacacagttgcccaattaatctaaaagaaataacactaaagctgacatcacaagtcactgggcaaattttccaaaaaacaaagcatgttaaaacaggagagaaaagaataagtaatgaacagggctctgtttttgtttggccaagatgataaaggcagtcccggaacttctggactctttctttctactagccattaggcaagtggccaatatcctgttatcccaattacagacaaagaccaacaagatgcaagttcgtattttaataaacagtctttatatctagaataacaatatatttgctttgctgcctctttcattggctctaatcctaaaataggataatattaatttctacatcataggatgttttgatgattacattaaatagaactcttaaacacttagcacagtgtccagcatatagttggtgcccaatcaatattaattgctctcatttatattttaattcaaataatgagttgtgattcaagttacatgcttattttcctaatgctaagaaccagaggtatttgtatttaatctttgatgataaataatactattgcatctatctcaatcatcttatcttttcccacttatttgttctatatttgttcatttctcttctcctgctttccccccattcatctttccttattattattttatctcacttcattttattacattcatgttagtttaccattttctaactgagcttgtttgattgctgagtagaacctcaattttcttacagaataaaaatgaggagggttgggcgaagtggctcacacctgtaagcccagctgcatggagggataaggtggtaggattgcttgagcctgggaggcagaggttgcagtgaaacaagttctcatcactgcactgtagcctgggtgacagagtgagacactgtctcaaaaacaaacaaaacaaaataggaggaggttggactaaaccagtctgcagttctcttccagggtgagaatttaggggacaaatgagcctgcatgatgtgataatatggacatgataggagcagagtagctgaagggatgagaggagacatccaatttttggttcttgatgcgatgggagttttctaataaatttatcatctcacaccaaaagagtgtggagaagcactgaatgttagtttaggagcgttacagtgaaaggctcaggggaaaggcttaggggaaaaggacaaagtggctgtcaagtaaacatactttttaggcatttgatgtgttttgacttttttttttagatactgtgaggaaaaaataacacaatttttgaattaatatgcttccattttagttctattaaaacttttcatttcaagggctattttaaataaatggctgcagaaaatggtccttttgcctgcagttaacagagtatataattgaatgcctggattgtttcagtatcttgattaaaattagtagtgttttgctaagtaaagtgtaccacaaaagaaatgaaagtaaatgccagtaaatgactgctgtttactaatacctttagttttgatttttaaatatttatttaatttgtcttcagtaaaagttgttttaataactccatattccaattatttatttcaattagcatagtctactacagtagactaaattgcttgtacaagtaactaaatgcacaagtaactaaatgcttgtttctatttgtttgatttttttttttgcagcttctttccacttttgacttaataaagtatgactttcagaaagatgaacccatgagaaatgagcagggttggtgtattcatgtgaaaaaaggtaagacttctatttgaagacatctcctcaagcaaagtttctgatctcctgtatacagacatcccttggtatccttgggggattggttccaggaccccgggtagacaccaaaattcatggatgtttgctccttatataaaatgatacagtatttgcctatgaggtgtgcacatcctcctgtatactttaaacaggttgcttataatacataatacaatgtaaatgctacataaatagggtcgtatggtattttttatttatattttttattgttttattattattttatcttttttaccaaatattttctatccaaggttggttgaatccacagatgtgaaaccatggatatggagggcccactgtgattattagtgaatttaaaaaggagaggatgactaggtccactgtataatttaactttggaattttaatgcaggtggaacaattttactattaaatgttaagagccctagagggatcactcagatggtaaattattaaaatacaaaagtggtaactatttggctcatactattcttaatccaccacttgtagtatgaacagtggcaaatttctaatgtcctatattgccaaactataatatagaaattagtgaattaatttatcactctagatataatgtaaagtcaggccaacttggatttaaacgtggtctctgacacttagaaatggtgcaactttagacagattactcaacctaagtcttattttcttcatatgtaaagtagaagtgacaatgtttattaagtgaggttattgtggacgattaaatgggatgtatatatattcctgggggacctggtatgtggcttgttactttcctctcctcagcttctccctctcactcccctcccttctctaccaaggtagactttcttacaattttaggttagaaattttcatgaaagcaagtacttcaattaacttgctgctgcatataatcaaattagaaaataaaatatagagatgtgcacttagaattgtttagagatccagtatggataaatcaagccaaaattaatttgtattgccttaaaatatgttgaaactgcatttcagaagtggcttcctaaatcttttcttcaaatgtgaagataaggtgacaaacctgtttttattttctggtagctgaaagactaaaataaaaaatgcaaactttgtctattaaaaaacaaatctcccaaatctctgaatttcaagcctactggcatttatcaaatatgtttctccaattctaatctgtagacactgcccatgggaaaataatttctgagcagagtgcaaagaacttaagtgcacttttctactgttctatttcttacaattatagtaatatctgatgttaaaacttgaatcccagaactgtgcttatgtaacctcagggtttcttaaaaagctggttgaccccaaatatctgtttttctattttggaattctcattatgagctactcaatattttttccattaaggcattgtgtcttcacaatgtaaattatgcccagacaggaaagatatgaatacactgtgacctatttaaacatttgcaacaattagtttgtcagaaaagaaactgtcacctgtgtcctaaaaaagaaaaaaaaacgtaagttttaagggagatataagagtcttgaaaaattctgaaatacagggaatgtagactgacagaatatatcacagaggtaaggctttggagtcagatgtacctggatatatatatatatatactccgactcctgcatttgacagctgtatgacattgggcaaattcctttttttacgcctcagttttttcaccttaaaatgaagatattatctgggcctttcttataggtttgtgatgagaattaaatggattacatatgtaaaacactcagaatcatgactattatgcaaaaagtgctcaataggtataattgtgatgataatgatggtgatgatgatgatatgatggtgttggtgatatgatgatatgatggtgatgatatgatgatgatgatgatgatgatgctatcagactgctggggcagagaagatttgctttggccagtgacctatgtgcccttgaaagccagaatgcccaggagtgggagaaatgggagtcgagtaaagactgttggctgggtgcggtggctcacgccagtaatcccaacacttttggaggctgaggtgggaggatggcttaagcccaagagttctagatcagctgggcaacctggtgagacctcgtgtctacaaaaaaattacaaaattagctgggcctagtggcatgcatctgcagcccagctacttgggaagttgaggtgggaggatcggttgagtctgggaagtcaaggctgtggtggaccatgatcatgccacttcactccagcctgggtcacagagtgagagttattttttttaagagcattaaaaagacagaaatcactctgtatcatagtttgctggactccaacttcatctagccgcatgaacactgcatcactttacagcaggcatagcaagtggacaatagccttgaagacttccagagcagtgattgctgctgtcctttgtcctctcgtcttctcttagaagtagcttttaccttgcagattgctgagaaaaaccttaattaatttgaataagtttgattggaaaattatttcagataatgtgtctaaacataactgaaactaataagtatcatagaataggaaaccttttcaatgtctcatctctttcccatcaaaaatttccagaatagcatcccagaggaataaactgttttattataataacatgtgtgttggatcagagatagtattatacagaaaccttgccacacaaagtcataaaaacttgaatttgagttataggtccatttatttctctgagcgtggcaactattttacccctctcggtcctagttccttgctggtgaaatagggattatatcaaaggatttctatgcagaataagcaaagtggcatttgcaaagggctcatggtaaatgcccaataaaaaatgctatcattattttattaacactatcactacatttgttatttatataacaaatgtcaatattatctgtggtaacatctacataatccaaaacaaaaatagccgttggtctatccacctgggaagtataagaaatctaatgaggcttttctttccattcaattccctttttattagtttttccaaagtaatttgtatttgtggtaatctatgaaaggatgtgctggatataggcaccaagggtaaatgatgtcaaatacagaaataggttcagaggaagctgagataagcagcattggttgtgctggccagatataatatagatacattcatggtgtgtgtaacaatagttttaatcagatggctgcaaaaatgtcgttctttcttgcaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcaggtatgaaatgttatgggatccatagcttgttctgtaattgtgaaccatgcttctatagaaacatcagagaccacatatgctttagctttcagggcagacagagcccttttatctccatgtctcctcattaaaacatttattggccatctgtttctagactgaaccacaagttaaattttgatgtaaagttttatgattattttagtgaatcagtttagaacaaatcagtgagctcctttttaaggaaataaaactggcagacagatgtaaaatataaatggtagggttaaaacagaaagccagtttggtcaactgtagtctaattcttggcctaatgataaaaattttgaagcagcaaaaatcccctttctcacatttccttttttaattccctaagattattttaggcctatgaaattattttgctttactagtccaatgacttgaatgaataagtaacttcctacatccttgccttcttgtaccatgttataagctcactttatataaaattatttcaattaaaacaaaatattcattcaaaagcattaaaggagtcaaagggggttaacacctagaaatttaagtgggtcagagtcaaaggggttaacacctagaaactgaagtgggtcagtgtcctaaaagacaactagagctttgctttcaattcttaacaccagagaaaaggaatgtttcacacttcattgttattttacaaaataatatttttgtaatgataatccttgtagttattttatttttatgtatattataaaacatagaaggtaatttatacaatgagatataaagtaattttgactaaaagaccaatgctgattttgttgaaataccaacaaagtgctttcttagaaatgcctttcatcttgaaaactacaattatgttggtcagtaggtgcttgcacagtgccaaatgcaagacattaaaactaaaactgggtacctagtttttcaaatacaggtgcactaactggaatttgatttttttcatttagatggaaaggagaaaatgtcgcaaccactgaggttgctgatgttattggaatgttggatttcatacaggaagcaaacgtctatggtgtggctatatcaggtataaatatatttcagattttggaaagattcttagaatagaattgccactattctctagttttgcaacagtcttgctaattcaacattttaatttttgtgtattaagataaagattttattattgtcttggcaagtaatgccccttgaccaagctaacaaagttcatgatcacatcaggggaaaggtaccaactgaattttaatgcctgcgtgtatttttttttttttttagcaaagcttgaaaactctgatcaatgtctcactgcttggaattagttacagctttttattagtctattatttttctttttatgactggtgtttgtacataccactaaacaagaacatgttctattttaaatgtttaaaaatactgacttttagttaagatggctctttataaaaattatttttaaatttggactcattatccttatagttatgcatatgaggattgtctcatgatgttgaaaatgccacagaaaagtgaccaatttgaagtcataagacagccattctccattttttctgcaaatgcttttaggtgcaggagagatcagggatgtgagtgtgtggataggagagcagaagaagggaatgattacttaataaatagccactgagtgttgaagaaagattccaggacattctgacccctgtaaagatccacaggtggcatgataagcattaaatgatttttggaatcaattatggaaatacgagtttctagtttcttaacttaaaaaataagcccttcatattttacattaaagcttaggatatgtatttctgctggaatatagttgcctttaaataaatgttttctttcttaatatttgttttagtgatggtaggatgcaaattcattgtaatttatagtgtttcccattccatgtatttcatttctgtagtataggcaattagagatagactctggccttccctgtccttaaatgatttctagggggtaaatcatatgttcagggaaggatacagactagtttatgctcctgttgtcttattattactgaaatagatttaatgtctccatgtgtgccaattagcatgtacagaattatcttttaaagtttatttggtacttaaaaatgactctatttcaaactttttttcaggttatgaaggaagagcaggaatggcttctattattttaaaaccaaatacatctttagatttggaaaaagtttatgaacaagttgtaacatttctaccagcttatgcttgtccacgatttttaagaattcaggtaattttagtggcggagtttactatcaaatataagacagtaaacaaggaagtagtttaattgcaaaataatattgtatcctttagataacatgtgagttatgtgagaggcgtggcgtgtagagttgatgcagatcgatgccatgtttgaagcctaattataaagggggcatggtgaaatgctaggacgtacctgtctttgtcctaattatagaattgctctcttcctcttcagtcaggacctcagagcaaaatgatggtcccagtgacggtggcaatccaaaaccacatcttacttttatcttgcgaagacatttggtgctatgtgcctagaattgggttccattaaggagacatcaaagagatggcaagatgtgtgcagaacctaaaggcatctggctttaggcaatcctgctttttaatttttattgctgttctgtccaaattccccctcacctggaccttccccatgtgagaaattctgagtttatttattttgagatgaggactttctcttgttagcttactggtataagtacagtaaaaagaaaacaaatttccttaactactgggtaactttacttactcatttattcaaccattcatgtatttaatattttgcctcaaatataatttcccaaaattattactcatcatctcttaacatccaaccacacagatttttttttctgaatacatttgttatttcactaatagactcctagaggagcaataacctgtgtcatattcaggtttcagtatttgccaagcaatcattgcagccaagtcactgcttattcaatgggacacatcctctgaactatcataatacctatttcatctctctttttgattttgagtttttacattgtctcagattattttaacaacaaccctctgaaacactaaaggtaagtaaatatgaaaaaagaagtaatatatttttattgaaattttattgagatagttgtagattgacacgcacttataagaaataataagagagaacttgtatatccttcaccttgtttcccccaaggataacattttgcagatctgttacaaccaggatgttaacataatctacccatcttattaaaaattctgctttacttacacttatatgtgtgcgtatattttctatacagttttatcacctgtgcaacttcatgcattcatgaccatagtaaagatatgaataatttcaaaatctttcccccatgttgtccttttacaaccatagcgagctccctcttgtccctcctcatcctcacccaaccccataagtaatatattttgatggagtagaaagttgacaggacaaataatattttaagagtttttttccaaggcaacataaaattcactttcattaaatagaaaaaatgttttagctcaagactactttagaagattagatcagccttgcacaaatttagaaagtattttaggatccttaagcacctaaaaagaacatggaccatgactgttatgtttattagagtattcactatagttagaaataaagcctgacagcagtcaaatatttgtttaataaatgaatgttagtaataaatgatctcataaaagaaatgcaaaagtaaaagttacttctgacaaaatgagtcaaacaagtattgtattacaaatctatttagcacaaattaaaaaatggaagaagcctttttgccaataattcacaaaaatataatattcagtgtggctgggataaaacgaacttggtcctttcattctgctcatggaaccataaattgttataacctctctagaaaacaatttggtaatatatgatcagactcttaacagtttgcatatattttgacttagtcaaaatgcatcttaggaagtaatcaaagatgtataaagattttaatattctaaaacacattttttatttctagtgttaaaaattttgatattctctaaaagttcatgaataagggcaaagttaattaaaatatgataattaaatgagaccttataaaacaattttctaagttcaattttgaagaaaattacaggacccaggaaaatatactttgtataatattaagcttaaaaatggcagaacactaaattgtataaatacagtgagctgctaatttttaagaaaagagtaaaaggatatgtttgcttgcacagccatatctggctgtgatgacagtgttggatcaggggagatggaggagggaagggagatcagggaagggggttcaaagtgaagttgactcaaatagtccaaaaggataaataaaaatggccaagctactcatagaatgttgtagggtctctacatgtcatctcacttaaacagactgtttatccatgcctgaaattcccacaaagggatacactcttatctcctttaaacaccttgaaacagagattcttaaactttctagactcatggcatctttaatgtctcatagcactcttgggtcaaaacaaatacctaaacatttgtttattcactagttaaggaaaaacagattggtaagtatttaggtctaacaaatgagtagccacctgaaaaataatccatataaataagtaaatgctttcatttcattttcaaataaccacaatcagtcactaaggagatgtaagttgggccacagttcttcagaccttggaattagattggactggacagggagagcctgatttcatgttccatgatgatttttggctgtacttgctttttatcccagcaactaccaaaaacccaattttgcaaagataatgacatcattgaatgtattacaaattactattgaaactgtgaaccttgagctagtagtttgtgactggtgactaacagatgtcactgagtttctcttgaaaacaagatatcctgtgaggaccttggaaattcactgaggtacctcaagttttagaccattcaagtaacccctctgggtatatttaagccatgttttagaacattctgcaccccgtctggctcttatagtattctgctttttatgatagatttgtgtgtacctgtagtagaaattgctgtcttttgtggcttttatctccttagcatcttatggcattctctatacataatgttatattggcattgaattgaagagataacctatgtattttagacataattataatcagtttattatgttcataattcttatatattgaatgagtttatatttaagtaaagtttacaggtaaatcaaactaaagattttaatattctaaaatacattttttatttctagtgttaaattattagaaaatacagagatcactagatataaagtgtcataatttaatattacagtctatagtattaactatatatgtatatattatagttattaaatgattctactcatcctggtaattgctttacaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttactgaaatatttta
